United States Patent 9,487,797 (GENOMIC PLANT SEQUENCES AND USES THEREOF) - sequence listing, part 79

SEQ ID NO: 77279 - DNA, 26197 bp, Oryza sativa
  unsure (1)..(26197): unsure at all n locations
ggtaccaaaagaatttttacgccaatttctggtttatgatagggttaatatttccaacgcaaaatcattgatacgagaggcatataattgggatcccccatagctttttctatacaatatggtggagaggtgatgcaatctttgtttgaccttagggcatgtataacagcttcacgataatagcacctaagaaaatattgtttcagcggactcctctggacaaggcccactgtgtatatttataaagtaccaaaatacctgggattcaaaatttggccttcatatgtagcaagttcacccggatctcaaagataaaatcaactcgtcacatgcctgtgcagaatccttccgtcatcgctacaaagaacgttatgatcatagtggcagcagccgccgccaccactctatgtccgcccgcttgccgccgacccacgagagatagagagtaagagtgagagagagagagagtgagagagaggagagagagaagagagagagaaagagtgagagagagaggaagagtagaagaggagtacgatagacggatcctacatttttttaataaatagaatgctgactggactgtcacgcgtacatcatgtaggacaaaaccattctggattgggtcgaggggataatttgtctggtattaaaagtttagggtgaacgatgtctagttttcaggttcagtgggctaatacggtctaccgcgatagttcgttggggggggggggaggggggtaattcgtacttttttctatcaaatatgcacatgacctttgttttattttactttatgatcctgcaaaaaaaaggaaaagatatacaaaatgttaaccttcattgtttcgtggttggagtataagggatacaaggtttcaaattatggattttgtctcacttaaccgcccttcatttaatttttactcagtcctaccctcaaccatcttctcattctccagattaggtgcatcatagtcttttatgcatatgtataccgacggagaatctgccatcccacctattcctgttgcaattcttacatattaccctttaaacttttttctattatagttaaatataaaagaatagccacatataaaactaatgtggatatccacattttcctataggaaaaatgtgggtaacatatttcatggtaaatatgatttatttattttagaaaatactgtggtattttttcctttatccatagcaaatcatgggcatttagccagtcgcataagaaattaaaggtaggttatatacttccttcttaatctcttaaagaaatttggactggtggtcttaaaagaaagaaattctcacattcataaaaaaaatgttaggagctcccatattatatatagtaataaaaaaagagaaaaatcatggctgttaattttcttcaaggaaaagttcatttacctttatgcctttcaccaagttcaaactggtttcggacaacctttttagtattatctattaattaatggcgatgagataataaatacaaactagaaatattggttagtttcttgaatcctagatggaaactgattcgtgatgtacatacatgccaacttctttacgtggcatatagactcctattgtatttttgatatagggactgtgtaaccatcgtttgcaagtttttagcccctaaaacacgcgatcgattttgtacccattggattgaaaagcgatgggccaaatctttccttgcaaaccctattaaatagatcaactaccctcagccttccttgcaaaccctattaaatagatcaactaccctcagcctccaagcctccaataccctttcttgcacattgtacgccgccaccatcctacctaggtgggctgcaagccttctgtcttgttggcttcatcccgccgccatcccccccacccccacaaatacatcaccactctgctccggatccactactgcgtccactccggcgagtgcccctgccccgccccgccctgtgcttctttcccctttccgatggctccttttcactagatctgcatatgccgccctcttcctccgaacttcttattccttcggcccactactgagccgcctcaaccactggtgacttcccctaagtctagagaactccccattttatgattcctccaaaacaacctttcctacccctatctcgaaccctaattcgttgcccttaattctatcaccacgggcgttattgcctgaagtggagaagaaggggtgaaagagtggatcaagatccgttgctgccgcgagtggagaagggatgaaagagtggatcttgtcataagttaggaggtaaggaaaattcacatgttgtaacctccaaaaatcatgtgcatgttgtttagcatgtctattttggtatggtataaaatgcaaacttaatatccaggggcaaaaagactgggctggggcttcaggttcaggttggctaaatttcctactgtttttttcttttggccttctctcctctaaacctaaaaaaagttgatgttgcggagttatttttttctcggtagttcacgagtcatatgattatagtagcaagtacaatacaagtgagaataagtataaaaaagggaatgtgtgatggatgtctagcttgagaataaaagtgaggagagagagagggtgagtgagctgctaagggcatgttcaacaattaaacctggcacatgccctaagtaacatgttatatatgttgtgactaatcctctgcatcagataacataggctttaaatattaaaccaccaaaaaaaatattttaccctttgtcccttccaacaactagttgcagcaaggtaaatttatatcttgtgacaagagtcgatgataagctaagggtttgactctcttccccttctctcccttccacattcacaaaaatgtctataaagcagatttatggtatacatgtcatgaatagtcggtggttgcacatgagttctaagaaaatgagacccatcattagaacatgtttagttatagtggtcattgatacctctaattttatccacatcacatatatgcttactaatagaatataccatctttattcacaaatactggatattcgtatttgtgcagtgtataactagaatcacttgtattcgtataggagtaccattaacaacacactactagtattctttcgctctggatcgatggttatctttctttatcccttgaagtttgtgtaggttctctcttagataaggggcacctcctttttcttctcccttctaaaatgtacatgatagagcatgcaccatatgtttaaaaatctattgctaccttcatctgaaaaaatataagatgcaacctctgtctaatttgtaaaactaggatatgtgtctaatccggtcagacggtgctatattttaggatggaacgagtagcaaaaaatatatttctgtctattatatacatcaggtgcaatgtaccacacataaagattttttacgtgtaaatggctaacccatatttaacttataagtggatttgtgggttagccacatacacccttaggttttgtatataatggaagctttattgaactcaagagtcttagtacactcgcggcctctgcaccacgaaagtgcacacaaccaacaaccctacacacaactaagggaacacaagattgatcaaaagtcatctatctgaatactagaacaccactcatatgccgggggtaaaaaactccgtggccacctgctccaaccgaagacaagccgcaacagtaaagtccttcaaaataggcttatgaagtataagccaagcacagagctatcgtgtaattaagaagataacctgcagttagtagagattaaggttaaggagaaggactctagtgtacttaaaaaaatagaatgatagataattgacaggacaaacagtagttatagtaatatagacattatttttggataaatttaaaacacttggaataattatagctcaattggtttgcatttttgcttatcagctgcagtcaaaatttgaatttaaaaacttaattttggatttgattctgatattttttttattttctagcatgtacataaaagtgaaattatttcttatcgttaataaatgttacggcttataatcagctataggcgaaacaatgacaatgcctatacttgtgaagagagggatatatagcaatttgtaatttacatcgttgaactgactctagttgctatcgtcatgagaacaggaatcgtcaaactgccccactactaccgatctcggcaatatgaactccatggcggcggaggaacaagacacgaagcctttcttgtccccgaccaccaccaccaccatcccgccgcgagcccaccgtggataccagcttagcgcttgcccccaccaccaccaccaccaccagatgacggcggcggcaccggaccagcgcagtgcaggcgcaggagcggcggcagcagcagccgggcagcagcagacggcggcggctgcctgcgtcctgaaccgagaatccgatgaactgccggaggaagaagacggcggcgccgccacgtggttattggctcgtcaggcgcccgcacggaggatcagcaggagcttctggagcgccggcgagtacgatgcggacaccagcggcgcggcgcggccgcctggaagtacgtgtgtatacaccgcgatgcggatgaattttaatcgcctttaaattcttatattctcatcctgtgctcctctcgatctcgtggcagatgtgcagaatcgcatgtgcgtccacccaaaattcctccactccaacgcgacttcccacaaatggccattcggaggtaagcgattatttttcgctataaacgtgtaagtggttaatccacgaaccaatttatacttcaaatatgtggagcaattttacggtcattgaggaggtactatgaggcaccaaaatttagtgtaaaatttggtaccttatagtacctaggtaccaagaggtattaaatttacaatagaaaacgtgataagttatagtacatccttaaggactgtaaaattactcaaatatgtgggtaccacttatttaaacttctataaatgggaaatccacttatctgaagtgtaagtggatagtacacttactattggtaaatactttgtatctatccctaaactgaaatatcagacgattgtttctgtctttatatgtttttgatattcttgcagcggtggcggagttattggacaatgctgtcgacgaggtgattcaaacagcttattaattatgcatttcaataatttgatgatttggggatatatatctgattgattttttttgacagatcaaaactggtgcaacaagaattatagtggacaaagttaacggttgtaatggatcaccagctttactcgttcaaggttctggttactgtgacaatgttatattcgtttacttgattttgtataggtgcaaattttgacagtaataacagatggtctgaaatttcagtaatgcaacaaatgtctaatggcttggtcaactgaaattgcatccagacaatggacataagtaaaaaaaaaatgccaatatcaatattctctttaccttctctgatggacttagtgtaactacagaatttgcataatgttgcactgggaatctctttctgattgacttagtgtgaactagagtgtctgcttaacgttgagtatttgcttaatgtcaccacatgaaactaaatggctgtacatttttctgtttgtcatacagatgatggtggaggcatggatcctgattccttgaggcgttgcatgagctttggattctctgaaaaacagtcaggctcttcgattggacaatgtatgtactactatatcatatattcaggtttttatcctctccaaacttaacttatattgttatcttgtatattgacattcgttgatctgaccagatggaaatgggttcaagactggcacaatgcggctaggggcagatgtaattgttttcagtcgctgcatgaagagcaggtctagctagtctcatttccctatatattttttttttacttataccaacttgttgccctttccccccttactttcttacactttcttgtttttttttattccagcgagcctacacaatccattggtcttctctcttacactttcttggccgagaccaatcaaaaggatgttgttgttccagtggtatgctttgccatctgattttatcaattgggcacaacacacacacaaatatatatatagcgcttagccatcacttacctcttttactgtgattattctgatgacattttttttatttcattaggtggactacaaatacaatctattgacaggagaagctaaaccacaccagcggcttggtccagatcagttttcgtcaaatctctctgttctgttgaaatggtccccttttgcaactgaagaacaactgatacaaaatgtatgttacattaggtttctaccatgaaagaagacatttatattactataaactcgcaaattaattttcaaaaattttggagcttggaatggaactatttgtctgttatttctttcagtagttgtaagtaatttatcgtcaattcagtgtgctaatggtgtttaaaatgtggttacagttcagtgacattggtccacatggaacaaagattgtagtcttcaatttgtggtcaaatgacaatggtgatctggagcttgattttgatatcgatgagaaggtaagcaaaacatctaaaaggatttgacttcagtaaacttttaaattgtaaaatacatgcgtaattctgaagtttctttcacttctgttgaattactaaatagctcctgatctcttggacaatctttatcatttttcagttgctatgaaatgtctcattattttccatgtgtctttcattatatattgtatatgtttaccatattccttgttgttttcatttcaggatattttgatcagtggtgctccaaaggcagcagaaacaactaatgctgcaaaaagaatgaacgaaagtcatctggcaaatcagttacactattcttttagggtgcgtatcacatggtaagtgtttctgcacaatactagttaattgattttgctaatatatattagcattttgcaggtctatgcttctgtcctatatttgaaactacctgcatactttaggatcatactccgaggagaagaagttaagcatcactacattgcatctgatctcagatatacccaatgcattagatataggccgcaggcctttggaaaaaaggaggttcgtcttcaacaaaaccattcccttttgctgagttgcatacacattacctgttcacttctgtaacagtgtgaacatgtaatgtctaatacattccttttttcgaacgaatatgtctaatacatttccattctcaaagtattgatatttacttctgtgttgtttaaatcgtttcccttttacatccattttcttcttcaatttaggacgaggtggatacaaccataggatttctagatggtgctccaaacatcaacctgcacggatttagtatctaccacaagaatcgccttatattggtgagctactgatttcttttgcattcactatgtaaaaaaaaaaagaagaagagaagatgctttacgggcataaacatcaaaactaatcaattttcactcaaccacattcaagctatttttgcctaacatttttttatcttgtttaaaacaaaatgacctctttcagccttttcaccgagttttgagtagtgcaagtagcaaaggcagaggtgttgcaggggtattagaggcagacttcatcaagcccacccatgataaacaagactttgagaagtcacagctctaccagaagctaataaaccgcttgaaagaaatgacgaacgagtactggtacaactgctaaatcccatcttgtttcatgtaaatccaatacctgtttctaataattcaataattcatatctcatcattcaactatttcacctgtttccagggatctatacagtcatctggttggataccataagttgccccgtgcagcttctggctctcatgcttctgctgcacttgtgccaactctgtcaggcaccattgctactgcatcgtcagagaggattccagccatccgtgacaatccaacaaatgcaattccaatcgcctttgctccccatcttgtctcttcacctgtaggaacaaatgctgttgctgcagtttgctcccagtcccagtcaagtatgcagatcacaattggcactgatttagtagatacaagaaaaagaagaatggaaactcttgatcagatggatggtcgatcgaaaaggctgagtatacatgatttggcaggaaacaactctgtggactcgagcaatcaggttagcctagattactatgtttgtgcccataatattgaaaatacacattttttttaagaaaacagacaggagaactacccattatattaataaagtaatagtaaaaaaacttatcacaacacctgaacaccaaaaatatatgattgcaacctacactaacaaattacttggcacttaatgtttatccagctagactaattttcgattagattttcacatcttttttatctgacagtagtttatgcgctgtattgagatctaatgactacagatactacagatatgccagcatatgggagaacgggagttgaaggaattttcctacttgaagatagagaatacactactccgtcaagagtaagtccaacaacagctctcgccttacttccatcatggaacaatttttggcctaaaagtctcaggacttcattttgtttttttgtttcacaatttcatatgcaggtgtgcggaattagagtcatcagagaaggaactcttgctcaaggtgacattttttatgttgtgatttgttcaatcttactcactagtacactacaccaggtgcatcttggctaaaatcaaactgcactgacgaacttaattatttgttgtaccgagcaggaacaacaattgagccttgaacttgagcagacggaggcacagtacaagagcctgttgaacgaatacatatcggtggctgcagttaggacagtgaaacgatagacatccttggctctcttgccatctgtaaagacagatgtttgcaacattgcaaatggcttgatatctcagtaagcagatgaacacatccggcttctgcaccgaaacagcatggagttggcgaaaacagaccggatatggtaacagggtaacagagaagcacaggggctacacccagtaatgtgactggtgatcacttgtatcatccggtcagcaagcaaagctactagatgattggcctcttgtttcatcatctatgttttgatcatctgtactctgtaaaaatagtttcttgatcagtagtggtgatggcgtgaagctgaaagatagatagattgcattttaggaattttaagattctcacaggaatagctaagaagtgatctttgccggttcatgcaaaaaccacattaatcccggttcgaataggaaccggtcctggttcaaaagcccaggggtacttgttgatctatcgggactaaagataatttttagtcctgattcaatagttgtcaggccccaacaaactttagtcccgaatcatatctttaatcccgcttggtgagcaccaaccgggaaaatatcactctcccatgtcattggcatctctcgctctctctcttccttatctcgtctgcatcgctgctgcgcgcatgccgtcttaattcactcgtcctccttatcttctcctccactcctccctctacatcggcgtgcagcaggcgatggcgccctcccttccgtcgaaggggaggtgacaggcggcggcccacggctcgccaagccaccgagggctctcctcctccactcctccctntacgtcaaatagagggagatgattgtgaaagtaggtgaaaaattaaattagagatgattgtgattggtcaatatgagtaacaggggaagaaatatcaaagaaagtttgtaaaacctcttagcagtgaatttgtcagaattccacttatccccttctccatcctgtaggttaataagggaaatgtcctcctccaactccagatactcttcctaggccaaactgctcaaaggcagtagaaaacagtcatacctagttttttcttcttgttttatttataggggttccattatagctattccttctagtgaaacttctttaagtttcaccatccaaactaagtggatcttttgcatctgatccaaattgtctcaatcatctagtcaaatagaagtgccacatggatgcaccaaattggattcaagatgccactattgtgacagactgcatgttcatttaaaattaaatcaattatttcttcttttttttgcggggaaatcaattatttcttcatgctcaatatgcgtggtaaatacccaaatttaatacttcccttcaatcctatcctagtagtggggttgtgtgcccatggagtttgtattcacaggcacccaataacatattcgagcaggaatgcaagttacgccttgaaattgagcatgcggaggaacagtacaagaacctaaacgagagtacatatttttctaagaggacactgatcgaaatgaaaggcattctacttccacggatcttttgcatctgcaaagacatacctccgcaacctcttagatgatagagattttagtaagcagatgaaaatatccggcttatgcgccaaaacatgcgctcgtgacaagggagcagattatagcacagggactgccatagtaatatgcttggtgatcacttggctccttctgccaggaagcaagctacaagacccttctctgcttgtttgtttcatcacctatgtgttttatcttatgtttactacactactgcaaaatatagatcaaagaattgtgatatgtttagggagccagtttttgtgagatctgagactcacatctctgatatctgcaagtggtatgcttgcaacatttcatatgatgcatattcattaagcaacttaaagaatatatccagtttttgcgccaacacatgcactcagctaaaatcacgaaaataaggtaacatgatagcacatggactgtattagaaatatgattgcaacatggcaaggaacagagtttatatatttacactagtaatggtgaaggttggtgaccacttagctctgtgatcagcaagcaagccacgagatctacgggttggtatttcatccacacaatttttgtagttgtacgagcgcattgtataaagagttgtttcatgcttaatgtaaaaaagaagtttcatcatgagtaccggtgattgcttgaaattgaaagatagattatgtttggggaatttttcagattctcgcagggacccattgataaggtttttatattcaccaggcacgactgtttttttcttaaatgttagtctcttcttgtacaccttgattattccaagatttttgcaacacctatattttttatgattggcttctgggggttgacaagaaaaagagtaaactgatacttattggagcctctgccttatgttgggctctatggctgagcaggaatgatagggtttttgataaatcaccatctgcttcctatatgcaggtaattttcagggcaacatattgggttcggcagtgggcacaattacaaaagtgtgatgaagatggagagtttctgattgtttgcatgtcgtaggcttgaaacgacggttatgtaacttttttctaattatggatagagattcaccaataggctggaataatgttctccttgtcttgttcggttttcttctattttggtttggtgtgtttcgctttattttggactacactcttttaaagtgctagattgtaataattggctgtagttcttttgagcaaaggccgagatgtttcattctattatcttaaaaaaaaaagctaaacctcatcctctttgtcatgagtcaatcccatcgtctttgtcagtcccaataaaacggacagcctcccattgcttcatcaatggtgaacatgcgcggatgagatcctctggtcgccaccacctcgccttctcggtcccccctcatctgcctcttcacctttgtccctcttcatcaacttctaggatgatttcccacccaacatctcctcttctgggatcgggatcaggtgcagtccctatagagactgcaactttggcagtagccaatctgaaccgtttctgagagatcagacggctggctcacaccactgcaccaactagcgctcaaaaggtcgtcttcttcctccagcgatagagccctctttcttctccatgtcaatggaagtgctctgtgcttcttcttacctcatgacaacaagttgacaactacgggaccttcgtataaaccattattacgaaagtgttcaacctgtcaaagattccattttccgtgcttcatcatgaattcatgatcctcaaataagcctcccgcatcaatataaagtatcgttgtatatcttcttcctcctctgttcttgctacgttcttctgtgaactcccatatactaataagcaataatctgcacagtccctgtcaaacgccaaggcagtaattaacttgcgagcagaccaagccaacctcgcctcctcctcgttcgatacctagctaccagtccaaatcaccaccaaattaaccacgagcatcagatagctaacagtagctaagcagcgcaactcctagccttgagcccttctcacccgctgatacctcctccttgttggtgaccacgctccagtgccgcctccaccactccactcttgaagcccaccggagatggagaggactaaagggttgttaattcgtagacatcggatgcttcgtgcatggtcagatcaggtgctactgctaaagttgcagtaacaatagcacttttacctaatccgaatcccctcttctgcctatgttggctcacactgccgtcctgccctgccccctcctaagtcataaccacgtgggctcctaatgatgatgcccctgccgctagacccacactactgccattcttgatgtatggctgatgccacttcttgctgtcctaaatgtactatgtcaattgatttcaaccattaattagatttcagtcatactgtttagaaatggagctaatccatggatattcatcctgcattttcactaatatgttaagtagctaaacagaaaatcaacacacgaactcaggaactgatagatcaatggggattccaacgaattccaccgctgccgccgccgccgttcgtcgccaagttctattacttaatcgataatcaaaacagagattgcttcctccttataaatatatatctctctctccctctcccttacagaccagccaagggccaaacagcacacacacctactgagcccattccggcccactcatgcgtacattagctttacgaagtctttttcccctccctccagatgcttcctcctgcaccctgctaccattgccctgagcaccagcggcaggcaccttaacattcccccctccttgaaaactggcttgcccccaagccagagctctgggaagacgagtgcgaaggtcttcccaagtggcttcctaaacagcactgtcagaccactgaattaatacttgtggtatagcagaagtacctgatttgcgaactcgggtgtcgaggacagcaacaggaactttcttagtttccatttgagcaggaatcataggagaagaaacacctttgaagccttgggcagacttgagttgagagacatggaaaacaggatggacaacgcttccttccgataatgctaattgatatgccacttctcccaccttgcgcaatacctcataggggccaaagtatttaaaactcaacttgtgattagcccttgcagccacagaggattggacatatggctgtaacttgagatagacccagtctccaacagcaaaggatctgaaactacgtttcttatcagccggagtcttcatatattgctgagcctgatgcaaatgctgctggagcaattgcatcatcaacctcctttcagacaaccactgttgcacatcagggagttcacaagaattcacagagatacctagctggtttggagtatgaccatataacacttcaaaaggagtttgttcaagggtggaatgataagtagtattgtaccaatattcggccaaatataaccatgtagaccacttagaagggcaagaatgggtgaaacagcgcaaataagtttccagacattgattcaccctctctgtctgtccatctgtctgaggatggtatgctgtactcatgtgaagtttagtgctaacactctgaaataattgctcccaaaagttgcttgtaaagatcttatcgtgatcagagacaacagccaaaggtaacccatgtaatttgaagaccccttccatgtacaattgagctacatcggcagcagagaatggatgtgctaagggcagaaaatgagcatacctggacaacttgtccaccaccaccattatgcaattaaatctcctggactttggaagcccttcaatgaagtccatagtaaccgtttgccatgcaccagatggaacaagtaagggctgcagcaggccaggatacctgaacctgtctggcttagcttgctgacagatggaacactccttgaccttcagcttaatctgcttcttcatatcgggccaagcaaagagggtcttgatccttctataggtcacagggaagcctgaatgaccgccaatagagctgtcatgcaaagcactaaatattttgttctgaagggcagagttgtgtcccaaccaaattcttcctttgtaccttatgagaccatcttttaacttgtaaggagagtcttctagattttgtatagacaattgagccaacaacttagcggactttgcatcatnnnnnnnnnnnnnnnnnnnnnnnnnnnnncaggtgggtttacagattgaaatagccgcaacttccaatggttctccatgatcacaccgagacaacgcatcggcagccccattatgaattcctttcttgtaatagattttgaacttcaaacccaataactttgtataagccttttgttgccagctggtatgcaagcgctgatcagtcagattcattaaacttttatgatctgtgagtattaagaattcagcatactggagataggaccgccaatggtcaacagccaataagatggagagacactccttctcataggtggagagacctttggttcgaggacccaaagccttgctaacatacgcaataggatgcttatcctgtgataagactgctcctatcccagagtcacttgcatcagtttctataacaaaggttttgttgaagtcaggcagagccagaacaggggctgtggctaaggcgtgcttgagactctcaaaggaagtgtgtacctcaggggtccattgaaattcaactcccttcctcaacaaatttgtcaaaggcttactgagaacaccaaagtttttgacaaacttgcggtaatatcctgcgatgcccaaaaaacctctaagtttcttcaggttagtaggaacaacccacttcaaaatatcttgtatcttgctggcattagtggccactcctgccaccccaatagtatgcccaaggtaattgagttcctgttgtgcaaaggagcatttgctcagtttgactttccactgatgttcttgcagcaggtgtagtaccttcctgagatcttgcacatgggtgggtaaatcagggctatagattagtatgtcatcaaaaaagactagggcacactttcttaaaactgaagacaaggttgcattcatagctccctggaaggtggctggtgctcctgtcagtccaaaagacatcaccctatattcaaagtgcccaaaatgggtttggaatgcagttttgggttcctctccagccaccaaccgaatttgatgataccccgcccttaagtctagcttggaaaaataagcagagccagccaactcatccaataattcatcaattacaggcaagggttacttacttttgattgtgagcgcattgagctgcctataatcaatgcaaagccgccaagagccatctttcttcttcactaataatgctggggatgagaaggggctgatactaggctgtataactccagatttcagcatttcgtgaacttggtgttcaatttcattcttttgggttgggttgtatctgtatggacgaatattgactggcttagcacctggtattaaaggaatggagtggtcacaggatcttctaggagctaatccctgtggttcctcaaagacagatgtgaactcagacaacacttgttgcactggtttaggaatcgcaacaacagtaggactagtttcagtggtgatctgaaacatgtgcataagtgccccaactttgtacaagcctctgagttgtgccccagaaatcagccgacagttagccacatcagagtgcaccccttgaattctaatgagttgccccttgtcctggtactccaaccatttgtgcatccaatcaattttcataacccctaaacctgccaaccaatccattcctagtatagcatcatacccattcagaggtaacaatttgaagttagatttatagtatctgccttggagccaccaagagcagtcagggagctgtttgtcacactgtaagagtcctccatcaacaactctgaccttcactggtttggataactgtactaccccacgcaaatggccaatgagttgctcatctataaaagagtgagtgctgccggaatcaacaagcataagaagctcagttccctataccaagcccttaactcgaagagaatggttagaatcagttctattgcaagcatggagtgatatagttccattgcaagcatggagtgatatggtcattagtgtagtctcctcgggggaagaatcaggaactggaatcacaaagttctcttcttcctcagactggaaagcctccaataattcttccaccacatgcagttggacagactgggcacacttatggtccttactccatcgtttcccacaggtgaaacacaatcctttggatcttctataagatttcagagcagaaattttatcatcgcgagtattggttctgacagactcaggaaattttctttcctctccagggggaggttgcaggactcttgggaatgacattgacctgagctgttctagaaaaaactttgttgaaattagtaccctcagtcttcctataagtagttctcttactcccttccaagatttccttttgtaacaaggccacagaacatgcagcatccaagtccaccggcttctgtagcatcactactcccctgatttcgtctttcaatccatccacaaatttagttaagaagtaaaggggtgtgagagcattgtcataagagagcagctggtgcattaatccatcaaacctctccacatattcagccacactgctagtctgcccaacatgaaaccagtgccgtatcagcaattcctgcctatcccttgtgaacttacggcaaacccgatcacacaactccagccaagaaatccccactaactaatgccgcaccgattgtaaccagaaagaagcattgccagtgaaattcagcagagctaccttgacccagttagctggatgcaccccatagacattaaagaaaatctcacaattatctctccacatttgagggttctccccatcaaattgggggcaggacatgggaggaacattaccaccaatactaaccattcctgtctcaaaggcctgatagctagaattttctggagtaaagggactcaccgaattgaactgaggatttcgccacccatgaggagaaggggtaaacaggaacggatttggcgagttaccattgagatcttcctctgttgacgcttgatttggtcctttactgcttttccccttaaacagcatccgctgctgcacttcccgctagcacttctccaatcctgcctggattgagttcactttcttggccaagtcactcacagatccccccagctcactcaccttcttctccaccaagggtatgcgcgattctaccgccgccttcaacgactggagttcggccagattcagtgcatccgactcctcccgtctcctctccgtctcctccctcttcttctccgcatcctccatcattttcaacagcaaatcgagtttcccatcccgagccatgatttgagccgcttgtttggtggtatacctaggtcgctccaggatgaattcactggttccgccccgaacccagccaaccagatcaagggagccccgagagcttttgcggaatctcactgataaacagcgaattcccacctatcacatggaattttccggctggatcaagggattcaaggaaaccaggaagttctggagtggctctgataccaaattgttaagtagctaaacagaaaatcaacacacgaactcaggaactgatagatcaacggggattccaatgaattccaccgctgccgccgccaccgttcgccgccaagttctattacttaatcgataatcaaaacagagattgcttcctccttataaatatctctctctccctctcccttacagaccagccaagggccaaacatcacacacacacacacctactgagcccattccggcccactcatgcgtacattagctttacgaagtctttttcccctccctccagatgcttcctcctgcacactgctaccattgccctgagcaccagcggcaggcaccttaacataataatacaaggaatccaatttacatattcacactgttgtagtaaattagagtactgtttgtacaatacgttaccattgtgctaatgcaaacatcacaagattcaatactgtgcaaacagtatcccctgtatttactcagaaggccgaaattcatacgtcttagctactccttagtttgggaagcaggctgtgaaacaacctataaacgctctcacaagtcactctatttttatatctgaatttactattctgaacacataagtgtgaataatgttgttcattcaaatgattgatgtgctacaacgttaacagattggcttagtcagctcgagcttgtgatgcttgcagaccgaagtagatgatatgcagcagacagcaagcggtgcacgagacatcggttaatttgcctagctgatccggtgtcttttcttgtgctagcttatgcaagaaaactacacaaacagagagggattcaaagcacgcgacagtcgacgcagaacacaaccaagggaagtatctggaaatatgttgtgatgctcgatagatcgacgagcttggcgtaaggctcctgcttcgcacatcgtcaatgtatggctacggggaacagctctggcacggttgcacattcagcaacttgctgaaagaaaaagcaaaacagtatgcacggaagaaacgctaattactttaatttagaaaattcacatagagataagggagtaaaatggcaaaaaggaacaggtaaatattttctaattctgttgcatctaactacatgccatcataatgcatgaaagtatatgtatgtataaccctcttcccttaccgtgcacaagctgtaaagaacaattggaggttcccaatgcatctcatgcccagagaaaatctatggacttttgttaacactttggatagagctacagcaagaacacaacagctcaactgactgatcttgtttagatgggactaaaacttttaagtcctatcatattagatgcttggacactaattataaatattaaacgtagactattaataaaacacattcataattttggactaattcacgagacgaatcaattgagcctaattaatccataattagcctatatgatgctacagtaaacattctctaattatggattaattaggcttaaaaaaattgtctcacgaattagctttcatttatgtaattagttttgtaagtggtctatatttaatactccaaattagtgtctaaatacagagactaaagttaagccctggatccaaacaccacctgagagaggcttgggggtgggggtgggtgtgggtgtaaggggatatatatagatttattttgttcaaagatattgtctttagtatttgtaaactacacaaacaacttgcccttatatctatctatctatctatacctaaactaatcgggcacttttttggagctctcacgttaatcaggaagatcaagccattgattaaacaaaccataatatgtcaaccgttgattacaatctaatccaagttccacgcggtgggtcttttaaagccccatgtaacctatattgtcaagcccatcgatatgatccattcacgcacgcaccatcgatatgatccattcacgcacgcattcttttttctttttctttcgaacgtgggtatttgtttctttttctaaaccgatgagtccatccatatttactgagatcgatctgatcagatgcagtggaagatacgggagggcacggcatggccatcgtgccggccggcagcggcaaacgacggagaaaggcaggaggaaacagtacatacaagcacatcgtacgccaattatgttctgctcgctcggccgcggcaaaggcgaatatatcaacgttatcggatctagcagcacacaatcactaaggcgaggttgacgtgcggccggtgagcgccggaaaagcacacaacgtcagccgaatgctaattgttgttttctccattgttaaggtttgattctaacttctaatttccagttcaattctctttacatgcatacttctcaactgtcacagcgtccaataggaattaatctacgtcatcaccatactgtatatatttttgatgttcagatgtgttgattcagcatcaacaagttcgctagcacctgacaagccaatccatggtcatcgtaccataataattcatagaagtcttccatctatttgctttgacaaattcgctggcatttaggaagatccatagtggtcaccgcatgtactattcatgtaagtattccatcaatttgcatagtctgactttttatctgtatttgatctacttttactattcttcttatattcaccctctccttaaatataagcgatttcaagagattaggaatgaaggaaaaatgaagatagatttaaaaaaggggtgaaggggcagtagaacgatggttagggataagattgatcgaaaaatataaaatgagaggtggctttacaaagttctactcttaaatccattatatttgtggatagaatttgaagtataggatcaaaaatatttgtggatgaagggagtatatttgttttaaaatgtattttttttcctatgtgatatgaatttgctacccttattattatattgttaaaaacttttttcatatttatgttcaaaaatatgtttggactttcctaaactatccccgcaaaaaaaaactctccatatattatttagttgatttttttttataatggaatgtaacattccggcctttactcaaagagttacagccaattattacagaactcacacagaaagttcacgatagcaaaaacaaagctaagcaaacacaaactaatatacaccaacggaagaaaaagatcccctaactactgaaatctattagagaacctccactcgatattggcaaatagatgcataattatattatttagttgattcatcataaattttgtgttatacaggtggtcatgcaaaggcaaagggcatggaaaaaaacaatagatatgcatgtgcagtttttttcgataataatgcatgagtggaaaaaagcaatagatatgcatgcgttgcttcagtaatatacatgcatgcatgaaaaagacaaatggtgtgcagtgaaacatggtttattttcatccctattttccaaaaccatggaaaaaagaataatcccatgcattttgctgatcctactttatcctaacatggcacacaatgaaaaattattggacacggaaccaattcatattaacattatggtaggacagtacagcagagttcttgatttggctcctagaactaatccattaatatttatacgtagtacatggtgtcctcttactatatgttaatactatatgttatttgattttgatcctttattatgccatgttctcacgatatataagtatatatatgtgtatcatcctatatcactataatctgttgcatgcttcatccagttgaacaatttatattttcattgatattcattacttcagaaaaatacatcattcctctaacaaattcagatgaagtacttttcttttaatcaatgttgagggataaacatgactaaattgttttatttattattaatctaataatagtatattgggacattgtattaagaaaatatgccattggaagtcatactcaaaatgaattaaaaaatatgaattttatcgttttaagtattctattgattaggaatcaatatttaacaatgtatatttcataaaaactcttcttttaatataatctaagagccattgtaattagaaaagaccacatattcatacataattaaaattttaatatttatgatgatatgacggctagtctatactaattgggtactttctatactaattgggcactttctatgagctctcacatttaactagaaagatctaaccgttgattaaaaaattattatatctagatcgtggattaatattcgaaagccatgggtttctaaagcccaatactattgttacgtttgggccaccatacaatctaggttataggcttcaaaccgcccttgatttgttgtgatcgtatcaatccagcaaatctagattataggattcaaatcgctgttaattagttgtgatcgtatcaatccagcagagggagagagaacgacgtagactcatctgcacgcgaggagatggcggcactgaaacaatccactctattactcggcactgaaacgatccgtataaaatttcgggtacccgaatttctcccaaattaatatggtcgttttcacccctagccataagggaacgtatgatcacgtcagagtcaattcaaccagaaactcgagtcatccatcctcttgagccagtaatgtttaatttatccaccagatttgattcagacatactttatttgatttgaacttcttttctcatgcatgttttgtcatgcaagatttgattcgaacttcttttggtttctaattcagttgattgtttctttacaattttctcatctaaacgacaccgattagtacacaagttcgcttgcaacataaaatgactcaatccatgatcattgcttctttgattcacaaaaagtatcatgttgatttgcaaatttttttttggctaatttcgctttcatgcatgtaggaagattatttttgccgttccatctacaatccatttaggtgttccatcatcaatttttactgttctgattgatatgtctataatctaactttgtctgttccaggatatacacaatctgtgacagtatgctctcaattgagtaagttcaattataaaattagttaatctatgacagtgttatgacagaggtttgtacatggtggggttgaaaatgtttccgtcttctaggaccgggacgttcccagtacgaggaacgtggatcaataccggccatctctttcgactatgatttcggctctcaacaaatatccagtgatcagaaggttagaaacaaattatgccgtgacaaagataaattaataactgatgatcacagtaaatcattcagagtcatgtttattctttagatacattactgatgctttataatcactgaaaaggctaataacattatctatctatataatattcattataatccacagagtaaaaccataatttatttatttttggatattctgcgaaagaggtacaatactttcttatagcacttcaaatttccattacctactagatttgcatttatgtatgtggcaacaaattttaataacttagactagaaaagagctgatgccggataccttcttagtagatattcatgacgaaaaaggaagattctatagattcatatacaagttttttatcgctaaactaaaaaaaatatagagctttataaaaagaaacagagggagtagaaagtatcctaacaaatattaggatggattgtaatttcataattactaattgtgatttttgaattataaataaaatgatattttttcttctttttagcttcaaaacatacatatgaatttcaacaaaatattattaatcgatacatctaatatatgattgtatttttaatattcaaatatcagattggctaagtctgcacgatttcacgagatatgattgaatttatttaggcaaaatactagaagttttagaacaagcgtgagcgccagccatatttttatcaaaccaagtaggtaatggtcgatctgtctagaatcataacagaagcacaaatggctgtgcttgtatatattcccagcacttggtcagtatttctagcatgctgatacttgcagcaggattaataattattttagtaattttatggcacaatgtgtttcgaaacactgaaaactgctttgccgagaaaaatattactggcaggtgagtcagagcatttccaagctggtagtgagagctgtgtcagccggtttctcaaagcagcagtttgtcactcgagggcaccagggctgtgtttagattcaaagtttggatccaaacttcaaacttcagtacttttccatcacatcaacctgtcatacacacacaacttttcagtcacatcatcttcaattttaaccaaaatctaaactttgaatccaactaaacatagcccagatcacagatcaaacatgggtaaaatgcgaaatgtcgtgacagcactacgtcaaccaggacttcaagaatgccagtatcttgttatttgcaacagaatcaggtcccagtgacatggcagcttccatgatggtaccgataatcatataccagaatagtccgtagagacacttgtctagtgatctcgtgatctctgcaatgtttttttctcatggatgacccaaagatactgacgcctctgatgcctatgttccatggtgggtattatggcacttgcaggaagtattatcatagttcgcaagctaagttggtaataagcactatggcatggactgaaacaagtggagcagtgaggggatatatataatgaaccttctcgtgcatatgtagaacacaacaagatgctagatacattaaattttgatggtggaatgtaagtttcgtatcaacaaaattgaattagaacattaaaacatttggtacaccagattttattacaatgacagagcaagacacattgaagatgcatgttatattatcattgtagatacatgcatatatacaacatgcttagattttttataagcatggaagtaataccggagaaaaaaagtagtatttatcaaatcttctaaatatgcatcatcctccaaagtccatttagtggtttagttatattaactatatatagagagacttactacatggcaaccaacgtgcacgtaactaagtaacacacttctctagtaacttttttttttttactatcagcaaccccacaccttcccccctctagcatgtgcaacccaacgtcagtatttttttattgtagcaacctagcagtataaccccaaggagacactgcttctaaaagcccaagtatttttttaccattgcattccaccaacattatctcgtatttatatttatcgttaccggctctacagggatggctagcattgcgcctccaaatccacccatcgccctgcacgtaacgaagcactgctatgtggcgctacatagcatgcatggagctatgtaactacgtaggacaactcacaagcgctctcacctccgcacccattgaagaggaaaaaagttgctcggcattgtttcagtctccttcagctcccacctctgtgtccccaaagggtaacaaattttnnnnnnnnnnnnnnnnnnnnnnnnnnnnnnnnnnnnnnnnnnnnnnnnnnnnnnnnnnnnnnnnnnnnnnnngtcatcaaacaaagcgg

SEQ ID NO: 77280 - DNA, 7623 bp, Oryza sativa
tttttactaacatgtataacttcacatccaccattcagtaacacctataacttctgtatccatcatttagtgagcttctgaacaacacatataacatgtatccatcatttaatatattttttttgttaacacggcacttatttgtttaggttggtcaaggataaatcaatagcaaactattaactccaagagaattaatgcaccacccaaccctcatctggcagggtaaatatatctactatcccaaagagcttccattctccatctattggattcaaagtaaaaacaaaatactcctcaaatgctggtcaaacaatccatatgaggggaacgcggactattgacatagtaaaaaaatactagcatgctaggtcagagatgcaacgtaagagatgctacgtaattaggtggcacgtagtgtcacatgtagtatgtctctccctctatatagagggagacttagtacatcgcacctgtcatgctacgtagctacatagagcacccctagtaattttttttaatatcaggaaccatgtaccttcccacctctacctcatggaccccacaccaacgtcagtaactttattttactgtagcgatgtaacaatatataaccccattgtattccaccatcgttatctgtatttatattcgtcattactagctctataagaatggctagcattgcgattccaaatccgcccatcgccgctctgcatgggatgaagcagcggtgccgctccaaaattgtgctgggcaatttaagtacttcactgaatatgcaattggtcaatttgatagtccctccgtttcacaatgtaagtcattctagcatttcctacattcatattgatgataatgaatctaaacacatatatctatctagattcattagcatcaatatgaatgtggaaaatgctagaatgacttacgttgtgaaacggaggaagtaacatatatagacttttatatatgttcgtgtggttcacacagtcttgttttggttcaactaatattatgattttaggtaaatgctagcgcgtctgagctatcctctctggtctctgccttaactaagctgaaaaataatggaattttttaatgaacttatataatgatcgataaatcattattttccgtaaataacgaatggatttttcacaatcagcgaaatgtgcgtacaagaagagagcgagtgcaaactgaaacattaaccgaaataagcaatcccttatttcattaaaaaactagttccttagttactatcttatagcttaattatatggagtgacaaacaaggtgacatttgagagttacctctgatttgtttctaaaattgttaccccttgtattccttagaacaagtgcaggttactgaggaatatccacctatcactatatttcaacattttcagtctacccaaatttgaattcgttaatctctctttcaaattcttctagtctagaagccgtgcctcttctctctgctcgcgacatcctgttcctcctttcgtctcgctctgtcactccctttccatctccttacatgccaaaaatcttcggtacaagttagacttcgtacaaacttagggctcagagcctatttgttgaaccagacctcttcttctttttccctaataagcattcatagacagtgtgtatcgcagaactagaccatatatacatactgtcaaatcattatatcattatagttatgcacaactcttcgtcgtcctgtaactatcctactctctccggttctataataactgacgttttgaacaagattaagatcaaactttaataactttaaccatcaataacttcaaaaatatttagtttaatttaaagaaactattatatagatttgtctttcaaaacactataataaaaataagcatgtatttatttattgtgtatattataatagaaaaataaggtcaaagatatattttgtagaccgtgtcattgtctaaaacgtcaattaaaatgaaaccggagggagtatgttgtttcatgctaatcaccactactacatcagaacctagaggaacaagtacatcttccattgcagattttcacaatgattatgaaccatacgcttcataattgttgcttactgcaggaataaatgctattggatcattccaactttccgatgcttctcattcctatccagtaattcaattctctctactatcggagtgcacatactgttctaatccccaagctcgactagcagacttgagttttgaaacaagagtcgagcatgcatggagggacacacacacaaacacacaagtacctactatacaccaaagcttatctttgggataggtatgaaaaataaactgacaggaaaagcatatcaggcacggtggttgaggtataaatgcatcactcgatctacacagcgttgataactactccctccatcctaaaatatagggcgtacctgccctggacgcgaagactaaggatgcctacctgttttactcatcccaacgcacagcacagcgcttcgcttcacgcacgcagttgtgctgggagagagagaaagaggtttttttaactagctagtcttgcatgtgaggtaacgggagttgaggaggtgagtcttgaatgcttgcatgcatatgtatgggaacgaggaaaaattcaatgtgtggatgcgtttaaacggctgccgaggaggtgccgccttatattgtgcgtgtactcacaattatcacacatagatacatttcaataaaaatctcgtagcattcatgtatttatccgtgttgtatagttcatctaatcagatgggtacatcaagagtgcttgcttgtgatgtcttccatttaagaggaaatggttgagaaatacccttcttttgctgattggtggccttgaacctgcgttagaacaagataggctatgtttagattcaagggtgtaaaaatttaacgtgtcacatcggatacacggatacacattttaagtattaaacattgactaataccaaaaccaattacaaaatccgccttaaactgcgagatgaatttattaagcctaattaatccgtcattagcaaatgtttactggggcaccacattgtcagatcgtggagcaattaggcttaaaagattcatctcgcaatttacacgcaatctatgtaattagttattttttcatttatatttaatactccatgcatgtgtctaaacattcgatgtgatagggtgaaaaattttgctagagatctaaacaggaccatagtggatggttgttccatcgttgtggaacatttgtaacaatgtatccttgggctttgtatgtcattagcacgtacagtggttggtttttatccgttattaaaaaagcaaaattaatgcacatgctgcagaagaaaagcaatgcaaattgaaccatctatccaaataagcaatccttattgtttttcttaaaagcactatagttacagtattacaggaagagacaaacatggtgacatttgaattacctctatttatttttctagaatataatttgctgcccctgtatttctctgaaaatgcacaaatgaccaagaatacacgttaacatgtctactcttggcaactatggatttaccattcctctctcttcgaaattcttttaatctcgaatgctagttgtctcctttcttttcacttgtcatttattcatctgctcgttctatacactctcttgactccctcttccactcctttttcgccaaagtcaagtaattggagacttctattgaaatttagatgcctagatttttggtaaaagtcagacttcctggaatatttgagctcaaaaccttgctagaataggtgttgaattaatgtactagtcctatttagttatagttggacttggagttgtaataggtggtaggaacggagttagagtcgaactctgtaacctgaccgcaaaatcaaagtgtgtttgattcttattctgtgatgaacaattggcatatgtggttattagttttgatatttggagatgattggttttgcaggtgatgaacatgagataccactgactatttggacttgtcagactgggcaggtgttgccagtcagactggagctatgtgagcggtcagactggctagcccaggtctgatcagccgactctgtgtcagtttcggtttcaggttcatttgttggatatccgtggataattcatatttatgacttctagatggatactatgcgtatctaatactgttgtttgctaacaatgagtcaagttggtgagaacttgtgctcggatatggtttcttggttgatccatatgtaggtgatcttgatgcctcgggagagtgttgttggtgatggatcatgagtcaacttgggagaagatgacgtccgaacgatcaggatatcatgcgggatgtttaggctaaagatcaatgcacatggttggtgaagatgccatatggcatatgatggagatattgtgtgtgtatgggatgcggagccgaatttggaaggagtccaaatttggtataattggagtttgtaaagtttgtttcttgtacgggaaggtttcctaggagattaggacttcttgtacaagtttggttcgtggctttaggctgcctaccttaggtataaatagagagggagggtgtggcctcccggtatcgctttagagcgagagttgagttgacagataagttagggttttgagtatagttaagattttcgtgaggagtgttgttgttgcactttgtaaacacagatagaaataataaagtttcaatctactttgtgagatcttcgatttatgtttgcttgagttcggcggtccaaccggcgggacaccaacgttcagaccgatggcatcgcaccggtcagactgacaagaacacagtagttagaccggcggcagcgacaggaggcataggcgattgcagggcagttagaccgggcgatcaacaccagtcagaccggcggcataggcacgatcaaaccggtagatcaactacgatcagaccgatctaaatcggattcgagggtaacttttaattttgctaaaactttcaacgcagcataggcgtcgcgttgtcaacggtcaactgtacgggtggagtgggggcggagctagcagcgatgagactcgtacgggtgctgctggtggtgtccatggcaacagccagccaccctggcggccgccacgccgaggtccatccccgcctccgcctacctcctgtccagacagttgtaacccttctcctcgtcgcaccgcagtgccctcccggccactgccgagttggacgctcctcgcctcgctcgcctcgacagagagagaaacgagagaggggtgaggtagcctttattattattattattattattattattattattattattattattattattattattattattatttttggattggtttgctacgtatgacaaaaccgctccagattgggtcaaggcagtaattcatctgatattaatggttgagggtgcaagatgtctgttttcggtttttgggtgttaattcgtactcacccaatagtgcagggggtaattcagacttttcgcttagaaaaaacttttgtaatgtttttacacagaactattttagtggagtacttaacccacaaggtagcattgaagcttttacgcagataactattttagtggagcacttaatctgtaaaggtagtattggatcaatctaatcccttgggtataggaaaaataagatcattttacgtcctaacgatatttatattctttttactttttttatgcttctctacatacaagtcataattcgctttgacaaatctaagatacgaaagtcaatgataattaaacaaattcactaaattccatgacctgcttgtataagcctctaaggtgtcaatacaaaatcaatagcatttcttataattatatgattagaaatttccacctaaaatttaattttaagactcattatgactaggtttttttcttaaaaatactgtagggtcctacctgtaagaacctctatatatctatgatatgtatatttgatcaattataaaaaagagatagctagaaaaaaatatttatgagcaattaaagttatttttaagaaaaactaaacaatgaacattcaatttagaagggaaatacctcactttaagttaaacttattttgttagacctgttttcaaagtaaaataacaaacatgtccgcgcgaatgcgtatgctacgtaccttgtttgtaaaccaaatggtgaaggcgggatggataatatatataggtgaaatgggtgatgcgcaaacggatctagcttgtgccatttcttgtactgtgtgttcatgaaaataaagagagtaattggaaattaaagaatcaacttagatattgttgtacgaaaccaaatcacagcatgtgaggaacactgacgagggtcgacctgcaactgcagacctatattgctccctcttctccctcttcctcctcctcttcttctctttttctactacagtacaccacacaaattttttttaaaactaaaagttagaaaaatttatatatagaaatactatatataaaaaaattgaattcaaattcaaatttgaatcaggtatataaacttttgacttataaactttgggtctataaactttaggtgtataaactttagatgtatagaaatactatatatagaaaatatttgaattcaaattcaaatttgaatcagatataattcaaattcaaatttgaatcgggtatataaacttttgactttaaactttggatctataaactttagatgtatagaaatactatatatagaaaattatttgaattcaaattcaaatttgaatcagatataattcaaattcaaatttaaaacgggtatatagactcttgacttataaactttaggtgtataaactttaggtgtataaactttagatatatagaaatactatatataaaaaaatatttgaattcaaattcaaatttgaatcggatatataaacttttgacttataaacttttggtctccaaactttagaagtataaacttgaggtgtataaactttaagtatataaatttactaaaataggaaagtaatgcggtgccaaaaaaaaagaaaccaggtagaggggtggagggagggagccagggagggaggaggcgatcgatcgctgatccatccccagagcgatcgatcgccgaacaggatttccagtttgttagggtgtacagcgctggtacggtcaaacagcaagtctcatgaagaaaataaaaaacaatatgcatggaagaacattgataacttccatttaggaaaacaaatgagatacagggagtagaaagtaaaaaaggggcagtaaatatctgtcaagtgctatactgacatggacccctttttattgaaagcagatgctttgacttaattacacatggagttaatcactgacatgtagatcccactttgctatggcccatatatcaatgcttaaactggataacagcttagtgagagaataccttttcttttattaatctagtggcacaatggatctaagggattatccaaatttaacttattaaaaccatgctatctttacaa

SEQ ID NO: 77281 - DNA, 862 bp, Oryza sativa
acgctgttgtcgacgaatctggatgtcaaagtagtagaaccttgagcaccaagtccccctacctggcgcgccactatcgacgggggatacccgtagaccggatatagagggtattggggtacgctggtacgaggatgtacgtagtacgacatcaagcaaacaggaaacagggattatactggttcaggccccttggtaggtaatagccctaatccagttgatatgggattatatgatggaaaccacatattacaaagggaatagtaaagctcgacgataccgacaggatcgtagtcgagttgatccgactagatctcccggcgacttggcttcgataagctctggcttcgtaggctgtggtagatgtgttggctctaagatttaatgccttaggtcctcccagggggtcccttttataccgtaggtcaactggtctccatgtcggactcagagacatcggacccgacacgatataatgacggccgatttctatccgagtaggactctttccatctgtagactccatgatggacttccttaacctatgctgagaacgtccgtatacgcgcaaacatactatatcgatacgtgacgtatatcgaagggtagagggtataccttacccgtaaccctgatagcgccgggagccggagccgctgtgaacgacaatatcaacggaggcagtttgcctcacaatccagcggagagacattcacagggtataaccttcgcatactgttaattcaatttttgatacttctgttagtcgtaattctattgcgttcgttgtatggtcatgatgcttattatatcttaagcatgcttctggttatgttagattttatcactagatcaccccact

SEQ ID NO: 77282 - DNA, 7698 bp, Oryza sativa
ttccaccaacaatatagttatcttgttagacagtccttgtagtctattcaattactgtgaataaataaagtattgaaaattaaaaggtgaaaatagtttagaacaccattatcatatcatgcatggttacattactgtatcagacatggttatggttacgaggtggtggtaatgaatctatttgttgattcagggattcttctatatgaaatgttgtatggttatacaccttttagaggaaaaacgaggcaacggacatttgctaatatcttgcacaaggatatcagatttcctgctagtatatcggtaagtaaatcaagcgtcatttttttttaagttggagaagttaaatcagtttgagttttcaggtcagcctagcggcgaggcagctaatgtataggttgctacatagggatcctgccaacaggctagggtcctacgagggagccaatgagataaaaggacatccctttttccgtggtataaattggcctcttatacgcgccacggtaacgtaactagctatatcctgctgctatacatgagtgtttaatttggatgatgagatcctaatgtagaatgtgtgtgtgtgaatgaaatcaataatgcattgtaggcgcctccaaagttggagatcccactattttccaaggatgacatggagaagaagggactagtaacaaataaccgcacggatatgttctgaagaccctgatgatgatcttcaataaaagagagggacatatattgttgcttgctttgcgtgcgtaggccaagattaagattatgtcatgtaaatatgtaatgtatcgtacagaccttgttgtgtttgaacctagtatgcgatccatcatcttaataagatgcaatgcagcgcaatgtgtgccagtgaacagtaatgagcttgacttgagtttatagtagtctagtatagtgagtagaggaaaaaaagagtaaattgtattgacggtacgtaaacttgtcaagtgggtgcaatttagtatacgaacttgtaaaacactcatttggatgtatgaatttgtttgatgtgtgtgaaccaagaccaaaagaacacgacatggccaagtttagcaagttagacgttggttaggacatgatgtgcacaggcataagactgatacaggggcgggcccactttaattcatgggtattcaaatgaatacccaagattttggaaaaaaaaaaagtacatatatgaagttatattattccatatgtatatatagaaaaaaaaggaaaaatacttatatctattcaaaactcaaaagaagcccaaactgaaccctcccaccacccaacatttcaggcccgttggcccaatagaaaaaaaaggcccaattcctctctaaccctatctcatctcctcacctccctccccttcccatcccagccgccacgcccacgcgtcgccagccgccgcacgcgccatcccggccgcctgcccacgcgcctcgcccgtcctcgctgtcgcgacgtcgccgcccgccggtcgcgctgcccagccggccagcccaccagccgtctgcgcgcgcgcgcgcggtgcgcctcgccgtcgcccggtcgccggccgcccacaggccatagccggctccgcgcctcgcgcctcctcggccctcgccgcttcgccgagtcgccggacgccggctcgccgcctccgcgtctccgcacgaccgcacctcgcgcccggcggccgcctgcacgcctcgcgccctcgccgcctccgtcctcgagacctcgacagcagtctgcaacggtgagtcgccgagtgcccgtaagacatgctatattggtaaacttgacttccgtttttattattggtatttttatctttctccaaacaatcttaagccttattaaacattttattgaataggccttattaaacaatcttaggccttttttatctttagctagaagaaattaattaagacgagattttttccccctctctttgaaatttgaatgaattcaaagagaaaacgctagtagtgaccgccgcaacttactaacgtaggagaggacaaggaacaggatgagtttgcccaggctgagggcacagaggtggtcgatgaagcataacgcgtaccacgttcctgagcaaatgccactagatgatcgatgatcaagaacaacatattaaaaccctaaaaaaagatgccgtcaaaaaggcgtgcaatttgatcacaccatttacatggattattcttctcatcggatgtcatgcattgcaatttgatcacaccatttacacggattattcgagataatataatttcagtacaaattcaaagtcttttttcccggagaatataatttcagtacaaattcaagtactaattaacttattgacaaggcattgtcgacgagcatggcgacgccgttcgccgtggcgcgcagggaggccggcaacgtgtcgtgtaggcggtcgctgcttcgaggcggaagatgtaatggtccttcctccagaaccgcatagccagcccatccgacgggcgggtccacttacacataccactccacttacactttcgtcctcgcttcgtgtaaaagggttaaccctggagtgatatggttcgagggaagaggccttataagttagttccacccttgctaaactagcgcacatagctctcatggtattaaacatgcgcacatagctctcatgggccacataggctttgtcctaattaggccaggatgtcatagaagtagacacggatgacatggccggcggaggtgagtgaggttgccacagtgttggcggcatcggcggtggcggcggcggagcaggagttggagttgaagtcctcttcgttgacctcgagtttgcgtgttgtccttgacctcctccctctccgcgcggtggaggtggtctcggcaacatcagagttgctcttgggaggagctcgatggcaagtgcatgctcaagagcgcctacaagatggccatggcggcgtgctcttgctgctgccacgcgatggtggggatgccgtgctacctctggcgcacgttgcggagcaccagacgcgtgcgccgtgtacactgccatgacgacgacaacgtggaggaaggaggaggaggatgggacagctcattgtcagacttcgcctggagctccagcaaggatgaggaggaggagggctccacctccactgaaggtggggagtacggtggccacggcggcggtagaagggaaaggaggaatcaagaccagatgcggcggtctctgcggctgagactgatgagctttaggtgggtctaactattttttatatacttgtttgactgacatatgggttctgcatgttttgttttaatttgttagtcttcaatttttctcttttaatttttctttttaggtcaaactaccacgtaagcgtcacgtcgatgccacgtgggatgaagacctagttaaaggagccatataggtaccatgctagcaaaaaccagggacaatactgttgagagaccttgtttgcactcgttttcgtaagttgggatgttgtatccgcttatttgcggtctatgaacgaattggtaggcctgaaattgggctttgctctcccatgttacttgcatgaataagtttactttaagtccctcaaaaattgttgccaagtctgtaattcgtccctggacctcaaaaccgaatacaacacatccccaacgtacaaaaccagtgcaagcgagatccctcggcactattgtccccggttttggctgatatggtgcctatatggctcctatgactaagtattcatcctaggtaacattgacatggcagtttgatctttaaaaaaataaaatgagcaaaattgaaaactaacaaattaaaacaaaacatacagggcccatatgctcctttaatttttctttttagatcaaactgacacgtaagcgtcacgtcaatgccacgtgtgataaagacctagttaaaagagacacatgggcgccatatcagctaaaaccagggacaatactgtcaatggaccttatttgcattggttttataagttggggatgcgttgtatccggttatgagcgttctaggaagactcagcgacaaaaattgggatctaaagtgaacttattcgttacttgcataacaaaatgttatgggcttcatcttgtcttgttgttgctagtactttctagagcactcggcgtggagggatggcagcggcagctcgcttgctgccggtggcggcgaagcgactaacgacgacggcgagggcgaggcgcctctccacctctacctcgacgtccccacccgccactgccgtactctacgaccagcacggtccgcctgacaaagtccttagggtggctgagctgccggcggcgaagatcggcgagcgcgatgtgtgcgtgcggatgctggccgcccccatcaacccctccgacctcaaccgcgtggagggcgtctaccctgttcgccctcccctccctgccgctgtcgcaggctacgagggggtcggccaggtccacgccctcggcggcgccgtccattcccggctcctctcccccggcgactggtcatcccttctccgccctccttgggcacctggcagacctacatcgtcaacccagccaccgcctggcacagggttcgctccgatgtgcctccccaatacgtcgccaccgtcaccgtcaacccactcaccgcgctcaggatgctctgcgacttcgttaacctcgcccctggtctcctgtcactgctttcttctcttttctttccctgtaattaagtctcacccctagccctggatacgtttgtttcaggtgacactcttgtccagaatggcgctaccagcattgtcggccagtgcgtcattcagctcgccaaactgcatggtcttcacaccatcaacatcataagggacaggtatgtatgcctacctacactacatcaacgcattctgcatccaagctacccaattgatgatgactacgctagcatctccataatttgttctataggcctggttcacaagaggccaaggacaaacttaaacagcttggagcagatcatgtgtttacggaaagccagctagacatcaagaatatcaaaagcttattggtacttctccctacaggcctgcatttccgtttcttaattcaacctcaaactacctacttgtccaccctttttcataataaatatatgaactaatgtggtaaattgtatttactcactctgatactgttgaaccagtcccctgtattatggaaatgcttccacacatggatgatccttgtagacgcttttacatttctgctaatagaaatggaggggtacccacccttttgatcaaacaaaaagaaacttgaaatgcttgggctcctaattaaacttagtcatgagttttactggaagctattttgctgcttcacagctaaatgttacagtgctgtttcatttaattaatgggagtgcctcgcactaaacaattatctaaaaaattaacagtaaggaacaggacaatctcaactgtttcattatactgctgctattttgtttactgtggtatcagggtgctttgccagaacctgcattagggttgaattgtgttggaggaaatgctgcttctgtcatactgaaatttttaaggtagtgctttaaacatgaacaaaattctgattagaaccgtctttgtcttccacatatatttataaactctctctttaggcaaggtggcacaatggtgacatatggtggaatgtccaagaaacctgttactgtttctacttcatctttcatttttaaggttagtacatcagatctttggtccttaacagtggtcgacagggtttctaatttcatatgcaatttactccagttgtgtactctaaatgtttataccaatctactgcttgaagcttctggcatcgtaatactagactagtctagaattagaatcaggggcgtttgtctcataagcacaagtcataggggcggctttgttagacgactgatcagtgaacacaagaatttgtttctgcatcaaaagtatcacctgtgatatcataaagttttgaaacatcatgtagttccgaaagaagaaaccctgcatggaagtttgaaagaccaatcgtttctttgtgctaccatgtatcatgtcgtttatgtcaattacttagcatggttttcatagacagtatttaacacaatgctattttgttaagtaggatctttccctaagaggattctggctacagaagtggatgagttcagataaggcagaggaatctagaacaatgatagactacctgttggacctggtgcacgaaggcaaacttaaatacgagtacgtaatgctactctcttcttgaattgctgttggattacacagaatgaaacaaatgtaggtcctatcatatatgagggagaaatgaattgttttcgtacaggatggagttgacgcccttcagtgacttccatttggctcttgataaggcactcggcaaacatggaagccaaccaaagcaggttctcaagttctaagataatgcaaggacaacggatgagagagagcttgtattacaaaaacaggagtagaaaaaaggatgtaaacagtgcatgtgtgcgtggctaggggatcggtggcctctttcagtagtagttaccaggctgacttgggaagcggcaatatgttttgcggtgattgcagcggatctctgtccaataatggcggatcacttcacttgagagtagaaagacgtagtatatcacttcacttcaatccccccgcgcaatatgaccttgtgtggttgtaagttctgaagtggtattgattaccgtccgatctggagaaagaaagttttcactagattatcgtcaccgattatttgctctaagttttcaaaaaaaattcttaaaagatttcttctgtattgattagaccacttgttttaaaatatttaagtttatttcttaaaatatataatctatccctatgatcaagtagataatatcaaataatcaaactgtctaaattgcattaatttctgagtaaaataaatagtcaaatatcatatccaaaagtagcactatatattttcattcaaactgaggaagtatgtttggcaggcacaatacaattatataaacctatatatactaatcttcaaaaagaattttcatttaacacgattgaaatagcttgagccttatgaaaaagagaaaaatgtttaacgcggctagtgtaaaatcaaaatgagaaaacaatcacgctcagttgtttttatgttggatttaattctttgactcggcttgggcactcttatatgataactccgttagttttaaaaggtagagataatttactccatgctattgagctttcccagtcaacgatttgccatcgacattgtctctttctacaatatatcgatgacttcgtcgatggttgtataatattttattgggccgagccatttaaacaaaaaatacccttagaggattgatttatctaattagaagttttaaaaaaatatgtgacctccttacacaacatggaagtttctataagtttcatgttatttttggcatctttactttctacaaaaatatttttgtatgatatatctcatagaacagattctctttaaaatgtactcgagcccccttaaaaaaaagagaaaaatgtattaacgctcatgtgaaaccaaaatgaa

SEQ ID NO: 77283 - DNA, 542 bp, Oryza sativa
cagcaattccagaacctacaaaaatttatagaaagctaaatttgagaaaacattccgaagtgaataagttgaaacagataaatttgaaaaaacttttcacaagtaaaaaaatcagtaaccgaaaagaaaaaaagcttaaggtaactgaccatccaaaagatcatcaacagactgtttggaatgattagcattaccaacttgaggggtaacaaaattcagatctaacaggaagaaattaaaaaaatattaatgcatgattaaaacaattaacagtataatttaacataacaaatttggtacaaaattaccatcatcacattgtcttgaatcattaagttcaacagcagatttagaaacaaaagcatcttcattttcctataaaattttcaattcaggaactcaaaaaacaaataatttaaataaacttggcaataattatgcaatatatgacaaaaaaacttacatgaaaagcattatgaataggagaatgagggaacacattatcattaggcacatgaacttctgcatataaaacgaacgca

SEQ ID NO: 77284 - DNA, 5344 bp, Oryza sativa
  unsure (1)..(5344): unsure at all n locations
ttccatgcgccgcacttgttgaaggaattttctcgtcttgacaaagtctactgctctatttaggtttcaatttgttaaacaaaaagggatctcacgcttgccctacttttgtttgcattgtcaattagagtgcaaaatgttgatctacacacatgccattcctcgtgtgccaagattctagacatctgctatttaatttttttgttaaatctatgtccgaaatttagataatagtattatccttgaggaaggaagtggatagctctacttttcctcatctgttgaagccaggttataaagccatgtgctctcttcagtttcaagaaccattacattacattacatacgaaaaccctcctattaccataaggcgtgatcttgtcttgcactcttgcttgagtaggctgagctaagagcaagtgtgttcgaggccatagaagaggaggatagggtagtggagaatgatgatggtgggaatcccgctttgcttggtagctgcaatgaccgagctaagcagctgcatgcttcaccatcaggtttgccttcttttctacccagaagttcagattgtttcccatgctgcttcaaaaataatttatctcatatgtatgattctctagattccttttttggagatttgttttcataccattctgtgaatttgcagcttgccaaaatgccaccattgtgccaaagtagcatctttattcgcttcatctttctcttctacgcttatgaaagaaccttttttctatcctgctgatgattagttagtctttgcctttcatttctgctgcatagtttcttcttcggttataattgatttacgtcgaacattttctactgctctcaggtaggttattaacagcacttgtaagtgaatacttggagtgggcccagctaagtcacacgatgaaagtttatctgcctgaatgtaatctggtaacagtttgccatatctcataaatcttggatggatatgtccaaaatcaacatctgctaatgctgctattgattgttggctgttgcatttgtaaatcagccaaaggacttctggaagaatgaattaaaggatttttctaacaaaagcggagctgaagggagcaggagtgctgaaagtggccccatgcttctagatgttcttgaaggatatctcaaatatgaggtactcttgctaactcagagtctcaggcagacagtatataaatgtatatggaaatctttctgtttatggaattttgatttgattaaaatccctgtgttgcaacaggattttaattaaagaaaattattattaacccattattaccatcatttcctgcatacttttttcttttaataaaatgtaaggaattggtaatggaggtggttgacatgtggaccctttggtcctacttgacctttttctttttcaaatagtagagagttggtggtgggaggggtnncnnatnnncanntnancancnccnctnctttcttttttaacatttacgtaagatatccactttttctttccttgttcttgagcccctgaattagctatcaccacttctattagtgatactagtaaaatgtccttgtgttgcatagatttcaactagctatactatgtataaaatataaaatacaatagataaataattatcgctaaaacttattcacttgattaaatgagacgaaatgagcacctatgtatacttgtatacagatatacaatacttttctatggaatttctacaaataatacacacaaggctacatattttttaaccacgaaaaatctagagtgaggtgggtgtagaacctatcataaccccaaactctctgtttctcttactcttctaaaagaaaatgcatttttacatatcttagttttaatctttatttgcttatattgcctgattttggttacttgaattgctacattgagcagaatttgtctcaaacaaggatggctggtactggtaggagaataatcaattccgagtcggatccggctctaaatgctgaacataggaacacgaggaggccaccgtcgtcttcttcagttacaggcttgcctcctatgggaaggtaacagcttactactattcagctattcaatttgcagatatttgttgtttcctcaaaacacaggtaacatttccttgcaactcgcaggccaatgccatcgtcacagatgtcaggtaaattataatttttttctcggtttgtttattttatgctagagtgctcctctaaagctagcgctttggacattcagaccgaagaggggggtcttcggcttccaatgcaaggaaggatgaatacaactggagatatgatgctgatgatatctctgaagaagtgttgcgagcatcaagtgctctagaaaacgtccagctagaccggaaagctcgcaatctgacgacttcttggaggttggaactattgcctttcttctttgcaccttccctttttgcctggccatttgtttctgatcatagaatatctgtttccaggcatccaggcgacggtgctgagtaaaatcggaaggtgggatgggtccaattcaccattgcgctgcttggacccccttgggccatttgtatcgttttggttgctgcggtgggattgtgcgcttgcgtagaagaatgctcagtgttgatcatgcctactgtactcctagctcatttgtttatgcaccatatatgggatttgatttctgctggacaatcttgttcttgtgcgtataattttagttgcgtgtagtttctaacaaatttgcttttgcttacatcgggaattcttgttacaacgtgcatacaaacctgccctgcagcagttctctccaaatccagtttcctgctcctcttgtaactcctttgagcagcattcacttattagttgccaacaacaattcccagcggtatcatttgataaaaccaatttgcacataaacaatgtgttaaaccaagattctggagtggttacatttcagttttgtcacagtatcatttggtaatttatgcctaatctagctagtagagtgacagcacactagttcggaggcctagcaattgcctattacacctcactcagttcactgacattattcccctttttgttttgtttgaggagtataccacgttaacatgccaataattgctgccaatgctactggtattgttccaagatgagtagattgatctcgagattatgccttccctctgatcatccacgtactcgcgcgtgctgcatctctaattactcctgcaatgcacatccaagcacttaacatcgtagcaacacatgacacaaacctatactatgtagcactgattgacaattttcttacagaaaatacaaaaggtgaagcgacaattacatttcaggggttaaacaagtgtactaactccaaacaagcacagacaatcgcaagtacgactgcatgtgttcttcagcatatggaattttgagcggacttatatacacaaatctgtatctctttttctttttttcatatcagtaagttaacaaggcagtccttcctagtttgcagttacctcaaccttgatatacagtggcatggaacaattcttggatgaggcattctagggcagctattttcatgttgctgatttttttttcctctgaatagattagtcagcaaggtcctacaaagtgcatgaatttcacgacatagattgtcaactttacagtgaatgaattcattgccaatcaatacctattcagctatcaacattactgcttttcctgaacatattcagctaccaaatgtgaccctaaattaattatattatgcggttgtgccagaattctcttacatgaaccatcatgaaatctcactccaaaacggaaaagcctaggcacacgacaatttcacagcaatcatctaagagtgtcctccaaggaggctgtgggtctgtaacgtaaatatcataatatgctacttgatattttaagcaaccacttgcacatttttggcacaaaaaaacattagtaagttctgaatgaaaattacagcataagcataccttttcttgcagtcactgatctcattaccatttctaaatccatccaagcagtgacagccacctcttaatgcttcaacaacagcatcagaaccaatagcttggtcacatccttctaacttgttttctaatccagcatcattagtggcaaccagagtctccacacttgttgataatgttggctttcttggaggatgaggtttggggtggttgtgctcaccgttgtatacaatttcagcaatccggccatctggtgtcatctccacctttctcttgacagggcatgttgggtgagtgcacttgtagtagctccgtgggaactcgctccctttcacttgcttctgcccatacttcctccagctgtagccatcgtaggacaaactgttcttcgcactgacatttggcttcctgacactctgggacactgtcaaattgtcccaacaggccccctttcctgtatctgctttcttttgatcgtatgctgtatgtgttccactgtcttctagctaaaaagttcagcatgttgttagaaaatgaccatatgatcatgtcaaaggtaggttcaaaataatctaatggacagatgtataattataaaaagcatcatttaaaagaaggtgcaaaattatgtaactgtcagaaagaaaatgaaatttctttccaggaaacagagaagttgaatttcgtgtcgaactgactctggttgcagcaatttctgtcgatgaattactcaatgggtgtgtgaatcgcgttgcctttggacgccttaatataatctcctccagggaagtaacccgaggagaatcaatagcagtggagtcttcctggagcattgagaaggacctcaatctggaagaaggcctggaagccacaggcttcacagcagcaaccttcttgtggctttgcatatcgcactggtgaaatttttagcacagtttatgtaccaaagtgaaatgacaaagaaagaaggtagaataacacaaaatttatgaacacaagtcatggatgtgctcccctctgctgctacctgtacgtggtgaatgaataaaagagaacagagggaaactcatagtgagctagatgtaaaactgaggaattgaccaaaaaaaaaagaagagaagagtgatactggaacaaaatagcatgcatggaaaaaaaaagtgaatttatgcaatctatagctgaattttgaagcctggttgagaccaagcaacaaaacatgcagaacatgctgaagtaataatgctttatttcaagatgtttacttgttttcctcttgtgcatgtacaaagcaaaaattgagaaaggaa

SEQ ID NO: 77285 - DNA, 6215 bp, Oryza sativa
agctgccgggggtgcagccgctggtgaaggcgctgccgcccgcggcgaggacggcggcggagctggcggtgtccgcggcgccggtggcggcggggtacggcatcgggctccgcgcgggtggggggtctagggccgtggcggtcgcgggcaccgcggtgctcggggcggccagcgtcgccggggccgccgcggtgaactccgtcgtgccggaggtcgccgccgtcgggctgcacaactacgtcgccggatgcgacgaccccaccaagctggagagcggcgaggtgaaggccctcgcgaccaagtgagtcgtctcgattgctcgactatattgtaggtgtgctgcattggccgtatggcccgtatgctcgattcgattatatatcagatgtcttgactcccaccctgcaatgtgatctgtattttccttccaatttatgcgccctcctagcatttactcattaattttgaagctcccatttgttttcggaatgctagtaaaattttggtgtagcttgtttcagcgaataaggacccaataataatttcgatgatacatctgatcggctaaaattacctttagggatgggacatatagttatatttttgcactaaaatgtttaaggaaaaggctatacgtactacatttttattattaaactctctttacactaatgtgtcatgttatgagttcatctacatttcctataactcctatctagttgaatcaaacagttgatatcattttgtgtaagaatttttaagtatgtgcatcagtgctcaatgtaacattgcccccacccacacacacagaagcaaaaagtcttacctgtttattttgtttcatatatggagttagtacacaggacgcagccttcaaagcagagctctgtgatttgtatgccaggtgatcctcttggcacctgttgtccagttgtttccaatgctttatttgaatgttggtaaagaatgtccatccggaaatggcctctaagcctaactgtatttatgacactaattctgttgtgttctatgtgttgaatttggctcaagtgcccttattatagctattgttttctcctagacacaagtatttgttcttggatgtttcccctctcttctcttaatattcacccgtcccaaagtatggtgttattttgcagtttttagttgtcgatatgcaatttgagcttcaaccattacatccagtaatttatattattatataccttgaaatatacaaagaacagctaaaatattacgtaaaataatatttactaatatcatttttattgccaatctatcaatgcggacatctcgatatatatatatatatatagtaaatttgtttggtgctccatggtgcccgggcaccattgttgaaattgagtatatacccaattcaaatgagtatgaaactttttcaattacttaggtattaacattaactactttactaactagttcaaagcatgtttgtactgaatttgaacttgtttttgttagattttgattctaggtatatagcatccatacatataattagttaggtatgtaatcatggattgtgaaataaagttaaatttgagttgttttgttgataggtatagatatgaatcgaattattataactaggtatatactcacaatttgaaaattttgaaaaatttgagtgattttgtacattagataccatggtgcccgggcaccatggtgccccatatgagtgtcctatatatagtatatatatatattttgttccaatcacatttcacataccacagttttgtatgtatgtgctcagacgtagttgcttcttttggcaagctcttgtacattactcagtagctaaactagattcttctaaaatcaatctttaaaaatctaccatttattggttgcatcttattgttttggtcatgcagtgtatataggaagtgtctttgctccatcttacctccattttatttccaggtttctttactcagtacttcctccaggagatgaagatctcaaaggtgatgaggttcagaccattataaaatttaaaaatgctcttgggctcgatgatgtagatgctgcaaatatgcacatggaggtattgcctcatgatccaagcccctttatatcttacttgcctgagacgttcttcctactttagtgccattttcacatttcctccattactccttatgccttcgactttgcttgtatagattggtaggcgcatatacagagaaaggctggaaacaagggaccgggatgccgacatggaacagcggcgggtacgtttttgtgctgtgatacataaatggatgtttaaaactttctactgcccctgatgataactattgtaaatattttgcaggcatttcaaaaactcatatatgtatcaaatcttgtctttggggatgcatcaacattcctgcttccatggaaacgtctttttggggtcactgattctcaggtattttattatgaaatagtcatcacccatttaaactgtgcatagcatgtcggcattttctgatttcaccccatggagaaagcagatggcaaccttagacaatattctaattatttgtgttgattttgaattttagatgcaccacttccctaacataacattattgcaactgtgactacgaaggatctctagtgtgctgtacaacctctttgcattgttttgtgcagttctagatgcaatggttgggctagttggcttgcctgtatttttacactagatgcaatggttgggctagttggtttgcctgtattcattataatggattgcaaatttcatgctctagttatagagtactgaaaaaaaaaggcaggttgtacatgtcatatcaaattgacattcctttttcccctagcatggtcaacatgcataatttttactagcatgggtatcatagagtctcagactggagtgttgttgaaattaaagaccttttctgttgatagggttgaggatgcggattgcctacaagctctagtgcattcacatatctcgtctatcttaggacatatttcagaaattgaactgcttgtttaagccttattacttgtgctcatagcttctttgttttcgttcctttttatttggtgatattgtttggtgacactaccatgttcttcttgcagattgatattgctatgcgggaaaatgccaaaatcttatatgcatcacaactcaagtctattgggagaggtatcactgaaatgcatatctttgtatttgtaggcaccccacatccgtatttgttatgcttacaagcttcagtgtaattatgtcagattagagacttagggcagtgcatatagtgatgctatcttattttttgatacactaattacttgatcggccttattgcatttgtacaacatttttaattttgacattctgttttctctaggtcttgacataggcacgcttatcgaagtaaggagagcacaacttgcatacaaactttctgatgaggtactgttttttctttctcgcaattcttctacttcatttggtcttacatcttaatataaatacctggggaaattacttagctaagcatgcatggctgctcagagtcgtgtactggagactagacaagttactgtattttgtttgtggacataaatctcagtatgccaggataagaaatgtggtatcaatctaagcattatatgttactaaatagcatattgtaatgtttaaattccttcagattgctgctgagatgttcaaggagcatgcaaagaagttggttcaagaaaacatttcgtcagctttggacatcgtaaagtcgcgtaccaaagcagcgtaaggaatctacacctctatggtgaattgtctaagcctacggattgattgccgttgacagttgacataagagcctgagctaacacctatttcctcttttcccaaatacattttgtttcaaactttgtttcatatacatgttgcagctttaaattgaactttttacccattttcccttaggttgattgataagtattatgtacttacaaatttacagtttattatttcatggcatgaatggatttttacctcactcctaaactatatgattacaggaatagcccaacacaggttattgaagatgtgaagagcatccttgcttttaatagcttgctcataacactaagcaaacaccctgatcaagatagatttattcgtggtcttggacctatttcgttaggtacggtgatatatctttttgaaatcatatgttaatcaggtaggactttctcttaaggctggtcgttgtgcttttcttgtataggtggagagagtgatcatgataggagggctgatgatctcaagctactatatagggcctatgcaacagaagtactatcagatggacatctggatgatgagaaggtgattccatgcatcctcttgttataatcccactttattgctaaacatcttgatgtaagtacaccggtgctgctttggaatgctgccaatcaatggtggcaaacctaactcatttaactctgcagtctagatcctgtaccttgtactgttattcctgatgccactggaactgctgtttacggcagtacttataaatggtgttttagttggaacataacatatcctgaatgcacgaaaaacagtctgccacctgttgttaaaaactaggagaagattaattgtgcatctatttagtgtatcaagatcttagcaaaagccagtattgttaacccttgaaaagcagagcaagaagctgatccgagacaatctggttcttgccataaccgaagtgtcatttggaaaaagcataataaaccattcttattgccagatgacagttgtgaattatgtaacattggttcagtgtcttcaatctacatggacactactctcctgtatcgtcaacttggttcagatcacttcttgaaaattgttggtctaagtactcaacaaaaattctcatggtgagactgattaactatacccagttggttgtgtaataacatgtgctacctctatcccaaaatacaaggagttttagggttggacatgggtattaagaaagttggtgaaattagttggagaagttgttatattttgggacaaattttgaaggctagaagttatattttgggttggaggtgttccattattgttctgtaaatggtactagcaagtactccctccatattttaatgtatgacaccgttgactttttaaccaacgtttgaccactcgtcttattcaaaaattttatgcaaatataaaaatacttatgtcatgcttaaagaacatttgatgataaatcaagtcacaatacaataaattataattacataatttttttaaataagacgaaaggtcaaatgtttgtcaaaaagtcaacggcgtcatacattaaaatatggagagagtatatccttgctgttcaaatttggttgttattagttcatcttatatttggtgcatggattatgacccctgaatctaagtttataaggtatcaagatagcatcttaatagaagccttttaatctgattacaataattcagctcgctcctttgaatcaactgaggaatatatttggactgggcaagcgtgaagcagaatcaatcatgtcagatgtcaaagctcaagtatacagaaagagacttgctaaatcatttaatagtgagttggctgcggcccctagcaaagcagcattcctccaaaatatctgtgaagagttacagtttgatccggaacttgctagtaagatgcatgaaggtaccttcttgacaccttctcttgttacactataattttcacagcatacctgtgcttagctcgactgcctagtcatttattgaacggagaactggttttcacctgatggctctgtgcagaaaatcactatacaccatcagctctatgttgacactgctgaattgttatcctagaccgtatgtaggaagtacatctgtagcaattcagttgtctgcattttggttcatctgggctgtattgcttctcatgattaggaatggatatccaatagaaaagaaataagacaaatgtggtgggactagaagtactatttgtctctatgttcatgttaaacagcattactatttgtaagataagatattcctcaccattccatcttaaggtacatcatcacatgctttaataaagcatcaaagtcccagaaatgctatcgacaagtgtgag

SEQ ID NO: 77286 - DNA, 13857 bp, Oryza sativa
gagggagctggcgggggtgcagccgctggtgaaggcgctgccgccggtggcgaggccggtggtgaagctgccggtggtggccgcggcggcggcggcggggtacgtggtcgggctccgcgcggggggcacgcggaccacggcggtggcgggcgcggcggcgctcggggcggtcagcgtcgcgggcgccgcggcggtgaactccgccgtgcccggggtcgccgcggcggggctgcacaactacgtcgccggctccgacgaccccaccaagctggagagcagcgaggtggaggccatcgcgagcaagtgagtgttggatttgcagattgctcgtctatacttgctgcatttggttgtgtgattttttatttttactcgtttacttctgaaactcccatttgctgttagaatgctagtaaaattttgttctagcttgtttatgcaaattgaacaacctataattatcaggaggaggaggatttttttttttttactaatgcgagctaaaaattctgtttataaaatgagatgcatattgccatacctataaaattaaaattagaattcatatattgaatgtatctctcttactccgtcaaatgatccttttactatcaattatttttagatacggcgttagcacagaggatgcaaccttcaaggccgagctctgtgatttgtatggcaggtatgtatgtttccttctagaaatcaatcttaaacatgtcctgtttttagttcagatccttttttttttggtcttgtagtatataagcatttgctcatcttgttctcatgtccattttattccaggtttgttttctcattaattcatccaggatatgaagaccttgaaggtactgaagttgagactattataaagtttaaaaaggcccttgggttgaatgatatagatgctgcaaatgtgcacatggaggtagtgccccaagatctaggcccttttatttctaactgtctgcctcagatatttcttctactttagtcttcattttcacatttccacagttttcccttcctcctcacttctttcattgcgcttgttgtaatagattgctaaacgcattgatcgcaatgctggtgtaggacaacagcaggtacgtggttgtgctgtgatatatacatgggtactttgaattttctattgatccgatgataaccattttaaatatttggcaggcatttgaaaagcttatatttgtaacaaatcttgtgtttcgggatgcatatgaatacctacttccatggaaacgtcttttcggggttcatgaatctcaggtacttaattaaaataatcatcattcgtttaaaccgtgcatatcatctctttgtttcatgatctcgtcatatggagaaagcaggggatcattagagagttttaatcatctatgctggtatttgaagtctagttgcacaaattctctgacattgttaccactgcaattcttaaaggcctctagcatgttgagtaatctctttgcataatgttgtactattgtgctgttctcagtgtaatggttgttgggttatggctttggccgaaagcctacactgtcaaggtcagcatcaggtcacatgtattggcaaataatattctccacttaatcccaaaaaatgcaacttagagcattgctcttgccactgtaacattattagcaattaaatgcaaattttataacaatatggaagtctgaattatgacaattactccaatattattttcttgtggttaatttcaatatctacaatttgtaaagttatcagctataactatgaaaaaaaaatacatggcccactgtggcatgctggatatggtgcatgtaatattatgtgatacaacttttatccccacccccccccccacccccaaaaaaaaaataataatgctcaacattttgcatgctggatagaaccaaaaaagaaaggatgtgcatgcgataaatttgaaagttatttataatttgtcctggcttggtcaaggtgcaaaattttgaattgcatgggcacaaaatgattttcgagttttatactggagatgtacttgaaaggggagacctctcttgggggaaaactttgttcttgccactagaaaagtatgctgttttttgccatcaaaattacaccatttcatttttgctttccaaaattttgcgcttatctaattttttccatcatcatcaaaccctgctagttgaccattactactgtagtactatggcgtttgactttcacatattttcttactaagaccaaaatgcctctatcaaattgtgtgcccaatttgtcagcctttacctctcttttgatgccctttctcaccatttctctcgaagggttggaactttcagtaaaaaaattcagagtgcaccaaaataaccaaaactacagacttctaaaagcttaggtgcttttatctacaaatttacaaataatttattttttatcaagattttagacgaattgaattattgaatgattttcatcaatttgaatgagtcagtattttttagtgtgacaatttcaacaaattaaaatttggtattgttttttgaaatattaaatgaataacaccaaatttggatgaaggggtgtgttcatgtgatggcaggaacttcatctgactataacgcctctttgtcaattatgtcggtgcgagatagaagtttgactaagactttggttagctgtattggcaaaacaatacacacaaagatggtgcagacgaaataaggaattaattttgtgtcaaatacaaaaaccggtgcttgcttattactggcattagttagtagcctatgcaaactttgtagtggcatgaacaaaatttccttatcagcaatgagtatgcagattgcctgcaagctgtacaaaatgcgcattcacatatttctcatgtgcttttgttcatattttagtgcatagcttcttttgggtttatatcttgtttgatgataagattttatttagttacattattgttgttttcggcagatagacgatgttatgagggaaagtgccaagagtttatatgcatcattgctcaagtctattgggagaggtactgagacacttatatttctctttttaaggcattagttccatccataactgtcattatgtatactagattcactgttacagagtatttatgtctgaacagagacttggagcagtgcagaactgcagatagcaatgttatctcctgcttgtataattatacttgatagactatttactgcatttctacagaaatctcaactcaacatattctgtttctctaggtcttgacataggcacattaattgaagtaaggagatcacaactagcatataaactttctgatgaggtaacacttttcctctgaaaattttactgcttatttgcttttccccattttttcgttcattttgataaatacttgggaaaataccacttatatctaagtgtgcacgcttgccaagatgtcagactctggcgtttggacaacaaaaaagttttctatatttgattattcacataaatcttaaatatgatatgtaagatgaatggaattcatataggcatactacgttgttaagcggcatattctattatttaaatttattgcagattgcttctgagatgttcagggagcatgcaaagaagttagttgaagaaaacatttcaacagccttgaacaacttgtaagtcgtgtaccaaagcaacgtatgaaatgcacttttggacaacttgtccatgtgaatatagattcactacatttcataacatgaatggatttggcttcataaaccatatctttacaggaataaccgaacacaggttgttgaagaagtgaaaagcatcctttcatttaatggtatgcttacagtactgagcaatttcccgggagaagaaagatttgtccgcgggcttgggcctattacattaggtagagtggtaaagtatttcgaaattcatgtgttaatgaggtggcccttttctaatgctggctcctgtgctttgctttgcacaggtggagacagtgatcatgaaaagagggtagaggatctaaagatgctctatagtgcctatgcaatggaggtactttcagatggacatcttaacgatgacaaggtgatttcatgtataataccatcttttcagtttactggtgctgcttatgagatgccaagctgaaatgaggctgccggatggcaaattcaattaaccatctgcgttgaaacataacattgcaatttcaccgacccttaaaacatagcagcagttgagacagtctggccttcgcaattgtgaattatgtcaagcattagttcagtggcttgaatctactagcacatggatactagtctggtcttaacttggttcagctcagatctacgttatttgttgaaaatcggtgatcagtatctagatggagattctcatgatagagcccagatcattttactggtccagctttgtgagaatgccaaagacagagttcaatacactttacccagttgattgtgaaataacaagtactgtaaacacttgtaaataatgcagtcaatccggaccaagattgcttgagcacataccatcaacattttgttttttctgttgatctgcttatacttaggtgcatgcatgctttatgacagctgcgtctaacaatttgttctaccttggtagcatgatatcatattaaccgaatcctttacatgattatggtaatgcagcttgcggctttgaatcaactgaggaatatatttggactggcgaagtacgaagcagaagcaatcatcacagatgtcaaggctcgagtatttcagacctactaaattctttaacaatgagttggctgcgaccccaaagaaggcagagttcctccaagatatctgcgaagagttgcaatttgatcctctcaacttgcaagtaagatgcatgaaggtgccatcctgacaccttcccttgttccaccactagtttcacaacgtagctgccctgaccgccttgaaatctgggcaaattgagaactgggtttctcttggtggctctatctatatatatggtacttagagaaaataacattataatattgcaggccctattccttttcaatatctgcttatactatgtgtaaatacactctaatataataatattataataattagaggcctctattcccctctggctggcttttgtatttagaggactgagagaactgggacagtactcactgattgttcatatttatgtattagttcatgtgttgtgtatactgtatacatagacatatttggttgtttttgggagtgtacatatctgaaattggtagcaatttttcatgcgatgtggtagaagatatactagttgagaatggcagctggaagaactggaatctgcatggaaattggttcagtttcaggctttcagcagcacaatacagacattcagtttgcacttgttcctgtttgggttatgtaatctgaagaaaggaagatggataattgatcatatagtactttgttccggtctgtatgagagtgtatgcatgtatgcttttgttgctgacagttcacttgtgcaagcctcagcatttcttgcttgtaacacatgataatcacaatggtatggaatgtgtgtgttcaaagaacttaatggttgaactgctgggatttgttggtggcaatgattaggaatgaatcagcaacagagagaggacaaatatggttggaccaaaagtactattgtcccttatggctctcatcgtctcacctatttcaaagaattcagttaggaataataatactccctctgttactaaacatttgacgccgttgatttttttaaacatgtttgaccgttcgtcttattcaaaaattttaagtaattattaattcttttccatcatttgattcattgttaaatatactactactactcaagttttttaataatattcacaaatgtttttgaataagacgaacggtcaaatatgtttaaaaaagttaacggtgtcaaatatttagggatggagggagtaactaataagaggtcacagtaactatggatttagttttttcctctttgaaaataaaattgccctgggatttgttggtagccttcgtctcttgagcttatgctatacatgttcgtacatccatgcgtgtattgtgttttccttgttatataaaaaggggaatacctatatgacattccctagaaaataaccccgaaatatttcaaattctggaccgttggatcactttgaaatttgtacaactattctcaaccctaatctaccttctctccctccctaatgttgagttattatctatactttcccaactcaccccctcgttttccctaatgccgaaaggcgccactggtgcaggtgagcccacccccaaccgacctcctcctccctcccctctttttcccaagatggcggtggcgagtgcccctaccctgcaatcttccctgtctcttacggctccccatcactactggccatcacttcctaatcacaagcttcgctttgcccctaccggcaacgctgacctaccttccttcccatttccgtggctttggtgtttttgttggtgcctcgttgttcatgtccaccgtctatcgtcggggcgccaactcccatagccatccctctaagtccggtgatcttccatctctttctccttccccatctccaacccatgccaaccctaacccaagaccttaaatcctaactagttggatcaccatcgatcgctgtaacaggaggagttagggttgttggaacacaaattgtgaaatactccctccatctacttttgatagtcatatttctaaatctgaaaaatttatttttgataggcatatttcaatccaacaatctatccttgaatttctcgaatttaatgcgtgactctccatttttccacacaagattggctacagggacaccgagaaatgtaaatactaatgaatcgcttgtatacgaaaaatgactagtagcatgtttgaatgtatgataagtagaattacttattcttggtctgtgtgtcaagatgaaatatgactatcaaaaatagatggagagagtaaatcttaaggtctgaattttgcaatattggagtcctaatttttcgtcggatgtgatctgccaattttcacggagaatactaccttaatataaaaatatagcaatctttgtatagttgattatggaagtcataaatatattgaaatactcaagacctcaggatctgagtattgtcaactgatgaagaacatggagagcatgaagtcacgacctgagtttagggtcgcagcttagacccacaccaccacccatcaataattccactcccctcctaaactccccacttcccccagcattcacgccgaccgagtcaccgacacaaacgcgcaataatatgtcctcacctcgacccaaaaatcgagaaaaatcaccccaaaacagaacactgtagcatcacattactactatcacacatcactagaaaacaatccaaaccacaattgcagcaacactattaccactaacagcgatcatacactactattaaactaaaaagagaaaaaaaaacactaacagcgatgcaaatgcaagagaagctgccatctccttcctgaaaagtcgtgcttaattagtgggacgggtgacgagcaaatcactccaaaccttgcttctcctcctcctcctcctcctcccccatctccggcgccgcgcgccgccgcccggaggagagcttctcgccggtgctgctactgctactaatccccacacccacctgctctcagctcagctcagctcagcttcccagctcggcgaagaagatgaagacgaggagctcggggaggggaggaggggagccgaggaggaggctgaggaatgcggctgtcatggcgctcatgctctcctccctcgtcgctctctccctcgtccgcgccaggttctcccccatcggtaatcgaatcgaatccccccatcctcctcctcttcgccgcttaattgttttttgttggatgctgctatggtggcgaggagaaggcgagagctgattcggagttcttctcccttccttcgcagctagtgatggaggcgaggccctcaagctcaaggccgacgaatccaagctcgtcgtcaccaccaatcacgccgtcgtcaacaccgaatccggcgactcctcctcctcctcgtcgtcggcggctggtaattacgagatgcgtttcttggatcttgagcggcgcagtgcagcgcattgcttggctgattcgttcttggcgatttcatttcgtatccgttttttcgattcgagtttagttcaaacgaggactagaggagaggaagaaaaagaggaaaaggaatcgaagaatccatgaattccactggctgtttaataactaagaagaaattgaatttgtttttttttttgcgagttgttgtcctagttcataatttatttcttgggctttttgcggagtttttgcgctaaagaatggcgtggattcggctgcgagattccgcgaccacagatctaattaaaaccgattctcctcgtgttgctgcagcggaggaggaggaggaggtcgccgctccggcgaagcccgccgccgccggcggcggcggggccaggccggtgtgctacgagacgagccgccgctccgacacctgcgaggccgccggcgacgtgcgcgtggtggggggcagccagaccgtctacgccgacacgcttgaccgcgagtggaagacgaagccctactgccgtaagcacgacgcgttcgcgctgtcccacgtcaaggagtggacgctcaggccgctcccctccggcgatggcggtggcggtggcgcggcggtggcgccgaggtgcacgacgaacagcacggccacggcgttcgtgctgtcgaccggcgggttcacggggaacccgttccacgactacaccgacgtgctcatcccggcgttcatcaccgcgcaccggttcggcggcgaggtgcagttcctggtgagcagctacaagtcgtggtggatgaacaagtacatccagatcttccagcagatgagccggcacgacgtggtggacgtcgacgctgacggcgacgaggtgaggtgctaccggagcgcggtggtcgggccggagttccacagggagctcggcgtcgacccaaccaagacgccgtcgggctactcggtgctcgacttccgcaagatgctccgcggcgcgttcgggctggaccgcgccacagcgacgccgagcggcgaccggtgggacatccgccgccgaccccgcctcctgatcatctcccgccgcgccgcccgtggccgcgcgttcatgaacgagcgcgccatggcggacatggcggcgagcctgggcttcgacgtgcgtgtcggggagcccgacgcgtccacggacacctccaagtttgctcgcctcgtcaactcctgcgatgtcatggtgggagtgcacggcgccgggctcaccaacatggtgttcctacccgccggcgccgtgctggtgcaggtggtgccatacggcaagctggagtggctggcccggaacaccttcgctgagccgtcgtccgccatggagatccactacctggagtacgccgtgcagcttgacgagacaacgctgagcgagcagtaccccgccgatcacccagtgctgcgagaccctatggccatccacaagcaaggctgggaagctctcaagaccacttacctcgacaagcagaatgtccggccgcatctcggccgcctcaagaacaccttcctccaggccctcaagctgctgccccatgacaaggaaaccatgaattagcttagctcatcagaactgttgatcgtcatggattgtcatcggcaccgtcatcgccatcgccatgccatcgtcatggtgacttgaatttgtggtataaatagatagataggtagctaattttttttcttttttcaaaattattagtattttgtattgatccctagcaagttgccaagatcaggtataatcagtagcttatctgaaataatccgttgcaacgcacgggtatttggcaatgtctatagaaacaatggtgatattgtttgtatgcaccatatttcttaacatatcaagtaagccaaattatcttatactagcagaaacccatattttcatggatttcttccaaaatgtcttctcctggcatatgtgtggttcatgatcattattttgcattggttagtcaaggttgatggcctgttctgtgttagtgatgtttttgcaattgtcaggacttctcaggttgtcatcaaggaagcaatttgcatgtgtttgatgaatagtatgacactaatagacaacatgttgatgtgaaggcagcacatggtctgaagaacctgaacagggaaggtgtcatggccatcatcttcagtaaactcaccaaattattgctgagaggcagcttatttcttattttcagtatactcctactaactttgaatcaagtttatttctgtattgccagatccaaagaaagctgtatcaggagaatgcaatggtctcccttaacactgttgttaagtgagcttttcgctgacattaaagaagaaccagcagctgctgacactgaaactgagactgagacatcaagtgcaacatcagaaattaatcaatgagatgatgatagatctgaatgggaacgactggagacattagacattaaggaaaacaaggcatatggtaaaagtgatgctggaaaaggttcaagccagaaaagagagaagacttgtgcatgagcatcaactactactcctatgtgagagtagtataaatggagacaagagagacagaggtgagctgtatgaacatcctgatgttctgcatcactgtagagacaactgaatccgaatgatgtttcgttttggatctgcaatccccacaaagaatgacagttcagagtcttcaatgcgagtaagcgaaagatgttgtcattgaaggcatttgtgcaagagtatgggaaacattggaaagagcaccgaaacccatccagcgagataatatatacattccagaattgcaatttagcgcacgtacgttgccagttcaatattttcagatgaaagtttcgtattttgaattgaagtttttgtaattcaaaaaaaataaagttttaaggtcacagtcgaaagttttgtatggtttgagttaaaagttgcactgtttgagttgaaaaattcttgtgaaagtacaggtgtatgttagaaacacatgttcggtaattagcaatccatttctctctgattatggattaattctttgtacttccgtcttgtagttatattgtttctatgctagttttgtcatccccacctatctaacaagtagtggccactatctaccttgtatgtgtccatcattgatgaccaacactgtactggaatgagaagctatgtttgtttcatgcacaccatacaacacaccgtttatcctaccatcattgatcagagcttgagagtgatgatttagttttaatcagtccatctaatataattatgctagtattaagaaaaagaaggcctcccctattgtttccagtaaaaaagtaataataaaaataaaaagcaaaacctatacattcatgcattcagctacccctagaggccttgtttgatactccgtttcatattataaatcatttgactttttttaagtcaaaactctttagatttaaccaagtttataaaaaaactagcaacatctataaggccatccccaacccagaaactatccagtagtttccatacttaccatgtcatatagatactatgtatagaaactatatatctaatggatagtatcttcaaattaaattctcatctaattatctcccttctctctccttttatccacctatccttttgtcttcattcttagttagatggtttttttcatgataaatggtttcttcgtacttttatctctctccttattaactctattgccacgtcagatttttacttatatgttaatgtatttaacaataaattagtttcattaaatttaacatttaatatattttgataatatatattttttattaaaattgttactatagtttttttacaaacttaccaaatttaaagaagtttgaaaaaaaaatcaaacgacatgtaatattaaatggatggagtaatgcctaaacctcggcccatttatgggatagatggaccgggcccaatgatcggtaggccgctgcagctgcaagtgcagcagcaagacaaccggacggcggcgatgcagccgtcggcgagttggctgggtaacccaaactcccaaagtgtagcgtgagagaatcagagagagtaacagacgttggctttatcttttttctttctttctttctttctttcttcattctttttctccttttcctttttcaataaatccaatctgttccttggtttggaggctcaagaaagcatcatgctttgcgaagactgctgctgcgtgtgtcttgagcctcaagacgtcctctcccaacaccattagctggctgccaaagtgccaagtgattgggtgatgtgtgtattaaccatattttcttcaatgaaatgtagcaatcactatgggcaacaatatgaggcatgcttttactcgcaaaccaaataatctccaacgatatgaattttatctttgttataacaaaagcactaaaaattgtgcttacatttgtgcatagtgttatatatttaagtatttaatgcaacacttgtaaagtgatagtaataaaatatatggagtataaaattacaaatcatctcttctaggtagtaggaaaaatagggtcacttcaggagtggagaaaagcttgacggatgaccacaaaatcacagaaatatcgcaatcacatgaaatgtgttatggacacttataatagacatcgaaaatgacttctgagaacaaaacaaattgtagaaaagcaatgctatgcacgacatctatatatatacatcccattcaacatcgtgtgtgagaggtcataattgcgagcctaatttttctattaaatttcacatcttttaaccaaatgtttcaaatactactgtaacatttgaatgttgagaatgacgtgtaataagtagccatcatatgaatgattgctcatgtacgacataggataaactcatctaacatacgtctaattgtgatcgaaataaaccccatatacaatacgtatttaccactatttatctctcctagaaatcaccatattattcacaggccaccatttatagatgtgcaagctaaactctctctcaccaccaccacctccgtcgttcccgcttgtccctccagatgcgttattgtttacatattatttttcatctcgtatgatgaatttactttcacactattatatttttctcacccttaatgactttattgtagagattgacagtatgtaaccttctgctcccctttgttttcaccgtagtctaacaagctagtgcccaatattgacaatcataattacctccttctaagaagaagaagataatcgcataaaacaaccatcaatacaattttagaagtataagtaaccgagtaatcctgactaggagtttggtttcgtggtcttattggtggaaaacatcacacacctcctctctctctctctctcgtatttcttttagtgtgtctcacgtgtcttttggggtgactcccatgtattcactctatttattccgtgtaagttcatttgatgtaatatatttatgtgagcaattcattcctcggtgatccgtctaaaaaatactccctccgtttcaggttataagactttctagcattgccc

SEQ ID NO: 77287 - DNA, 2161 bp, Oryza sativa
ccgccgccgtgtgccatcgccggtggggtgggcggaggagagggagacaaggggctcgccctccggtttaatttgcgcgttcaggccaggggatatcccttaaccctcttcggaatagtattaatttattaatctctctaaggctatgtttagttcatataattggtgataagtttggagaaaatcggtagtttgtaaaaaaagttgagagtttatatgtgtagaaaagtttaggatgtgatgtggtgtgatggaaagttgggggttgggggaaagtttggtgtgaacaaacagggcctaaatgccgtgggatcgctgtagatccgtgcagtctattttgtcatttcgctgttgatctcaatcatatcttttatttaacaactaactcatttttcggaggacaacgagtgggtttgtgaggtagctccaacatttgtaacacataatgtagcttagcagataatgcaatacgagaatgaaagaacatgtaacgagacaatccttattcgtttgacaaaacaacataatgtagatacttcattatgctatataaggattcctgtattaaggacaaagagagtttttcagactttataaaaactgtgtttgattttgttttttttatcagttatttgatgtacacatgcccttcatcccaatataacttggattattatacgattactttgcgtcaacaccattcacaaaatagtatgtgacaactaataagatgtttggtaatagttggatataattgatcactacgatcatcttaatgcaatatgttgacactattacccgattagatacttaaccaaagtagagtggttactatacattaacacatagtgcatgtttggatcatgccctgacaaatcacgcttgagcaaagcatcattcccgagcgtccaatttcgtacgcctatagctagatgcacatgtctaggcaagaaccctaggtcagagcactatccaaatatgacatgtactcctggacatacataaagaccccctctcttggaaaaaaaaagttaattgcacaatggctaggtatatttacaaaagttttatattggatcactctttagcaaatgtttttactttgagttaggtaatcttacctctagtgtaatttagactcgttatctccatcttttcatctctccctcacctctggcttcctatatttgccaccatcattgtcacccatactttagagttgctcgcttagcccatgccatccacactttgagctcgagctttgtgttgccggtggcctcttgagttatgttcatgtgccgtgtcaatgtttattttgagttgaagtcccccggcgctgtggtgctcatgcttgaaatccatatgtgctggcccctgatcgggcgcaatctctattaatattagcggttaacatagacaatggggaggataagagatatgaatgggagaaaaggactttcaaagcaatgttatgttctaaatcgtggagatagcatagttgatgcctttttctagtcattgagcgaacaagcagttcaaaccatggaacaaaattgagagaggggggctcgatgacttggaaaaagggaagtgagtcagagttagcaataatagcacgcaatggatgattcttgatgtagcatgattttgtactcatagtggacgacgacaccgtggcggtcaggagcaacacatatatgtttttgttgggagcatataagataatgaaaaatagaggtgacgaggtagggaggaagaagataagtggctaacatgtgaatcaacagaccaaagtgtaaatgtggtaacaataggtagcaataaaatgaaaatattggaatgcaacttacttaaaaataaaaaagaaaaagaaagaaaaaaaagaagaggaaggcacaggggagggcacaggaggaggagatccgggtccctccatccctcgtcttcttccttactcgttcctccttcctcatcaccaccatacgcgaacacgacgacaccagccagcaagcagcggaggagagagagagagagagagagactccatagacggccatcgatcgtacgcgactccccccatccatccatccacccgccggcgccccctccctctcatcgatcgatcgattcccaccgccgcccccgttttgaccacctacct

SEQ ID NO: 77288 - DNA, 27437 bp, Oryza sativa
accccacaccaccaactctcaaaattctgacatgtgggatcactgtctatcccttctccaaaccaattgtatgatagaacagtgaaaatagcgaggtatgtcagtgacccagagaggaggggacggcgcgtggtgagctacaaggcatactcagtggagggcaagatcaaggcctcccgtccgtagtggactccgctgcatcaaggccaactgctccgaactgatcaatttatggtacggatcacttctcctttcctttctttttcaccttaagcactctcttgattcttcgctgctacctcccttaatttctttcaagatattgtggcacttgatcatggctgagacctaccttccagtgtgaaatggattttgtcaaagaacttattccattagcttattttccgattacatggaagacattcttttctggaataaatacagaactaaatcctatttcctgaataaaagttatgtggtgtgtggcatgctgcatttctgcgcttctaaattttataaaacctgttcattcaatttgaacctgcatccaatattttaggtgcagacaggtgcttgcgttcaggttaaagaagttggcaaaaatgcttctgaagaaaggttaattgttgtttcatctcaggaggtaatatgcagatgattattccaattgtcattgccttgccatttttatcacgagtctttacaattttatatcttcctacatattctttccagattccagatgatccagtgtctccaacaattgaggcgcttattttgctccatagtaaagtaagtacacttgctgagaaccaccagttgacaacacggcttgttgtaccatcaaacaaagttggttgtattcttggggaaggtggaaaggtaattactgaaatgagaagatggactgggggctgaaatcccagtctactcaaaagcagataaacctaagtacctgtcttttgatgaggagcttgtgcaggtaatttatttggccatacctacaccagagatccatatattacttttataactgcagcttttacttgttaacatttcattgtgcttttacatttgttccaagctttcaggttgctgggcttccagctattgcaagaggagccctgacagagattgcttcgaggctttgaactaggacactcagagatggaagttcttccaataatccgacaccttttgccccttttgatggtcctcctgttgacatcttgcctaacagggaattcatgctatatggacgatctgccaatagtcccccatatggagggcctgctaatgatccaccatatggaagacctgccattgatccaccatatggaagaccaatatccacaatatggaagaccttccaatgatccaccatatagaagacctgccaatgatacatcatacggacggttgaacaatgatgggcctcgtgatccttacaccgtgtatcctgtagagtacttctctaaaagagagtaccgtagtggaagtagcaaagtcaccatctgcttcatacgacagatatgcagcaactactcgcttgcctagtagagaactgccctcatctattagtcctggtgccgattatatgtcccgccgttcttatcttgaccaagtacctactgataggtactctagtagggtacactacaattaggcctctcgagagctgggaatagtaatgtgcaacaattaggaatcaccagagctggaaattccaatgcttatgattatactgaggtacatttccaatgcgttagcttgcctcttctttgcaaatggccctcgcctgatatgtttccattagaaacatgaaaccatatatatgactgttgcattatgtctattttcttccatgatggttcagacgtctgaaaaaaggacaaaaatattctagaatatgtcatggtggtccaaatatatccttctgtcttgtgcccactctaatatctatcattggtaacactattcaattgttaccatgttgttgcaaaccctagattcagttattcagctgttctctgctactgttgcttaccagttttcttagttgggtgttgatcttttctcattttttatttccttgtttcctggtacacctgatgcctctctgatgcatctgaatgtatgtttttgttctcttcagtgcttaatagatttaaatttcattcttttcaggctgcggagcagatccatggacgtgaggattaccgaagactgtcaggtctcactgggtatggcttacgcagactgaatttttacaggacacaaacatgaattttgtcctcataatcattgagtgatgatctctttgcaggtatccaggtggctctgtcgaattgcggattccaaatagttatctggagtctgtgactgtctgtcattggtgttggtggtgtcaatctagctgagatccgtctggtatagcgtatgcgaaacatcatgcactatccccagtcttaaccatgccccaatggccaccaatagttttcctcatgaaaatctccccttgatcccggatctgtggtgcgagagtgaagttgcacgaagcccatcctggttacaaattatttaataattaaacatgttacaaattaaagaagaaataaaaaaacatcaaaaattataaaatgtcaaaaaaatcaatgcacacgactagtgtgcttagcaatttttttatccacaattacttttacaatattataattaattttgttagaattattattataatatagaaaaaatagttgccaaagtttctcaacgaatatcgaataaagtaaaaaatatcatatatttaaatatgatggtaatatttgtttgcaaaactttgatcttcaatccttcaacagcatagatatacaacgtcgtaatcaccaacgagcccgagtgaccatacgggatagccgagcggcggatctgcactgtccttgggtgaaataaatctagaacattgtatatcttatcttaatctctactattagaaattaaagatgtttttgctcaagatttccgtacgttctctacttcgttacaatatcggttttgtacgcccgcacacgcgttgtgtgttctctggtagagatgcaagtggatagtcctgctacccgtataaaaacccgcttcctagttcattttccacatgatagtataaaatttagaagaaaaaataaactataaataaaataagcaggctgaaaaaccccgcttgtccactccgtttgcatccctattctccggttccaatacatgaagtgagtgtcttgcttctccctggtctggcaggccctttttccaccatccccacccgggccggcgggttacattgaccgatcatggcccacattatgtgatgaacactagctgagttgaaatttatcctttgatgattttcagtatgtttttttttctccacatcttctctttcaattttggaaaaatattttattcttgatttttgtgctcgtacatcactaataaatcagctgttacccttccacacattgtcaatttatcatgtctatttcagctcttaccttagtatagtcttgagtcatcgctactgactggctgtgttcgctaggagaagttcccatccagaacagtgattgtgaaaaacggaacggtttattagcgcgtgattaattaagtatttgctatttctttttcaaaaatagattaatttgattttttaaagcaacttttgtatagaaacttttttaaaaaaacacaccatttaaaaaagcgtacgcgcgcgaaaaacgagaaagaggggttgggaaaagctacgtgcctcctacaaatcaatagcctgccataacaatattttctacgacatgatccatattaatccatgcaatgcaagcacacacgctactgcacgaaaaaactacggtccataacttcaaaactaacatgttagaatgacgttaatttttcattgcaattatattcatcgaccgttaatttactaggcagcctgtttaaaaaaaatattcaccggccatacccacatgttccgtagttcattaggtgatggatcggtagttacagcagactatggtaagcaatagctatatatacacgtatatgcattgctaatccttcaattttgtccaattcttttagattgtattcacctattgtaacgcatgatcatttttctagtcttaacctgaactaatcttaatcttaataaccaattaaaagattcgtaatttttccatcgtcacctcggctaatttttcatcggtccaaaaaaaaatccctgttgttcctttccatcccgagaatcgagacagggaaaactgaagcatatacacacaaatatatccaaaaattcccatgcagctagatcgaagggaagggtgctgttgtcatcgccaaaccgccaccgccgtcgcagggacgccgtcggctcccctatcgctggatctggcggaggggagggcaccgcccctgtccgccgcctcccctcccaccggaagtgagggcgtatgtggaggagagaagaagaaaaagagaacataaaggagagaaggatgaacggtgattgagagaaagactgagaggaagagagagctcgggaataaaaatgtggagttaaggatcggtggaagaatcgaggtgcgcggcactctctccgctctctccgagcggttaaaaaaaggacaatggtaaatttacaatttttttgaatcgttaccgtaaaaatggcaatagaaacttgcaaaaataccactagaattatcattcgagtggcatccttgaaaaattgaaaaaaacggtggcaaatttacaaatgccctttaaaaaaaccacttataacttagtactttatttataaaaatggtatatcttatcttaactacttaaattagtaatttttcgtttgtcacctaattctttcgtccgtaaatccgtttttcggccgtatgcacatttgtgttggcgttcatccgtcgttcctttctcgcaatccaattcgagcgacacaaccagccaaggggctactaaaacgaagggaaaagcaaggatggattggatctggaccctgaatcggacaaataaccacgataaaatccgctggaagggaaccatgagattgcaatccaatgaaatcgatcaatcatctggtactttgcctcggcactgggcattgatcccctaccgaatttccgaccacgccgtgcatgctctcgcgcaccatgaggtggctgacctcatcggcgtgcggtggccgccacctgctccacgccgcctccggcccccatgtcctcgtcgtcgagacgcgccacgcacaacatcacgagaagccccctcgccatcagagcgcatgccttagtcgccgccgcctccaccacgccgcacacgtcgtccgtaccggcgtatctggctcccgtctcccccacaagcggggcgggtctcccacctccctctcttacaccgtggcatcagctaactccgcacggaagcttcgccgtcatcgctccaccaagccgccctcacatctctcgcttagaccagtgcgtcatacaacacgagctggccggcttcgcttcggtcgtggatctccactgtcaccgcctcaccggggctcaccgaagacatggacgacatgaatacgtcgctcatggctgtgttgtgatgtcatcgctgttgctctgggtggtcgccatcgtggactcatggttcgctcacttgaggcagaaaagtcacggctaatgggcatttttttttcattttttacaactttttttatttctaaagaatatatttttcttgaagggcttatatcatgaaaaactaaatcctaatcatctaatattttttataattttattttacacgttgcatctatttattaaaaatgtttaaataataaaaaaattctcaacctgtcccctctgctctttttttctttgtccctgtccgctctttttttttacttttttattttttttcctcactgtctaatctttttttattttttttcatgtctacttattaatatttgacctcaaatacaatttgtaaataaaaaataatacacgctctcacaaaaataataagattaatttttacgatttgttaaactacacacattttcttcaggtaacaatacacaggtatattcccacaattgcaaagtgagtatagtttaactggatgggtttcttgtggtggaaccagtcaacatggatttaaatctttgatgaataaagagcagcaccgacttcgaccaacaggagtagagctattacctatcatataagggggcacgaacctgtataaaaattcttgtctccatttcttttaccttaatctcgtatacaccctggtaccgacaatccccataccatgcaaatactatagttgtgacctcaaaggtcgacagtacaattgtagtgtaattacatgttagtctaactataactactacatccgtggctccgtaaaaaaaaaatctaagcatggacaatgacggagcgtgaggctcctcaccgggagactgcgcaggcccccctttgccggttcggccggggactcagggtgagattctaagctctctgtatgtggaaggttcgctagaccggaaacacacaagacacgggcgatgtatacaggttcgggccgctgagaagcgtaataccctactcctgtgttttgggtgatctgcgtatgaaggagctacaaggtatgagccagcctctcccttgttctgggttcccaatctggaaaagtccagtccccatctcagtgggcaaggtcctccttttatatcttaaggggataccacatgcaccatttctctctttttttgtggggacttaccccaccttttcataaatggacggagatttgtatagttgccgtccgagtcaccttctgatgagacgggccacaactacctccactttcgccgggagcaggtgcgacgtggaatcgtggctgtctgctgacgacatgaccggtgtcagaccagtcacgtcggtcattcttgtccaccacgtgtcagcttagcaatctacatgttcgcccttcttcacacaacatcttgcctgcaatggttaggatgaagcctggcatatatctgaccaggactaacgtgccatctctgggaggtaacacgctagctccagctggggacgagcgcctagaagccctcgtcctgacgggatggggcgaggcgtgtgtcagatcgcctgtcgccacctaacccgcgatctgaccggtctgtgactggtcactgaccggataaactagtgcactgcattgcgttacatgcggcgtgacacgctcagccaaaccgcaataaatgtggttaggtgagccccactgttctcacctaacccatatacgcagagcaaagacccacgaggggtcggggcgcctcggccctcggggccgaggcgggtgcggcccgaccccctcgggggggactaagaggagggcgaacacatcaccctcgggcccgacgtccctcggaggtgccaggccacgtgtgcgattgtgtctgcctcaaacctctagtcatgatactcctgatcccatgtcaccgacagacaacaaatctggacatgagcacgtttagattcgttgtcctatgtaatgttccatccatatcttttttttcttaaggggtacatgtacttactccatcccagaatataagacataaccacttttcttctatgtctcataatataaggcatgcatacatgcatatattaattatcatctcttggttctttaaatttggtttattttaattcatgtaccattaagtctcctaatcacattgctcgtatgtatggatgtgattcaatcaaggaggtgattaaattctttcttggtctttatgctagaagtggttgtgtcttatattttaggatggagtgagtaatatttatataagttatttttaatacttatatatgagttattataattatagtatagatatattgaaattatattaaagttgtactatagttagatttaaaagtttttgttgtggcagtttttttagatagtctaggggaaaaaaaacaatacaccggttgcgttttattgcaggaaaatgcggccaaaaaagatgcacatataaatgtcacggcgagggtgattctcaattttggccaggtctaatgaatgtcaaatatactgtcttacatatgggttcttggattgtgaatgatgggaatcaaataaggttctgggaagataaatggctaggaaacttggcgtttaaagataaatatccatctttatactctattgtccgaaggaaaagttctactattgctaatgttatgagttctgttccacttaatgtttccttcaggagatccttatttggtcagaatcttatatattggcatgatttgtgtgcttccattatacatattcaattaaaccaatcctctgattgttttagatggaattatcatcagaatgttagattttctgttaagtcaatgtatcttgctctaattaataatggttatattgagagaaataagattgtttggaagcttaagatgccacttaagattaagatctttatgtggtacttgcttaaaggggtggtgctaactaaggacaatttggcaagacagaattggaatggcagtttaagatgttgtttctgtatgaaaaatgagatcattcaacatctttttcttgactgtcattttgcaaaatttgtttggagagtagtacagttttcttttggtttaaacctccctggtaccatatctaatatgtttgatggttggctttttggggttcacaagaagatgagtaaactcatacttgttggagcatctaccatttgttgggctctgtggttgagtaggaatgatatagtttttgataaatcaccatctatctcatatatacaggtaatattcaaggcaacatattggctccggttttgggcaaagctgcaaaagtgtaaagatgatggagagtttatgaaggttgtatgccgtaaactggagacgacggttatgcaaatatttgcgaaccatggatggagattcacaaatagacttgaatgagattcacaaatagacttgaataaatgtgtgctccttttcttggcttggtttttttatcgttgggtgtgtttaattttatttgaactttactcgttgtttgtgtgattccttgtaataattggctgtagctctaatgagcaaaggcagggatatttattccattatcaaaaaaaaaatgtcacggcgaggacgcccggagagccctgctcgccggcggcgagctcgctcgctcgctcgctcgtctcagttggcccgggacgagatgaggggcttgagcaggagcatcctgcacgagtgcggcgccacgtcgagggtgatcttctccgtcaactcgccgccggcgccggccaccgtcgcgtgccgccacaggtccctggcctcgacggcggtgccggcggggaggccgacgtcgtcccagtgcgcggtgatcgccgccgcctccgccgcgtgccggttcagcagcagcaccgccgtcctgtaacccgacagcggcgccgcccacacctcgctgctgccctccatcctcaccttcttcccctggatgcccagagcatctgaattcccaaaaagatcaatccgacaagcgccatgaaaactctctgaattcctgaagctcgcggcagcaggaagagtagagtaccttggttgacggcgatgacctccttgttggccaggatgtcgtacgtctcctgcgacatgtgcctcacgtcgcacccgatgatcagaggagcctgaccaattcagagaaaatttcgatctgtcaaacccagcaagagcagaataatgcaaagcagagtagtatatcaccgttcttttctggtcacgatatagattttatctcagtttttgtaaacatgtttttaaaactgttaaactatttggtcttaaaaacctttctatataaaagttgttttgaagtattacataaatctatttttagagtttgtaataattaaaactcaattaatcatacgctaaccgatgataactttctttttttctttacactattttcatcgtcatctttagtagaaacgaataccatcattatccgacatccgtcacatttggtagtaccttggagatggcccagaggctgaaatggacgatgtactcgtcgttggtcatcccgccattgccaacctccagcatgtccgggtctgacaaaccacaaattatatgcctaagtttagacgaaactgtagcatttgaaattcagacatggattgaactgatgatacagtaatatgattcgtcagtgattcactgaccgttccagccgccaggtcgcgcgtagtccgcccacacctcgttctcatccgccctcgacaccatgctgaaacagaacgaacacaatcacatatgaaaactctgaactctgaacactgatcctctcgtttcttgcatgtcatttaaatagttgaagacggcggttcacctctcccaggtgtccgcgatgtcgttggtggttctccagctgttgccgtacgccgcgccccacttcgccgggtgcatgtcgcccctgatcaatccgacaaacacgacagctcgaatgatgaacacgaaactgatcacagatttttctaatatactgatgtgtaatctttttgcatgttcgccaaaaaaaaaatgatgaacacgaaactgatcacagattcagaggttcagagaaactaatacacatcgagttgtcctaacctaccattcgcacagcgagaagtagatcggccggccggccatcatcagagccttgctcatctccgggtacctaccattggactacttgtcagagaaattcacgagtcatttttcagacattcagtatcgacggcttcagaaagttcagacaggtagtagcaccaagagtgatcacctctccagtggcttcaggtcgccattgttgcagttatcatacttgaggtagtccactccctgcgataatggtgtaacagaaccaatggatcaagaaggaaatctttaacactaaaccggttcttgaaaaaagaagacactgaacacctagataaaaccccaaaaaatagacatgtttctgaacatttcagtgtgattcagtggctcattctcacccacgatgcgaatgtcttggcgtcctgctcctcgtggccgagagaccccggctgaaccttcgcacacgtcttgaatcttcagaaatttgcacgcaagaatcagttaaaaaaaacaaaaaatggagattggagcaacaaacagattgatattttgccacagattatttgctccatcttctatttctactgcattggttaaaccacctattgtaatctatttgcaaagtttatttttcaaaatattgatttttttatgttcttggctcttaccctgcatcggagtaaatgcctagcttgagccccttgctgtgaacataatcggcgagcgccttgatcccgtgggggaatgtctttttgttggccacaagattaccctgggacagtatcatcaatattaagtactgtggatgaaatttttttttgtctgcctttaatcacatcaactctgttcattacaactacagtccagaagaaatcgaaattatcagtgctgcattatcacacacaccttcgaatcacgttgtggctctgcccagcaatcatctgaaaagtttttttatatatataaaaaaacacgattttattatactcagtcaggtcaagccattgacgacaatatcatagaatatcaaaacaatcatatcatttttctattaacaatatgattttattatactccaattcaagccattgacaatattatcctataataacaataaaaataatcatcagaaaagttttttaaaaaaagaacacatgattttattatactcaatcaagttccagccatcgacgacaagtaatatcctagaataataagaaaagggaaaaaaagggttagtccaagaagcaatgacgtatgcatgacgcacgtaccgatgttgacgtatttgtagccagcagctgcaagcccggttgacacaagtgcatcagctgctcagaaaaaaaaagggaaaaataattaatcaagattcaacaaaggctaattcatcaattattctgtttcagactttcagtcaatcagctcacgctggtagtaggatactactagtacaaatgtacagctgtaaacggcactgccggacagaaaaaaaaaagaagtttattactccaaacaaatatattgcaaaaaaggatttaacaaaattaattttttgttatagaaatattattacattttctctatatgttttaccaaacttaaaaagaaatttgatttaggacaaaatcaaaacatcctacgtaaaataactgaaattaccagtctccctgatgacgtcttctccgttgccgtcgcaggcgaagtgattccagctgttccagctgcatgaaattcagaagcttaaattaaccaagatgcagactcacaagcagaaaggcgctattgctcacatgacaggatagcagcaaagattaaccattactattactagctaactacgcttaacaattagaattaacattggattaattagatacgctaaattactgcatgcttagtgacgatgtgagtgattattattccttaccccatgggaggagccgtggcgaggccattggcgagcatgctcctccggtgctcctcccccacgtgcaccacccttccgcactcgccgccggcgatcatcgccgccgcggcgcacgccaccggaagcagcaccgccgccgccgccgccatcgcctcggtgatcaagaacggcacagctcgccggcggctggctgctgctgatcagctcgagttaagaagagaacgagagtgaattaatggcgctctcagccagtgacgcggcgccacgtgtgcgatcccccgccactgacgcggcgccacgtgtgcacctccatcgaagccactggaagctagagtacgcgtgataggggacacgtgtgcgcgaaagggtaacgtggggcccgccagtgggacccacttgtcggcgaccggaagcttccgaccgcgtaggcgtaggcgtcgatcggtctgatgatctgatcgttatcctgatgaccgagtaggtggtaggtcgacgtacggatagaacggaatttatttctaccgttttcctggaccgcgatgacgctgtccgtaggaagcccgcagagctacgctgctgctgctatcggataaggaaaactgatgaaaaacctctaaatataagcagttcaaaataatttatgaataaactcttatacagtaatgtaaaaatcaatgataggtgtgtttggaaaaccagttgtggctgcagcagcatatttgctgcttgatgcactattgacttgtaaacataaaaggtctgttcgttgcaacttttgtgcagctgcgcagttgtagctgctacagtgactatattgcttctatgttgtagctgctgctgcagcaagctgcaccgaacaggatcaaaagtagacgacgagggcatttagaaggagaggaattgtatttgttcctggtatttaatttttaaatttgtggtcggaagtttcggaagaaaaaatgtgctcatgagtgattattggctctgaacaccaacctctcttttcgttgattccttctgaggtgttgggtgttgggacacgatgctgccgccgacacgacaccgggttccacaatacactaatctactcgcgacaccttcattgaactgcatataattatttagaaagtccattaacacatcttataaaaccttgttgaatcatataatcattctacaaagtctatttgaacatcttataaaaaaataagatctgacctagtcgttacactctcttacattttccattagcctaactaattccgtgcaggaaacgcccaaaaataatagtaccaatagtccactaatcccgtgccagaggccgccaatgattagtgattaacccaaaaaacataatcatcatcacacgccgctaatgaccagctctcgcttagctaatcccacaggcggcccccacacgccactcctgccatgtgggcccacctttcacaccccccaccaaccagaaaaaaaactcccccaaaaaaaaaacttttaatgcttatctcgcggcagtataaaaggcgaccccaccacccacacacaatcacagtcagcgacccaacccaacccgagccgaggagtcgagtcgtgtgaaaattacgaaattgcccttcgactccaccaccaccacccaccggcgaggcgaggagaggagaaaaattgggaggaaaaaaaaagggaaaaagaaaaagggtggaggagatttttgcgaagctaccgagcccgacatgacgccgcatctgcccgtgtcgccgtcgtcctcccaccacctgctcgacgcggcgccgacgccggcgtcgccggcgcacgcgcagcaccggcggcggcggaggaggaggatgtgcggcggggggagggggagggggggagggccccatcctgtgaggtgttgcgcgcccccggcgccgcagccgagggtggcgacgggggcggaactgcgcggagcggcggcgacgactagggtgttcgtggtgtccgacctgcacacggactaccgggagaacatggactgggtgctgcggctccccgtcggcggcgggggaggcgggggcgacggggtggggatcgacgcgctcgtcgtggcgggcgacgtggcggagacgcgggacaacttcgcgcgcaccatggccgcgctcagggagcggttcggggccgtcttctacgtccccgggaaccacgacctctggctccgccgcgagaacggccgctacgtgagttggatttctccccacccccttttccgtttcctttctttcccacccctttcttgtccgtctcggctttcgctgcaagcaaggtgtttgacgaaatgccttggcctagtgattgatatgtactaccgttatttattaaagctacatgagtagttatgttagtgaattcgatcgaatggcatgacatatgcctacttagtgcttccctttatgtagtactagtaagttgcataagctgatacaagaaatcttagatgtagtacccagtttattgatgtcattctgaatcttgtcacttctttctggcagtattgtccagctaagctgtatttcagttgtgaatttgatgacatgttgatagtactggttcttgcttcatgacaaagggtgacccgtttgtacataagtaatggacattattaacacattagttgcgacatggggaagctgtttgatagctattctagctgttatacatgccgcaaagcatgacgaacagcacaaactatgaaatgagaactctactgttggatcatagctagtataacagtgaatttatttatttattttccttttgactgcagcattaatctttcttttgtacattgcttgggctgtctcagttactcaagttatttcttccagatggattcgctggagaaactgactgcattgcttgatgcgtgtagtgagctgggtgtggatacaggcccaagaataataggtgacttggggatcataccattgttctcatggtatcacaaggttgctaattttccagccagactgtaatgcaccgtgtttaataggaatatcctgtttgctcattttgcttaattgtcttccagagctttgacaaggaaaaggatgttaacagtgttcgcgtcccttccttagagatggtaactttcttttcccccaatggcctgatatgctattcactgttatagtgcaaccactaggagtgtcaattagcattgattaagatttctggaattccatgctgtcaatatgatatcccttcaagtgttattcatatgtaacctgatccaaaaccatgctgtgacctgggtgacaaaacaatcattagattgataccttgctttcagtgtttagctaccatctgaatttcatttttgcaagcagcttggccaacgttttgttctgttttgttttgatttgtgaaattggatatgttaatacgggtcttctttccatgggcactaacttacattgatattatgttactggtttgaatgatcaggcttgtaaagatttccatgcttgtcaatggcctccagacctggcaaatgaagatgaagctcttgctctctactttgacaaattgaatgacagaaatcaagatgcaattgaagaagtaaaaaagagcagcaaacagatactaacattttcacactttgtaccaaggtgagtgcaagtgcctcctctagttctatctaggatcccacatcaccaaaagttctccttcgtaataatttgaggatattgtttctttgatggctaccatagtactacctccgtttcaggttataagactttctagcattgcccatattcatatagatgttaatgaatcttgacacacatatgtgtctagattcattaatatatatatgaatgtggacaatgctagaaagtcttataatatgaaacggaggaagtaccatacactgggtgtatgatgaaacttgatagtctcctcacaaattctcactgagctctgtgatgtctgggatatctgatcgcgctagcagcaagtcttgtaataccatagtaatgccttcttttcaactctgcagacaggaactatgtccagagaagcggatgctttattatccaaacctcccaaaggtcatcggatcagattttttggagaggaggctgagaactatacatgacaacactaaacatggagccgcttgccatgtttttgggcatacacatttctgttgggattctgtggttgatgaaatcaggtataacaatagatgcactctctgatacaatgtatgaaattagcaatccttattctgactggatacatcttctgaccttaggtatgttcaagcgcctttggcgtacccccgagaaaggaagcgaaggatgaacggaggagacggttggctgcccttctgcatataccgcgatggtttcaatcctgaaatatatccagctctatggtctgactactacaacaagaacagaagggaaccagagaatactcagctcgctccatgggttgccaaatatttttccaagtactactgaccccctacaccgatccaagtcccttgggttcgcgacagattggatagagttgagccgctcaggacagtgtcaaagcagctgctgcattttcctggaagaaaaggagattgacgttttacctgtacatgtcttttgccttcttttcttgtttccactcttactatatgacttttgggcagggcaactaagctcgccctcctgtgatgtatgttggaaaaataatgtgtaaagattctttaaagcccttgctgcaaagatagtgacatgctggaaacattagctagttctgttcatccatcctgtgtaactcatttggcctgtctctttatctgcaaaatcaatctgcgtaggcgtgtagcctcctcactcctaaactgaacgaattcagtgaagtgatgcattggccaaaatttagctaatgactgacgatacgatactaactttgtaactacactagcatcaagaacaaacttgaaataaagttacttctacttgtatatgtttttgtcatgaaattaaggcatatgaaatagcagaaactctcgtatgaaaattgaaaggaagaaaaaaaagcctttgcagttccttcagaaattgttatgcacctcttctaaagtgaagaacccatcacccacgcaatgaaaacgaagcagtctattaacacgtgattaattaaatattagttattttttaaaaaaattagatcaatataatttttaagcaacttttatatataaactttttattaaaaaaaatacgccgtttagtagtttaaaaagctcgaaaacacgccatttagtagttgtttgaaaagtgcgcgcggaaaataaaaggggagttgggaacaactgttatcaaacacagccttattccccctaagaaagcaaacaggccaaggtccatgatgcgtgcattctacatttgtattgggctggatttcactttataatggaaacttaattatttatcattacacactggtagctcactgttcatacggatcatcatccgagtaaccaaccaacaaatgtacatgagctgatctggaccgtccatcccagcactggggcaagcaaacacaccaccccttattaaccacttaatcacactcacaaacaaccacacacacatagctaatagatattgtagctggaggtcgccggcggcgggtctagtagtcctccggcgccagcggctggtgcgcgccgccgtgcggggcggcgtcggctgacgggatgacgaggtactcgtagagaagcccggcgaggccggcgccgacgaaggggccgagccagtacacccagtggtgcctccagcgccagccgacgagcgccgggccgaacaccctcgccgggttcatcccggcgccgtcgaacgggcccccggcgagcatgttggcgccgaggaggaagccgacggcgagcggcgcgatggtcccgacgtgcccgcgcttcgggtcgatcaccgtcgcgtagtacgcgtacatgagcccgaacgtcatcgtcgcctccagcagcaccgcgtgccagtcccccacccccgacgccagtgcgaaccccggcggccgctgcacgacgtcgccggcgacggcgacgagaaggtatcagagaggaagcttagctagagagagacatcaaggtatatgtacgtaccatgccgccggtggtgaggcggaggaggagggtggcgacgacggcgccgaggagctgggcgagccagtagaagagggcgcggatgagggagaggcggccgccgaggagcgcgccgaaggtgatggccgggttgacgtggccgccggagatgttgacggccaccgccaccgccaccgccagcgccagcgcgtgcgccagcgacaccgccaccagccctcccggcgtgctcatgtcctggtacagcttccctgcacacacacatcgccatgccacatgtcactcccgcgcgccgccgcggctgccatggatggaagaaattatcaagaaacgagtgtgtatgtagtgcgtaccgagggagaggatggagccctcggcggcgaagacgaagatggcggtggcgaggaactcggagatggcggcgcggatggtgtccgggtgcgtcgcgtcctcgctccgccccaccgtgaaccgccgccctggcctcgccgccgccgtgctcatctccacaccgatcactcactctcactactcaccaactctcgccgccgtccggtccgcccaccgccgccgccgccgaagccgcgccttatcctagctagcctcgtctcgatcaccaagtgcgcagtacagttgggggtgtgaagcagctggatctcgtcggccatggccgcgtcgcggtgagcttataacgtggcggagccgggcgcgcgcgcgcgacacgtgtgcatgcgcgcggggcgaagcggtggcacgtctcgccgccgcgacgatgcgtgcgtgagttcgtgttcatctctatcgcggggggagtggggcccacatgacaggtcaccgccacgtcacgcacccacgtacggacgcgccggggagtaggtatcgtctcggcgtctctccttcaagcgatgggcgcatctgatgcatggatgggaggatgcatgggcaacgctgtgctcgcggtcgatgagacaaaatcataaaagagctttgattgatttgatttggaagtgcttaggttcgtcttgtgattaaatgggaaggggttgaagtaatgatgtggatttttggctttaatttggttttattagccggtaaatggatgagttcttttttttttagggggggggggggttgtttgggtgatttgcaagtttagttttgctttaagttgttgattctttcttcttcttcttcttcttcttcttctggtttggagggattagtattgcttaaattggactaaatgacgtggatttagccatcccgtgttgcttaatttttgtctgcgatgttgtgaaatgtcttgtatgagccacatggattgaatctccattctccagcaaggatcacgcatggtttgtatggcttgcactttagtttgttaagattaaagaggatttttataagtggagtgtactcaagctaaagtagttgtacaccttccgtttgaacagacataggcacctctgggtagttgagtttttttcccccagaaaaagtttaacaagactaatgggccaatttaaaaaccgatcaaatcccaatctcaactttacattaagaaaagattaagcctcctttgtaaatgggccaaatcctccttcccaagatgaacttcaaatttgaactagaattctggcccatgccaaacgaggcctaaaatcgacacaaacacagctacaaatggatacaacacttctcccggcaaattctgtgcagagctcaccgcagcgcgagctctcgccccgccgtcgcctccccgtctccggcggcggcggcggagccggcggcgatgtcgtcgatcatcctgacgacgtcgtgcgccttgggccggcgctcggggtcgacggcggcgcagagcagggcgacctcggtgagcctcagcatgtcgccgtggcggccccggtcggcgacgatctccacgtcgaggatgtccgtcgaccactcgtggctcagcgccagccgcgcccactccgccaggtcgccgtcctcgtcgacggggaccttcccggtgaccacctcgagcagcacgaggccgaggcagaacacgtcggcgcgggaggagagccgccgcctcccgcgcgcgagctccgggcacttggccgccgcaaggcggtgcgcgtggtgcggcagcagcgggtggaacccgtggtcagtcagcttggccaccggcaccgcgtcgccgccgccgcctccgcggccgccgggccccgggaagacgacgagcacgttcgacgacttgaggtcgccgtgcggcggccggtggaagagcggcagcgtctggtgcaggtaggccagcccccgcgccacgcccttcgctatcgccaacctcgccggccatggcagcggcgtcctcccctctcctctgttctctgcagcaaaatcgaggatccgatattcctttatttttatatgtctcttaaaaagtcacagaaaattttaaaaaatttagtaagatagatctatacgtgatttatcactccacaacacatgcaaattcaaattcaacttatataaatagaaacaaaaataacaaatttaattatgaatctaacgcgtaattcacgttcaaatttattattattttttaaattgtacaagttaaattttgactcatatatttacgaaaagatatatcataatttttttaaaaaaaattgataattttttaagctgcatacacaaaacgagaggatatcgtcttgaggtaaaaaatcacacacttccaaaaatcgaaactcttcgtcagatcagtcgccatggcagccactactccgatcaagaatggccatggactgaccgtggaggaggtggaagaggctgcggccggggacgtggtcgtagacgacgagcttctcgtccttggagaagtagcaggcgacgacctcgacgacgttctcatggcggagcttgccgaggagctgcatggtgtgggcgaagtccttgcgtggcacgtgccccatgttgcgcagccgcttcacgacgacgacgaccgggccgccgccgccgccgccgccgccgccggcgtggagggcgacgcggtaggtgatccctagccggcccttgccgagcatctccgccgtcgaacggaacagctcgtcgaggctgaaggtcgccttctccggccggaagaactgtagctgatccgccgctcccttgccggactccgtcgtgctccggcttccgttgccgctgccactgctcaccttcttgccggcttgctccgccgccttgtccttgatgtcacctgccactggtcacgtcgccgtcaatgactcgtcgagaagaaagcggcggcgagcgaagtggagtgggttttgtggcgtgcttacctgcggtggcggcggcggcggcgcgaccgccgccgagacgaaccacccggctcttcttgctgtggtggaggaagatgagcaccgcggcgaacggcaccagcgcggcgatgagcgcgatcaccacgacgctccacctcgctatcctgaaccggatgggcttgcgccaccgcgccggcggcgcggcggcgtcgcgcgccccgaagacccgatcaccaccatcgctgccgctgccgccgccgccggccggcgcggcgtcgaatggcgagccctcgcggcggcactccgtcctcacaacctcgccgcagagcctgaggttgtgggcgaacgcggtggcggggaaccggcggagcgcgcgggtgtcgggcacctcgccctggaggaagttgtacgacacgttgaacacggcgagcccgtcctgctcgaacgccggcagcgtgccattgatcaggttgtcctggagctcgagccgcgtgagctcacccagcgccgccgcgtacccgcgcgggatgggccccgagaaccggttgctcgacaggtccacgacgcggagccgcgccagcgcgtcgagccgcgggagcgcgccgtggatggcgttgtcgcgcagggacagcgtctccagccgcgccacgccggcgagcgcccccgcggggagcgcgcccgtgagctgcgcgccgtcgagctgcacgccgaccacccgcccgtcgccgtcgcacgccacgccgtaccaccggctccgcccgccgtggcacggcggccccgtccagttcgagtgcaggtccctccccgaccgcagcgcgtcccgcagcgccaccagcccgccccgctcgtcgcgcaacgcctccagctccggctctggccaccccacaccctccaccaccgccgccatcgccgccgcaagaatcaccaccaccaccatcaccacccaaacccatgtcgtctcacaccttgtcccgatcatggcggcgttcttgaagccctaaaccacgtcaagaaacaccataataaacaaatggatcccaacaatggcgggacgatgcttgccgggaggagaagaagaagaatgcgacggcgaggggagaggcgggaggaggaagaaaccatgataagaatacatggagggaggaggagtgagatttggtggtatgaggctacggattaggtggtggattcgacgtgaacatctcgatggatcgatcggcggtttggtcgcggttgcattgacgacggctcaaccgatagccttggagaagaagggtgagactcggaagagttgcaaagaaactgaagtgctcagttgggtgaagcttccaactctttcacctatatttccacatgagatgtgtggtcatgcaaattgttttgagatatatagcacatgagaggtttggtgcttgctgatgattcatcagtttgttcaattctcgtttccttttactattatttttaatttatgatccaaaaatatatggttttgcactattaatttctagattcaaaacgtaggttgtgtgccgtatggcagaggatgtggatataaaacattaattttcaattatatttacaaaatgtattttgcaattttttaaagaacttttcgtgactatttggttttttattcttaattgagttaacaattgagaacctgttcgtttcttctaaggctagaggataaaattttgcatacttgtggcacgtttttcaaactgctaaacagtgtgtttcgtgcaaaaactttctatataaaagttgttctaaaatatcatattgatccattttcaagtttgtaataactaacactcaattaatcacatgttattactatctcgttttatgtaaaacacttaatatttatcttcagaagattcaaacaccacctaaagctgaattttggagtaatcatgatgttttaaactaaggatttaagaaaacattaaaggtttgatcgaattttatcctacaacattaaatatttctgaccagatggtgatttttaggtacaattcacaactattcggttggtgatccttggttgagttaacacttgaagctgaatctagactactactaatcaggatattcaacttgggtgcaactccccaactgatcctgcagctctgcaccaaccgtaggatggcagttgcaggacaatcggacggccgcgaccacgccacgtggcgaccgatggagtgacgatcacgttgggaggttacggtacgctttgctctccccacaagccatcaccgtaacatggaagccaactcatactttggtagcagtagtagttagcagtagctggctggataagcagagatatcagaagaggtccaaaagaattcagagacattcagacaacacacaggctttatctttcacatctttatcttttcttttctctttctcactatcttttcatccctttcgggttccggagaagcatcagggatcaggggaagggtgtgtgtgtgattagtgtggggtgttcagaggctaaacccagtgtgtgtgaagattattagggcgtagatcgctgtctgatcttgtgtattgcgattttgcggcgagtcttttgagatggcgagatcgtgcttgaaagcgctggaggtttgcctgcaggatgttgcacttgcattagttgcatcctcgtgtcaggtcccagaatgactactactagaagctttggtgctgaattatttggaggctaacatgtggattctgacttaagaatcctgaagccgctgccttcgcatctgtaggagtactggtccgttccaaaaaaaatctaatcctaacaataaatctggatacacatgtgtctaggttctaggattaggttaggattaggttttttagacggaggggatatttcagttgaaggatatgcagccatgcaggtgtttcatacttgcattataatgtcagaagttagaggtcagaattggctaatgcttactacctccgtcccaaactaatagtcgcttcgaccttttcttgtaacgtttgactattcgtcttatttaaaaaattagtgcaaatataaaaatatagaagtcatacttaaagtacttttgataataaagcaaatcacaaacaaaataaataataattctataatttttttaataagacgaaagatcaaaagttaaaaaaaaaaaacttaaagcgacgagtattctgggacggaggcagtaataagtatgggctacgatggttttagctatattactgatgagttgtgaaacaaatgaacaaatctaacttatgggtaaaactttcgtatctaagttgcgatggttcaaaaaccgaggcatctcatgtaaaaaatagaccaatatactccctccatttcaggttataagatatttgatttttaaaagtcaaactgtttcaagtttgactaagtttatagacaaatatagtaatatttatagtactaaattagttttatcaaataaataattaaatatattttcataataaatttgtgttgggttgaaaatgctattactttttttctacaaacttagtcaaatttaaagttgtttgactttgacgaaagtcaaaacgcgtcttataacctgaaacgagagaagtataaattactgcaatattaaattttaaaatccagatttaagggccagtttggattgctaaaattttggtagagtagcacatcaaacatctctattaaaatactgcttatgccacaaaattgactttgcccatatacttgtctcttataggcatattttgacttcaatacaaatgagtatttttaactctaccctaccaaaattttggtagtgccaaaacttacctaagatttagcactactaaaattttggtaggacattaatccaaacatgcactaaccttcaaaactaaaatttaagatttagattttggctacggctaataatctaataagcatacatatacttgcctgccaagatggtaaattgatgtctttgtgattgacacatgttgatggttatatttgatggatcgggcgttgtaagtgcttgcatttataatatgtttctaaaaaaacatattttattcatagtaattataatactggtggtagaacaccgtcattagatacggtcttaaaaccattggacgcatgtacagttatgcaacatcaaatctgatatataatttacgagggctgctataaaacagaatccgttacaatgggatagacatattaattattctctcacacgaatatcacaggtatcaggtcctagtaatcacaggtaccgaataacaggtatcagaggtatcgagtaccatgcaactgttaccatacacaggtatcaggtatcttatctaggttttctgatgatttataattccatcaaggactacatgattttgttttccatattattaccagtatcatatggtagcatggtcagtacattttgcaacactgatacacagtggcggatctcagacatattctgtggggtcgtctgatcccacagttttttagaaaacacttgattttcatgtataaatttaaaatgtttaaataaatgaccctaattaaatacaaactaattgacctcacgggattaaattcctaactccaccactggtgacagcctgacacaaacactacaatttgtcagttgaactgaattttttcccctttttagaagcatgaaaagagactgactggccaccataatatttcaacgacacagatagcacataatcacatgaaaaatggagagatactgcagatactctaaattctgaaaacgacttgaattttcagagtgtatatatcggagcaagaacaaagcagagaaaaatcacaaaaatcaaaacgctaccacagccacactctcacacacacatatatccgatcgatttggcgccaattgcgagacgcacacacgttagaacccaaatcctccctgggcctcgagttccaaatccccaaatccattttctgaaccagtaaaatttcaaaaccacccaatttgagacaaattcctcaaaaattcagaaatcacaaaaccacacactgacccatcaaaccgggaggaggctttagccgtttaagtcctctcgcgcgccgtcgccgccgcgctcgccacgccacgccacgccacgccgcgcgcgcgcacagcaatggagctctcgcttgcctccgcgaagccctcgcctagcgccgccgccgccgacgcggaggcggtggcggcatcgtcgtcgctgctgtcgctgcgggggaagaggaggagggtggg

SEQ ID NO: 77289 - DNA, 1082 bp, Oryza sativa
tagggtttgggttcggattttttgattttattttttttgggatttttattttacgtgcaggtgatataagcacccgcacgtggaaatcagatttttccgtgcggtccacttaacctgaccacacggaaagatgtattttttcatgtggttgatcgcccgcatggaaaaatatttattttcccagacacctgatgcagacgggtaagatctctgtagaaaaaacactttttgaacccacggaaaaatgcttttcgtagttgtgttttacgctagtcgccatgggatgcaacgaaccaggtaagcagccaacagttaggctgtgtgtgaggggaaggctgttttctccgataattccaaaaattggtggctagtggccccatctttttgacacacgacgggcaaagaatttgcatggaaagaagcaacaatattactgcatcagcacatatcttcgcgcctcattaaactttagtagcaccttaaatcctgggtttgatttttatgggagagaattttttagattttaacggttttgtgcttttagtggcatgtgatgcacccgtccacaacgagacgtctgtagtaacttcgtcagtctttaggatttatcagctcagtcttcaaagatgctcgtaggagtagggtttacgtgcgtgcgtttataggggtgagtgtacgtatgttgtgagtgtctgtgttgtactttataattattttaaaaaagcatatatcttcaagcggaacaatgtcatcagccatcagccacttgcctttctgtttctggtcaaccaaagtggccgccataagctagctctagctatagcatacttgaccaagagttatggagtatatagctgacatacatcctgacaaaagcaagagcatacatggatgcagggtcggataaagaaaacaattagggagagacatattttttaatcatagaatttattcccatcttttctttaaaaggctataatcaatcattatagagattacatggacaatgataacaagacatactagagagtgaagaatcaccaagtccaattccgtacattgtactggttgaattaaccatt

SEQ ID NO: 77290 - DNA, 777 bp, Oryza sativa
cgttttccgtcggtggtgatttgctgcccaacatgccaaacatctgccatacttttggtggtgtatgtatctagggactaaatttcatatagaatgtttatactaattagaagtattaaacgtaaactaataataaaactaattgcataaatgagagttaatttgctagataatttttttaagtctaattaatctataattagcacatgtttactgtagtatcacataaactaatcatagattaattaggctcaatagattcgtatcgtgcattagtacagagttatagaatgagttttatcattagtctacgtttaatacttctaattagtttcaataatccgacaggggttaaaaattagtccctacatccaaaacaggatcttaccttcatgtaccttcgtgtataagatcaatgtgccttacataatataaacgattggttggatgagatttaacatttactcgctccatctcattgtaaatgtaagtttagaagtgagatgagaaaataaaatagaaggaaaattatccaaaataccccctattaaatgacaaatggtacggagtgagatggtagctgactgtaagacgaacagaaatttgaattaaatgtgattaatgtcacaataataagtagtatagttggattgtccttattttgagacaaaatttaaatatagaattgtatttatttaaatatatgacccgcacctacatggataatacctatcgatttatagtgactatgagtaatgcaaatatgtcttgttttct

SEQ ID NO: 77291 - DNA, 1271 bp, Oryza sativa
acagttgttgtgtccactgcccttgcatttgtacctgcatagtaacctaagttcacattggtgggttcgactgttctccagtaaattcttgagttagaaatttccattttccatttcagagcaggttccatttttttgtgagagaagtaatgcagtgagataggggcctctctctccctctccctctccctctccctccctccctccctccctctctctactttgcccaagaaagcgcacgagcaagaaggaattcaccatccctccaagagttggagtcattgatataccctccaccccttaggcataatggttgtaggaaaaatgtgcactactcaataatttgcagctccattacgcctttagaataaataatattttgcaccactatcacagtatggattttggtttatgctatgtaatgtttactatttatcaaatataattagtgtcagtggctacttcaatttaaagaatgttgtgttatgtatcttctcgctttaagatatcagcgatatcaatctaatgttcttccactatttgttacaatgataaatagatttttgaagcaatcctgttgaatatagaagaccattgtagctcttgaattgttttcttattcggttgcctttctctaatctgttcttgtgccaggaatctctcatgtttcttatacatagcaattcatctatatggaaaaagcatggcaaccctttaactaaagttatttttctttaaaagaaatccttactgtggttagtcttttgacgaggctatgtgaaatgacttttttttttttgcttttggctatttctgtcattaacaaccttttcaattcaatagatgatggaaagcaagaatgttcagaaaatatgattatgcctgttctgacagtttattataccttctaattttaaatgtacttcctaaatttttaaacgtgccttgcacgtgcacgattcctagtcttaaaaaaagaagcagctggtaattggaggggattgtaattgaaattgatcgttagcagcaatctttttaccaggtatcctggaggaaatgccgacgacggaacgagaagccttccggatcatgctattgtctgctacgcttgcgacgcccgtgatgctgacggtgcgagggcccgtaggcttcctcctgacagtgcaagggatgacagtacctgcaggttctgaagaaatcgcgcaacaaacagagcaaaaaatttcagttgttttccttcttcctagtgacatcggctagggctgcaggaa

SEQ ID NO: 77292 - DNA, 8740 bp, Oryza sativa
  unsure (1)..(8740): unsure at all n locations
taaatatattgataaactattcatcttaactattgtggtagtagctatctattgtctcttgatgacatggtataaatttatagccagcaacgggctacactattaaacttgctataaatcttctcaatcaaggggataggccttagtaaattcgtgcaaagtctctgtaaccctaaggccttgttgggtttagaggggattgaaaatgattggaggagattgagggggaataattccacaccacaataggtgtggaataaatcccctctaatccctctctcaaagggattacccgaacaaggcctaacccatttttttcctcccggcactccacaaagtggtcaatgtgttgcttcccgacacctccttgaccccgcctattgcatcgccaccaccctggcctcgccggcgggacggataatttgtgtgggggagacgacaagggaggtggtgggtgttttctcttctctctctctcccaccaataatttatataggtaaggggactgtgtagtgtactcattatcatgaaacccctcctaaattcctaatatcttgcaaactttcaactattgaattactttaggcccctttgaattggaggataaatggaggagaggccttagtagattcgtgcaaagtctccataactctacggccttattcggtttagaggggattgaataggattggaggagattgaggggaaataaatccacaccataataggtgtggaataaataccctccaatccctcctcacagggattaacggaacaaggcctaacccattttcttttttcctcctggccactccacaaagtggtcaatgtgttgcttcccgacgccaccttgaccctatcgcgtcaccaccaccctggcctcgccggcggggcggaatacgccaatggcattggcaaggtccccccagccaacctcctctccctccctactccccctctctctttctcctcacagcggcgttggtgaggtgcccccgccacgccgtcggatccaccaccatcggtcgccgcctcctaaccgcacacttgctctacccctgccaccaacaccagtccacaaccctcttccatcccagtggcttcggcaccgcctctagagccttgccgcccgcccaagtccaccaccgcccacggccctccctccaagcccgacaatctccctccttccttctcccgtccccaacccaaccttgggccctaaaccctaattcattggcaagtcatcggtcgtcgaagttggtggagaaggggtcgtaagagcttgaggtgaggtcgccagagcacgaatcatgtagtgaatcctaaggttaaagatttgcaagattttggctacaattttctatcaacaggcatttagcacttctaataatttaattccttcttgagaaaggctatgttgcaatttggtcgttattggatcgggtcgcaaaagcgttgggcctagcggcaatgggctgtcacacgcacccacgcacgagataggctgtggtggtgggccaatagtcctacgtggcacgttgacctagtttttatccaacgtggcactacttatgtggcaacaccgtcaagtaaaaaaaataaaaactccaattggacaacatgtaagtgagatgaacctttcttcttcctctaaaaaggacccacatttcattccctttccactctctctcctctcttctatctttctcacaacaatcacactgacgccactctatggccgtggagctcgagctcttccttgtagtagtccgccgatctgcgcacctcgatgattgctgcttctcccctgcggtagcaagtccacacctcttgagcatcatggtccatcagttcgtgccatcccctcctcatttgtggtcatgcctccctcatcaacatcactactctcggttgcatgggcctgtgaaaggacgatgaatgggccatttagaggcaatggtagaagggcgactccatctccaccttccgttgtcgcgacatgctcctgttaatgccaaaatttggtaagattcttagtggatttggtcaaggaaagaggtcaatcaatgatggaagtttatctagaaaagaccaagttcaataaggaatcatgaagaccatggcatgacagtttaattctatctattaattaggcaagatttaatagttttccttttatcttgaggaagtgtttatctagtgtccaatcggatcaggacttgtatatttccttttttatctttagaaagttttgtctagtttccgatatggactactacccacccatgggtataaatatgtacacctggggtccctgttatatatctccacagatcaatacaactactctcggtgcatcgccaccctcttttctgatatttttatttatcaccggcggaacttggcatctgacgcggggctgcatcagcttcgatctccggcgaaggggtaagccctacattccgtcggccctggaaattatatcgactacattggtcttgttcaaggctgcatcacttcgacctcttggatcactctggtttgattgataaatttggtcgatccgatatttcaactctatcgttaattacattgtgtttattgtgtttagagatgcatcagtttagttgggactgtcttggttaggtatgatcttctgacttagctgatatatctctacaatcacaatggtgctttagatagatttgctatatccatcacattagagagatttatcagctcattgattattagattattatttacaatctcgtgctgcatcggttaggttcattctaatgttttatcggagtgctatcctataaaattatctttacattggacttcggctaatgcatattttaatcatcgagcctacattcaacattctatttcaatatcggccgattggttcattggatatttacttcgtcatattatcatcagccgattggattgattgctcaagttcttccatcatatttatataatcatttatccaagtgtcaaaatctatatccgacatacaagcgatagttcaaaaccctattgacatcagctagtatcattacatgggcttgttagccgatcgactctttgatcattaatttatatatcttgtcagtgcaggaccaaactgactggcacgccggcatctcatcaaaatttaggacctacgctcgagtgttgatttaaaaacacggtggcctgggagatctgcttaactccggtgcaggtccaaggctagcctcgagtgtatcaagggcgtgccagctgatttgatcctgcgatcagcaagaaagacaaaagcagaattagtcagccgatagccgatcgaccgataggccaatagcgtatcgttggtggtctcatccgatgtagttagaccacatcggctatggattgggtagatgagtgaatattaaaccctaatttgcctcatcgactgtaatactgtctatcaggtttagtaaagaagtttaagacaatattattaaaatatccgatgtgacagtatttagagcgaaaaagataatgtactagataatactctagtacagacttgtatacacaaatcaatctatatcaatatatcaaactgtgatcagttagtagtttagatagcccagccgataccgatctagcttgatataactatatgaagtgatccgtctatataagtggcaaatatacataaaactttagtaaaaaagcatatatactaggtaagatcggttgaaacttcgatgctatccttaattataattgtttccaggttagtttctagggttcaataaaagactagggatgatgcattacaaagtagataaagaaagctagagtctaaacaatcaagtaaacaatcacatttcaggatggtagatgccttaactaatctaatctagtcggaagatttagctgataccggcaagaaccctatagcgagaaccaaccgatagaggtaaatctagatactaagactagattagctaagacatatgatagcagatgaccatgataaaaggactaaaatatctaaagcgacataatagccatgatagcacaagccatcgagacatgttacctcttgcgaagcgaactcgtcgaaaagtaaaaacgaaaagggtggcgatgtgctaaagttgtattgaattgtctcacgtatttcaatgctagggggttcatatttatacctcgagtacaaacttagtccattacggacacgactcaaacctttctaaagataaaatacaaacaagaccatatatggcggtctcttgccaaaaccgacataactaatctaattaatagatgcaattgccttaatagagctctatctctaattggcaatgacgattatctcaatctaggcccatgccaactacacttcaatatacaacttccgtcgcatggccaacggtagttttagttttgacgacttcttgtttgcgagtttgggcatcattggtttcgatctcaggcgagaaagtaagtttctcaactccgcttgtatcagcaaaatttttactttctcagttaagtccgatatactagtgaagcttttactcgtgttgcctatctgacatattagctcattcttagatcgctttgttctcttgattagattcaatatatcaatcactctgaatattaccaatcgactagtttaaatctatcaagtttactattaatcttgaactttcttggttaagttcattcttctaggttataatttgctagttagatttactcaagtcaataagttttaatcattgtttcaatagagttttagccgatgagctatttgcttatcataatttaacttgctatatcggctaatttgtaagatttagcataatcagctagttgttgttcttattatcttcagtcttatactgtctcagttgagtctgatccatgaaaattgtggttgataattatagattgctaagtgattttttttaacttgctttagccgatgttagttgttttctccatatagagtaatggtaagttccaaataactcttggtacatcagcctatatccaaaagatatataattgttcagattctactttattactttcaatcttatattgtctcagtttggtatgatctatcaagattggttgtaatgaagttagaagatttacaaatatattatatcaaagtttcgaccgatgtttaatcttttgatatctaaattccattggttatagctgattgatccaaatttccatcggcatcagctgggcacatgatactttatcggccctgtgaccgattggccccacgatctattttttttttcatatctagttgtaggatcaaactaactggcacgtcttgaaaccgatttgataggacttgcattagagctcagnncaaatctctaaggccccttcgntgtgtgcgacgaattttgcgtcaacactatatttagtgagtttgttggttctacgggctgatttgatggtttccatctattccaagactctctataagtctacaaatatctcatatacatggatttaattgttcccaaataaaagttttaaagataagaaggtttcgatagactagatagtcctacggaaaaacggttgtggatttcgtatacgggcttcgttttgaacgtgagtacttgttggaaagctaatttgatggcccacatcaagtttctggtcccaccttcagatttctcatgagtttatctgcaatctaccaaatcagtcgatgaatgctgctgcagaagtttatttttcatgtccaaattatgtaacgcatttttgacaatcttttttacaatcatgaaattatgttgattctcttcttcatcaacaaatttagcaatcttttaactttttgcggaactcaacccgatcacaccaactcatggaaataattattcataacaaccagttgtaacacaaaaactattagcacattctaggataattgatctttcaacttcccttacaaggcaactctagagcatagatctttcaaatactaacattttctaaaataatttcatcattatttggctcaagaaagtagtgcctcattctctccggcaaccagcttgacgatgattgcggccttaccctcactgacacaacatctagaaggagtcaacgttgtacctagtgctctgccctgcaaaagtgcaagaaaaagatgtcatcatcggcctagagtcagtatcggcttcagagtcatggaatcggccgatgggaattatcaagtcgccaacagtcggattcttagtagattcggttatggaaattaatttactaaaggaagtttatccataagtgaccgagttcaaggaggatgtggcatgacagtttatctattaattatgaatagtctgtttgtttccttttaattatagggaagtgtgtttagtgtccgataaggactttgtgttttccttttatctttattaaagtttatttcttgtccaacaaggactagtatctacccatgggtataaatatgtacaccctgggtcattgtaatctatctctcaatcaatactactctcgacgcatcgccaccctcttttttgagattttacttatcaaccggcggaatttggcacccaacacggggctgcatcggttcagttcgatctccggcgaaggggtaagtcctacgttccgtcggccctggtaaatctatcggctacattggtgttgttcaaggctgcatcgtttcgatctcttggatcgctctggtttggttgatatatttttctacctgatatcttgattctatctctaattgcattgtgtttagagacgcatcggtttagttgggactatctcggttaggtttgatcttatgtcttagccgatatatctctacaatcacaatgatgttatagatagatttgttatatccatcacattagatagatctatcggttaatcgagtattatataatcccgtgctgcatcgattaggtccgacctactaaattgttgttgataatataaatcttgttaagctgataggttcatgctagtgttttatcgaggtgctagccgataagttatctggacgttgcattggcttacaaacattacatacaagttggatttagccgtttgcaacatgtttatctaaatcgattggattttatgtcgtcggacttttagccgatgtatgctttaaccatcagatcaatacttatcctatcatattattattagccgattggtttctattggattatattattgttatattttattatcatcagccgattgtctttatatcattatttgcattggacatatagccgattgctcaaaactctatcgacattggctaatatcggctatcggttggaattactccatcggtttgtcagccgatcagctgttttatctgctgtttacatatcttgtcagttgcagcatcaaactgactggcacgcccgtatctcatcaacatcttggacctgcactggagctaagcagatctcccaggccagtgtgtgttttttcgcatcaacaccgtgcccaacccgacccactgccatccctattcaccgtcgctgctgctccagcctcctccgaccgagcctcactggcattcccgtcgatgccaagattcgtcatcgcctccgttggattcgcaggagcaaggtgaagaccatccacttgtttgttgccgccgaaaagtgccggaacgccgccgccacctttgacccgacctcgtcgtcgtttgaagctcgctgtccgtcatcgttctgcccctcgatgagttcctcgtgtcatgctcttccttccggtgtgcgctggcggtgggcggcggggggaggagctacgcccgggccggcgagcgtcgaggaaggagctgcgcgcgtcctcctcctcctcctcgaacctgccgccatcgtcgttgtcatccattaccgccccgctctgctctgcgccactggctttgcacgccaccgcctcgccagccttctccgcccgtcaacgctgctccgcctcgccgtcgccccactttgcctgctgccgtgctcgaggtcgtcctcttcgatctgtccatgctcccaccgccgcctccctccctttctctcgtgtcgtcgccaccgcatcgccggccggccatcggacctcctctccactgccgaccaacctgcccagggagatgagtgagagagaggaggaggaggaagggagaggaggggaaagagagaccttgatgacgtggcgtcctgacatgtggggtccacgtgtgtcccatgcttactcacccaccacgtcggataaaaccggggtcaaaactaccgaaggacgtaaagtgaacggttttgtaagttaagggatgtcaaaaccggggtcaaaaccaccttgattttataactcgatgacaagttgagggaccttttgtgtactttttccttttaagtagttggttgtgggtttcagccataaaccgacccattaggatggcctgtaacgaggacaaaatacaaaacagtaaatggcccaccaaacccaatccgtgcagaggagcgctacccacgagctcgtgctctcacgcgggatgttgacgcgtgtccgatcggatgaaccaaatttatataaaacagtgcaagcgagttctcaaaagaaaaaaaaggtgcaagcggcatgggcctccattacaacaggcccacctattatctaaaggcccaagttaccacaggcgatcggtacatttcccgccaattcccca

SEQ ID NO: 77293 - DNA, 1388 bp, Oryza sativa
actaagctgttggtaacctgtagttattttgacgactcacagaacccccttattattgttctgagagctatccacacaatatcatgatcatgatgcacactagtaatagcttcatgttaaattgaagaggctataatcaccatacctgtactagtctactgatgtgtattaacagatttttggtcggtggcatgatgcatgatgcgcacattctacttttttgtactaggcattatcttcctcattttatcaatttttttctgaacttatctgattctatctttagtgattccactgtcatttcagtcaatcttggaaaaagcttcatatactcactacccactgagactaccatatagtgatagattggcagagaagagcttgtctaagctatgccattaacctttttgagttgtcatgattaagaaaacacttaagtttgcagattgttcaattattatctgttctatctccagtaaataaaactgtaattatccagggtgaagttttatacacaagaaattgtatttttccggcaagacctcctttataggatgcggcggtcttgtctgattcccccaacaacagaagaaacaagtgaccctttcgagcatgtatgttaaatacccctcctttgttgttatttcaataagcatatattgttcaaagaattaacacatcattttcttttcagctggtagcaaccatcacccatcagagtcatctttgcccattgcctcttacagttcagccaatcatatggagctacgatcattgccttcgactctatcctactcctcatacggtatgcaatttaggacataagcctattcaggaccttgaaatgtgctctaaatttgttgcgatgaatgtgctgttgtgctcatttaattgcttgaccgtgcatgtgtgattactttcttttgtataactattacaattcatcactataaacaaaagttttggacgttctttgctgattttcttcctgaaaaacttcttcagatagtactgggcgacaagagcgaccagaaggccttcaaatacacaggaataacttgcttcaaccctggttcttttgctaacgatagcacctttgcagcttaccgtccttgcactaaggaggttgagctttctgcattagaaagctaatattaaagagatcaaaatgaggctcaccaatttggccaatttggtagcctgtaccatccaaactagcattctccaaatcttcgatgaactgcctatcgccttggacatcagcctgatatttatgacttggacatacaagttaaggtggaggccattttcatgcaagctaattcgaggagatgacataacatgcatgacgccatggttggtgtttctctcaagcaaactgatgctga

SEQ ID NO: 77294 - DNA, 4782 bp, Oryza sativa
ccccttgggcttcacgcacatcgtcgccacctccgcaatcttccacaccgactgcaggtcgtaccctgcgtctaacgactgatcaatgatgccgtggatatccccactctccatgtgcgatctagcctgccaatggacaactcttcactcagcatctttgtctgcgccaatcgctcggatatctttgataattcactatcaggaagaaagactaaatgcaaagttcatgtatcatcataaggcctactacttcttacccattcaacaatgttacggcagtggagcccaaagttgtcatttgagattggttcatggcctgagattagctcaagtaaaatgacaccaaaactgtacatatcactcttctctgttagctgctgcgagatatagtacctacgagcacacgcaaaaagggtgagcttggggaacacttggcatcagatgttacaaaggtatatagcaattcaatttgcaaggccattgataacaagaatagacttcataaatttcaggaaagacatggccttactctgggtccagatatccaactgttcctctaactatacttgatacatgagacccgtcgacaacaggttttgacaagccaaagtctgcaacttttgctctcatgttcttgtcaaggagaatgttactgctcttgaggtctctgtggatgatagttggggagcatcctgtgtggagatactctattcctgatattttattttatttttcatggaaatgaaagacttcagaatctttgaaatgcatgttggtagaataatcacaggaaaattgtacacgaggaagggagggagataaaccttttgcagcatcttctgctatctcaagacgcttgacccagctatttatttttacatcatcagggcctcctgtcaaagtatgataaagttcatgtcaatcctgagcctcagtgtcaaagaatcatgcacgagctagacaagtagacaaagccgcagctgagccttgatttatgtgtagtatggaaacttctgaaatcttgacagtttgtattcagttcttagttaagactggaaagaagtaaacatcagaacagaaaagaaaaggcttatacatcagtgaagatcctataagtttttcagaacacgaatccttatccaaaactggaaaaagaaaactcaagcatgaatttgctgtattatctagggaaatatcaggtgaaaagtaccaatctgataaaatcgtggaaaccactgcacaaactatgcatatgactccaaaaaatttctcaaaataattactgtatgaggggaggagataatgagataccatacgaaatcatggagaccctaatattctaaaatataactacgcatggaacatttacttgtagaagaatcattctctacacaacgacaatttggtgttgattctgcaaactagatttatcatcagatggtaggaccataggaacttaccacggaggtgttcttttaacgtcccgttatgcatgaattcatacacaagtatatttttaccatcttgctggctgtaaccaaggaagctcaccaggtttctatgatgaattcttgaaagcaatgttacctgaaacataagtccatcagatactatactaagcaacggatcgcagtaaccacccaaagaaaaagtatgcgcgctgagttttccagtagaccttgagaaaaggatatatgagggatgcctacatagagggtgagggtccataggatgttccaaatagaaaatgttcatatcttatactacttaaaataaattgaggttataagtatatgtaacgcaacatggtcacatcccattagtgtaggtctatcaattaagtaggaaatgaatgtgtcccagaatatactgggcttcagcttcagcttcaaggtttcaatctaccaagcagtggtaaaattagcaataggtacgcaagttctatttatatcttaaactgttaaactgtgaaaaacagcccattttgggccgaacgcaaagcctttttgggccctgggtcaacactcattaaactgtgtgcacaaaggttaaaattcatctgtttttggctaaaggctactcatgagtcattgggtcaaaggctaatatagatgcacttttgggcccaaggttgactcacgaagttttgggctgaaggcaaatagtaacgtgtttttcagctgaaggtattagggtcacgtgcttttgaactgaagactgatactcatgtgtagttgggccaaaggctaatattcatgtgtttttggccccagtgataatacttgtgcccaagactaatactcatgtgcactttggccaaaggctaataatattcatatgtttttggcccaaattaatactcacaattttttttgggttgaagactattaatcatttgttttggggtcaaaggttattatccatacatttttagccccaaggttaataatcatgaattttttgagcagaaggctaacattcatgtgtttatgggtctaaggttgaggttgagttcttttcagcaacttgaaacaacaacttcctcgttttccgtcaacatgcttcccaaactgctaaacgatgcgttttgtgaaatatatagaagttcttaaaaaaatcaaataaatccatttattaaatttataatagttaatactccgtccatcctcaaatgtaagacatatttcttttgtcaccaagaccaaggagaaattactcatctcccatgtaacaaaatcaaggaactatatgcatgcaaccaatgaatattaagatggttgcttgggttcctgtcaacaattaatttagcacatgaagactacaaatataatcatctcttttagaaaaaccaaaaaaaaattgcctaacacttttggatggagggagtacgtaactaattatgtgctaatgatatgccccgtttccgagctgcgaaccgctgcagccaaactgctggttcgaactagccctaagagtaaagaaattatggggcaaaagctaatattcatgtgttttttgaccaaggttaacactcttgaaatttttagacgaagcccaaattcatgcacttatggtcccaaggtcaatactaatgaaattttgtgccgaaggttaatacttgtatgtttttttggtggaagagtaatacacctgtgtatttggagtaaggcaaatattcttgtgttttttcagctcaaggataatattcatgacattttgagcgaaggtaatatttatgtgatttgggctcgaaggtaatactcatgtgtttttgagtgaaggctaacaatcatgcatttttggcccaagctaacattcatttgtttttgggcccaaggttaatactcatgtgtttttggaccaaagacttaatagttgtgtcattgaggtgaaggctaatagtcaaccatttttgggcccaaggttaatttttggccaaacgggaatagtcatccatttttagcctaagtttaatagtcttcatattttaggccgaacgctaacacttactgtgtatgtgatttatatttcaagaaaaaactataaggcaagaaaagaaacatacctcattcaggaattctcggatgccttgataggagtcatttgtgagaagtttgactgcgatttctctcccatctgtaagctttccatagtatactatgccaaaccctcccgaaccaattcttctgtcaaatttgtcagtagcatcttcaatttcagacaatgcaaatctgtgcgccgattccgtggccacttcactgaaaaatgagcctagcttttttgctggtgccgcaataacaacggtttctggagacacaaagtaattactacgcgaccatacaccataccagatatgtccaatgagctaaagaatacgcaccgtccgatgatttcttcttccttttgcatgtgaacaggtaacaaacaatagcagcaacaagaatcaaaatggccccaaccacagcacatacaataattactatagtgcggccagtgttactgtgtcccatgcgaaggtcactgtttcctgagaagctgcatacgggtaacagatcagaacaaacagcacaatcctatgcacaagttaggtactcgatttacatgggaaacaaatatatactttcatcgaaggtaaatgaagcttgctaagccacactggagttcatataggcacaaaagtatgcactgctcatatcaaatgattaagctatgcttaaagaaaaagctacacatacttgaaaataatgctctttttgaaaagcgcttgtgggacctctccagacagcttattgttctgaatatacctgtgaaggcttggatcagtaaggtatttttgtttcaatacaatgaataaagcagtaaaatgagataaaatctatagcaatgatgcatgttgaggtcttgaggatcataagaacaaaataacagcacaaattcatatttactgcacttgcaatacaaatagcatgggggtggaaagaaagtgtactgaagcgtataacttacaactctttcaggttaggtagttctcccaaggaaggtggcaatgcaccggttaattggttgtcctcaagggactgcagtgcagacacaagctccctaagtgctaaattacaagaataatgtttccaggatacactatcaaaataatggaaaactcacatatattgtaaatcatggcatccagtgaaatcaggaatttgaccagtaaatgagttaccatcaagctttctgaatttgaagaaataaatttatcagaaaaaagccaactacaaagagggg

SEQ ID NO: 77295 - DNA, 4091 bp, Oryza sativa
gatccatttttgccaacaactgcagtttgcatgaccctttgaggtggttcttcgttggtactgacgaagatgggttttgtagttgatattctctccgtccccggagcaacatcgacaaggtaatttgctcgcctcactaaatcagactcccatattctatcaaatggatcatcaggatacctgaaaacatcatcaacaacaaattctttaggcagatattgcaacgaaagtatgaacaatggtgctacgcagcagtagtagcgcatacctgactgatgcattgctttcagcaccaaaattgatcctcgcagagagtctaagaaagaactgtttttcatcagtggtgtagtagagggagccgttaaattggcgaagctcgagagtagaaataaagggctgtccagtgctggcattagagaggcaaacgctgagtgttggagcagcagcgaggataatcgcctcctggacgactggggtggtggcatcatcaatgacaacggtggtccatggggtcggtccaagggagagatcaaactttgggtagacattgctgttgtcgaagttgccatagaggaaggtggctctaacaaggtagcgtgttctgttcctgacattcatggtgtagcaatacttcctgttgtctgctggaaaagagcgaacggtggtatattgctgcaattgttgattttggagcaagaggttcgctttctggccagcagagacaaacttggcatcagaagtccactggatcccaatgccatccgtgtaatcatcgtctcccccgcaatccaagctgatgaaacctgcatgcatcaaatcaaagatggaattttcttgtagagatttatatttggagatggatttgatttcccagccctgaagctgaaggaggtccagcgaatggtaaagaagggtggaaattattgagttccaagaaactcgaaaagaaaagaagggagtagggtgagtgagagggagagtgactgaccaggctgagcattggagagcgagaaggcgacgaagaggagcacaagagcggcggaagcagacggcatctccctcagtaatctgaattgatgatggattgattagcacagcagtgggtgcgggctggtgaatcaatccatatgctccctccttggaacaagtcctaaaacaaaaggaaaagagaggattgaaattttgttggtagctggggttggggagagaggggcaatcaccaattctctctctctctctctctcacacacacacacaggcaagaaagagctcaaccagaaacagccaggggagtgaagagaataccaaaccaagcaggagtattccaagaagaagaagaagaggagcaggacaggaggaaggggaaagaagaagacaggagggtcccaatcccagtctcctgctctcactcacagccagcctctgcaccctctgtctctgtgtaataatcttggagaaaagcaagcaagaaagaaagcaagcaagcatgcagcagatgtagaggaaaagcaatggaaaaggtgagagagaggagaggccagcctgagcctgctttgccttttgcctttgctgcgcctgcgccgagctgagtggaccagtacactacctgttgctgttgccctgttgctgctgcatcatccacgtctctgtgactctgtcactcatttgtggtacctgtgcctcctgtatttaactactagagtaataaactcatcattttgtggtactactcgtagtaattagcttaacctccaagctcagactcgactttaaaaggacttctcacttaggagtataataaatccaacactaccatgaagattgaggacctctgtttttccaactactacggcccaagtttagttccaaactttttcttcaaactttcaatttttccatcatatcaaaactttcctacacatataaactttcaactttttttaaacaaattttcaattttaacgtaaaacacacccgtatacaataaactgggctaccaccaaccaaacagcatcttctataactacttgctactactgctgcacaagaacattctaacaaactgcgactttaagttctaaactactacattaaactaccatcagttcagtttgtctgttgttaagcatgttacaatttagcaattgttcaatcatgattcatgaggctctgtttcatattcggtggttctagtactacctctggactatttgtctttctttaggaaataattgtataaatagacaaacctatgaggcatgttcaaaatacttctaacggtatagccaatgatatctttctttacttatttaactaagtaattgaataaacattgttgattcaattttgacagaaatttgagtccaaaatgttatagttattaaccttgggccaaaaatgaatgggttaacttgaccctagactttcatgagtattaaacttggaaaaaaacgcatggatcatatattcaaaattttgtgttcaagaaatttaggcctagaaatacatgaattttagcccataatacatgaggtttacctttcagcctaccatttcactaatattagcattcggctgaaaagaaaatgaacattattactaagtccaaaattttacgataatacatgaattgtagccttcaacccgcacaaacataaccttcggccaaaatttcataagtattaacctttaaagaaatgcacattcacctttgatccaaaatgttgttgagaattaatcttgaattcaaaaatgcatgagtactaaccgtggcattattatacacggatatcagtctttctaggtcttgtgcctaggaacacatgaacattgcccttttgcctagaatttcatgatgactaacctactgaacaaaaggcaataaatttagcctttgacgaaaaacacatgcatattatcctctggctaaaaaaattaagggctttcatttgtgccaaaaacacatgaatattagcctttgaccaacaatttcgtaagaattaatcttatggccaaaatggtcctactcaaatattctcaactattaaccttgggccaaaatatgcatgaatttgaactttagacgaaaatacatgagtattagcctttggcctaaaatttcatcagcattaactttgggaaaaaaataaacatcacccttcggccaaaatacacataagtattagtctttggcccaaaaacacacgagtgttaaccttgggtcaaaacacatgttaatattgggcgaaaacacatgagtattaaccttttatcgacaacacacagacattggactttggtccaaaatttttttttactggaactttggtccaaaattttaaattttatgagtaaccttgggcctaaaaatgaaaggttattagcatttggcccaattacatattagtattagtcttataaaaagcacattaatattacatttgggtacaaatttcatgatcactattgttgtgcctaaaaatgcatgaatttttgccttcagcaaaaaaaatgtttattaaccttccgacacaactccacaggtattaaatttgagcctaaaaatatatgactattttcttttggtcaaaaatttcataagtattaaccttgggttacaagcgcgtcaatattagccttccatccaaaatttttcataattaagtattaccctcgagaactggaaaacatgaacattagacttcggtaaaaaattacatgaatgttagcctttggcataattacacacaagtgctatcttccacttaaaaacacatgaataatgaccttatgtccaaaatttcaaaattatcaaccttgggcccaaaaggcacacgagtatttgcctttgaccaaaatttcatgcatattaatcttgacttgagaacatatgaaatttagtctttggttcaaaatttcatggtttcataattaacgtggtcctaaaaattgcatgaattttaacccatgtccccaaaaacacattgagtattagcttttcaacccaaaatttcatgagtactaacgttgagcccaaaacagatgaagattagcattttagcctaaatttttgtgtgtattaatcttgggcc

SEQ ID NO: 77296 - DNA, 1932 bp, Oryza sativa
ccagcttcactttgggcttggagtactcaccactcatcgcgagcttagccgcgaggccactgccaaaatcagtgaagtgcacaccatcccagcttagcacctttgatcctggctcgcagagatcatcgcagccaaatttccctggcttgaagttgtatggaggcccaccgttgccgcagcacaccatcaacggccacttgatccctgaacacacaagaatgtgagcgaattcagatgcaatatatgaaactaccataaagttattcatgaatgtgaacacaattatccaaatgttctgaacttttaaagatgggagagtcataccatatttggtgtggttggcgacgaagtcgtacttgatggcaaacatgtcggtgtacacgacggtggcgttcttcagctgcaaccgcatttcgtcgcaaaggtggctcagctttttggtgaactgccgtgcagcttggttgtaattcgccagacagccatgggcgtcgtgctcacccttttctagcaccaccagtgcaggtaggcagccaagggcgccggtgccatgtatccagaacttcctcgcgccgttgtcgtacagaatctgtggatgttggaaacaaccaaagcttctgtcagtgtaactgcttaagagttactactacactcgcaaacggaagtttcagatgctgtattgtagtgtgtaatttacccgaatcgcgtctttgatctcactgacgatcttgctgaattttttgtcccagttatcagatggagtgtgcatcacaccagccacatcgttgtggccgatgtccatcatgtatagagcgttctcgaagccctccttgctcactggccctttctgccctgcaaataaatgcatgatgttttatcatcaatatttccaattttcagctactgtcttctatatttttttcaggtttaaactgtcttcttttttctcgcaattgtaaatgtaacagcacaaacttattcaagcagcaagcagcaaagcaaacctcgttcgaagagctccagggatctgtgcttgaagtacacaaactggtcgacttggacattcaaggaatagggagagacgccgtgtgatactgttgagccagccatagcgaagttgacaccattgctgtagtctgaaccaattgacttcaggtatgggttcagttcacgtgtattcaagctctcacctgaaaacatcatcatcagcgaccgggtagatttaaagggacattaaattactgtgacaacagcagcagcagcagcagtagcagtatttctatgatattgttttaccaccttcaagatccccatattgtgttaagcttcacatttgctaccacaccttactagtcactatatttatctaaacatggtcactacatttatcattttgtggtctaccagtaatatttggaacttatgtaaatatgttaatgttatgttgtcaggcttctggacagctaggtaattaaatcttggcccaaacataacgaaaggttacttataaccaagggctgctaagagtaatatgggcctcatccaaagatattgctcatgtgtccctaccatgtgcacatctcaatcatacatatgcatatatgtgatatcttctatgtctgtacttggggtcacccatggaagttaaagcttgcaactctcatgaccacataacgaaagtacagattctgcctgtcctaatgcaggaacaatgataaatggatttcccaccaaattctcagaagaaaaggggcatgcacagataatacactctttatcccaccaacaaaatgcatgtcatggatgggtctactccatgtgatttacagataatatatacatgatactatgtgagaatcattaactatcacatggtagcatgcatgtgtttggaccatactaatatgtaaattgcttatttcaaatgaagaactg

SEQ ID NO: 77297 - DNA, 14460 bp, Oryza sativa
agagtagaggggctaaagaaggaagaaaaagatgagccccccttgcataaaaaaaaaagaagatgagcgcccccccccttccccaccatttttggatccaccctcacgaataaagcatttaaattagagttttacaaaaagaatttccaagaattagttacaagtaaccactaattccatagcatgtataaagaccaatatgaatattcaagcatcgcaagaaccctagaatccaacgcaaaaccgaccctgttcgtgaaaagttacgcctagtcgacaattggatggtctctactctcttcttaaaccattctggcaaaaaaaaaagggtaaaatatattcattttcagcaggatataaatttgcttttggtgaggaatttgacttttttaatttacatgcccatgctagatggaagtaagcatttttacggtttgaatggataatctctataagtttagaattctatgtctagaaatataatttagtttcctgcaacggctgatttatgaaaagcaaaaggttggagcaatgggctgtaatttggtcgaaccatatgatcgaagtgagaaaatgcaatatatgcatggattcggtgtgagaccgggacaaggcttaattaatttgggctttttcccaaagtcagtagccagaggacccacatatataaatcatcgatgcagctaaaaagctaagctgcaagaggttgaccaaactatcaattctaaaagaatgaatgaagaaagaaaaaggacgaccaacttggatcatgcgtgcatgcagctaagctagctgctggtacgatattgtgctaacagtaacaaatggagtatatatacatgtatatcatactacgtacatgtgtgtgaaaaaaaagatatataatgaacacactactcactcgagtcgatctgcaggacgagaaggttaagtaaggaaagaaaagctactactctcctaacaattactatgtgtttaattattacatatatatatactcgactcacgctgctacagcgttgggatcctctgcaatcctgtaacagaggtactacgtgatgtggtgatatatattatttagtgaagctgcaggcacgcagctgccaaatcttaaaccagctaagctgtaattaatttaatttgatcatgcatgaagaatatatactagctcgtatatataaagtcgatcgacatgcgtgcaaatgcattgtaaatttgtaatacggccttacaaacagtaggttagttgcatatatatcgatcatcatcatgcgagtactgcagcatataggttggtagctagctagccttccaagctaagctaagctaagatggagatccaattaattgatccaacaatgatgaaataaataaaatgaggtaatcatacccacgaatatagtacattttcgcctttaattatgggcgcagactgtgccatgcaaaggtagctaaatacaacttgcttgcctcgcatggatctgtatgtttcatcaaaccagaccaaagcaatcaacgaatgcatgtgattttcgttcacatatatatcattgatttaattagtcctagtggtctaccggcccggaccagatagtggaaaaaatagtaattagtatgggagaaaccctattgtcatattctattatgatatattacatgaaccttctcagaggtacatacgagatagatgtttggattacaagaaaagttaacagcagatgtatccggaaatattattccgcgcacgtacgctagcaagtatgaaatgacaaataaattattcacttattatcctctcccacctggttcacttgattccgcaacaaacctctcgcaccaattgaagctatgtgccacgataggcgagacgccgctccccatgcccgcaagcaggtcaaggactgctttgtccttccttccttctcgacatcccgtgcaccctagctatccctcttcttcctccctggtgacccctggttccccttcttccctgtccatggtgagacatcatggatgtcgcctaagcctcgccagcactagatgagctaccgctgccctagatgttgggtcgtcggattctattcttccttctcctagcatccatgtcgtcctctgtttcttccttttcctagggtggggttgggggggggttgttccctttcttgctcctcccagtgagatatcgggtttgagattatgagatgaaactttttagaatgggcataaagtttttaagtttctagttgaaagtttccaaatcatagaggggtgttagcgcgagtttcctctctcatgtaatgagtgtacgccgtgtagttgtgctaactagcggtccctatatttatatctaagatttgattaagagctctatttatctttaggattttatttttacgactctattttatcttagaactctgttttatttttacgatgtttatatttgagtggcatatgtactgggatgggtaagttgcatgttgggccgggccgaatggaatggaatcggatgtgtgtgttatgaaatcggacacgttagccactagtaggccagccaggagtattagtcggagaattggacacgtcagcgtcatccaggctcccagcagcctctcccaatctctcctcctttcttcttcttcctggcttcctgctcagtcgacttggtgggaattccattcccctgcagttgcaatgcttgggtgaatccagctccgtcgtcgccatccccacccccacccgcaccggagaatgagcagctcatccaatgcacttgtgcagcactactactcttgcaagcccccaccgccccccagattagtactagtaccattcttcttctccggctccggctccggcaccaacaacaccgcctcctcccctgctgctgcatcctccacgcacactcacactcacactgcagatgccaacgcccagctggacgcacacctcctttccctcctccgcgacggccacaccgacgccgcctaccacctcttcgcctccaacccctccctccccctctcccctgtctccgcctcccgcctcctcgcccagctctcctattcttccttctcccgcgcctccgccctcctccaccgcctccgcgcccgccaagccctccacctcctcgacgccaactccctctccctcgcctcctccgcctccgcccgctccaacaacccccacctcgcctattccctcctcctctccatgctccgacgcggcctcctccccgaccgccgcgcctacaccgccgccctcgcgcgcctccccccttcccgcgccctccgcctcttcgacgccctcctccaccacctccgccaccaccacaataaaactaattccctccccgacaccgccgccttcaacgccgcgctcagcgcctgcgccaacgccggagactgcatccgcttccgccacctcttcgaccagatgcccgcctggaacgcgccgcctgacgcgctcacctacaacgtcctcatcaagatgtgcgcgcgcgccggccgcaaggacctcgtcgcgcgcgtgctccaccggatcctctcctctggtctcaccccctgcgccaccacgttccactccctcgtcgccgcctacgtcggcttcggcgacatccccacggccgagaggatcgtgcaggccatgcgcgaaagacgcaccgacatctgcttgctgttccgggctgtcgcggcgaccacataatcagccacgaccagcagagctgtgtgctggaggacatcgtcaagccgtgggaacaagaggaggtgccgctgctccccaaggcttacccgcccaactccagagtgtacaccacgctcatgaaggggtacatgaacgccgggcgcgtgcaggacgtggtggccatgctgcgcgcgatgcggcgagagggagagacgtcgccagcgagccgccccgaccacgtcacctacaccacggtcatctccacgctggtggcggccggggacatggagcgagcgcgcgccgtgctggaggagatggggcaagcaggggtggcagccagccgcgtgacatacaacgtcctcatcaagggctactgccagcagctgcaggccggaaaggccaaggagctcctcgccgtagacatggctgaggcgggcatccagcccgacgtggtgacgtacaacacgctcatcgacgggtgcgtgctgacggacgacagcgcgggcgcggtggcgctgttcaacgagatgcgcgagcggggcatcgcgccgtcggcggtgagctacacgacgctgatgaaggcgttcgcggcgtcggggcagccgaagctggcgcacaaggtgttcgatgagatggagaaggacccgcgggtggcagtggaccgggcggcgtggaacatgctggtggaggcgtactgcaggctggggctgctggagtcggcgaagaaggtggtggagaggatgaaggcgcggggagtgcagccggacgtggcgacgtacgggagcctggcgaaggggatcgcggtggcgaggcggccgggggaggcgctgctgctgtgggaggagataaaggagaaggaggtggacggggaggtggtggaggcgctggcggacgtgtgcgtgcgggcggcgctgttcaggaaggcgctggagatggtggcgaggatggaggagatgggggtggagcccaacaaggccaagtacaagaggatgtacgtggacctgcactcgcggatgttcaccagcaagcacgcgtcgcaggcgaggcaggatcggaggcgggagaggaagcgcgccgcggaggcattcaagttctggctcggcctccccaactcctactacgccaccgactggcgcctccaagacgacggcctcaactaacaccctactatatactactaatgataatgttaaatcttaacacatgttttatgtactactcctacagtccatgaagctacttgcttcccttgctcattatgtacaacttcatagtaatttattttccagcaaaaaaaaaacatagcgacatatatactgatagtgataggggtagcaacgctgttaccgaggagccgggacgaaatggaacaagagattttcctttattgatttgttagccaagcgtttgcctgggacgtggtccgtacaatgttctacaaatttggcaaccaaatgataacaaaatgagcgcaagtaagcgcagtggcaaggcttgtgaatgtctcatgtacaaggttagccaattacatggaacaacaggaccaacttgttgcaagcaaggcttcgtgttgtgctgtgacctcaagacaagtccaaggccaacgatttgattgctgtcaaggggtatcatcagtcacttgttctgacgttcttggaatacttggtacagtcgaatggcccaacatcttgagctttccgtttaacctgcaggaccatcacaaggaatggctcttcatcaatcaacctacttaacttcacttttgttaccagcaatggcaagaagtgatcctacgcaaaaagaaccagcgatgcatcttcgtttactacatctacatgtaatgcatacactgactgactgaaacaataaggcaaacgctctacatatgtttgaagaaatttcatcccatacttctaaatttcagaaaggcataccggtgaccatggactaggttctggagcagctttatcggtaggagaattttgcacagcgcccgtcttctgttccaaaacttcctgtcaaaacatacgtaaactcaggtataagcctcacagcagaagactcaatcaaacttgtacggcgaggtaaacttcaggttagccgattagggtggcaattcatgttgcatatcataaaatttatttcggggcataaaccgagctcaacctctcctaagaacactggactgggcccatacaaatagaacaaaaacaagcagttgtgtaagacacacgacaacctactcatgtaaatgacaacctgacaagctcaaaatgtccatgatgcaagtaaactgacctctccaaaagcttccatgacagcaagccattcttctgtaaacggtaccaagttttttagatgatctttacttatggtatttgttcttgatttacccactgacttaatcctcctgcagaaatataagaatgacacgctatcaatgcaatatataattgtagatgactaactttgtacattcaaatattcgatgcagacatactctatacttgatgcaccctctgaagacgacaacttggtgtcaaacccaattttgtcttcagtatcttgttcttctgataaaataggtcgtctttcctgggtcgaacagtgatgtgattctgttctaccgtcagctgtatctactttttctgtcaaattgccagctagtgcctcttgatctacacaaggtgaaggcgctgccaggttcatatgtgaacattctgcactcctgtaatcatggtcacattcatcccctacatgtaacaggggaggttcctccacagtgaatgaatcatctgtatcaagctccatttcactatcaatatctggtccttctgatgaagtaagctgaacttcactacacaaagaattgttggagtctaactggctgtatgctaaagatggttttatgcctgttgaactatcaaactgtggtatttgatctgtacaatgtatagactgaactagcatattctgctgatggcaggaatcggatttttgcaaggaatctgtagctgaagtgcaattgttgccttctgatgaacaaactgtaccagatgtctctccagagagtgaattttctatgtcaactgctgtttcaccattgtcagacttgctttgagaattgagatcatttggggtgcaccctggagaagaaatgcaagatgttgtcaagttactccccacggaaggttcgcttgacgagcaaatgactttaagaaagcaagaatcctcagcaggctcagtgcttgagcagcaaatagcattaagatcctgtccgacagacagcgcaacactgcactcattgggcatgctatttctgccatcatcattatctctaaaactcaactctgtggtagctccatttccagccaacgaaaaatcatcatctggcatttcttgataacttatattccctgatttttctgaatatggtacagtactttccgataaggattgcttcagtgaacaaactgtcgcatcctcaacaccaggtagagaagaggccaagacgttgggagtgctgtcactagtggcaggttgcacaggaagactggaagcagcagagaaattggttggcagctgctttgttagatggaatctgctttttggatccacaggctgcttatacctggggggttttactgatgaaatatttccactaaagcacctctctggatttctttgagcagtaccactatgtgatacagaagcttttccctgaaataattagtcaaaaatgaggtatggagattttcacaaaaaaaaaaaaaatctcataaaacataggcatacactttgtaggatggccaaagtaaaatttctccaagaatgagaataaaattttgtccaactcagacatacattttgtaggatgcccatctcttgtttcaaacaattttcacaccacctcatcatccagtaacccacaaatgcaattattacacacaaatcattcaccgctatttttttaatgcgctttcaggtaactaatttgtaacgtctggttagatgcaagtaaacacttaaagtgtaagagaaatatattgatacatcaaagtagctgtaaaaatatcacgttattttcatatcactgagaaaacaagaagcaacattagtgaatatgtatgaaagagcataatagattacctgagtgaaaaagccaactgaaggtgaaggcatccggagagcagatggcttagcagatattcgtgcaggggcgacaacagaactggaggggttatcttgtgaatatggtgaaaaagtttcacatttcccagaaccattggtttcttgacagatggtagtaacagtaggcggcacctgtagaagtaaataagcatgtaacatcctttgtagttttaaggttacaatgttttcaaattcaccgctacatcctttgaagtaaataagcatgtaacaaccataaagtagttttaaggttacgatgttttcagtatcatatataggggcaagatttgagatcttgagtggtatccaacaaagtggcagtgcttcaaataacagaggtgtactaagagtttcccctcgattaaatgtaattgacgctatcactcaccatgtccttccctatggtaggtccagaagatttagtgacagatgaacgctcagtcttcgatttaagcgggagcccctctactttatgtgtacactcacttgtaactgaaaaatagtggcgtgctgaattagtgatagtgacatgcaaaagtgctgaaacctaagttatatgtcaggaagatttcattggtagagttgaggagtgaggactatgagcaagattacctgtagctggccttgttgtggtttgggaacatttgtcacagatgaggtacttctacttctagagaccacagaaggagaaggttcagacttctttggtatcctttgtatttgagctataccacttgagtttggcacttttttcggtgtataattatgttaagactaacaatagcacgtgtaattaataagagtgaaacttatgaaaagagtattaaccagacaattggcatgagtctgttaagaaaaaaaaaacaagacatccaataatcccaaaatctccataaggatatttatatcctgcaggtggtcgtggaatggacttttggatggcttttgctgaccttttatcctgtgtgccctgcaattgtccagaagaaaacgagaaattgcatgagctttaataatagcattaccataagtaagcaaaatgctatgtgatgaactgaccgcaagtgcttttcgttcatcctgctcagaagcttttgaggaagcaaacaacttccttcccttgttttctgcactcaaacattttgaaggaaattttccacgagaattctctccgatttccttgagcacagatgtattgctagattttccaaacctagacaatggggaaaaggtagaagaaaatccagaggcagggctcctagttgccttcacttgggagccagtaagcatagaaagctccgtgttatccaaaacgcctgccagaagcatagaggtttttcagttgccggaagcatttagtagctgtgaaagaaatcttgtaccttgttcagtgaagaaagcaggattccatgcgatgctttttctgagattgaacccccctgcaggcttgttcttcctctttttagaggtagccacgcctttgccttcgcacggggtttggcaatccaagacatggcgtcgattttgggagatattgttctctttgttgcctgtccatgaagatattattagagaagtaaagcttattggatacctggaaagtcaaagtccagggcaaaccctagtaggtgcaaatgcaaagagggggttggggggggggggggagctcaccggaaccggtggctgcagggatgcggcacggcgaggccatttacatgtggattcacgactgagcgtgccagtgagaagaagaaatttactttttgtttgtcctttttggatacctggtatcacaagaaatggattcgatttcaatttatagttgaattgagtcaagaggaatcggtttgaactgccattttttctttacatgtttggtgtccacgtgaagtgcaaactttgcctttctcaaacaagagcaaacatattgtgtttatcaatctaaatcacaagaagatactccactagatagaaagggggcaattatatatataaataaaaaagaaaaagatagaaagggggaaataggcatgttgaaggcgcctgatgtagcggagaagatggccgtagtgcttacccacggagtcgtggacgagggcggtggtgagcggagatggatctggcttgtagcggaggaggcagggaaggaagctgcgaggagaggaagaggagaatgtggcaagaggaagacgaggagatggagcaggtgggtggcggaggagtcgaggacgacaccgtcggcgagcggcggcggcggcggcggcgagccggcgatgcggttgagttggatggggaattgaagttgaattttctggagaagaaacctcgcgtcgccagccagcgggaaatgaaaatctacatgggccaataatcgatgggccggcccaggcccaggcccaaccagcagcggtttcctttttggtttctgagtcttctttgagaaggaaagaaacggcagtgggagtggagtcgatcatgtccgccgccctccaccaccagctctccctcgcctcctccgccgccctctccgcctccgaccacgacctcgccttccacctccagctcaccgaggccatccaggcctccctaccctccaatgccgccgcccccgcgccaccggaggaaccttcccacgcctcatgtgccctggaaatcccacgccgccgacctcgcgcgagccgagcatgaccgccgcgacgcccaggcctgccgcgcctaccacgcccgggccgccgcctccgtccgcgtcgccgcgcacgacgccctcttcgcgcgcgacctcgccgccatcccggaggacaggtgggcccacgacggcgactacttcgagcggcccctccccctggaaggaggcggcgcgctcttccgcgtgctgttcaagggcatggcgagcagggaggtggtggggccgcgtgaccgtgaccctggcgtcggggtgctcgccgtcgccatctgcgggccaaggggggaggtggtgctccggatacacaagcccgtgcaggcgcaggcgcagcaagggcggatgatgctggaggcgatggcgctggtggaaggcctcaatgcggcgctcgccctcggcatccggaccctcaacgtcctcactgacaacaagccgctgcacaaccatgtaatgtactatctatgcttgctctcatcgtaaccatattaatattgatttgccttgactacgggtagtatgttgttgtcctgttaactcaaaaatattatattctccaatactccagcacatggtgtcttgttatgtttcagcatactagtttgtttcagtgcctgttcatttggaaatgccttcctcgataaatttcgatcttaaagaaatgctgcagcttctttccatttaaataccttgataaatttccatgtaaattcattgatagatattctttctgttcatgctaaaagaatgattcaattatttttttgtctatcactggtcttgttatgatgtgcactacatgattgttgatagatacaatacatacaatctggtgtttatttcctaatgatgttgggaattgggattgcagatgagtggtatatggcgcccaagacagaagaggcttgtggatttgatcaatgaggctttctcaacaaaacagaaatttgagcaatgtgagatcctctgtgttgcacgaacccaagtcaactatgtcacaaaattagcaacagattctctgcatactcaaattgccaaagctgctgctgtgagtgctggcaaggagaaaaaagagaactgcaccatctgcttggaagacactgacgtctctaagattcatgcagttgaaggctgcgcgcatcgcttttgcttctcctgcatgaaggagcgtgtcaaagttaagctacttcatgggatgctcccagcttgcccacaagatggttgcactaccaagctaaactgtggagggttcaaagatgttcctatctccacggttattagcgatcatggtgcagcgtatcagggaagcacaaattcctccaactcacaagatttattgcccatatcccaagtgttcagccttgatgtccatgagagaactgatacatccaatgcaagcatcatcctcaaagtacactcttgttgatgctgccacattgaggaagtgtgtcaaatgcagtggctctttctgcattagctgtaaggtcccatggcatcatcagatgacttgttatgactacaagaggaggtacccccatgctcgtctagaagatgcctatctacagaaccttgcacggcagcggttatggcgtcaatgtatccgatgcaagcacatgattgaactagcagagggttgctaccatatgacttgcgtgtaggtgttttctcctcaacattgagtctgccatcctcatattattattacctttactaacaattcaacattgatctgcctccaaaatctttgatacttcctctcatatgctaatgctcagattcacttgaacgtttcattcatcctgttcatgcctgttacaggtgcggctatgagttctgctacacctgtggaaaagaatggaaggagaagaaagcgacctgctcttgtccactgtgggatgaacgcaacattatccgtgatgatcctcaaggcaatgctgctatccatgatgatcctgaagatgaatatgatgactactatgatgaggacgaaaataattactatgttggagaaggccttcagtacaatgtggattaccatcgtcagtatgatggaggggaccgtcaccatggccacttctatcaatacaatcgctagtgtcaatgtcgtcttctacagctactaatatctagttattagtacagtagttgagcaggacaatccccgtacttttcgctttcgctttatttttacctagccatccaatgttgctacttcatgggatcctatttgtgccagacatcaacctttgcagttagctgaagttgaagggctcaatcctggcgagcctgttcaattgccatgctagtttaatggatattttcatcataacttgctcatgcttatcgtaacaatgctgtctctgatatctttttaacatctcaaataactcacagtgtgtaactcatggacttgtcacaactgagctaactaatcacgaggagggttaatgaacatgtcatcaaggttctggattactaaagaaataacaacagatgaagtgaactgtgcaagaaagggcagcacgtctactcctgtagttgtcatctactatacagtggtataatgaaggcctatggtaatgggaattcgacaaatttccctctgttggggaggatgggaaggatatagaaggacctaacatttggtacatgtatcacgaaggcaatgccaaaaaatggttctaattctttgcaacaagggcaaaaacatttctgttgcatggcttgtcctttctttacaccatatagagtaaccaggtgaatttggatctgtcatcctctggaacccactgtggttctcttctcatgtacagagtctgcggagtcactctcagtttggatcattgctttcttggcgagctcatagcctgcaaagttcattgctccgagaggagcaatccagaagaagcgggggatcgcacccttgaacagtccgagaggtccctcatttcgaaggatggagaaaactatcaactgcatggagactggggtgcctggtggagcagtcatcatccgagtcttcatcacatcaaagggagttgtgacaactgctgcaagccctccagacaacgctcccactgcaatagtttcccatggttccaagtctctgttcaacacatgctgtgccgcctacaataacaagagcatatgacatgatcattaaattcgtcaaggcacagggcatagttctgaatctaatggcattgcaacagaactagatattatacagatctcagtccattaaaagaaaaggttcagcaacttccccgtaactatatttttgtattttgtatatccagtcgaacaaaattaaacttcttaagaaaaatagtgatcagagaaaagtaatacatgcagaagaaaacaaaacaaccttactgtgggcaatctttgaggaaaataaaacaagccaaataattcagtccaatgacatcattgatagacaggtggatagaagaaaaactccattgagatgccatttcagaagcatgaaattcaaatatgcagaacagattttttttttgccgggtcggtagaaggaaccggcgcccaaatttcattaagattgggaggaataaaaacaaagtacaagtagttttcgcttgcattaaacaaaggcagctcactgcacctttcagtcaacaaaatatagatggaagaaaaccaattttaaggtatggtccaaagaaacaataagaactcacaatacctttttagcttctgcataaagacacattccagcaacatagaaggaacctctcggcaaagagtggccccagtgccacggaagaagccctttggaccatctttttgcatggtaccaacaatggcctcccctacattattgaagattccagcctgcaaacgctgcttaagaacctcacaaggtatacggactgctgttccca

SEQ ID NO: 77298 - DNA, 1422 bp, Oryza sativa
gtataataacacaaccttacctcacggccactccctcggaagaaaattacataggatggaagaccttcaaacatcagaaggaccgtgcttctccggttgacacgtgtataagcacaaatcttgaagcaatcatcccctacctctggcccaactcctctccactctccatccccgcacatctgcccttctgcacaccaagcctggcattggatggctgctcgccggcagcacctacagtcccagctgtggagattggtcgatacggcatacggtatcaagaaattgtgagttttcttaacttaattcagctgtatgtcctttatttacatgcccatgaataattttgacagacaaatcattaattgtttggcatataggttgaatcatagatcaaacttgggtactcgacgctcacaaagtgtgaatgaaatctggaaaccagtgattgagaatttgagataaaagtaatgcgagattcaccaagaaaacccacaacaaacatcactaattgaccatagtgtactcaacgagagaggggaactctggtcagggaaggccggaagactagggagaggagagaagggggagggggggaagttgggctagaggtagatggcgattgcttcaagattcgtgctcatacacgtgtcaactagaaaaagcacggtctttctgatgtttggaggacttcgtctcctacgcaattttcttcacactcacgccggcgcccctcatctccttccccaattccctctccggcgacaaggtcagggcggcgccgatcggcgagcttcgcactagggcgggcatggcgcgccgcgccgcttcccgcgcccttcgctcggagggctcgatccaagggcgagggggccgcgcggggggcggtggcggtggcgccgaggacgcacgccacgtgttcgacgaattgctccggcgtggaaggggcgcctcgatctacggcttgaaccgctccctcgccgacgtcgcgcgtggcagccccgcggccgccgtgtcccgctacaaccgcatggcccgagccggcgccgacgaggtaactcccgacttgtgcacctacggcattctcatcggttgctgctgccgcgcgggccgcttggacctcggtttcgcggccttgggcaatgtcattaagaagggatttagagtggaagccatcaccttcacacctctgctcaagggcctctgtgccgacaagaggacgagcgacgcaatggacatagtgctccgcagaatgaccgagctcggctgcatacctcctgagatgaaacaacaattaacctttcttcataagcatttttgccaacttctttaacctgaacgcaagcacctgtctgcaattaaaatattggatgcaggttcaaattgaatgaacaggttttataaaatttagaagcgcagaaatgc

SEQ ID NO: 77299 - DNA, 4222 bp, Oryza sativa
ccacccatgtcgtgcactgatcacatcgttaatgacaatttcctagtgttgacccagcagctagcacgttacagtcacacaaggtaagagcaaaacaggaatccaaaaaacaaccaactatcatttcagtcaatcaagtgattggagtgcccatctgagcttccatccaatgaccatttggatcagtaatctaacttgggttagatctaagtacaagaaagtgcaagaatcagtctcctcaaggacctgggttgcaatttgcagacacaggtgacagacagggagaactaatactacttcttaagtcgagcagttcacatcaacaacccagacatatccatccaacccggtcacagagaggagcaagtcaaagatacagatcataggtttcctctgtcccaattggcaaaggagaaaaatgcggaaattgttaggcacatgctgctactgcttcggccaccaaactctccccattttttaatcccctcctccagttccacgtcggcggcgaccaaattattcggaatcactcatctcacagcttgctgatttgctagattttgctctaccaacccagattatagcaagatagttactcgaatggtcaacgaatttcagatgaaacagtataatttctagagaaatgggtcgcttggaggggtgaaattcgtggaaatttcacacgtagtagttcaaattctacagtaatcaactaatcatacggcttaagaagcttccaaatcaaatgattttgtacgcgattaaggactgggtttatggctaaatggcagcaaccaacaagaggcgaaatgattaattaatggagagattgattgaactcacagatgaagtcgatgatgacgcggccgtcggagaggcggccggtggggtggtggaagtaggtgcggccctccggcggcatgatccggatcccccccgccgccgccacgccgccggtgtcggagttggagtcgccgaagttgaacagcaccaccccggccgccgccgcctgctcacgctcctcctccgcggccgttgtagccgccactccggctccggcggcggcggcggaggcgtccgctccctctccggcggcggcggtggcggcgacgacggagccgaggttctgcctgacggcggcgcccatggcggacggcgagacgaacgcgagcgagagcaccatgaccgccaccaccaccgccgcgagcacgcagtagtactgcaggcgcaggctgatcaccttgttcccgcctccgcctccgccgttggtggggctcgccatggccatcgcgcgagctcgcctgagctctcgccttcgcggaggaagaagacgacgatggctgagtttctcttctcttctctctcaaaaaaagagcggtgagaaatgtgcgtacgcgtgtatacgcgtatatagtgtgattagtgtgtgacttggggtctcgtgtggttaggtgataattaggagtaattaattactagtagtagtttactaggactaagtgcacccgcaatggtaaagtaaggtgctatctataaaacatgtacacctcaacaatagactagattaatagtaaaccacttcaatggtatgtctacatgggtatctatagctctctaatccattgcctcgtttttctctatagactatctccatgttagtagataactttgctctctctcttcatttaatctcttctaagtaggaaaatatgctgacatggatctcttgtagagagcttatagataaccattgtgggtgccctaatggtgattagcgaatggacatcgagatacttagtacttcatccggttgataatacttgtcgttttggacaagggcacggtctctaaaaaaacaactttgactattattttccataataatatgtattgttaacaaatatatgattttattaaagtactttttaagaataatctatacatgtagtcatcatatttaaaagacaaatattttaaaaatgattcataataaaaattttaaaatttgatctcactcttatctaaaacaacaagtattatcaacccgaagaaagtattagtattatttagttggacatttttgtagttaagacttaagagtggattagttgggttttgaatgagatcacacactccctctcctcacttttttgaacttttcatagtttatagtacaagatacatgtttgttggtgtgtgctccctttgtgtcatattacaaatattgcaagttattttgagtttttcttaagttaaatttctttatgtatttaatgatactaatttggtgttgtaaatgttggtaatttattttttttcttcttatcgaacttggttgagtttgatttgggacaaatccaaaataacttataatatgagatagagggattatatcatttctttttttcctaattactttaaattttacaattgaaaatttacatttttttaatataggaggtgtatgtacatgctaaggtaatttgctagatattttagttaaggactaagatcatgaggttgattaattactgttaggacacaataattggagggagatggtgttgacgcagaggaagtgacggcggtatggcttggatttggacatattttggacattttcaaacttcaggggaagaagagtggacttaacaattgcattaacataatatgaataaacccacatggattatactaatgatgatttacagtgaatccaaaattaaataatggacgtctcagagctgtccttgtgattttttgccaatttaatggaaatttgcagaatcaaacaaaaggaaaaaaatattagtttttctactttcttgtattatacagttgtatagaaagaggttgtggcacaccaatcataactgtagaagtgtatggcatcttatatgacagtgacgtgcattatagcgatgcgtgtatatgaaaccagctgttaaggttgaaaaaaagtttactatcttttggactgatcatgtccggttatgattagcattcagcaggttttaattaagtaaatcaggcaaaaaaaggacctaatcccatttactaactattcaatttacgcttcctaggaacggatgaattttgccttttgtttttttagagatcgaactgattcctgcgagaattctgtagaactcctgtatatcaaaggagccctgcaatctgcaaataaagtacatatgtcaatgattttcttgaacagtatatagcatgagaaccttgtaatcctttagtactagcatggtacaaggaaatatttgttcaatgcaatggcaaagttgtaattttattacactttcatatccattttgcgtttttgctatcaaactgaggaccaacaagatcaaagtaccagagagttcttgcctgaaacgtggccagcttggtacagactccattcagtatacggttaaaacctgaaacttggatgcatctccctttgtttatattttttgtcagtagaggacagcaagttactttttatttgtttggattgtacaatactcttaatgtgtgtttagtttacatcaaatttgaaagtttgattgaaattgaaacgacaaaggttagaaatttttgtgtagaaaagttttgatgtgatggaaaagttagaagtttgaagaaaaagttaggaactaaaacaggccttagttcacttgtattttctattttgggtttgaactgccatactcactgcaaggggagttctgatttaaatttatagattcatctctatttatttatcaaaattaaagaaaagaattatacatagtattaacctgcacgtatcaaccccctaggatatacacacacaccccaagtgtacaaaaaaaataaaattttgaaattcttcatattctgttcttcctcaatgaccgaaaagggcctgaaatcaaatgaattcccttctgttggccagatctgttagtgattcaccttcaccatttcctttgggaaaccaaaataatcttaatttttcataaccgcgaatttttagcctttttgggcctgacaacgctggcggtcagcttgatcctaggaatggaaaattcgccacttatcactttagaagcaacgatctcgtttgcagcatcggtgaagtggaccccatcccagctgatgaacttctcaccaagcttacacaggtccttgtcattggccgtgcagcttttcttcggatcatagttgtaagggggccctccatgtc

SEQ ID NO: 77300 - DNA, 4111 bp, Oryza sativa
gaaaaaaaaacctatatatatatatatatatatatatatatatatatatatatatatatatatatatatataccttttttatatgtgccggtttgaaaaaaaaatcggcgcctataaagcatttttggccaaatcccaatcccactaagagaggagtattgatgccgattttaattaaaaaccggcactaaagaccctcctaccagctgtcaccaaaaaattagtttcggccactagataaaaaccagtaccttatagatgtcggttgtaaactccaaccgacacctatattatcatgacgtgataaggttaaaagtaaaaggtgccggttctcactaagattggcacccttgcttgttcatccacctgtctgccatgctctgcaagcttcatcagtaatagcaattaattggcctgtgacaggcaataatcatggcatgaacggcatgtaattaagatccatccaagtatccatatccaacaccctacatgcaggaaggaacgttcctagcaaggataatcaagtgtcatcatctctgatcagtctcacagaataataattaatgagatagatcattaggcaggcaggggcatggactaatgtcttcaaaatggttgttggatcactaacaagtaacaaccccgtcttgtttatggaacacattagctagctttagctagtgtagccatctaccccttaatcagtttgctaactggacacatggaacgagccactaaccaccttttaactcgcctaatattgatctctgctttgtttaaatcatatgtcatctcaaaggagagcaggaggcacactgagattattggggtggtggtcctctacgtacatatcaaatctttgatggcctaaaagatggagagatgctgtgcaaactgcaaagtgggattctgaatatctcccccgtgagtcacgacgtgtgcgttttgaaaaatgtcagaaatattgaagctagcagacaactcgatcgccattattcaggagcctcgtcggttgcccttatttgctaataagccaaaacggtttattagagaataaaaattaatttatagacaattttgttatatatttattcatagtgcctaaaaaaactattgttaaaaagaaattacgttaaaaatgtttgaaaatcaataaaaattcaaattttaatttttgcttcagctctacaaattttgtacaaccgattgggctctcaattcttcttcacatgcttcttcgcgtcatgcataaacacataatgcatttgattgattgatgatcacaagctaggcgacgacgtacgccgttcggtagggagagctgcatttgtcttttcttttttcagaagctagtagagtgacgtacagggtattcagcttaatcagtagcatggtacagtatagtaacatgcttgagctaatttcacacacatgcgattaatcagtgtatcgcatgttagcattggcgtattaattgcagcatatatcaagtggatcgacagcaactaatacacacagcatcagtggagagaactagtgagaactaactactctcaggatgatttttgcaacagttcatcgtctccagcggtgactgagttagaaagattttttttttacccgaacaaacttcattataaactatcatttgctataaaaatttcatcatcaatttattcaacaatgggagggacccgtgaacccccgcgtcgcccacgcgcaggcgacacggggggcgaaacctagctccgccgcccccctctttcccctttccccacctcgccgccgccggagctcaccgccggaaagttggccggcgagttaggagggcggcggcggggccttctcctgtggtggcgtcccctcttggcgcgggggaggcggcgaaaaccggcggcggggagtggcggcggcgagctctccgggcaagacgatgacggatctgcggttgctgtcaccggatctggcctggcccaggccggatccggcggaagcggccggcgttgtggcgcagcgcgaacgaaggaggtatggctggcagcggaggggcgcccctctctggcggcggagacggctcgcgaggccggcgcgcgcgccgacacacgcaagcggggcgcgaggcgtcgcccggtggagccgtcggcggcggggcacatcggcggctctgcaccggtggttggggcgacactgtcctagccgccgtggcgtccgcccccttcggcctgccccccctcccccttctccttgagttggcggcagggtcggccggtcgggcggatctgtgggcggtggcctaggctgattgctgaatggtcaatgtggcttgcgacgttccttgtgcaggttgcgtggatttgaatggggtatcgcgggtgaaagccctgctgtgccgttggccggcttgacgacggcggcgtctttcggcgtcgttcccctccttggaggcgttgttatagcgttgacccctttcttttccttaccgttctccgggtgaaaaccttgctccggcttccggatgaagcggtggcggcgaccacgtcgtgtccttcttggggcaccgctttggagaagctttctcgtacaaggatatcgttggtctttgcattggcttcgaagctttttagtcctaggtttcgacgaggcctttgctcttctagtttcactttttgtttcgcggcgggcgacctttgctccttgtttgattttgctaggtgaagtcggagctgcttcgttgtggtaatgaagctgggtaacgatgacacactacagtttctttctaggggtgttgttgctgaacatgaataggatgtggcgcttaggcagcttgggctgatgtccattgtgggatgttgaggccgcttgatcattatggcagcgtgttaggtatcgatgttgtattctaaagtcggagctgctgtgtcgcttggcggtaagctcggcaacgatgacagattgcaaagtcggaacctcctatattgctcttggtcaaatttggtatcgacaccctatgttgggctccgtcagtggtttttagttgtagtgtgttgtggcgagtgctgtgtgttcagccagtcggtggttgttttttcttttcttgtaacccgtctagggtttttactcctgcttattgaaaatataattggcagttctcctgccagtttagtttaaaaaaaatttattcaacaatatagcacgtgtgggcttcagtgcaaaggacagagagaagcccatctctgtatatgggccgtacatttggtccaaaagttccagattcagcgaactaattggcgcacgaacaaatgagtgaacacacccgatgcgttttattatcggaaaatgctgctacgaccaatctctctcaaaaaaaaaaaaacttgtacagttcttatatttcttttaatctaattcaggtggggtcttttccccccggtggatcaatgggcttgtttggttcagtaccctatcaaatcaaaatattgataggcctaaaatctaggtatgtttcagcactactaatattttagtacggcagagttgtaaataaatgtgtttggatttaaactaattgagagccaaattttaaattatagtgaagaatgttctataattgtaccaaatcgagcatgtgcattaccaaaaatttaacctcagaccaaaccatcacatttactattcaaaataaaaaaaatggtacaacacattttggtatcaaaccaaaacggcccaatattatcacgcgacagcagtcggcggaggtgttgtccgcagggagggcggtgcaacagacaataacagggatggagctacagtagaaccatcggggtcagccgaccctgatgacctccgatgaaatcgtaaattgtttaagcaattaagatgacatcaggaattaaacaagattagtatattctgaccccggtgacaccgatgaactaattcctccccgggcgacgagataattcagctgagcggactgataaaaaggttgactcgatcaacgatctgtgtttttgtggggttcggaattttattttccggcgccggtgaccccccaactccggtagggagcatacggattaggttttggagttggggtcagggtaggaggggg

SEQ ID NO: 77301 - DNA, 858 bp, Oryza sativa
  unsure (1)..(858): unsure at all n locations
gtcttgaacatcttggggtgtgttttgggagtcgttttttagcagcggtagcagctgnagcagttcaaagtggctgcagtntgcagcaattttgacctgcgccagcctcagcagctgtggcaggtatggctgctgaacagagcccctatttgttcaattatcaccctgtgacaggactttctgaaggcaagcttctgcatctagaatttctattttggtacttatagttcttgcgtgacatttgttctggcacaatgtaccaacaattttgatagtgaataactgagtacaatttaaaagatgaactttcaagatgattgttttgacggattctggatgacctcttatatataaactaggccactttgtaggatctgattacttgcaatttcaaacgttccccatttctccatttactaaccatgagcatccattttacatccaggaattttaataaagaagtaactatgaaatataaggaagttactccccaatgccttgaaccacgtggcccatgctgttggcctgttgtttgtgtaggcagagttctgttgtatgcgtagattaggagttctggtcgagtataattgctggatcttagactaggttcatggcaaatttgcaatgtgctacacgggactgtattcgtatgtggtgatttgatccatttaggcaatcaatcttcgttatggcgaactggtgtctgtttagttagtattgcaaagtcgcaaactggctaccattggatgactttctttatgatttcctttttaaaatcaaaatttccatggtaaatttgatttaactaggaaaaatgcctgtgtgttgcaatgggtgaaaaataaaagtacaccaaat

SEQ ID NO: 77302 - DNA, 4802 bp, Oryza sativa
  unsure (1)..(4802): unsure at all n locations
gaaaatctggatgaggatgtgtacatgacgcaatccaagggatttgttgatccacaatcagctaaaaagatatgcaagttgcataaatccatttatgggttgaagcaagcatctcggaggtggaatattcattttgatgaagtagtcaaggcgctgggctttgtcaaaaacgaagaagagccttgtgtatacaagaagattagtaggagcgcactggtgtttctaatcctacatgtagatgacaaattgttgattgagaatgatattcctatgcttgaatccgttaagacatcgttgaaaaatagtttttcaatgaaggacttaggggaagcagcatatattctgggcataaggatctatggagatagatcaaagaggctaattggattaagccatagcacatagattgacaaggtgttgaagaggttgaacatgcaagactctaagaaaggtttcttgccgatgtcacatggtattaatcttggcaagaatcagtgtcctcaaacgactgatgagcaaaacaagatgagtgtgattccatatgctttggcaattggatccataatgtatgccatgttatgtacacgtccagatgtttcatatgtatttagtgcaacaagccgatactaatcagatccaggtgagagtcactggattgttgtaaggaatatcctaaagtacttgagaagaactaagaatatgttcttagtctacggaggataggaagaactcgttgtaaatggttacaccgatgcaagcttccaaatcgacaaagatgattttagatcgtagtttggatttgtgttctgcctaaatggatgcgttgtgagttggaagagttccaagcaagatacagtcgccgactctacagcagaagccgaatacattgctgcttctgaagcagcaaaggagtttgtttggataaagaaatttgtttctcaactgggtgtgatggctagtgttcctagccctgtggaccactattaggataatagtggtgctattgcgcaagccaaggagcttagatcgcatcaaaaatccaaacacattttacggcagtatcaccacattcacgagatattgggtagaggagatgtgaagatatacaaaattcatacggatttgaacgttgcagatccgctgacaaagccactccctcagcctaagcaggcacacactagggcaatgggtattagatacgtgcatggttgactctagtgcaagtgggagactgttggttatatgtcctagaggcaatcataaagatgaatgtatcacatactatgtttacatatttatccgacattgtttgttgaaatagataactcattattggttatttaatatgtgattctttcatgagactctttatgttgtatattgctatttctaaaggatccctgatcaaataccatatgtggaacaaatatgtttagctgatcaatgcatgtattaattgatgatcatgtctcatggatcatggtatagagatactaaattaataatgtggacacatgttggggaacatgttggatagacccaacatgagacaccgcaagagccgtatgtgttgtgtcattagtgatctcatttagtcttcgtattaaatctttagacctgagattatcatggttctncacatgtatagtagcttacttagggactgctaaatgctactctgtaattgggtaagtttattttaaaaaaaaaaattaagggggggttctcggtatgctataaaacatatagtgggatatgaataatcaagatgagatttgcccttctatggagagatatatctgggccccctcgatcttatagattatagaagtgcatggccatgcaaaaggtgattgaggtgtcaatcacaagtaatataatctatcacaagtacgagtgaatggttgagctattagaggatgacacatatctagccttgagcttaatctatattgtgaggccaaggggtttatacaagtttacactagaggttcaaccgatatgatctttatgtatgctcggtgggtcaatacgttctgctaggggccgctgttgacacgtggaccgaaaaggagctttcgggttgcagccgagtatatatatgaacctacagggtcgcacgcttaaagggccggaataaagggattggatagagttccaatatgcactcaatcggatagggatccgagtaggactcatatgggcctcaaaggcccaatcgtggatccgatatatttgtgaggggtgtgaccgccggaatcaacacaccatgtgaaaccctagccgtcactccccttcccgagaaaaccctagccacgcgcgggtgctagcacatctgcgcgtggtgttccttccctggattgtggataccagtaaaggcgccgctgctttgtggtgctgatcggcttgggagcacggtgaggagaacgcatgcggaggaaaaggtcgagccggtgcgatcgactacttcctctacatcgacgcacactacatcgcgaggattccttagccttcttagcgcttacttccgctgcacagcacgtcgagtggtaacgatatatgatctaatactcgcatggttcttggtttacgcgctagaaaattttgatttatgctatcgtagcctgcgcgcattccaacatggtgctacactggtgtgtgcattgttgacaggatcttatataaatgagttgattgatgaagtgtctcaagaagataagaaccgatagaagattatagagggagaacgtcaagcgccacatgatagctttgtagatactggcgtgggcgtaattcaccgcacgattgatctgacgataaaaagtcgactcggctggggtggtttttgtgcagtaatttgcatgcacccacccgtgcgtatcgtgggagagggagagacggtaattggaccaattaggatggaagggcttggcttacaaacatactcttgtatattgtgctcttcattgcacattagcaattagtgaatctgaaacctcaattgtagatctaatggctagattaatttgaggtgatgtggcacactgtgggatgagagaattagagttagtggggatgaactatataagtatatagcattaactcaccataagtaaaactgttatttaattcaccataagtatatagcattaattcaccatgagtatctaagcaaacaaattacttatgctgatatgacaaatatcatacgcttattttctatcatatgataattttaaggtttgcaatgtatattttcccttgaaactcctccctagtattcacaactacgaaaatgatttcaggacccatctcaaattggccggggaccttactaggaatcagtgtgttgggggaagtggaggagtgccctcgcctcctcattttttttttacatctaataacctaatctcttctttctataaagctaatacggtaatacccactaaacaattaaagcttaacatgtaagcataatatttattagcactcctgaaacatacataccacatcaacccattaataacacaaagctcaacatgcaagcatataataattattatatctacgatttatttcattctaaaactaaacgtacatatgctaaatcatcattctcaaatcacttttataatatttcaattcaaataatttcatcatttctccattatctatttatctaacatacttcccgtagaaagcacgtcacttcatctagttagataattaacctaataacagtgtattaaactctctccaacccttagttctctcctatgtctaaatcgcgattcccccactgtcggcaatgctatcgctgtcggttttattagctgacactcactacgccagatcctcacacctctgacgggatacctgtgacgggcaaacgaattggtcagtattgaccattacctttgacgggttatacgggatgccgtcaccggtgaggcatctggccgcggcccgtcacaggtatcccctcacctgtgacgggccgaaaggaaaacccgtcagaggtataccagtgacgagtttttcttccaacccgtcactggtatcccctcacctgtgacgggccgatacattagaagccgtcagaggtgatgggccgccacctgtgacggctttcatttctggcccgtcacaggtgagcggataccagtgacgggccgttgaatagaagcccgtcaaaggtatgagcaatacctttgacgggcttttttttatctaacccgtttgaggtgtgttgggtctataaatacccccaaactgccaactgctttccatcccgaccattgtactgttcacaaatcggttgggagggcaaggggggcgattttttactaaaattcaaggtaaaaaacacattattctccattcattctcaacatatcgatcatcatttatttttcttcgtatgttgttgatttcagatggatcgtagatggatgtactatgcgcatcgttcgtctaccgagtatagagagggggtcactgaatttgtcacatttgcggataatgacagaaaaagtaggatgagcatgcacatgttgtgcccatgtagggactgtaagaatgaacagatgatcgaagacaaggatgaagtgcatgctcatttgataatgaatggattcatgaagaaatatacctgctggaccaagcatggagagcaagaggcgcctgatgtcgcagctgaagaagtgttggatcagggtgtagagaacaccgccgcagctcgagaaggcatgttcgtaccttctcctttaggtggagaccatagatttggacactcaatgtct

SEQ ID NO: 77303 - DNA, 8575 bp, Oryza sativa
cgatattaagattttttatgccgtaaaaaatctcgcatgtacccacatgcttcttcacaagcgttcttttcttgataaatatttgtgtaggaacttatgtcacaagaatagaaaattttgtcatcgaagtaaaaggttttagtcttttagacaataaagttattacagtagaaagcttgatcatttgagtagaaaatttcaggaaagtttgagtagactactttttgaattcaagcaaaaacactacaaatcaagcataagttttcatcactaatagaaaaaaggttttcgctgatggtggcgtaagccgcctcagtaaaggccagtaaaaatgaagacaactgaccgcctgcgaaatacatttccacaggcggcatgcttaagatagcaacatatgaaaattatatatcttcccaagtagctccattaggccagcatctaggaaaaaggatttccggtgacaaaaaagtgaattataaaagtactatttgtaaaaattcacaaatcaacaggtcaaaattcacggggcatataccaaacatcctcaaattttataaaattcacaatgcaattccaccaccccaaatttcacaaatgcaattccaccattccaaaattcacaacataaactcaagctttccacacatcccaaattcgcgagccctatccgctgtcgctgagctgccaccactgagcctcgtccaccgccggcttcgtgccctttggcagatttagactggagtggaggagagggagatagttgaggcgaagcagagggatttaaggacgactgattataaagcggtgatacggttttttttactggtggacctctttaggctccgcctgcaaaaaatatattttcagatgcgggtctagaacaataggaactctagttattttaacatttatggttcgcctgaaaaaaatcaaacctaagtgctttgaaaattcgttttatagtagtgtttttgaatgttttggattaaaaatattggtattttgaaaaaaaaatttctagaatagaaagtttcgataaatcttatgcactatcagaatgtatatttattaaaaaagatatggcataactaacatacaagattgatcccatcttccaatagacattatgcgctgcacgcagctaggacggcagcgaaggaggggtttgggcctttgggggtggggcggtaagccgtaccaggatcttccagatgacgacccacggctcggcggcagtgctgatcatgccgccgcacggagttgtcgcggctccgtacggcggcggtgagcactgagcagtgtgtcctttgctttttctggtgccggcaggattttcaatgggcctgcctttgctcttgggcttaacgtttgccaccacaagggcccatttacaggagtaatttggacaattgagatgacaacggatttggatctcaattgaatttctctaatctactgatttatcttcccatttcttctaccctatatctaccctataattcaccaactcactcttacacctatctaccctataattcaccaactcacttttatacctatctatctaccctataatttactaactcacttttacacctacattactcattcatcgaatccgacaatccgtactcatccatgtggaatccatccgatgatccacagtgctcattcggccccacccccaccaccacccccacccccacgcctcccggttccccgatccacgcacgcccgactcggcgactcgcacccccacctcaaaacctagctcctcctctctctcgcatcaacacaagcgccaccatcactatgccgatggaaggggagtcccgtgcgcccgaccaatgcttcgcatcctggtgagagaaaaagaggtaacctttctattccacgaccacggcgaaagtttggatcttgattcgaaaaaataggacacttttctctcccttgtttctgagctacaagaaatcctgttccgattacaaaattttcatcttttctgagaaccgtgagatactgattcttggagatgttcaatagtaaattagtccatagattatactctagactaaaattaggtttaggagaccctccccggattgatggatcaattgatctcgtgtgatgttaatttcagaggagggaaaatggaggtacagtcatctggggggggtccattgaagtgctcatggagaaggtcctgtcagtgaacatcctctcctcggactacttcaagagctgtacaggctcatgacgtaccacgaggtcatcgacgagatctacaactaggctgaccacgttgagccatggatgactggcaactgccgcagcccctccagcgtcctctgcctcctctatggattgggacccctgacgtgaagtcagagggatatggtgactgacatgtggggtccaccacttgtgggcccacatgttagtgaccacgtcacgtggcagtttaagtcagaggagcggcgttcgtcctctcttcaccatgaagctcacggttaagcaatggtgcgccatgttgtcatggcgggattatccccattgacgcctatgggtagtgtcactgccgcactccgggtcgcaatgatacctttgtgtcatcggtcatgctgctaatccattatataattaaaaatttaattctttgtattttccttcttatgactcttaaatatatattttatttcatgctttcttgtcaaaacagatcatgccttttgtttgttccatttgggctattatgtcgtcataatgtttattaggagttgttcatttttcgtgctatattaacattcttgttgcaagtaatttacagtcattgactgtttagcatcatttgagccactgtggttttaaattgatatataatttttttcccttttacaacgcacgggcacccaactagtatttaataaatacaaccagtgctgtctcgaaaagaatttgttcgtcactcaaacttcgataggaagataaatcagttgatttctcaaattcaattgagtcccaaattgctcatctaaattgggccttgtgtgtcaggcccattgaaaatgcagcgggcaccaggaaaataaaaggaaacgtcacacgcagctccgccgcaaccgtccactccgccgccgcgacaactccctgcggcgaccatggcgacaagatcagcgctaccgccgcgccgccgcggcctcccggaggagctcgtggtctgggagatcctggtacggcttccccctaaacccctcctccgctgccgcttggtctgccgcgcatggcgccgcctcacctccacccgcggcttcctcctcgcccaccaccgccatcaaccctccctcccgctcgtcgtcggctacggctgcgacggtgggagcctcctcgacatcctcacccttgaccgccgggacgccgctcggccgcggctccatcccgtggtgcggctcaagaacgccgctcacttcgtgagtgcatcctgcgacggcatccttatcctcaacatgaccaactgcggcgaattttactactcggtctgtaacccgaccactcgtcaattcgctgatctgccgatgctcactggtttcttcgtcatggggttttaccagcaccgccccaccggtgaataccggcttctactctactaccagtttcggccggaaggttctgaggatagatatgcctgctacgtctacacattgggctccagcgaaatgccgaggtgcattgggtggatggaggaggttgcaacctgcacagctgttgtgctgctccatggtagcctgcattggtataattacaaaacagacaagattttgattttcaacaccgcatccgagtcgttctggtcgatgcgtcaggctgacaagatgaatgggaatgatctgtttgagattgatggtacacttggcatctacttctgtaatgatgatgcgacgatcgtagatatttgggtactgcaggattacaagacagaattctggtctctcaagcaccggattgaattgccagtcccagatataaaggggaagcttgatgatggtgatgattggagtgcgatggtattgtctgaggacggggatgtgcttgtgctggtttactacagacaatggctgctttacattggtactgatggcaagctgttggcgagttttcaacatgatgttgggtgccactacaatactcctctgaagcttaagcaaagccttgttccacatgcattctttccattgttaaagggttatgtcgtgaatgctcgacctttcatctgatgctggagcggctttgctagttgttggactcgtcttgagatggtttcttttcatcctggtgggtagcaacttttggtgctgtcttttagaggttgtggacactgttatcttgtgggatgtcaccttgctaaaatgtactcaaaccctgctgaactatgtaatatgcagtagctggtttgccaatctttttcacaaaaagagaaaaaattctgatgtctgttggataaggtggagcttcctgttaacatttgtttccgattccctgagtgcttttctattttataccatagaatctctctgaactggacagattgaagtttgagcaaaggaactatttttttttttacttcttagcagaactgatggaaaatattatccggtcaggaagctaagtttggtttatgatatcctgattggatatatgaaatatacatctcgtattttggtctgaggtggctactactcttattgacgagtggtgacgctgtaatgctccaacgttttcatgtacataatttacaattaatttggtgctacactagaaacatttgacaaggtgcagcttggctcgtgcttgtttttttcttgaactgaaaacttctgtactttttatctggcaagcttatttacagctgaggaagtgctccagtgctgtcaaaaaaaatagtgaaatggcttctttggatctaactgatcgatgaaatgtttagttcatattctgtttactactagtctattacattgtgttcgaggagtgattaagctcacattccatgcaacacatggttttatttttgtcttttttgcaggaagttataatgttcaattgttatgatacaattttattgacgatggtcagtatgttgacaattaaatgctgcaaactatgaagcaagattatagtataccttatgctgatcacctatatattcatttcagcaatgtactcttgcttcctgtttaaaagaactctagcatttccatttagatgcttaccatttgaagtgagctttctattatgtatgggtcactgggcctcatgatagcatcagtcggtgtgatattctcagtcataaaattctagaaaaggtaacttgcagtatgcttgatagaagttatttttgtcctggttcagtccacactgccctgcaactgattcagtatgctttttttttcacaggcacaaacgctctctactgctatgatctctcaaacaaggtaaacttatgtacagcatataaatatttagctcctcacagttgtttctctggtgcatttcccttgctggaatctctagtaatggaaatgaaatataggacaaatagtttgggatatctgattatattacaactttcactttccaccatactcattgtgcatttatttaaaactccagatcgatatgattgcgatatgaacctgggacctgttccctcaatcaattcgtatgtggatttctggttgaaggtttcagcattttcatgaaaattgtaagaaaccgagtagcaaaaaatgctcttgtctggttacatttgaagaagcagtggttaggacctctttttgttggataatcacattccaatgtgcctttgcatgaatttggtgaaagtttttaaagtacttcacttgcggcgctttggtccaagtctaatgttgtatttcagcttttgctgtagtgcctatgaagtgggatgcatgtcaatttacttcattgacagttacctatataatcaaacccacaatctgcccttctatgtctagagtacctacacacatgcatcccctgttctttgaatttctttagaaccaaagggaagagcctgagtttcaagttttcttatcgaaaaccagaagccacagctgcttatcaacaggttatctcaaatgcaaagttccaaggctgacagctcatttagaacaaactgaaaacccaagtagcaaattccttaccaatgtctctacttacaatagaagcccagtcgtcctccttcccatccctcactcattgcacacagcgcaacatccctagaaaaattgctagaaaaaaaaaacagaaggaaaagccggttgtgcactctgaaaaaaaaccgcaaaaaaggaaaagaaaaaggaaaggtggttgtagtgcgctttgaacaaaaacataaaatttgctaataaaaaagtaaaaaaaaatggtggggtgatagaaaatttgctaaggaataataataaaaaattggttggataaagaaaaatcctcattttaatggtataaatcaattgtaatgtacgggtatataactagtatgaacaaacaccactgtgacagcaaaacaccctagcttatctccttcactgtggcctgtgggtgtcgaaaccaccacatagcaaatacgtggatggatatttttgctcaacaactggacaaagcaactttgtttgctgtgatggagaatacataacacatgtcaagcagcgctatgccgcctctgttcttggaatgcacaattaaacctgaaatactcaagatattgtacagatggcctaaaatctcccattatattgccatgaatattctaattacttgcttttattattgtcttcttcatcttcggttcattcacataaattgtcagtttcaatttctagagtgggctggtttggatgtgcttctaccatgcacctgaaagcatcctctacggcttccacatatccaagctttgcacccaaacgatttgtactgacactgaccatagtgaggcaggacaggtgctggatgcctagacaaaaaccaccatatgttgacttgaaattagctacattgattccaaacgaaagttgtccaagccttggcatagatccagcttcaaacatcagacccgtatgcgtagattggaaagtgaaaggctccaactgttggaatccatggatgtcgctgatggcaatagatctttcattttggtctgggtctaaacataggtacaaatttgtcaaactgggtatacttccaaggacctgaagatcatcttgatctatgtccttaatagtaagagccaatcgccggatgctcacaagggagctctgccatatgttaaccatggaaatgctttctcctctgagtacaaaacttttaatgctatttagaggtagtaacaaggaagagaaatcatcgttgtttctcaagtgaacatgaatgctcagatcatggagattgcaggcttctagtttgcagagagaagatgctattatttccttgtatctcactttattaccttctagcctgtcaatatcccaatttatgctcaacctccacaggtttttcagctcacacagtccctccagaaattccatcgagtgtctgaatacatctatgcctactacctcttctaacatttgcatatttttgaattgatcaggcaactttgttccatcattgacatacagaacagctaatcgctgcagctgagtagtagatttaggcagttcttttaccgatgtagctatgacatctagcacctctagacatttgagatctccaaattttcttggaagttcagttatcttcttcccttggattgtcaggtacctcaactgagaaagtcttgtcacagtctcaagatgatggttttctaatccacattcagcacaaaaccacaagtccagcacacgcaaggtgctgaagttggagaaagtgggtagttgctttgcaccccaaaaaatagtagggatctaagctgcgataaattccagcttggagaaataattatgtctgattgctcgtgtccctgtatcagagatagtcgacgaaccttcatatctggagttgacaaacatgtaagctgtggatagttgattgtagcagcaaagttctcttcaatagacttggacaagaggaaatcgtggatggtgtcatggactcgacaactccgcgcttggccatcaatgcgtatttccaatggctggactaagcttctgttaataagttaatagaaataagaatttcccaatttatataggttttgtcgactatctccttgaatgaatccttcagctatccatctatctatcaaatgcattcgaggaatcctaaaatcttctgggaatatagtcagaaacaacaagcaagttctgagatgttgaggtaggtcgaaatagctgagagataatatcttatgccttaaaatctgaattctctgcaagtgcataaccaatggatctttgtatccgatcccattgatctgttttgttcttgttagccaacaggctagatgtggtaatgattgccaatggcaaaccaccacatttcctcaatattgcattcg

SEQ ID NO: 77304 - DNA, 3924 bp, Oryza sativa
gtgttgcacgagcgtgacgatggcattttagcgaagcaacttggcggaattgcattacagcgaaacccatcctacaaagtgactaaatgtcaattttctcgtcatcaacacattcgaggacatcatgggtgccttcgtcaaggctacgtagcagcgctcaacccagaatgcgtgggggcatcaagacaacatgcgccggtgccggcacggatgccgacgtgagggccagcccaggcaacctaaccgacgtagacgctgaccgtatccttgcctagctcgacgcccatctaccggcgtccatgctgtacataagcttcggcaatatctcgcatctggcggcgaagcagacgctactacgaaaaccttttttcatgcgggcgggaaggatctttgcatgcggacatgcggttacgccaaccgcatgggcgagaaagtctgcgaaaatcacgcttttcacatgcggtcgcttataccgtccgcatgcgaaaataaattcggcaaacaaaaaaaataaaaaacaaaaaacccgaaccctagccccccgccgaccgccgtcgtcgccggcgccagatctgtcgcccccgctgcccaccatcgttgccaacgctggatcggcctcccccgccacccgctgtccacaccggcaccggatcggctacctcatcatccgccatcaaagtcgatgctggatccgctgcgagggaggagcgcccttggcgctggatccgctcggagcggcaccgcccgaggctgccgaaccgcccccaccgcagcggcggtgaggagaggagagggttgcctcgtcgtcgtcatcgtcggtggtggcggtgagaagggcatggcggtggcgccgctgcccactcgccggatccgccgcccgtcgacgccatcgccgcccctgctcacccctgctcacggccgccggcacatgctcttggagaggagagaaagagagagagacaggggaggagagaaagagagagaggggagagtaaaataatagagggggagagatagaggagatgggttgcaaaaaaaaatttgaaatcgtgggagggaaaagagagtggagggagataaaaaaaaatagggtggcatttttgcatgcggtcctcttaaggggccgcatgcaaaaatatgagaaatttgaatcgaattttatggtactaaatcacaattcatgtgaaaaaattgtcaaaaacaaagttatagaattcattgagatctaccaattttcttttggttatttctccatccgagattgattgaactatctaaaatttaattttaaaatataagaaatttaaacaattttttgggtagtaaatgatttcaaatgaaaaaattatcaataccaaagttgtataacttatcaagatctacaactttcgttttgaacatttttctatatgactctgtttcaacaatttgaatttgaatttcaaattaggagtacttcaaacaagattttgaaataataaatgatttcagctgaaaaagtcatcaacaacaaagttatataactcatcaagatctttaacttttattttagtcatttcttcatccgacaaagtgataataacatagttcacaaaatttacatatctcttatatggttttctaagctataagagagatatgtaaattttgtgaaaatgttactatcactttgtcggatgaagaaatgaccaaaataaaagttatagatcttgataagttatacaacttttgttgttgatgactttttcaactgaaattatttactgcttcaaaatattatttgaagttttgaaattcaaatttttaatggataaaacgaagtcacaagaaaaaatggccaaaataatagtagaaagaacacaataacatgatagagcatgatttaagaaacatttaggtaaaagaatcatccaatttggagttcatatgagtgagataaattagtttcatattttcaaattttattttctcatacggctccttaagacacccgtatggaaaaatcgatttttccatgcgggctcttaagcggtccgcatgcaaaattgagctcatttttgcatgcgtacctcttaagtggcccgtatagaaaaatcgattttcccttacgggcgtcttaaggagctgtatgtgaaaatgccgcttgatttttccagatgcggcaagttatggtccatttgcaaaaattatggggtctcatacagaaaaatcatttgtgtagtagtgagatcattgagctcactcgcgacatcgaggcatcgacccagctattcatctgggccatcaaggaggccaagccaccaccgccgccgccggtgtcaagggagagtggctcgatggcaagggatatgaggagcacatcacggataggggtctcctggtgcgtggtgggcgccataggtgagcatccttgtgacatcctggaacaattaggatgaggtctgtgtggcccataaaaactgtgtgcatgtttaatatcatcttgctagttttgcaagagtggaaccaacttataaggacttctactccaaacatatcactcccaggttaacacttttacatgaagcgagcacgaaagtttaagtggagtggtgtgtgtaagtgggccggtccgtccaacggcctggctacacggttttggaacgtgggttgttagcggttgcgcgtacgggtcagtatgcgggcatatggcgcatggcgcatgtgggtctatgcgaggcacattttttgttcttggacatttgcctatatgattgtgtcgctatgtgggtgagttggaccgatgaggacatcgggtcctttcagggaggtgtatgtgacatcctggcccaattaggatgaggactgtgtggtccataagagctgtgtgcatgtttagtaccatcttactagtttagcaacaatagaaccaacttataagtgcttctccctccaaccatatcactcctgggttaacccttttgcactaagtgaggatgaaagtgtaagtggagtggtatgtataagtgggcctgcccgtcggttgagctggattgcgtggttctggagggagggatgttacaatcctctagcacccagccacgggcgggttcctaacccactatgggtagaacgccgtgctggagggccatcaaccatgtcctgccggcactgacatggccaaccatcctcgactagttcagcgagcggttgctcgtttatgtgcttggcgttggtgtcaggtcgggtgtcaccacaccactcatgttcctccccaatgaggccgaggaagtgcaggttgctagcaccagcgtggaaaagtctgtggccaagctgatggatggcgacacggacaacacggctaggagggcacctggtagagagctcgctgtgagggccagggcggcagtaggtcgggcgtcaccaagccgctcatgtacctccccgtcgaggccgagggcatgcaggtcgccagctccgacgtggagatggcatggccaagctgaatggatggcagcacagacgatgcagctaggagggcacacgctagagaactcgttgtgagggcgagggtgatggttgtctgcgtcaacccctctcttgtatgcacgtgctgctttccgtcagatgctatgacctccacggcgccaacagaggggatataaagagaaaacagttcactagtggagaaaacatctttgcccggtcgaccaaaaaccacaatagtctcggatgcagtaaaaaccgggactaaagatggtttttagtcccagtttataagtagaacgagactacatgatctttagtcccggttcacatgctgtcaggtgttgtcaagcccctccagcatctttagtcgcggttgcagttacgaaccgggagtaaagatcggatctttaatcccggttcgtaacagcaaccgcgaccaaagatgctggaggggct

SEQ ID NO: 77305 - DNA, 3114 bp, Oryza sativa
caatggctttcctgatttcagcaactatgggaggaagctttcgaagaatttcatcataggacaagtgcaaaacgcccattaaatcattgtgccctatgtccatggtatagagggcattttcaaaccctttgctatcaattggggcatcctcacctggatgacattcaccaaaattaagcaactttgtcactccaaaacaatgcaaataagtcggaaacccaattaattgcgcaaaaaaggaacactttgcttagaacaaaatgtcaccaaattaagatcaaaccgacctctttcgatggactccaagcatctctccttgaaaaatatgaactgatcaagctgcacatcaagcgaaaatgtggtttctcccggtgttgccgtcgagccggcgatggcgaaattcacaccgttgttgtaatccgctcccagtggcctcatgaacgggctgaggtggtgagtgttcaagctctcacctgaaaaacaatgtcatgtcacaccaccacagatcatcaggtagaaagttcagagttttttttttttgagagggaggggggatacgcaaggatagtgtatcgttgcattaagaggaataaagtttttgtacaaccgaaaacagacaaccaaaggtacattctgcaaatggtttgtttgcactttcagttgaaagataaacaagaactggcaaaaagatgggcagcacatgcacaagattccaattgcccttacaaaaggaaaaaacaaaatctaatagtgatttacatctcacttgtgctaaaacaacgaggtggtcctgaagaaacaaggttccatgcttaagaatgcagctgagctgttgagtgagatgcacttgagagctacatgacccggtactgcactggtgacctgtgcatttatttgcagtaaactgaaaggcaacacaccgtgatcgagaggcgaccggtacgtctgtcgcattcggtttactcaactaattcaacttctatttataaggtagtagcaagcataagaacaatatttttttttcaccttgctaaaaaaatctgtgatgcaacagctcttctttttttttctcatttataatctacagctaaattgaaaaggtgggtgagtacacaaagattagtactccatgcttagtagtacagtactaacatggggacgaaaactaaagcgtgactagctcataagttttctctaggacaacaaaaacaccaaggaaaaaaaaacactagtcaatcaagatgtaacctagtggcaagtaatccattcatctacttttgatagttatatttcatcttggcacacagactaaggataagtgattccgcttatcatccatttaaacatgtcactggtcatttctcgtaaacaagcgattcattaatatttatatttctcgatgcccaggtagtcaatcttgtgtggaagaatgaagagttacgcattaaatacaagaaagccattaagatgataagttgttggattgaaatatgtcaattaaaaataaatatttcagatttaaaaatataactattaaaagtagatggagggagtatttaagaagaaaatacgagcgtgcccagaaaaccaacacactcctacgactacgctagtaagtgtgcatctcaatcacaatggaacaggaggaaacaggagggcatgcggatgcatggagaaaagaatgtgtccgtgcagagaattgattgcccacggagtggaagagataccagaatagcgtgttgagctgagcacaatatctctttgaaactcgtggctccactcaggcttcacagaactggaccagagtagtcttttcggcttttcgcaaataccatttgattatcggtgaaatccaactaaattttgtcaaaaaattaaaatatactttgattttgttaacttgacttgggaaacctttcccaatttgacccagaaagtccggttttcgccggtttcgtaaaccccggctcagctagtatatatatatttcaatgaagtgaatgaacaactctagctagcatcactggaacggtagttgagcgagaatggcgggagttattaatgtcatggaagagcctgaaactggtggcaactggcaagtagaagtagttctagcgttcttgccttctcggcatgtggcacaggcaattaattcctctccatttagagagagagagagagagagagagagagagagaggagggagattttcttctgggaattatgggaatattaggcagaagagatcagacagaatgaaggcatcatattgatgatatggtgtgaatggtggaatcagtgaccacactggaagtgtcggaccatctagtagtactagtataggagacgacagagaaagttaggttcaagtaacagtgtaacacgctttccttcctccttcagtttccttttgctgatccgtgacagcttcctaatgcagaatgctggaggaattcatcgtgataaaagatagggtgtgtttcgttcacgctaaaattggaagtttggttgaaattggaacgatgtgacgaaaaagttggaagtttgtgtgtgtaggaaagttttaatgtgatggaaaagttagaagtttgaaaaaaaatttggaactaaacaaggccatagtactagtacaaagaagaagaagtctttttttacgaaattcatgcgttccaaacaaatcaccaatctaccatgaaagaacttgaattctgaactacaaggaacctttgacaatcacaagtgaatatatcaaacttcaccaagcagaggtaaagccatatcgtttcacttatacttatacttataaaaatttaaagtttgaataattttagagttgttgttttttcatcatagtttattttacaacatttacttttaaatcgctaaatatatatatataaaagttttacatacaaattattttttaattattaacaagccgtatagataagcataactgtaagcgatacaatgggctggtaccaccactatacattatgtaactgtcgcttgtgccttacgattgaagaagctattccctccgtcccaaaaaaaaaaaagacaaaccctggtttccgtgtccaatgtttgaccgtccgtttatttgaaaaaatt

SEQ ID NO: 77306 - DNA, 5206 bp, Oryza sativa
aggaaatgtcagtatgaggttctggtctcaaggtgccaacgacttgaaacttgaaagaatggcacatttgccatgtgcaggatataaacaaagaggagtagtaggtgagagaccgtgagagagaccctcgttgaaggtgcaaaggtgctctttacgacttgatcttgccttgctgttcttgcattggaagtacacaaaaactactccaaaccagtacactccgtactcgccattggcaagctaaatactaccagaccattcgactaaaaagaagataaaaaagaaagaaaatgggtacagtaacttattttttttactatctcatctgttgcctaaaaagaataaactgaactaaaaaactttaacttttaagttgattttaaaatattttaaacttttttcaacattaaattttaaataattaaaaacatatataaaaattttacttataaaatattttttatctgttaataaatcattattgtttataatcagctgttaagcaaccgtgagacaaccattcactgtccattcaagtagtcaatttgctgcgaaagggtatatagtctaatggttataagagcctcaatagtattttaggtcctagattcaactctttatgggagcgaatttttcaggatttaatagtattatgctttcagtggtaggtgacgtacccgttgtgtgttgtgttgtactgtataatcttttttaaaaaatagtcaacttgccactttggcagagtttattattattttttactgcagggtaagaaccccaagaggcaagtaggcaaccgcaaccagccaaccacaggagttaggacaggagacatgctcccaaagaggcaaagatagcaaggaccgggtcgcacaattttgacggctgccacgtgtcagcaacaccaccccgcgcgtgccgcgtgccaggagcgggaagacgagctgtccgcgtcgtgcgatccagcgttgctctctccatcccaaccgttaattaatcaacacacctgccttttctttcattctctcttcttttcctttccttagacaaaactccaaatccattccaaaaacttttttcttaaaaaatggcaaacctaccgtgacattggaccattttgcaaaagaacaaataaaataaaataaaatgattttcactccccttttttccctgaggggtggttgtcacgttctgatcaagcatccaggttccaagctggaacctggagaaaaaaaaatagggacgtcctaccatgcgagtgaaccaaacaaagatgtacaaagacctgcgtgatggtgatgctgcagttgttgcggttggtacaaaatttgaagaatttttttcaaagtttgtacgtaccaatacgacccatagtcaacactctaacaaaatgagccagtacccaatcctaaattcagtcggttgtgcctttcgagtcgttcatttttgggcccaaaatattgagaataaaacgagactataccgaccaagtattcaatatccttctttggatagggtttttcacgtaaattggttcaatctcaataaatttcttcaaacttccatcgttcatttttttttctagaataaaatatcagaatttccccgtaatttgtttcagttctaaacttctaataccaaacattttacatcctgtattttttaaaaccgaacaaattataaagggttaattagatatatgccattaaaaatttgccggatttgaaatatgccatcagtattcgcgtatttggaaccataccattgcaattttacacatattcaagatatgccactaccaatcatttatgaaaaaatttggaccaaattacccttctttccttttttttctccccctcctttcttccacagctcagagaactggcggcggcggagcggcggcagcagcgagcggagcaagcggctgcagcggtggagcgagcggcgcggcggcggagcggcggcagcaacgagcggagcaagcggcggcaacggcgagcggcgcgagcggcggcggccgagcgagcggcagcagcgtgcggcgagcggcgcggcgaagcgaccgacggcagcagcgagcggcggcggcggtggcggagcggcagcaacagcgagcagcggcggcggagcgagcggcggtggcggagcggcgagcggcagcgacgtcacagcaacagcgcggcagcgacagcaacagcggcggtgacggcgccagagtagaagcagcggggaaagagctagagatgagagaagagggagagaggtagaagatgagggcattttcgtccaatacatgtaaaatacgtatcttagtggcaccactgagattacaacaaatagcaatggcatcattccaaatacgtaaatattaatggcatattttaaaaccggcaaaattttcatgacatgtatctaattaacccaattataaattatctgactatagctagccgagtactaagaaagtgtggcaacttcaaaaatttatggctatgatctatgcaccaaacaaccgtataaaaaagtttaaactctcctaaaatttgacaaaccaaccgaccacaacctctccaccgatagaggtttaattaaattaaaccatgcttattattaagtaatctaacgatgacaataaaacagagttccaacttccaagccagtcaatatcacgctaagtagaaaaggactaattaaacttaaataaatcccaagccatctaagctcgaacactaataaaaaacagaacgcatacgcatttaaaatccaaattaatctgcacttcgaatcagatttaaaatttgagattaggattgggaggaggaggaggaggaggaggaactcacagatgaagtcgaggatgacgcggccgtcggagaggcggccggtggggtggtggaagtaggcgcggccctccggcgccgcgatgtggatccccatcaccgccgccacgccgccggtgtcggagttggagtcgccgaagttgaacaccaccaccccggccgccgccttcttctccgccgccacctcctcctcctccccgctccacacgtgcttccgcttgcccttgccccgctccaccccgccgccgccgggagcagccgccgccgccgccgcggctgagtctacggtggcggcggaggagcggacggttgcgccgccgccgtcgacggtggggggcgcggtggcgggggcaggcatgtagcggagcgtggcgagcacgacggcggcggcgacgaagcccatcacgcagtagtactgcacacggagaaggcccatcctcttcatcaccccgccgccgccgccgccgcctccgccgccgcagccgttcatcgcgctcgccatcgccgccggcgagcttttccggtggagacgagaagtaattaatccttcggagaaaatggaatggcgatgatgcgtgtggaaccgtgtgttttatatataaacacaggatgcaggcacatgtgtcactagcactttatgcttgggtttcaaacaatgtgtgtgtgtggaggagttggtgtgtttgaaattttattatatgttttctcttgctttttcttgggtggttgtcaattctttagcttttgttttagtactgatgataacaacatacatcaccaataaaataatttttagcacattttatttgttttttcaaaagaaagtcatgatgttaggatttactaaactgtttgcggtaaggatactgccaccctacggtttgacgattactgtgaaaaccaaacggttaccgcgaggtataccgtggttttgtaaaccctgccagatgccaatgttttccttcctataagcccctacgtttaaaaaaatcttgttattggatattaaacatatttaaactctcattactctttttttaaaaagaaaaaaatataagtactaaaaatatattgacatccgttacgttacaaacattaagttttcgttcgtcgtaattcaatcgatcaaagttaaaaataatatcggttagtactaaggctgtgtttagttgatggcaaagtttggattttggttgaaattggagatgatgtgactgaaaagttgtgtgtgtatgacaggttgatgtgatggaaaaggactgaagtttggatctaaacacagcctaacatggtatctgtgatgaaccatagtatatgacgacacatacttgcaccccctgcagggctcacaaaattcttattgaaatgcaaatgcaaatgcacacgcatacatagtatagtacacaacttaaatcatggtaggtggtgacaacatgaacctagctaagctatacacatgcacacacacacgtaaaagtctaccagaatcactttccgttgtcatgccagcatctttaatcatcatccagcttacttatattaacataatcagctgattctagaggcgcaataattaatgacggtgaggggatgattaaattaattagtagtagaaactagtgagaaagcaggtggaaaatgcacataaaggtgatactgctttagttgttgcaagccgtcgtggttgatcgatcagatcgatcgaacgttcgttgatcgtgtggttggtgcaacgttggtttcctatcttggccaaggaaagaaagctgacatcgcatggacctgagcttgttaccggcgagcagcgagcgagcgagcgagcaaccgcaacggcgacgccgcatccgccggcgggtcgggatcgatcgagacgcattccatccatcggtctcggtcgtctcgcctctccagcatatatgcagatttctcggtcggtcgccgcgaaaaatcttgtttgttggtattagtaggtgtgtggctgggctccgcgactttgatatatactcactctgtttcacagtgacgtagctagaatttatagtaaagatggtccatctatatgtaatatgtcaattaaataggtggtccactatataatttttattatattaactagcacatatactatagttttaatcttgatcaaatttttaggtggtccatggaccacagtgccacctagctggctacgccactgctgtttcatatataaaactttctagttttacccaatgtctagattcattaacatctatatgaatatggacaatatttgctagaaaatcttataatataaaacgaagaaaatatgttttttttcccaagcaaacccatcgtaacgtaatgcaacagaaaacggatgcagg

SEQ ID NO: 77307 - DNA, 664 bp, Oryza sativa
ttggtgattcgttggttgaacttgaacagcactagaaataagcatcaccacccttgcctggcataaacaccacatgattgaattaactagatataggcatacccatgcaatgaacatgcttcaataaactaaccaggggcaacatctggaggttttggtatatatatacgtggagattgttgagattgtctggcatcccaaatcctgcatgtcccatcatctgatgatatgcacaccaatattgtgtacataattgagagaaaaatagcaagcaaataacaaattgcaagatcaagggtacataagcaaacaagataaggctatatcacaagaatatatatggaataaacatattgtaataaatctgacatgcataagcattcttcatggtatgaaaatcgcacttatgagatctgcagcgttcaaaaagaaagttacatttacattaaagaaaaatcacatgatacaccatggggtgtaccatttcctttattaggaaatggcatactagtgtccactagaacagttacataattcacataggtattagtaactttagtgctatgtgcacaaataagtaggactgaacaaattaagttcactcacatactctggaatagataagtcttcatatatcgcctgtgatatactccctccgtttcag

SEQ ID NO: 77308 - DNA, 7943 bp, Oryza sativa
ctacaattaattattagtacaccaaagggagcgcactttaaacaaaaacttaaaaaacactcccaaacatgaagcaaacataaactaataaacgccaacacaagataaagagtacacaattattagatcctatttgtgaacctccatctgaaattaacaaaaagctacatgactgttatctcaagattacggtatgcagactttaaaaacttaatatcttcatcacacgtttgtagttgtgcccagaaccgaagtcaatatgtttccctgaaaagaacctgcatataagatatagatgtcaaaagtcaaaaggaatattaatttaatggagaaattaagtaatgtgacacacttgtgtgcagggcttgtgcgattaaaatatatatgaatttcgtaaaaaatactttagatctaattttcaatttcatgatattaatccgctatacagactacaaaatcattcaactatattttcagaaaaaaaaacattaatgggagatatcgatataatgtcttcgtttggcttcttttttatcacatgcaattctccacgctacagtgaaatatacatttctggccgtccggggcatacaattagtcctaacattttgaagtttaataattagtaattggcgaaacaattcttcaaatgcacctttttttgttgctactaacattttgtataaatacttggggctgaagttacatttatgatttttctatacctcgatctcgtccaaaatttgaaaatatatccatgctcaaaatattaaagtatgacttgaaaccataagtccatatcgaaaacacgtttttttgtgaccgaagcaagtattctaacatggtgacggctactatatataccaaaaaaacaacatgacaaatacgtatgggatccaccgttaattagggtgttagttaaacggcctagctgtcggcgactgtaacagtgggacatcgtacagtactccctccgtaaaaaaaaaaggcaaaccacgggtttgcgtgccaacgtttgactgtccatcttatatgaaatttttttataattagtatttttattgttgttagatgataaaacatgattaatactttatgcgtgacttatctttttaatttttttcataatttttttaaataagatggacggtcaaacattggacacggaaaccagggtttgtctttttttttgggacggagggagtacatacgaagctgcccagcagcagccgccaaatgcacaaaaaaaacactttttcccctttttgaatacgaaaatcaaagaaatgccttggaattaccagtgctatgtactccctccgtcctaaaatataattatttttaaatcataacacggtctccgagatactactttgaccaataatatctataaaaataaaacgttttaaataaaaagagttatatattatgatagtttgtttaatgataaatctagtaacatcaattttacatgattgatctttttttattaatgattaaaattaaaaatgtttgatatattattatgctaaaaatacttatattttaggatattttgggatggaaggattgcctaattaaatcatgcggcaattgcttcaggagcagacaagccaatcaggcagagataccatcatgagattacaaaaggccatttgatcgatgtgccatcatgtacatgcacgaaaaaaaataatgttttatatattaccacatcatggcaatatatggtttggcagtagaaaaaggtgacaggtacgcgcctgaaaatgcaaatatcttcttctaatgatcaaggcccctgcctcagcttagtccaaataaacttactattaacttaccaaacaaatttaaacgagctgttcctttcagatctaccaaacgatgtagtttgtcgatggaaatgagaaccaatttggtagttagtattactttccagtacttaaggagtagttagcaagtggatggagatgatgacatataattgtatatataatggagacatggagttggtagtacggagtactcccttcgtcaaaaaataaatctaaaatttgatatgacacattctgaatctcgggtatgtctagatttgtaacgtggtaacggcacgaagagttgccagctctgaagcaaacaagtcagcagattagactagaaaaattaccagttcgcaagtcttgggtagcgatcgtgccgacgagccagatcacctggcgctctgcgtcggtctcacgtacggccgagatgctcaatcctcagcgtttcagctgagcgcttgtaaaatttgtaatttttttatttctccttcgatatatataaccttctaaaaatttatcaagtataaatatagtatgatagcgtgataacattatagcatgcatgtaattacgattaactttcgttgtaacactattttcatgaagcggacgcttaggaacatatataattccctcgtccgtacacacattatgatttttttattcctggtttgcataaattatgtaaagattataaataagttacattgtaattacatacgagttatgatataattacactataattatacaatacttgcatttgacaaaatgtatagcggaatcgaaagggaaaagtaaaataaaatgagagagaaaaataagaaacaaatatgggaaaattgggaagatatataaaagaagatgaaaatggtaaatacatatatgaatggaataagtctattttgcgtcctttgtatgaggagacagagccctcccttcaggagggactagccgaattcaggaacgagtatgaagagaaaggctacatcgaggctggtgaagactaccacacatacatggctgaggttcaagaatggtcgaagaaatattgggatctttattttaacacttcagagatggaggaggaggaggatgactgactgacttttattttaacactccagaggtggaggaggaggaagatgactgactgactaagcaagtatttatgtcatttagagcctgctcagtatttaggttgctgtgaattctcctactgggaatctaatataatttgctttgtttacatctatttgttttcatgtaagactggtttgttggctactatccatccatctatatcatatttacatgtgatccttgtgtgctagtattacaaaaaaggcttgtgatttttggtgttatgtttgtaacaaggcgcatgtattgatcttgcaagggtggtaacaatcagtgtacgtgacattttgattctggccgttgctctaatgtttactttcaggaattcctttccctgtaaaaaagaggtttttttttcctttcccagaatcctgtaaaaataaggatatatgttccctggattctttcttcagaaatttctagacttactgacaatgacaaatccatttccgtgcgataagtatattcagtaacagtatatatgaaaaaaaaattcctttcgatatttcaggattacctgataaatatttccatatggtatacctgtctttacaaatattccttgtttcttcctttagaggatataagacatgctacgaaaccagaataatctttgggctaattttctcatgggacattgttattgtgagttgtttcatttcattctcgtttatcatatactatagactatagtgcagggatgcactaatttgctagtgaactgtttcagctccaaaataatgagttggagcatgctctctttgccattgtttagagaagtagccaagagttattttgagacctattttttagcacaagaaaatagccctccaataaaatagccttaaattgtttggatccaagggttattttgagagctatttggcgtttaatgtaccttcccacagagagatatagagaaaagaccattttcagcgggccccacccgaaatagccccaattaacaccccttgggtgggatagttttttttttcgaggaaccgacgacaggagtttctcctgtcggaatttatagaagaagagaattggcccagttaataagggaaaccgggcccaaaaacctaacaagcacggttaattaaacgggaaaccgacaaaaacctatacagaaaagaaaaaggaagcaactaatgagacctcacacaagtcgtcgttgccgagcttgccaaaggcaagcagcttcaaacaacaaaatgcacgaggtctccacccaacattctctagtgaagcggaaaccttctgagcgaagccttcaacaagggaaacaacattaagaatgttgtcaacgcccgttcccaaaaggaacccggatttcacctgaagggagagagagccatcatgacgatgcctccaaggaggaaacggcaccgacaagcgtcgaaatcatcagcctaggaaagcactaggcaaggttttcacccgagactctctcaaaaatgctccacctcccaaccctcgtcgtgttgcctggacgtctgttgagggtcatcgttgccgagcttgcaagacaagcagctccgactctgcctcaacggtcaatcacaatgcagctcgaccagagaccacctcacacacaggaacccaactgcagcaaacctacgacgtggccgacgaacagcgagatagaacaccggaaaccaactccacacgccacccctaccacaccaaggagctccccggcaacgactggaagcagcctagcctaagaagggaggagcacctaagaagaggggagcgggcatcgcaccgccagagagcacttggaagaagaacaactggagaagaggagaaccggatctggagggaaaggacggatggagatggaggcgccgtccccgccgccgacaaaccgcagcaggtcggcagccccggccaggtccgcggcagctggcgccggagcagccgtcgacgccgacgaggccgcgccggagaagcccgtcgtcgccgccgcccggcctcgacgtcgggtcgggaccgagggccgctgcccgccgccatttcgctagcccctcatcggctcgccgccgccggtggaagtaccagattcggccaagggagggccggatccgagcacaccacacgctggcctgggctcgtcgccgtcgccgccgcccagcctggtcgtcacatagcacgcgccatcgccgccgcccggcctcgtcgtcgcgcagcttgcgccgacaccgccaccatcccgccagccccttgaaggctcgccgccgccaagtgagggccggatccgagctcaccggcgccggatccggacgtcgttgcgaagccatgctccacctccggtctcgtcggcgccccaaccgcgttgaccaaggagtgagggagatggggagccccgccgccgccgtctttgcagctgcccggctttgccggtggctgctcgggcggcggtgaggcggggggaggaggggaagggtggggcggcggcggatttcgccgcccgcgtcgtccctggggcggagcgaccgagcggaggcaacctaacttgccgttggtgggatagtttttttgggtgggttattttcaaatagccctcaaatagctcacccttttggatctttttggactatttgagggagggctaaaaaatatcccttggatcaaacagggcctttgtgggggtctcccctttatatttggctgcttttacgtggccttagtgtagtatattagtactttagtagaatataataaatctaacaattgatttttatgggtactctataccttctataaacgacctctgaggtattgttgattatgaatacctattttcagggtacatgtgctgctcttccttctccgaacagcagagtagcatatctgtagactgtagtgtactcagcagcttattccatccaaccatactcaataacatgctgttactccatctcaatctttgcatatagttcagtaacatctcagtttttactactaaatgggtccctaatagggataagctggccacaggcctccatttcaatctagtctaataggtttacatttatcatcatcgccccaatgggcacagacacagacgagcatccggacgaatcttcccctcgctttgagttgaaagcagtagagcatcttgaactggccgccttctcccctgtttgaggtttgtgtttaattcctgaaaaaagttggaagtttgaagaaagttgggaatttggaaaaaaaattggaagtttatgtgtgtaggaaagtttttgatgtgatataatgtgatagaaagttgggaatagggggaaactaaacacggccttcttttcattgagcccaacaggaaccgtcaatgaccctactgtgaatgaaccttggcttctactctttggtgttgatagcagcaccggattattagcccttgatgcttgtggctcttttcccaaacgtcctgaggattcttcctttccttttgagttcagcgcatgagagcagcttgaaccagccttcttctccactggtagagtttgtgtttcattcagcacattaggaacaatcaatgaacctactggaattgaaagcatggaaagggaagaaccttacttctgtactcaggagtcttggatgcttttggttcctccaactttgaagaatcttcctctccttttgaattcatagcaggagagcagcttgaaccagccttcttctccactggtagagtttgcattccaacaagcacattaggaacagtcaatgaacctactgacattgaaagcatggaaagggaagaaccttacttctgcacttaggaatccttaatttgttggttcctccaacttcacaaatctactcagatgaggaggtcgatggtttggataatctctgtaagtttggaacatgcttgttccctttcaataaggaacatgccataacattgaacaaggaacataatcaaatagcttctccttctcatcctttgtaaacaacacgaggtaggcacatcttttacgatgtgccacctcacgtggaagcttcctgagaggtcttcacaactctcaaaccaatgctttttatggtagatgggactgaccatttctgcaactccgcggaaataggaatccttacccacctgtaaatcctaattttagaatcataatctaagttttaagacaaaaggttgaacaaatgagatcaagaactcactttcaaaaagagtataattgggcatttgcaattcttttgggcacatatctggtgggcaagtcgaaatgcatcgtcaagagcatgattgccagcagaacaggtccataacatgtcatacctcatggacagatggataacctcctcattatatgcctgaagcacaaaaaagattgcttcctcatacactactgccaagtcagcccagttatactgatgtgtgtatcgcaatggttttggaatctctcctaggattgatcttgctatctgagaataacaaatatttataaataagaaacaatgtaaaaacatgaatatgaacaatgcacaaaattgaaatagaaagttagccagtacctttggaatactagatgattcaccaagactcatgctacaatctgctgtctgtctcttcaaagaatctctatcttgttgcccccctacaagatgtgtgtatctcaatggttttggaatctctcctaggattgaacttgctgcctgagaaacaaatatttataaataagaaacaatgtaaaaacaagaatatgaacaatgcacaaaattgaaatagaaagttaggaagtacatgtggagcgttagacgattcaccaagactcatgctacgatatgttgtctgtctcttcaaagaatctctatcttgttggccccctacaagcattgcaccatcctggaacatcttcagtgagtttacattggatcggacatactgagtatgtgtcatgccacaccgttcaggtggttggtttgttgccgtggctgctgatgtttgccattgccttg

SEQ ID NO: 77309 - DNA, 676 bp, Oryza sativa
attcctgcagcccccgacggcttggcccatggcacggggttttggcctgaccaaattaaagtatggcattgcccgatttttgggccgtgcttgggcctcaccctcggcacgatgggccgacccagcatggcccggtcaaatgatcagggagttaaatagacttattctaccatataggactatagatggccaaacgggcggcacggcccaggcctggccatgcctggaccgaggttaattgggccggcacggcccgacctacactccgggccatgccgtgccagcccacgggccgcacacatggcccaggcatggcccaacacgactcgggttgtgccgggccggcttgaaggcacgacttattgtgattttcacataataaatctgtttttggtccctcaactctgtgggctaggtctatatggctggaaaataagtctattatgtattcctcttctctttgggtcctgtctgatatggttcatcaagtatattttgcatcccacgactttttttatttggttgggtgccgggccggcccaccgtgccgagggtgcggccgaggcacggcccggctatcgggccaggccggcaccggcatgaccccgagtcgggctgtgccgtgcttgggcgggccaaaatggcgtgtcttaggccgggccatgggcctcaagcc

SEQ ID NO: 77310 - DNA, 6270 bp, Oryza sativa
tctccggagcagaagttggcgaggacaccgccattgcctcctacgcatcaatcgacccaacccaaacggacgcctcggccgatcccccgggggacacaggacacacgcccacaggaagagagaagaggggagatgagaggaggaaccgctaggcaggaaggaagagaggagaggttatatatacggaccctgtcgttctacctctcctacacccatcgcctcccgtattttataagctttttcttggtttgaatgaatggggaagaaatgggatgggagaagggaataataatgcaaaaatagagagaaatgccagctttgactgcactgcaccacaccacctctctcactcacactctctctctctctctctctctctctctctctctcttgctcctcttgctttccctttcagagaaagcttcgatccttcaacatcctagctggccaagatgcctgggcaacacctctccgcctcttcttccccacactcacaggcccagcagatataaataaaaaggttcttgtatagggtggtgagctttaaaaggatggagagagaatagtgtttgctgccccactactccagtacacatctctttgtttgcccaaccaaaaaaaaaaatcctcttcttttcctctttcttgcacttctttttccctctttgtatgattcttttacgagtgaatagtacattgggccacattttattatcagagttgtaagttagactaagggtaagttaatagtatcactttggattaggtatttttgcacaagtttcatattggacttgtgtttcctaattctcttttttctttgcttcattggccgatgtctattagcttgtgcgtggtgtaccaatgccactaatattgttccatactcgagagtgatttgatgccatcaatgatgggctgtttgaatttaggaaagatgagagggtggtgtaaggtgaaataaatggctatattatgtggtccaaagtgaaaacattggctaagacctagtccaacccacaacaaggatcaaaatatatggcctaaactgcaatttactcttcttttattctctcctctattttaggttatcgattttaaagggccgagtatcatataagtatacgtcgattcttccaaaggtgagagaatatcagcaaataaaggactatcacatttttttaaggtatacgaaccgtgcaaatgcaaaagctattattatagttattactgtagaaatattaatatttgaatgttaagagaagagtcaatgtcaattataattcactgattattaatctttaactttattatgaacctaaaaaaatattaaatggaaagtctaatgtgggtaaaacgtcatctatctattcattattatattattcgggtgctttgagggagctcctatgttacacataaaattccgacgcagtcggatcgtacttcgtcatatcagtttagattacagtttgtaatttagagaaagataaagtgtattgtgcatactttttccccttccccactttactatacacctgaataaaaacatactagtagtatttagtattttattaatttaaatttaaatttgtgagttgcaaaagttgcagacccttcttaaatgctacaataaagaaaacaacatcgtatttagtatttgattaatcatatatttctataaacttaaggcacactaaattctaaagctcaacatgcaaagatgccacataatccactaataattattacatcttaaacctcatgcaagcatgctaatttattatgttttagagctttaaaattcaaccatgttaattagattatcatcccacataattcacaaaatatttcaatatatatctccatcaattttttttaatatcctatatgactatatagtttatcctcacttacattttagagctttaaaaatccaaacatgttaaatcatcattccacataattctcaaaatatttcaatatatctctccaacattttgtataatatctatatacctatacagttcatcgtcacttaattagtttatattctttctctcttgtatcattaagccatatcacagcagttgtttctaaccccccaaatgattaatatatggtcggaattatctccctcattttcttctctcataaaaccacatcatattacttttacatttggatcaacattctatatattatttaaattatgataaaccacatcaatttaagcgagtttatgtcgtctagctatcttacacattatttttatttattattatcataccaaactcctgcaccaacgagtggggtttcacctagtatatataataattatgatatcaataaaaaagtgtgtgcattgcacgtagtatttattaattctagttttaaaaattattaaatttaggatacctaatattatagagttcacaataataaacactaaagagtgcatgttattttcaatatcatgttctatttaacatggctttttatataactagtgggaatcttatttactgttttatgaaataatgctaacaaaagtcatatctcaccatttttacgccatgagatagaccatagacttaaatgataagaatatcttttaaaaatcactttgtaccggttatgtataaattatccttttgtcaccacgacttattatcactattttgaaattgtgtatgtgccaataaaataagcgtaatacatcattaatacactaaatcaactatttagagaacacactggcctgagatatttgcttagctccagtgtaggaccaaaggttggtaagatacgagcgtgccagtcagtttgaccctgcagctgacaagatatacaaattgaagatcaatgagccgatcggctgacaagccgatggagtaattccagccgatagccgatattagccgatgccgattccagccgatgtcgatagggttgagcaatcagctatatgtagataatgatataaaagcgatcggcttagttgtcatcggctaaatctaacttgtatgtaatccttataagccgatgcaacgtccagataacttatcggctagcaccccaataaaacattagcatgaacctatcggcttagcaagacttatattatcaacaacaatctagtaggtcgaacctaaccgatgcagcacaagattgtatatgataatctaatactcgatgagccgatagatctgtccaatgtaatggatataacaaatctatttagaacaactgtgattgtagagatatatcggctaagacaggagatcagacctaaccgagtcagtcccaactaaaccgattcgtctctaaatacaatgcaattagagatagaattgagatatcagatgggcaaatatatcaaccaaaccagagcgatccaagagattgaagcgatgcagccttgaacaacaccaatgtagccgatagattcaccagggccggcggaacgtaggatttactccttcgccggagatcgaaagccgatgcagccccgcgtcaggtgccaaattccgccgattgataagtaaaaaacctcagggaatagggtggcgatgcgccgagagtagttgtattgatcgagattgatagattacatagaccccgggtgtacatatttacacccatgagttgatacaagtccttgtcggataagaaataaactatcctaaagataaaaggaaaacataaaatccttatcgaacactaaacacacttttctaaagataaaaggaaactaacaaactattcctaattaatagataaactgccatgccgcatccttcttgaactcagactcttttggataaattccctttagttgatccgactccatcgagaacacggttgctggcgatttgacaactcccatcggctgattctataactctgaagccaatagtgactctaagccgatgatgactttgggcttaccaaatttcgtccttaacaaacctataagcatttgttggagtgccaaatgtcaaattagtaccgtttatagtaagtttaatggattttagtatgcaatagaagatgtataatcatgataatttgatctataaccaacgggtagatcgtttcaaaccaatgcaagagctcccttaattaggttatattcgggagtgagggttgggaaccctcactctccggtacgcaaaacgaagcagcatttatcacgtgattaatcaagtttcagctattttttttcaaaaatagatcaatataattttttaaagtaactttcgtatataaactttttgcaaaaaacgcaccgtttagcaatttgaaaagcgtacgcgcaaaaaacaaggaggaggagttgggaactactcctaacgaacgcagccttagagcaagtttaattgtacagcccactactagctccaattcatctatagccaatctaatagttaattcatacaatagttgcttactatactattaatatatggtcccacctgtcatacacacattgtgtcttggagtctgtgctgcagctggctatagatatgtatcccgctgctcttctctctcatcttttatctcattaaaatatgtttatagctgactaatagtctgctattgtactgctcttagagtgcttaaccagtataggtcatagactcctagttgcacactcgtgatttgcacatattattattaatataatataaaataaagttttattcgtatgctgatttttaattaatgtcagagtcatatatagtatagttttttccttaatttaattgagaaattatgaattatactaagtattgatttatactcgttttgtattctcaattatagctttttttcgtaatatggaaatggacaatccgaattaatgtttgcttttgtgttggggtcttattttatttattaatgttgcttttttgaattttagaattaataaatactaagttctacttacttatgtagtattatattaatactaagttctacttacttatgtagtattatattatctcatgccattatataaatgattttttctaattaatgtaggactgtaagagttaccttagagtgcaaaatagtagtttatagggagggaaatctccagagaaaatcattaaataagtaaaaactcgtgaaaaccatatctaaatgtgttgtaaatttatgaaaaaataactagagatatgtgtgtaggcctgaaatacatttataccaaatcttaagttcaaactcaaaaaactttatttgagagaaaaaatgacaatttttaggtgaatggtgtttttcttactattcactcgaaaattgttttctttgctccataataaagttcagtttgaaattcagatttggtgataatgtatttcatgcctacatatatctaattttttcatgattttacaaaactttcatatctggtttcactactcactagatatgtctccttataagtgttggtagatacataagtagatatcggctctcgtcattgtttgttgatttatcaactgcaaccaattttgaaattaaaaattggagttaacatttgcttttaaatatttagcagtatggatataaaagttgtacatataattttatttttttattcatgtttctacagtctattaactgtagctagctcagccagatacaactattattctcggtaacatactaagggggtgagggggtgtttagatggggctaaaactttttagcctatgtcacatcagatgtttggacgctaatttggagtattaaacatagactaataaaaaaactaatttcataaataagagctaatccgcgagacgaattttttaagcctaattaatctataattataaaaagtttactgtagcatcacattgtcaaaatcatgacataattagactcaaaagattcgtctcgtgaattagtccaaggatatggaatgtgttttgtaattagtgtatgtttaatactccaaattagtatccaaacatccgatgtgacatggacttggaataagtccctggaaaccaaacaggccccaacatatagtagtaataaagaagcgaagaattttccaaatctacgtgaatagcagggaggagttcgattataggtttagccctatttcggtcacaatacctgcagatataaatagcacccgaaacatgccaataagagcaaacttgctgatactaacgtctttgcaggaacacgaacgcaccgctctcataaaaaccactccgtgcgtattgcatccgcgtaaatggccattgc

SEQ ID NO: 77311 - DNA, 19028 bp, Oryza sativa
ctccacttttcccgggctctaaaccgtgccttctcccggaagctaagcaacaaccggttctcgagtggaacccggcgccgcctcccgcctgacacgggggacagccctgtcattccctcataaatgaatgatgacttgcgacagcccttcctcgagtgacgcttggatgtgacgggtcatacccacccccactccaccgggaacaagggcgacgtgaggacatgattgccctttccatcggatgcgacggtgacaggccggtcacagaccggtcacattcgatggacaggggttagctaggcgcgccgcatgtctgcccttaccgtattaaatgcggtgagggacagttggggcgtcgcatatttatggctgttcagccagtgctcccctctcgctctctccctctgccgcgtggcagccgggtgaggtcctcggggcgaagccgcgggagagcccgagggggtgacgtcatgccccccctggccgcttccacgactcgcgtgacgcgtgagtggggccatcttgcaaagtcgcgtggccggaggaaaagtaattcccctctacttcacataccccgggcccatatctccgacagtcttacattgtgaaacagaaggaatattagttaattagtcagtggttacgctatatagatgtaatgccaatatgccattaagtggccagcagtgcataatgcatttatttttaaggaaaatcagtgatagagataatgtacaaacacatcagcaacaaagaaaaagacagattgaacaaggactagctcggtcttgcatacatttgggatcgttcgaggaacacattggtgaagagtacttcttgtattccgtgtgcatgtttttttaaactactaattgataatatttattagaaatgtataaaaacaagtttatttaaaaaattatattaattcatttaattattttcaagtttaatctaaataacacttactatatcatccgctaacggctcacatctttctagttaaattgtctttcttcttctttcccttaccagaaatataagggagggggataaatctatttatataggtatattgttctttcgtccgttctttttaagttgtattttttttcacacgcggtagggatttattttttatatggctggtttttcgccctagcgtcgtcgccacgtcgatctgcatccccatgcgttccctcctccaattgattgtaaaaatcgattcccactattctctcattattttcccatgatatttccaatcaattaagctttaatttaccggatataatcttcatttaaaagtcatcatttttatcccgagtttatggttttgctccgattttgataaaaacggtaagaggaaatcgagcgtatcaaaagcgctcaaccaattttagaaaatcgagaaatattcgatcggatttaatggggacgataggttccaacattgtacggagagagattgtctccgtagattgaagatgacattcggctatacaaggtggtcctacagcttcacttatgggctacgtcaaagagaggcaggccaagcagatgtatgtaggctaggctaagcagatgtatgtaggttaggctaggactgaaaagaaaggacgaaatgtgcttttggctcaaaacaacgagtataatgtatgcgatccaaaaaaaatacttttattgtttgcaacgcacgagtatttttttagtacagtgataaaatgcaattgtgcaaacaaccgttcctaatttgacacgtgatgatcctgctacgtggattatggtaatattatctcaactagacattgttgttcatgagctctcatcacatggattaatacaaagtggagtcgaacactaacgtgctgcatgcatgaaaaatgaaaaatgcatcgactaaccaccagtgcacaagcatcattatggtgtacatgttcctccgttattttgacattttgaccattttaaagaacttatttgaagaatagaccttaaaaaaacgtcaacaaaaaagagactgcaatctcatcgtcatcttcctggcgctgataaggattccacgtggacacgggatgccatgtcagcagaccgcaagtgctgtataaaatcttatgtgcttcccttatcatcagtggttgagtagcatccaatctaacccaaagttgtaggttcgactcccggccctttgcccacattttcttttttgcttttttctcaccaatgagcatacttcaaacaaattataatactttcattctttttccacattattattttccaaaaatatgctccaacggtacattcaaaatatgtagtacctccaatttttttttcttatagtattatttcccttttttttgacagtattgtttccaaaatatttctttttaaaagcaccggaatcaaattcaaatatatttcactgcaagaattcgatttgcttctaaaactgactcctaccgcttggggaacagtgccggaagaaaagaataaaaggacggtaaacctgggaaaaaaggtaccggaagaaaaggacggttaaaaatgacaaaaaagagagagagagagaagtgaatccggattacttaggcggtaccagttttcatcaacgacggatgtaaatggaacggtccagatcagtggggcgtactgtttatagcactgtagcatagaatactgtttgtacggtcgctgtatcactagatctgagtaattgatcactgaaatggacggctgaaattgcttgcagttcttaagtcgcagtcacagctataactgcaactgatctgaatccgagaaaagtatagcctgctacctcagcgtgcaagcacagaggccacacgccaacactacaacaacattggttggtgctgctaggctccgttcgttccgggcgatctgggggactgagggagaaatgcatctcgtttttcgcgcgcacgcttcccaaactattaaacggtaagtttttttaaaaaaaaaaaattataggaaagttgctttaaaaaatcatattaatccatttttaaagtttgaaatagttaatactcaattaatcatgtgctaatggctcacctcgttttgcgtatcttctcaatccccttcttctcaaacacacaaaagtagcaacatccgaacaacattgaaattactttatattttcagcgatcaggcttttctcaaaatatatcaacttctccaccaataattatctttccaaccaatcataacttttcactattcactttttctacctacctccacttctcaaccaatcacaacctctccctatttaatgctactattttttaataacagtgtccaactataaaacttcttatagtttaggatagatgtagtagtatttagtatcaaacttatggggtgtttagatccaggggtgtaaagttttggcgtgtcacattagatattatatagggtgtcacatggggtgttcggacactaataataaaactaaatacaaaatccgtcagtaaaccgcaagacgaatttattaagcctaattaatccgtcattagcaaatatttactgtagcaccacattgtcaaattatggagcaattaggctcaaaagattcatctcgcaaattagtcacaatctatgcaattagttattttttaacctatatttaatactctatacaggtgttcaaacgttcgatgtgtcagggtgtaaaatttctgcgtgtgatctaaacatgaccttagaatttacaagacattggtgcaaaaacatatgtgtgccgtcagcccgtcacgtccatgggctggcctaagcgtttaacttgggaaaaagtatattttgactccctcaacaatcgcccgagtatgattctatgtcctccaactataaaaccggatatatcaactcctctaactgtcaaaaccaatgcaaacaatgtcccttgacggttttagaggtggttttggctgacgtggcgcctacatggtgttcttgactgagcctttgtcctacgtggcgtttacgtgggcattagaataaaaaataaaattaaaaaaaaatgtgggacccatatgtcattcacaaaaaaaaaattccaccgcatttctcagcctcctgttcacgcgaacccatggcggccaagctctcgttgctcatgctcctcgtcctcgtcctcccggcttccggcgatgacgccgcggcgcgttcaacgtgacggagatcctcgggcggttcccggagttcggcctgtgttcagctacctgatcagaaagacgcacgtcgaccgcgacatcaacagccgcaacacggtgaccgtgctagtggacaactccgccgtggactgactcctccgctgcagccgccaggctgccgcgggcggcgctcgtcgagctcctctccgtccacgtcgtgctcgactacatcgacgccgcgaagatcgccgcgctgccgcgggggaggcccaccgtgtcgacaaccctgttccagaccaccgggaacatgtgccgccgcaccgggtttgtcgccatcacccccgacggccaagggtggcgctgtcttcgcctccgccgcgctctccgcgctggtgaacgccacgctcaagagggtggtcgccgcggtgccgtacaacatcttcgtgctccagatcagcaacttcgtcgtgccgccgagtgtactcacgaggccacggccggcgctcccctctgccgccgccgctccagagagagacgagggatagagaggagaggaggaagggagagggaggatgacatgtgggtcccacaatatatatttttaataacatatgggtctcacatattttttttatttttattctaatgccacgtaagtgccacgtaggacaaagactcggttaagaatgccatgtaggcgtcacgtcagccaaaaccacctctaaaaccactaaaggatattatttgcaccggtttttgatagttgaaggagtcgatatacccggtttcgtggttggaggatataaatcatactcgggtgatagttgagggagtcaaagtatactttttcctttaacttgggtcagaaaagacacatagcccctagagagaatggcccatctaagaaataaggatatgggccaacctgagaggaacctaggccccctaaaatacagcccaatttagatgacaacgacccaccagcagatataatagccgtcgtgcacaccatctaagaaagaaaacttaaggggaaatgttcacttaggtacttcgtgtataagttaagtttcattcacgtccctcaacagtaaaaccggacataatgtgtcccttaagttttaaaaccggtgtaaattaagtccctcaaaagttttagacaacaattccatcctatgtgacatccacgtggtgtgttgacctaatcttcatgtgatctgatctttatttttacaacttataaatgtgcttttctttctcaaagttataggttggggtaaagattgtgctttgtggattagataaagatgtcacatgaagtcggctttatgtaggctacgatgctatatgcgtctgcactccatcgtctcatgttggagctttgtacgatacaatgtgctgacgactcaatctttatgtgagcatgaagctttatcatatatacttctattgactctttcagtataacgacatgggttgaattactcaacaatgcttatttatgttaggactcaatccacatatcacatacatagtaggtcatcatgtaaagttgtcctttgtccattgcacactagagttctaagggcatttacattgctatgcgatggataatgcatggcctcacaatttcatcgcaatgtcacgtcggacagtttatataaaagtttctgcatgaagcacattgttagtagtttgaaaaacatgctaacgggaattaaggagtagccaagttcaattagctctttagaatagacccttcttcgacacagatcaaggcgagcggctagggcgctgcctagcagtgtcctagcaggagctcatgcctcatggagaaggcaacaaataacaaaagatgtaaaacttggtgtctcttttctttctctaagcctcttctttacgggctctagctcctacttcctccgttttacaatgtaagactttctagcattacccacatttatatagataatgctaaaaaatctttaataagtcttacattatgaaacggggggtacttggctttacttcttcattactccataaacttataaaaccgttctatttatcagcttcctcttcctcaaatcttataatttgtacttaaaaacaactgctatttgtactaagaaaagtggatttctaataacattgtatgatctatcatattcataagattagttactataaatgtcaaaactcaattatcactaagtgggtgacgaccataacatatataaagggggtatattcattcttctcctttctcgttattccttttgcctatggtctctcattctcttagataaggggaaatcctcatgccacttaagctatggccgggggctaagggcctgtttggggtagctttagattctgagaagcagctgtttggtagccagtttctgagaatctggaaaagctctgaaactcagcttctccagcttctggcttcttagtttatttttcagaatctgtaactacatattctcagaagctgtggactgttaagggcagcttctagcagaagcagcttttgggaaaaacttttgggaaaagccgcagttgggacaagctctcccaaacagggctaagactaatttaggtccatatttaaaatatgattttttttgtcaatcgagataagtcaatttaaatcactcagggcatctttaaaatacgatgtactactccgttctataaaaaaacccaatcctaactacgaatctagatatatgtgtgtccagatttgttgttaggattgtttttttttaacggagggataatatacaacattatgaattttcttatcaatagttagcatgtgaattgggttagttccttcatacggagtactatatcgcaattgtgagtttgtgaatgaatgcacatgcacggttacaccgtatctgtcctcgtatgcgcatacgtattccgtagacgctcccgtcggggtcgaattcggtattcgtacccaaactcttcgtatttacatttctgccattctctcctctcctttgtcctttcttgcgcagaaggccagagagacaagcagaggagaaaaaaaaaagaaaaagaaaaaaagaaaaaaaaaacatagcgaagaggagcccgcgagatggcgatggcgagcttggcgaggaggcgcgcggcggaggcggcgctgctgcggcgggcgccggcggcggcgtgggcgtccgcgtggagggggtacgcggcggcggcggcgggggaggagagcgacgtcgtggtgatcggcggcgggccgggcgggtacgtggccgccatcaaggcggcgcagctagggctcaagaccacctgcatcgagaagaggggaacgctcgggggcacctgcctcaacgtcggctgcatcccctccaaggtatcgccccctccctcccgccccgtctccgcgccgcgatctgggatggatggctgcgcgttccccgctgttagctctcggagagctcgtagatccgtgcgaattcgtacgacgaatttgggcgttagggtttgcgttgcgcgggtgtttaggatgtagttgtttgatacgtttcggggtttgcaaaattttgatttatccatgtgaatgtcagagaattgggacctgctcaacaagctatttggggggtgtggtgatgtgaattttaatatggcccccatcggttgggcatatatgcgaattatacgccttacagcgtattagcaaaagaataatgttttgtgggtaaaactatagatatgagatatgtttttagcgatttaaaagctaatgctgaaaaataaacttcgatgaaaaaactttaaaattaagccttaatattcaaattcttggcagcggctgatttcttataatgaaaacgatgggggcctatggttcctgctcttcatgccagattgtcagttcagtgatgcgaattttgagtcttcaagttgtgctaggaatttggaacccgctgataatgttatcagtgctatttgcagctgggttttatattgaattgtctgaaatgtgtggattagttacagtcagttccttttcttctttgctattattggttaggaggtgatgaatcatttcgacccattctatttagctgtgccatcgatttattatgaattacgaagcacaatgggggtaatatgatgccgtaggcctgagtttttatcagtgggtcaactttctgatatcttttagagaaaattgcgaatatcattgccattttatagataagagctttgagtaatctgaggttggtaatctcattgtttgctctacacttgttctgctagtgtgcataaatttgcacctgtcttcattagctagtcatcattgagcatgtagttggaggtttcattattagatctttattgctttagttctgaggtccatggttggggccaggtctgtcatgacaaagggatttaacctacttgatccaacacaaaaattggaatatttttggtgctctaatgaagctagggatggataactggtctcgaaatttggtctcgaatgctcatacactatttattagccgatataatgccacattttatgatgttagtcttttcatatggggccagaaatattaattgaatatcgagaaggtagattcggtattttgctctttaagagtttcagcttatggcttcagtttttctcatctatagttgccactttctattctttactcttgtttatggttcaactctagataaaacactatgtacttcctttgaactgtactatggttatccttctggaatgcaactttagttgaacattaacatttttgttgatttcatacatgctgtatcttcacgcatgcttgtgaaattggtcatgttaaccatgctgaagtagatagatataccaataaattcttgttcaaatgctactgcataccctcctgaagtaccaattttgtacttagcttttgcagttatgtatttgtagctggcttatttgaaagaatgcaaattgcaagtgcatcatttcgatggttattgcattgcatcttatttgttttcttttatcatttcaggctctcctgcattcgtcgcatatgtaccatgaggccaaggcttcttttgcacaccatggtatcaaattctcaaatcttgaaatagatttgcctgccatgatgtcacagaaagacaaagcagttgctgggctgactaaagggattgaaggcctgttcaagaagaacaaggttgagtatgtcaaaggatttggaaagtttgtgtccccttcagaggtatctgttgacttgctcgatggtggtagcactactgttaaagggaagaacataatcattgccactggctcagatgtgaaatcactccctggagttacaatagatgagaagaagatcgtgtcatctactggtgctcttgctctttcagaaataccaaagaagttggtggttattggagctggatacattggtttagagatgggttctgtctggaacaggctagggtctgaggtcactgtcgttgaattcgcttctgacattgtcccgtcaatggatggagagattaggaagcagttccagcgtatgctggagaagcagaaaatgaagttcatgcttaagacaaaagttgttggggttgatacctctgggagtggtgtcaagttaactgtggagcctgcagctggtggagagcagagtgttcttgagtgtgatattgttcttgtatctgctggcagagtaccatacacctctggtcttggattgaacgcccttggtgttgagactgacaagggtggaagaatccttgtcgacaagcgctttatgacaaatgttaagggtgtttatgcgattggagatgcgatccctggacccatgcttgcacataaagctgaagaagatggtgttgcctgtgttgaattcatcgcaggtaaagaaggtcacgtagattatgacactgtacctggagtggtgtacacacacccagaggtggcttctgttgggaagacggaagaacaggtcaaggcatcaggagtggcctaccaggttgggaagttccccctgttggccaacagccgtgcaaaggcaattgatgatgctgaagggttggtcaaggtagtggctgagaaggagaccgatagaatcctcggtgtacatataatggcccctaatgcaggtgagataatccatgaggcggtgcttgcacttcagtatggagcatctagtgaggatattgcacggacatgccatgcgcatccaacagtgagcgaagccctgaaggaggcttgcctacagacctacctgaaggcgattcacatttaaatcatgatacagtttcaactgccatctaaaaatattccccaaagttttgaaataatatggaacgatgtggttaaaacatctagtttgtttaccatttcctcagcggaactgtgaattcgcaccttcacttcttattgtagttatattctttttccttgctagctggcgcgtctgttcctactccttaataatatggtaaaaacttaatgctgaatatgtttcttttttctgttgatacctgagacaagaataccacagaggctggctcccctagatcagatggcgcccttcatctctggaattttttgcttaatcccaattctgatagtctattttcagtatctttgttgggacataaaagatgtataattgtgtgcatgtcacaaatctttccatgattcattattgctcaaattattaaattctactgtaattacttgcagttgcaaacttgcaatatgtcttcagttctgcttggttactcaaacttatcaacgaaaccgcaaggtcaagggcgatttattgaaataaatatttggcactggattttttttttaggcaaatgttttgttgcttccagcatcaagcaaggcctctgcgatttttttagaaaaaatcccgtggaacaatactacacaggaatgaaatgaaaccaaactcctgaaattttatataccaacgacctgtttggcaacaattggggaggggcataatattagctctgggagttgagtgagggaattaatatgggaattgacttttaattccaatctcttgtttgggaatttgattcacattctctgtttgttgcgtgggttttgaggtacgaaattatatcggaagacatgataaacggtaagattaacgagagttggatcaattagtttcccatcctaatccctctaaatttcccacatcctccaatcaaactgagattataatgcttaagggtgagttcgagggataggggattgagaagattgggaagatacgcaaaacgaggtgagccattagcatgtgattaattgagtattaactattttaaattgcaaaaatggattaatatgattttttaaagcaactttcctatagaaaatttttgcaaaaaacacaccgtttagtagtttgggaagcgtgcgcgtggaaaacgatgtgctatatcactcattgtccatgaaacgaacgcactctaaatctcctaaacttccattccctcttttcaaaccccccaaccaaacaaactgcaaatgctttctaaaattgagtacgcaaaaagtgtaactatgtcacatgtcacacaacacagatcttgaaacagttatatcaaactttaggatccaaatttgtacgagttgaatacaaggaaacatttttatatctcctgatgttaaggcccgtattaaattaagcccaaaaacaaaatcacatctctatccaagattccagacaagccaacaagtagagtaaccatcacagaaaccttcaactatccaaaactcctcatcctccccccattctatcaccaagaaaagaggggaaaaaaaaagagagaaaaaaaaagagagagagaagagaggaagagatggagatggccatcgacacgccatcgccgtcgccgtcggcctcgtcggcggcggcggggaggcagacgcgcgcggcggagtcggtgcggctggagcaccagctgctgcgcgtccccctcgaggccctcaagtccaccgtgcgcaccaaccaccgcctcgccgagaaggagatcgccgccgtcctctcctccgccgccgccgcgccgggaggaggaggaggaggcagcggtgacgccgccgccgtcgaccacctcacctccctcgtctcccgcctccacggcctcaagcgcaaggttgtactcccctccccttcccttccccaattccccacctcacttcgccccccaatcagtctctcgccgaatccacacttgccctcgaaaagatcctggctcgttgatcgattgattctctattctatctggatcctacttaggttggggaaatcccatttcgttgctgatggattgattgattatgatgatgatgatgatgatgatgtcttgcagatggaggagggagcgcgggcggaggagctgcaggtgcagaggtgccgggcgcggctcaaccgtctcgcatcggcgagctctggcgatgatgctgagtgggaggaattgcggctcaagcggatcctggttgattacatgctgcggatgtcatactacgacaccgccgcgaatctcgcggagacttccggcattcaggtataagaatggtagtagacaggaagaacataccaaggagagattttccattggttgtgtatatagtttgttcactaacctcacatagtcacattagtggcaacaaagcaagcaataacccacaactttaccctttggccatatcgattgtttgccgctgaaatgatccgtcaagtttgttgaagttaactaactaatcttgcgacgaagaagtatgaatataatgctcaaattgcctgcgagctccttttaatcctttgatgaactagggcctaatgttgcctttaaccataattttacctgtattttatttgtccacattattcgatttccactctggttaagttttgcagtctcttacatgttatatgcttgactaccctcctgccaaacaaaagagaatgcttgttttaaaactatctcatctgtatgtgaatgcagatgacgtagcataagttaatctccttttatttgtagttaccgttattcttttattttaccaatgtacataattattggcgagtagccaaacatgttgctttctgctttttggatatagcatgaatacagaacattttttgtaatgaatcttaagagttaagatttgctttccgctagtatataagtggcttcagcaacaatgataatgagagcagtatcaattcatgctggagtcgagactgatcagtacatactgcctttaactcccataatccataattactcactggaacataatctgactagtcaacttatgcaggaccttgttgacgttgatgtttttctcgatgcaaaaagagtaattgattctcttcagaacaaggaaatcgctcctgctttagcttggtgtgcagaaaacaggtctcggttaaagaaatcaaaggtttgttttactgtgctatttcgtaattcgtactatattgattggtttgcttcaataaaaaattcagcatattagcaagatgaaatgattaatctttggcgtatgatgaaatactggtgtctggtgcttgcattggcatctgattattgatagctctgacttctaatagcacatgaatcatggtggattttgctggctcaaattcttaatcttgtaagctgtcttctttattggaatttggaggcgatttgttctacatgtcctctgttaaaaagcatcctaatctaaagaaacaggcgagagtgcatagtacatcaatgaatatgatgttagtgtacaacatttcttgatgtcattttcaaagaaacaaaataagcccagtttttttaggtgctgactggcgtatactactatctttatgttaacacaattgttagttctagtacattagggtgcctttgttatttgccctgattagagtgcttttgttattttccctgcagagtaagcttgagttttttctgaggcttcaagagtttgtggaacttgtcaaggccaagaacttcatgcacgctatagcatatgctcgaaaatacctttctccctggggggctacacacatgaaagaattgcagcgcgtcacagcaacattggtttttagaagcagtacaaactgtgctccttacaaggttagcagcattgtctgtgtactcttgtttttttttttttggtgtcactgcatgcctgcatcacgaatctgaccacatattttcattcaaatatattattatctatttgactatatgtgcattcttggagagtcctctgatatcaactcctattggagtagagctgcatcatagtcttcataccatgtgtttatgctcgcaggtcctgtttgagcaaaatcagtgggacagccttgtggaccagtttaagcaggaattctgcaaattgtatggcatgacattggagccgttgctgaacatctatatgcaagcagggctcacagctctgaagacaccgtatccttcgcctgatcattattttccgcttcacctttaccatttaatataaaccactagcattgtattacattctcttttttccttgaccatcattagattctgcttcgatggtaactgccccaaagaagaccccttatccctgcctggcttccggaaactagcagagccgcttccattctccaagcagcaccattcaaagcttgtctgctacataaccaaggagctcatggacactgagaacccaccgctcgttttcccgaatggctatgtttatagcaccaaggtaaaaactacgagctgaaccaggtcattacggtattatgccgatctgcgagttcatacttgaaaccgtcgttcgtagtgccacactgataatccgttgctggctgttcattctatcctacctcaggctcttgatgagatggccaagaagaatggaggcaaggttacatgccctcggacaggagacatctgcaactacaccgatctcgtcaaggcctacatatcatgatcacacaacgcgtgtggatctcatctgggaagacactgatttgcgcgggtgatctgcaccctgaatgcttgtacatagactgatcagaacattctctattctgttaagtttagtctgaattgtgatgcaaatgcaagaaccattgaaactacttcagtactgatttctgattacactttgaccttttgtgtcattgcattccatttccatcctttttaacctttttcttggtcaaaatgaattggtgaaatctatctcgaaagtaaattgattcatgcgaaaaatactgcactctattaaagtaggatttggaaaccttataaccatcacttttgatattaaaattaaatcagcatatagctgcagtatgaatatgctttacatgaaagggagatgacttgtacgaatggttcaaaacgcctttccagcctctgctcccacgaaagcggaaatccatgatgcgttttccaagcaagaaagcggaaaagagaaagtaaaccggtgccctatcctgagtaatgggccggaagagaagcaacgaaccagtcccaagcccaacaaacccagatgaaccccagccgtccgatccgaaaacccctagatcgaacagcccacaccgctccacctcctctataaagtcgatctccacatgcgccgcccaaaaccctagccaccttccccccacccctctcgccgccgcagccgcggaggcgacccctcccccgccgccgccaagatgcagatcttcgtgaagaccctgacggggaagaccatcacgctggaggtggagtcctcggacaccatcgacaacgtgaaggccaagatccaggacaaggaagggatccccccggaccagcagcgcctcatcttcgccggcaagcagctcgaggatggccgcaccctcgccgactacaacatccagaaggagtccaccctccacctcgtgctccgcctccgcggcggcgccaagaagcgcaagaagaagacgtacaccaagcccaagaagatcaagcacaagcacaagaaggtgaagctcgccgtgctccagttctacaaggtggacgacgccaccggcaaggtcaccaggctcaggaaggagtgccccaacaacgactgcggcgcgggcaccttcatggccaaccacttcgatcgccactactgcggcaagtgcggcctcacctacgtctacaaccagaaggcctaggttgatgcttgctgctgctcgctttgctctgatctgatgcttttcattcccttttatctgttattatcatgagctgagatgagctgctgctggttacatgttattcagattatatgcgttttgttctccgtttacaattggaaaactttgagtagtagcctcttggaatattattatctgttactgaattgatgatgcgatgtgagttcacttgtgttttctgattcctgttggatgattagtttgcgccagtttcgttgctctgatgtgtttttgagatctcactgattgcaattagataattgtttttctgcatggactgggatgcaattgtgctgattgctggtctcaatggaagtagtctccataattttttaatcatttctgctcatccgttcagttagatgtgcaattgttaatctgattgtatattctgccattaagcatagtgaaggttaccatagaaaattttattcttgtatggcgacttgattgtactgagtgccgatggtatggctcaagtagaagtggttgcgatcatttgcagattgtgtcacataagtagcattgtatgtgtttgtgaccattcttgttctgaagtttagggttgttacagagtttttttttttcttacaataacccttggcttcattgggtggtgcaatcttatgcttttttttggggggtggggggtggggggtgttgaatgatgcttcattctgatgattcaacccccaaactacagaaattatctagatttgaccaatgcttttctgaaatttctgtagtttggatatacaattgctctagacgtgactaatgtgtatgtgatcctttcttgatctgaaattatggggtgctggttagcttctactttgcagcttctcgggttttgcagttattcaggatctgtttgaaagcttgtttagcttttgccttttgctgctgtaggaacaagaaatttcattagcgtatgattagttaggtgttaactattacaaacttgaaaaacaggtttatttgaaaaaataagttatgttgcgctccagatgtgacagttaatctggtgggattaatgtttgtttttattgaagcccagtgaagttctactcttactgtatgctacgttggcttaccagccgtgtgaacctgacagtttattttggagttgattttgggtttttttttcatcaatttacttttcagttttagcttttaaacgagtaaatgtttttacccaatttttgttctactaagatattataaaatttataattatttatagttaagcaggagcgtaaaatggatcgtgcatttgtacgattaggttgttatctgttgttgcctattgctactgactatgatagcgttctgtattctggaatacatttgtttgtgattcttttgggttcctgtgcacaatctataacaggaaatggtaccgttgagcttcttccaacagcttatattgtcacgtacaacagcgtatatacggatataccttagactttttattattagaagctggttagtcttaagcttcctgaaaaccgtcgacataatagttaggagccttaagagcaaggtcaacagtgcagcccactactaccccaaatcttctatagccaatgtaatagccaattcatacaatagttgtttactatactattaatacttggtcccacctgttatacacatattacgtcttggagtccgtgcagttggctacagatctgtagcccactattcttatctctctttctttatctctttaaaatatatttatagttggcttatagcctgctattgtacctgctctaaatgagctactccagaagcatgggattaccaattatgtttcttataggcatgggattaccaattatgtttcttataggttatctctttaaaatatatttatagctggcttatagcctgctattgtacctgctctaaatgagctactccagaagcatgggattaccaattatgtttctcataggctgtgtttagttcagcgcaaagtttggattttggttaaaattgaagatgatatgactgaaaagttgtgtgtgtatgataggttgatgtgatggaaaaagacagccataatcttaatcttttcgcgtcaccgctgggtcggtatttttcttctctatggccagtgtacaataacggccacggcgatcgtcgatagatgttggctgctggctgtgacctgtgatcccaaccacagcagccgcatttattcaaagccctgagtgcgaattcaacaatactcttaaacgatgttttgatttctcaacattgttacatcgcgttctgatttatgaacatctctctatattcattcagccttttactcgtcttaggaactccgtgctcgtttttcttttttattttctagaattttggaggttttgttttacacactgtatgacaaatgtgaacgtccagagatgataatattgattaagcaaggccaaaaagattgtttgcagatatgctccaccgtggttgctgctcataactgcattactggaattgtggtgatgctaatcatgccatgttcttgctgctctgctatagtatgttgcagaaagtgttcttccctcaacttttccaatctctccttttt

SEQ ID NO: 77312 - DNA, 8047 bp, Oryza sativa
agtcgacgttgtgctttcctggcgcagaaggtcacagtgtcgtctgctggtaccacctgggtgacgtgcgcagcagcagccgtacgagtgtggcaacgtcatcagctcatcagcttcataaaagggctcgccatgcatgaatcagcccaagcttttttataatggttttgctatttcactcgcgatagatttttgaatttctatgtttcaatttttagtctgtaggatttttcatcaagattcgtattcctgtgtattcaatttgcagttacattctgttaacatttacgcttagttatatagcacttacactaagttaaagtgcacaaaaattagatttttacaatagtttatttcctctagatttacaattttgacttttctttttatgttgtagtttcatttaatacgggatatattttacagtgctttaaaattgttttcgaccatccaattaatgttgatccaatgttcattggaggtaatgggattggatatgatctgtgatccatgcttgactttctttttccggtgcttgcatagaattatcttagtactatttcatttaagtctactctgcttttggacccaagaatttttttgaggtgaaagcttttggacccaagaattcagactccacacccgcgtattatgcaaatctattaatttcaacactggtttcaactgtacatgattcaaatgttacttatctgccaaatgaatttaatctttgtcacgtcagaaacctagctgtatgcctgtatctctgaagcataacttgataagtttcagccaaagttatgcaaacgaatcttagaaattaagcaaatggtgacttatctgttgacttttccactatcaactcgaaaaaaacccaagaaacacagcaaaatctgatgcaccgtaggggagtacttggtttggtgaaaatgcgatctaatgatgcactcaaagtttttatctgttactcttgcaaaatatcaatgcaatcaaaacaagacaaatcatttacagaaagcaggaaataaacatcgaaggcaattttctccattactgatgataagtacaaatgggcacgctctgctcatcttgtcaataggaatatcagcaaaggttctgcttttttttttcacccttgtaaaggtaaaggccagtaggccattataccctaaaaaaaagaagataacactaaatatgtaaataataacatgccttattctaggacagtataattagcatatcacattgtcccctattccttaattatagtcaaactgcacatctatatctcaagtttccaccattgtaattcttttgtaactgtccttacctcttgcaagctagctactgcaccatgtgagattcttttgtaagctgttgtttctgtcctcttctaaagtataaaatgaacaccatgtgtttatgtgcctcctaattattttttttcaaaaaagatgtgcctcctaattatgaccagtgagattttcttctgccttccttctctatctacaacaaaaatattgttgctttttgttgtctcctcctgtgtgtgtatacttatgttactcttggaccaaattaccatcaaatgcctaaaggggcacctgaattccgaacccaaggcccaaaagtctctttgtaatttttttcctcctatataattgtggatatgctgtttccagcaggcgctgatgcggcgaatggactctcaggcagcagttcaatctggttactgcagttagaaatcaaatgaagcaatccagtgaacaaagaggaactagctcaatgtcaggtagcaacatatatgcaagaaattggctgcaaatatgtttgtacctctcatggtcatcataaatgttgcctgcctgtgtaggaggagcttggctgtttgaaacgatctccagtggatcaggggatgcaagggatggattcataaggtcgagttgtttcgaatctgttcacaggaaaaaaacgccgcataaaaccatcaggatatttggccgtgcactattcagtattcactatactattaaaacatttctccacgcttcaaaaaatatgttttggtaagaaacaccgttcttctactgcacttattaacctaatcattaagttcattacttaaattatttaatttatcactataatcaagtagataatccttgagccactaaacaaacttcaaccagggagaaatggaacaactagaggtataattctggcaatgaccaatgaatgacacaacacacagaccatcctggagagaatggaggggactggcgtcctcaatgctgcaatcgaagtatgcaaactgtggcggcatggattcaagcctccgaactgtggcgcgccgcctctccatctccaagagcatctcgcgcttctctgccaactgcttcctcatcaacctcgaagcatcatactctgctgttgcacaaaattgaagcaagatgaaggttgagaattaatcggtgcccattgtgatgatgtgtgcatgcaaatgctattatacctgtgtagagctcttgatcaaactcaaagaagcgtggaggacagtagggaaccatcgatttgatgttgtccacgcacgtcctgcacgtgaaaattgcaatatttataaaaactttaattaatttaatttgctcgtcacaaacacaaaaaagtagtaacagctagaagtactaacaagtccatgggaaacaccatttttaataatttgaaaactctactgtgaattgaactatctgttggcaagaaccaagaagggtaatggttacctgtcgacgcatttggatttctccctgtagggcttgacgagaacccgcgatccgcagatgaaatgcgggttgcgccgcatcaggatggtgctcaccgtctccgggctctggaagctgacgaacccgaacatgcgccgctcttggcaggggatcctcacgtcgcgcaccggcccgtactgcctgtcaaacgcaatcaaacaagcgaaaatggccatgtcatttaagatttggaaagaagcaaacaagttgcggtttatacatgccgaattgcagacccgaagtagttggcgacgtcgtcctcggcgaaggtactctcggctgggaaggtgaggtatatctggtgcgagctcgccggaactgagcccgtgtcgccgccaccaccgccgccgccacctctgaaatccatgtacttggcagcgtcctccgcgagaaccaccgaatgctgcccgtgcggcctgttcgtcagacagtaaatcaatcaatcaatcaaattgagaagaaacaatcaacaagattgatagagaagaaatggaagattattttggcattacctttcgatgacccgtatcttgttgaggcgagagagcagcctggtgaggctgtatccggccttgccatggcgctggctctcggtgaggtagccgtcggcttggagtcccttgccgtacttctcgccgtagagcgtcggcagcgaggcgatggacaccggctgcccgcgccgcgagttgagcagctcggtgatctccatctccagcgtctcgagcgagcccggcgtcacgccgcctggctggtggttgtacacgtcgccgttgatggcggcgccggcgagcgcgtcctggtacacctggtggtgcgagtagtggcagttctggccgttcttgcagatgcctttggagaagtagtggcagggacgtcgagtggacagcccgttcgaacgccgcgccctcgccggcgaccccccgccgccacccccgccattggggaaggcgtcctcgccggccgggtagtagtacccgccgccaaagttgttgtcgtcgaggacgtgttggccgccgcgcagcgggtacgggccctccgcggaggcgtcgacgacgagcccgggaggcgcgaactcctgctgcgccgccttagtcggtggcgccggcggcgagtccggccagtactgcggcgactggacctggtatccaaaggcagccgcggcggcggcggcgggagagtagtgatggcgaacgccgccgcaagcaggtaccggggggcgggagaagagctgctgcggctgctggtgatagcctccgccgccgccgacgccgacgccgccgccaccgggaggtccgtgcgcggcggcggcggagcagcgggcatagatgacggtgagcgcggctttagtatcctcgatcttggcgaggagcgtggcctcgggaccatatgcgagctgcaccaactcgtcctcgtcgggctccctcagcagcattacgccgaatatcttgccgacatgctccggctccaccctctgcaccctcgcgaacgccagcttcactaactccggcacctccattgccacccaccaccaccactggtggacatgaaacctaaacctagcctacctcgatcgatcactagacgcccgcaatggaagaatggaattgaaacaggaggaacacgaagaacaaacctgggcctccttttataacaacaaaggaggaataaaattcgagatcgatcgagagcgcgcgattcgatcgggtggatagtatcgcgcgcgcatcgatcgcatcgcatcgcatgcggggggatcgagcggagggctcgctcgccgatcgaagcctagtcgtcgccttggcccagttcaaacggggcgcgcgactgcctgcgtgcgtgcgtgcgagcgagagagaagaaggcggagaggtttgatgagatggagtggagtacgtcggtcgattttttgtcatttgcatgatatatttgttgataggggaaaacggcgatctgatcgctcgctgatccatatccatattgccggttcctgattggcccgcttatcactattagaatttaagataactcttggaattataaatggtaaaaaaaatgagagagaaaacgagaaatgctgcaaataggacaaacctcgtcactgtcatatgcatgccaaactgtttcttctccttcttttttttctctctttaaatttttttctcctaaactacttatccgatctataatccgatcacactgttgtattttttgtaattaaatatttacaacaagatatcatataattatattatgtcaaaagaaaaacatatattttaaaccattaaaactcaatgtttcatacgtaatagttatatgtttcgatgtatgttttcagtgtgtttcaaaaaatcttaaaactacctgccaccactctctcttctctctccacctcatctatgcatgcatacatttgagagcttcaaaatgatttttctcctaaactaattattcaatctacgatctaattacaccattataattaaatctttacaacaagatattgcataattaaattttgatgaaagaaaaacgtgtgtcaatccgttaacattagttatttcatatgtaatagcgatatgtttcaacgtgtattttattatgtttcataaaaattttaaatgtctggaacatgtttcacacgtgatgggaagattcttccgaaagaaaaaactcccagcgctgcgctgctctacttcttcaattcccctctttcttgctacgcacacacattagtctttgacgtgcggaatgaaagcaggttcccggtccttccaatggaatcaaagaaataaaatctagagctttccaaagtactactcccgataagaaatcacaggataacattaaaaggaccaatgaaaagtattgcaaatctgaaagaaaaatagataagaaaaatataaacagatctgaaaaaaaataaagtacacgttcagttttaaaacttgtttgtttgtgtcctccaagtctctaaatttttaaaatatggctcccatcggatggcctattcagccaaaaaaaagccaaaatttaaattttcaaacttaattttgacattgattttgagatattttcaacgcagtttctttttcagcattgccttttaagtcaccgagaacacatatataaaagttttacctaccaattcatttttattctctaataagccaaaataaaaaaaccaaacgatgaggccctatacttttaggtcccttaatttgctaaagtgtatcattctgatcctaaattgccatgacctgagtgatcgttggactatttttccttttttcttttttctcgcctttctattctctttcttcctttccgctcgtgtgagaaaaaatacaaaagagaagaactaatccaagagaagaactaatcctccacatgtgcaaaacaaaggagaggggaagaaaaatattgggacaggaatgtccgtgtagcatgccacgtcagtgccacatcagtgtatgttaggaactaatcctccacatatgcaaaacagagcataatattagcgtttgataagtaagtattagcttaatagatttgaaaaatagattaatataatttttaaggtaactttttaatataaggtattttttttagaaaacgtattatttagcaatttgataagcgtgcgcgtgaaaaagagaaaatagaagttagaaaaggacataaaagaacacaccctaaccatgaaaaaaaaaagatgatgagagtgataactaagcagaaaaaggtatatatgcaacaaaggactaatggaaaaaaaatacaattctaaattcatgcaaaactgatcggtataaaagaaatgggatagaattaggaaagagaagatgggagaaaaaactagggggttaaatacaaatagatttgtgtcttgattttgttagatttttgttttcattttttctaacattcatctgactgaaactatgtattgctaatactcgatgttacaagggctaaatagcaagcgcaccaatgtgcgctctgattttctagtttactttaattggcgcggtgatggtggagaggacgatcccgtattgttcgtatgtgtgaacacacaaaaaataagtgcaaaaaaattgtttttttttgggggggaggggggaggatgagtgatccgctcgactccctacatgcaagcaagtgatttgtcctccttacattgttagtactgtttggtgtaactatttttttataacaaaatctcatatgaacatatgactctattatgattaaaggaataatatgtggtaatcgttaaaacttgatgtttggtacgtaaaaatattgaatggtttcactagaattcggctgtctttatatattctggtttattttatgtactagtcattgttacttaatgttcatatagttttattaacgatgttgcaactaatatttttgaaggaaaaattccaattaaccccctaaactttagatggaagtctgtttagcaccctaaactttgaaaccgggcattcaaccccataaattttacggtacctttatataacccctaagatgatttttcataatggttatatgaactagaaggagatggcagctgagttgggcttataacaactggcaagccaaggaaataatctgtcttctattcttcgtgttccttttttgaaaggagtgaagggattctttaactgtcaacgagtgcctatcttcaatcagctatacctatgtatacctatgtgcacagtacactataagaaatgtcaattgaatttctcgaaaacacgatcgacaatctttccaatggtatataacacgatcatcataaaattctatatacgaatttatattaaactgaaattgttggatgatcgaaatggaattttcagtttcagacgagattccggagaccctcttgtccacgaggttgacaattcgacgccccacgtatggcccacttgcaggccagccaaagctgggacccaccacctgacggcctgaccccaccattcttcttctccaagcaaccgtcgacgaaaccccttctctccctatccattcgacgagagattgatcgagcagagcaccatggctgccatggcgagctcgcgtgggtggggcgatctcccgccggatctcctcgcgctcatcgccgacggcctcaccatcaaggcctacacccgcgtccgcgccgtctgcaccgcctggcgcgccgccataccggcggcctcgccgtcgctcctcgt

SEQ ID NO: 77313 - DNA, 3606 bp, Oryza sativa
acaactctagtacattttgtgagaaagctccacccaactccactcccagttttggtggagctgaaactgtttggctgagctccagctctaggaggggtggagctggagctggagctgtcccaaacagacccttagtaccactgtagccggcgtcaacaaagcaatgcgatggttagggctttggggagttaattactgctacgcgctacaccaccgtagggcgattatgttcgtgcgtggcctgactgcgcgcgtagtagtactacgtggagtgcggcagaagcaactgctgtacccgagtgtatagctgctgctagtagtcgcgacaccaacaacttgaggcgcttttcctttgcaacccctaccggctttacccatcgcaattgaatgcgtcacatgccgaggaaatgtcagcgtcgctctcctctcctctactacggaggagtatacccccactgctttatatcctccgtattggtagcagttacgtactacgtacgtacatacactgatatactattacgtggtagatcgaatattccaatgtgtatacggacgcatgcagaccataatatacctactcgtacgtaagaacgagcgtgagcgctactactgtttgttgcgttgatggtgcatttggtgcttcacgctgtatgggcaggagagaaaatatgggtgcgtgtctgatgatgattggtgagcagggagggatctcccattatttgagcaggagttgggcgtgagcatctctcgctaatcatgtgtgcatgttcgagcagattaggccatcaatctgtccatgtgttcttccgtggggtaggagtagtaacttgttcggaaagcatgctgggctgatttcagaatttggataggtggcgtgcaatagttttgccgaatgcagcaacagcagaagaaaaataatttcctcggaaactcactaatagaaaaggtatttttcccaacgtgagagtcttattttcgcaggcggacataacccttagaactaaatgaccgcctacaaacatataaatcgaggtgaaatttgatgtccgcctgcgaaaatctattttcgcaggcggaccacttaagcggcgcctgcgaaaatcaatagacttgaatataaatagacttaggataggaggagattttttctaagtctccgcaccttcaccactcacggccggcaagcttatcccctcacctctctcattcacctctcctccccctcccctcccggcggcggcggccagcgacgggcggtggcggcggagggcggcggcggcgcgctcccggcccctacctcccagatctggccggagggggcggggggagagcggtggccggcggatctggccggaggggggcaaggggagcacggcggcgggcagtggcggcgaggagggttgaggcggcggcacggccacggcggcgagggcggttgaggcggcggcgcggacgacagcgggcggcggctcctgaccgcccctccttcccagatccgcgttgacgacggtgggccgcggccgtgctgcggcggcggtggcggctcccggccgccccccccctcctagatccgcgttgacgacgacaggccgtggccgtgcggcggcagcgcggatgactgcgcggcgcggacgtgcagcggcggcggacaaaggctgggcagcggccgtgatttgttgaatgtttttatttgctttcttttagaattgattcggtgattttggatgaactgtggatgaattgatttggtgtttttttggatgaactagatgaattgaatggattggatggggaaggggtgggaactggattgagaacgggaagctaccgccggaaatgggggtggctgcccaattttttttagcgctcgaagctattctcgcaggcggacctggcgcacgcctgcgaaaatcaactattttcgcagacgttgaggtgcaggcggatggcttgtccgcctgcgaaaatatgattcggcctactgggaaaagagtttttctagtagtgacttctgtactcctgttagttttgagaaacatatacgcatcctccattcacagaaaattgctgccattttttgtgcacgtaccactacgaatatggattgcattttgaaaactgtggtaacaaaggtaattgtacgcgatgtattttcaaatagtagagacgatcagagatctttcacgagccatatcccaattccgacctagtagtactcctaacagcaaaacaaccaaagttttggtcaatgtgagtatatatacatttcacagactgcagtctctcgtcgtgcgaacgaccaatccgcgctgcgcccacggctcgccaccagcaaaggcagcaacaattctccgcggtttcagtaacaaaaaagctccagatggccctggcggcctggcacgacgtggcgtgcgattctagcgaggaggcgtgcgattgggtagcgcagccgcgcaggagtacgtgctaccgcatggtggtgaagtactaggctcctataggcaggcgtatataggtgggctcggctcggcgattcgaggccgggagaaggtagcgcacgtcgtggcgctgggcgtgtgtccccgtggccagcagcatgggcgcgaccggcgggatgcgccgcgccagcaatcccggcgcctgtctgcatgcccctcccagtcccaaccctgccactccacctccggatagatggacagaatcaacgacgatatcgttgtggcgcaccatgcctccgcgctgcgcctctcgttgcaccacaccactggttgagttttcttttccaattctgtgatcagcctgcaggccgtggccgtgtgggtgttctggattccgggggagcgaagtcaaccggggcgtgatcctgcgaaatccagctgcgcgcactgcgtttcgtgtggatacccgcgtgtgcctgactgcctggtggagctcgtgccgaccagcttgattttcattacgaaaacactcctgatcggtgtacacagatagcctggtgaagaaaaaggaaaagtgagttggaatacgctgcgtgccaaccagccacatcggatcctcagatgcttctggctgtggggccctttgggagtatgcctgtctacgtgctgccacggtgtccgagaagttgaatacagctgtcgccctaagagtggatgtgtccctatatgaagtgctttattcacaggtaagcctatgttattgacaggtaagcctagtggcattcgtttcgactttggactggaataggcactgaacaaaattggtccttggtccacgtggacaagttaagttgggcccacgacaaaagacatggctgagcgggcccagggttagctttcaaggccgtatcttggaggctcagggcagtccgttgaaagaaaattgttgggtgtcacatcagatatttgaccggatgtctgaatgaatttttggacacgaatgaaaaaactaatttcataactcgcctggaaactgcgagacgaatcttttgagcctaattaatccgtcattagtacatgtggattactataaaacttatggctaatcgtagactaattaggctcaaaagattcgtctcgcgattttccctataactgtgcaatt

SEQ ID NO: 77314 - DNA, 3076 bp, Oryza sativa
cgcctccccgccggccgccgccgccgccagcgaaggccggcgtcgttcgagccactgttcgacaaggcgagcgccgtgttctacccggcggccgcgttcgcgccaccgcacagcacgggcgacaagtacctggtggtctgcgatgacggccatctctaccagatctggatggacgaaaagatctcctatggcagtggcgccatagcatccgttctcaggtactaccctcgccgccggccgtgctggctgccggcgaaggatctcggcgggcgctcgttcttcgtcggggtgaacaacgcggtggcgctgcgcgtggatggtggcggcggcggcgcgtcggggctgagaggcaactgcgtgtactggagtgccaggtgtagtagccgggccaaggtgttcgacgtggagtccggcaagtcggcgacatgctttccggtggtcgacttggagacgggcaagtcggcgccgggctttcccggcggcgcggaagctcatagagccctctgctggttcttcttggctgatatgcgtagcagcagcagcaatacgagagtgggaacgtcggctcatcagcttcagaaaagggctcgtcatgcatgaattatcggaccgagttttataagactactctcgctccgcttcagattacaaacccttgttcattttgaaggattcctaaagtaaatctcaattcctttggaataagcactatttatacattccgtctgtagaaacactatgccaatcctccaaaatatgctaattccatagaaatgaaaacatccacgccatcctcttttctttagctcagtgtaggtctataggaaaaatttatgtgttccaatcttttttttcacgtgcatttctacattatttctacgtttttattattactgtgatttgatcaaagtcaaaccccactctaaatttgatcaagtttgtagataagtatagtaatatttacaataccaaattagtttcactaaatctataattgaatatatattcataatatatttgtgttgtgttgaaaatgttattagttttttctataaacttagtcaaatttgaagcagtttaacattataacttgaaatggatagagtaaatgatatcccgtacgttgctaagaaatgacgatatcccgtactttgctacgaaatgactatgtatatatagatagctcgacaacatatgcaagctagatagatagctcgacagcatatgcaagttatactaaaaataagaaggaatgaacaaaagaaaattaaagaacttagaacttttcgattagtttggttgtgaagatcaattgtgttctcaatagaaggaaacacacatgaataaagaaaaattcaaaaggtttttaacttcagtttgaaatgagctgaggctgagctgagatattcttctagctattcaatggtcaaaacttttatggtgatgtggctcaatgcatgttgaacttgtggttccaactataccgtatttgtagctaattagtagattagttctaatgcaacaaaagttcataattttaactttgatcctctttgacatagcttcaggtctaaaaatttcatatacctctaggtattactaacttcacaaatccatatatttatatatgcgattatgttaataacatttggataaataaattttattctcattttaaataaaatttatttttaaaaatcactataatttaatatacaaactccaaatctaacgtggatttgatatctagagctgcgcttgtatgatctaataacattagttttacttgtgcttagagaataaataaatttccttaaaccatgatacgtttttcatgagcgcgtaaaaaacgaatctttagatctagttgatggtatctagttggtgctttattaataattaacaaaggcacacatatgaccaggaatgtttcccgtcgcgcggccgattccatctgacgctttccatcatttcctctgcaattacaaatatatagctatcaatctacattgttataatacttaccacaccgataaagaaaatcttttctttctcggattaattaattgattactacctccatattttaatgtacgacgccattaactttttgtccaacgtttgactattcgtcttattaaaaaaaattatgtaattatcatttattttattgtgatttgattcatcatcgaatgttctttaagcatgacataaatatttttatatttgtataaaaattttaaataaaacgaatagtcaaacgttggtcgaaaagtcaacggcgccaaatacggagggagtaatttttaagattatacagaataatagtttacccttttgccctctcttatacttactacggtagttttgagataatccgatgaatatctttaactaacttaatcacccagatttttttcttctggatgatcccaatctcaatctcataatagttaattttatccgaatattttgacgagagagcaagcggcggtcgagtcgatcgagcttggccgccatggcgcgtgggtgggaggacctgccgccggacctcctcgtgcacatcgccggtggcttctccatccaagcctacacccgactccgcggcgtctgcgccgcctggcgcgacgccctccggccgccctcgccgtcgctcctcgtcctccgcgaccgccacgccgggcagcgcttcgccgcctggtgcgtgtccccgaggatggtctccaccgcgctccacgagacgctcgccgcgaggctctccccggcgagccgctgcgtcggctccggcgacggctgggtcgccgcccacgtgcccggcggcgccgtcctcgtgaaccctcacaccggcgacgagatcccgctccactctttccccggcggcggggggaataatgtggtggtgttcaaggtcgtcttcgcgccgaacccgacgccgagcgagttcaccgcggcggcgatcaccggcggcggccgcgttgtctacacgacgaacgggaacagcggatggaccgacttcaagtgcccccgcctcggcgctcacggcgacgggggcagcatcgccgacgtggtgtaccac

SEQ ID NO: 77315 - DNA, 605 bp, Oryza sativa
atttgaatgagctttattttagtagcataatgctcgtacattgcaataaaaataaatataaaagcaaaccgaattttgggttcgctagtaggtacacgtacaaaatttacatagttatgcgtcagacccatatatcgcacacacatgataacttacaggttgcatcttattgataaaatcgtttattaaaattgtagctttgtgaaatacctgtcttttagtatactaatagttcgaatcattttattgaaatttatgaaaaacaaaacaagaaaacagagggttccagagacgttggtgcaaatctctgaattcgaccgagcaacacactgctcaggcttgtaccacctgtcacatagcactagcagcaagttgtaatcaccccagagaaaaaaaaggttaaaagaaaaaaaagaaaagaaaaagggaagaacaagaaaatttcttcgcaactccagcgtgtccagcgcttttggacttgttcgcactagcccgaaacaaatggagactgctacggatcggacgttcgatttgatgcaaattattggacggtgttgtcccgattgttgaagaatgtttcacatgtttcacctctcgataaaaat

SEQ ID NO: 77316 - DNA, 6921 bp, Oryza sativa
cacccactcctctctccctccatctctaatcttatctcttcccttcctccttatctctttttcttcttatcccttcccaactccccttcccaactcgatccagtgtgcgcagcaggagggggtgggcggcccggccggcggagggcagcgcggcggcggcgcggagggccgtggcgacggtgcggcggcggccggggaggaggggaggcggcagccggctcagccggccggcggctttacttcgtttttttttattttttttcaaagaatttgtgatccatgtgtagattgagatgaagaatctgtggttcattgtatggattgagatgtataattatttttttggaatctcattgtatggatctgagatgtacatgatttgtgtatgatttgtatatttgggatgtttctttgatttggggtttgatttgggatgtataatctgtagtgtatatgattgatttgtgtatttgggatggtatgcatcccacctaatttgggagaaaataaattagagattaaatagtaagtaaatgaaaaaaaaactattgcccactcccatctttagtcccggttggtaacaccaaccaggactaaagatcgatctttagtcccgggtatttgaaccgggactaaagatagggatctttagtcccgggttcgtagtcccgatttaaaaaccgggactataggggggttacgaaccgggactaaaaacgatttcttgtcacaccctgattttcgtgttaggatttataaattatttaataaattattaatagaatttatatgaaatgttcattaatttacaagtgaagttaaatgtgggaaataaaatttcctaaatataaagcatgggtggatttaatttttattaaattctccatggttaattatactctctggaattttctcggatttttcggagctcaattcctaaatgtaaatgatacagagaacagttcagtaattatttgatcaataatgatctaattataattgttaagtgcttttcttgtttaaaatccttaaattataaattgttgtttaaaaggaattattagaaatgattttaaaagcttaaaagagaagatctaattttaatgtgctaaatctcaatataaaattgggttagataaaattttattaaatactttgcttgttcctctattttctagaattttctgggaattgtttgagcaagggaagtatttttaataaataaaacatcatttcacgaattatttttaattgaaaaagttcaaaaaccctttccctctaggcaccgacatgtggggcccacatgtcaggcccttcttcttcctctagcagccggccggccgagcccaagccgtcgcccgagccgccccttttctccctcaaatccgctccaatccggctctttttcttccgggtttttgaggggattttatcctctcgtcctcctctatctttcccctcaagaatcggagcaaatggttgagtatcttgcccgaatcaaactcgttttcgagtttatctccaaaaccgagttttctcggatcgatttcttgcgggaggagtccgatctcttcaatccaaggctataaataggaccccctagttcccctccttcgtttgccccatctcccgtggtctcccgtgctccgtagagtcgccgccgcgcgcacttagttcgccgccgccgccggccgtcttcagccacgccgcgccgtcgcttgcgtcgtcgccgccgcttgccgccgccgccgttaggtgcgccgtggtgaggagaacctcggccgcccgtcccctttcgccgccgaccaccggagctccgccgtcgccgtcaagccgagccgccgccgccgtcctcttcgtcgccggccatcatcgttcgtcgtttgtcgttgtggtgagtaccgttgggttcgcctcgtcgtcctctacgcgtaggtgtcctccaatcacccggccaaggtccctagctccggcgaggtcgccaaccctagccggcctccgtgggtgatgtcatgctgacatcatcatcctttctttttttcctttttttctaatagatgaaatcttcggaaaatcataactaaataaccatagatccgtttcaggtggttcaagttgctaaatttttctaaaataaagatctacatattaaaattatccataaattgaattaaatttatttaagtctttttaaatggactttaattagatttaatcttgtaaaattcataataaattcatttgaagtcggaatgaggccgttcaagtctcataattcatctaaaattatgatctacatgtttgtttactttttatgtactgtttatttggtttttattagtctttttcttcgttttgcgtgttagcttgtcgtttccgtcgttgcgaaggttcgtgagtgcgtcggaagtgatcaagaaggttaattgaagatcgattattgcaaggcaagtcacacagatcctaaacacaatcctttgagcatgttgatcctatatttaaattctctatttatttcaactatgcatttattttcgaatgtcaccgggtggtgtgaacctattcctttgttatggccaatttgcattgaatgccctattccttgataccttgggtaataaattgattagcttgaaccttatgtattggtttggttcagctaaaagttatatatataattgcttagcaatgcttagaaacattagctcactaatgggatgaatcatatatactacattattatttatggttatatttaatggtagctcacgatggttaatcgtgtgatgttaattaattgataattaaaacctggttaaggtgggttgtgagcatatggttttgatggttgtgctcatgacaattaaggaccggttcgcgagctactgttgtgagacattaaccgtaccaaccacaagccagcgtgggcaacggctttatcctttgtatagcatggttcattatagtgcgccagactgagaagtggcgagaagtccacgggggtcgctggggagtccatgccttgtttataagggggtgattatgatccaggaacggtgcactgttttgagttgtgttgtgcaaagggtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgggttgagcaatgtttttcgtgattagtctcacacctttcacaataattatggatgtaataactggtaataatttgcttagctcctggtttggagttagatctgttcagccgggtatggttgttcaggatggttgggcctgtacagcatgggtgtgctgttcagtgttgattaaaacttctgattaattaatctactgttttactactcttaactctttgctaaatgctgctttcgcaaatgagcctatattatgccatcctttggaatccttgtgcacttgcatatttgctgtgtggcttgttgagtatgtcatatgctcattcttgcaataatcatcaaacctcagttgaagataaaggatccagaaggagaagacgtttggcttataccccagttgagctgcctatgggagtggagctgaagccatcgctagaccgttaattccgctgctgtttttcttttcttttgtaagtatgtaacgttattattatgatggatttgtatattaaattatcagtttgtgtacctcggctgattcctggacgaggattttatgcacaaattagttcggaaattattagtgaatttccgggcgtgacatttctccactagtagttagtagagttgacatgtgggttcaggggtatttcttaacatttcacacgatttttctctcctcttcaacttgaaattatcattttaatgggtgtggtgtccactggcaaattaccatattaatagagtgttttccccccaaaaagtcacttctctgtctcctacaactaaaactacgaagtcacgatgtccctttacaaaatttgcctttctattgtcttgctctcccttcactttatctatgcttgtatgcatctagcaagatttaaaatatttttttcttcattatccgaccttattgtattcatcgtaattaaatctttataacaaaatattgcatgattatattccaatgaaagaaaaacatatgttttaaacggttaaaactcattgtttcatatgtgatacgacatgtttcaacatgtgttttcactatgtttcacaaaatttttaaatgtttcaacaactgatttttttttatcattataacttaatgtttcactcggtagccaccttcaaatttttttagaaatcaggtgaccgatctgtagtttcgtcagaataatttataagctaaacaacataaatcattttatgtgaaacaaatgtcactaagtagagaaataagaacattctatgtattaaaacattatatggaacaagaaattttgactattgaaaatgaataagttaaattttgaaattttgactattgaaaatgtttcctttggaatgaattcctctacttctccaacaaatcttctctattccaaagaagcccttaggcacattattattccatgggtcatataacaacgtcagtttacttgtgttcgaagtttttgattttaactgcacacgtgtctaaaagcacgtctatttaaacagggcgatatatcagttctcgcaacattaaattttagtgctaattactgtagtaatgagttacatcgtgaacaaatcctcgccggagctcgtcggcccgccgacaaccaagccggtggcgccgaccgtcgctgacgtcatcaacctatcctccttcgacaaagccattggttcctacctcttcacgtcgttccacgtcttcgacaatggcatcgtcgagccggccatgacgatcaagggggcactgtcccaagctctggtctactactaccccatcgccggccgactcgtcatcaccggagcggccgacggcggcggcgaccagctctgtgtctcctgcaccggcgagggcgtggcgttcgtctccgcgacggcgagctgcgctctcgacgacgtcaagctgttcgacccgccgttcgcggcgctgttgaaggagctcgccgtggcgcacccggcggcgggagaggccgaggccgacccgctgctgctcatgcaggtgacggagttcgcctgcggcgggttcgtcgtcggcatgacgtggaaccacgtcgtcgccgacggcaagggcatagctcagttcctgcgtgccgtcggcgagctcgcgcgggggctgccgcggccgtccgtcctgccggtgagctgcggcgacgactccctcccggagctcccgccgctggtcgccgccatggagaaggcgatgctgacgcaggagagcaagcagttcgcgtacctcgacgtcaccatcccttcgagcgtgatcggacgcgtcaaggcggcgttcgacgacgtcggcgacgtcgcacgctccggcggcgagccgtgcaccgtgttcgaggcggtggccgccgtgctgtggcgcagccgcacgcgcgcggtcttgatctccggcgactccgacgccgacacgcccgcgccgctcgtcttcgcggccaacgtgcacaagcacgtcggcgccaagcacggctactacggcaactgcgtcacctcccaggtggtcgccgcgacgagcggcgaggtggcgaacggcgacgccaacgacgtggtgaagctgatccggcgagccaaggagctgatcccggctcagttcgagaacggcggtgtcgccatgaacggggcggcggcgcgcgtggagaggcagctgatgagcgcgctgttcgggtacaacgcattctacgtggcgagctggcggaacatcgggttcgaggcggtggacttcggcggcgggaggccggcgcgggtgatgtgccatgtcgggccgacggcggtgccgagctgcgtggcgtgcctgcctcgcgacagcggcggcgccagcgttctgctgctgtgcgtaaaggaggagcacgtcgacgcgttcctcgcagagctggaaagtttcaaatgaatatatatactgtcttactggttgcttggtcgcctctgacgatgaagatacttctataaaaataaatgtaacgtcaaatgctagtactttctctagtttaataataattgttgttttggatggagatacagccttaggctgtgtttagattcaaagtttggatccaaacttcagttctttaccatcacatcaacctgtcatacacacacaacttttcagtcacatcatctccaatttcaaccaaaattcaaactttgcgctgaactaaacacagccttaaaaaaatgaaacatggagtattggtttctattacagtatatatagaaatatatgagatataattttattgaaaaacattttaagattaatctaattatatatggtcttcatgtttctaaggcaaatatttaaaaagttatttatagttaaagttttgaaggtatgacgtcagtcttgttcaaaactacaaatattttctactggaagaattacttaagattgtacaattgtgagtttcattctcgtctctcgaatgtgatgttgctactaataactatataattattcaaagagtaaattacgctcacggtacgtgaacttgtttggtgggtgcaaataggtacaacaacttaaaattgctcgttttggtataataacttgactagtttgtgcgaacataggcaaaaacaacccacgcaagcaaaattgatataacgtggtgcatcttggtgacacctttgcgggctagtagtttctttgttttgaaaaaataaattgcatagcagttgttttgtttgaaaaataaaat

SEQ ID NO: 77317 - DNA, 21619 bp, Oryza sativa
attgctcgttttggtataataacttgactagtttgtgcgaacataggcaaaaacaacccacgcaagcaaaattgatataacgtggtgcatcttggtgacacctttgcgggctagtagtttctttgttttgaaaaaataaattgcatagcagttgttttgtttgaaaaataaaatccgtactgcaaaaactgaaggtaagttagtgtactcaggtctgcacaactacaaacaatagctagcgtgcatatgtttcattatggtactacacattatatcaattttgcatgtttgtgttgttttgtactaggtttgcacgagctatgcaagttattgtactggaacgagcactttacaagttgttctacctatttgcacccacatcacaagttcatgtatcaggagtgcaatttactcttattcaaataaatgaaactgtatgtatcattgctcagttaattcaaatggcaaaactttctactcagttaattgtcttatcaacttaaaaaatacctattaaattaatttccatattaagtgtagagtaaattgtatccacgttataattaaataagttagcagatgggtgcaatttaacacaagaacttgataatagaacattcaagtgcaataacctgacaagatagtgcgctttaatatagaaacttggtaatttatggtcttttagtgcaataacttggctagacatgtgctattttggttaagagtgctatgtactcctaagttttttcacgatgtcagcgtatcttcacataataatcctgtagatattatcttacaatctttgatgtagtctgcaagaattgtgttgctcatggtttaattttttcttcaccatctcaaatctcaaccaaaaaagtttcaacacagtaaaatttcattgacttttaattactagaataaccaaaataagtatgcctatacaaatatgcataagtatattaacaaaataagtacttaaaaactgaatgagtatagccgaaaatgcttgaaataattaatttgttacaccacttcttataagttattgtaccataatcacccccacctttcaagttgctatatctgtacgctcacttattcttgtactagttgtgtccacttgttaagttgttgtactggcacgctcagttctcaaattcttagcactaaattacacccaattgccaagttaatgtaatgtgaatgtaacttacttagaaaagcattgaatttgtatcaacgaactaaggtaaaatataggtccataacaaagcactgatttttacatgtaaccagttagtttgcacgtgcaatgcatatttgtgtgatatttttgcggggatgttcgtgcagtataatgtgacaacatatataatcatactgaaaatatgaaatccttgcgttatatacctaacattcaacgaattgcctattgccttactaaaaccaatttggggatgtttttatacggtaggtaccgttcagtcaatctcatataacatatgttcaacattagttttttaacgactataacatattcaaaacttctgcatttgtatcatttttcttttatgatcaggacacgcaagtgaagtattctctatatttcatctgtagtatcaaaactgatttacaactgtacaaaataatgaaagaatcaaatgtgaaaagttggtgcaattgccctctgctcatctcttcttcactaaaatcaaggccacaaatgcaacaattctgaagaacagaccatacataaacagaaccaaaatacagagcatgtaatgatgaatgtcgaaacgacttctgaacaacaacccacagcgagttataagccaaactccaggatacctgaaatagaaaagaaaaacgcattaactcgagctgctaatttacaaatgaatattttggcagatgtgatgatgattgtgtatctagatatgatcatgcaacatgcaagcatgatgagtaagtaatacctttttgcatttacaattatgaaaccctctaatgcccactttggatagcataatctattgagaattgcaggggtattattttgagtggataacaaagtcagaacaactgggatcaatgcagaacactgcaaaagtttcagggttagtctccaaatatattattaatcagaagaaactgcaaaagttgaacaatctttatgatacataccagttgtgcagaaccagggttgaagcagatagcaaaagtgtatcctataccggttacgcagtacacaagtgcgaggagaatgatatagttatcggtaattgtagatcttggattattgaagtagtagaacatggagaggtaaacgatcggcttcacaatcgtgctgaaatgatcaattgtatccctagcaagaaagtatgccaatgagctcatccctgactctctttccctcaagtattgcaatctttcaagtgaaaacgaccttagtgctgcaatcttgcacaacagagctgcagaagtagtaatttatgtcagtcaaataatcaagttcgtactgcaatgacagtataatctgaatactctgaacttacaaactgcaattatggtgtaaatgtagccaggcatcccaaaatttggatcactgagctttgcaatagtacccagacagatcccagcaaggcctagtatcagaaaatcaactgcaagcaacctagcttcgcgcaacctctgttttgtgaccctgtgatgtcacacatgaaagaataacttttaatctttcgaaaattttatcattggaacaatgaaaatttgatcacatggttgttcaagatttcataaaaagattatatgcattgaattgaacataccttcctaggtagtacttgtactgtctaatcacccctggtgttcttctgctggacaaatcctttggtttagacaaatggtgctcgatacgatcacgctcttcagcaaaagcattcctgacatgaggaaggcaatgaggtgttgatccagctgaagggctggaccccaaatgtggtctctgttcacctattgccttgagatcatctttcatgtcatttggcacttcatagccattgtagagcatccagtgcaatggaaaatgcttcgcattgatgcctgactcaggcttcacaatgccctcaagaatgtcaatgtagtgatctggtgggttaactctttcagggacagtgatcccaagagttgagaagtaatcctccacactcttgaccggaccattgtaaacaattagacctccttttgccagaagtatcagatcatcaaacatgttgtacaatgtgtagctgaataacacaaacaagaaaatattagaaatctttcagaaagatgagtactatcttcagaaaaagatggtctgagagtaacctcggttgatgaacaactgcgcaaacatttacgccttcgagcgcctcatgacgtagtgctcggaggagcagttgtgaagaggagctgtccaggccagaggttggttcatccaggatcagaagtgatggctccatcaccatttcaatacccacattgacacgcttcctctgtccaccagagatcccgcgcttctccacagttccaaccaatgaacttctgactccctgaaggtccagggagtctatgaccctctccacagtgaggaccttgtggcggtgtgccgttgtcgcagagagcctgaagatagtagaaatgataagaatatgctgagctaattactgaaatggcaatctgatataaatacttcctccgtttcaattgttttgttttgttaggacaaggatttgaccagcaattactttattatgatatgacttatgtgatacaaacgcataatcgtaagtaagtacttttgaacacaaatctaacaaatccaattttgtgtcacaaaatcatatcccagtagagtaattgttggtcaaagaattgtcctaacgaaacaaaatatgtcttatattttgaaacagagatagtaattgtcaagtaaacttttttatattaataattttacctgcactttgcactgaaccaaaggttctcttccactgttaaattcccatgaacaacatcatcttgaggaacaaatccaatgatcttcttgtaagaacggatgttgtcatgcctcccattgacaagaactgaacctgacaccttatagccagctaccttccctgtaacagcattgaggaatgtggtcttgccggccccggatgggcccatgacggcagtgacacggccaggccggagttcgccattgatagacctcaacagcttcttctttccaagtgacagggtcaggtctttgaactcaaccttgagcagaggccttgttatctccttctgctgctctgacaccatggagagcactccagtgaaggtcaggttcttgttctcctgttgcctgaccttctccttctcgatctcaccatatgcgtacttgaagatctgcgtgtgtgttgatctgtgcttgccttttggtgcagatctatccttgccggcaacaatttctccatcatcgctaacatccacaacgactgaaggcatgacttcagatatctcaccagtgctctgatgagctgaaaatgcagcagaatccgacaactcctggttcataaacagtggtgcttcctgcaacctatggccagaattctccgagtccagatgctgacggaatgatctcctacgagagaatgtacgtgagagatgactctgcatgtcattgacatgcttcctcgccagtcgtttcgccgccttccatccctcatgcgctttgagctgctgacgtgccaactgaatagcattctccctcgatctcgctttccgtttctcgcggatagtcaggaactggcctgaacagttgtatatgatcagaagaaatacaaacaacatgccctgcaccaagtgttcaacctgaattaggcacattttccagtacagtctgcagtccattgcactcactggatcttaaaagaggcaaccatcaagctagcaagatagtgaaatgatgactttgttgatggaatttaccactaaacaaccaccaagaatgacaatgttttcattctctgtcttctccttgcaggatccctttatgatacattctgcagattttgaataaattcagcttgctggatggtagatactataactgcatgattcaataagaaaatgaagtatcaatctattttaatgatgcttactgtcttgagtggtggaacccagtctgcaatagtgcctgaaggggaggaaaaaaacaagaatcatcagtcacctagtgtttaaaatcaaataatctttgtaatatatgtcaaataagtcatacaaggagtatgattggatcagtacccttcgctacaaggttccttttttgttggtgttggacagtagtaaccggctggacagaacatctcttcagtgctcccaaaatcagcccatgtgtcagcacccccgcagccagttgtatttggagttatctgatacttgtatctaatcaaagttcagaaaattcaccttgtaagcattgtgtttatattttcaagaaggcaaatgcagaacaataagaacagaattttttttaaaaaaaaatcttacggatcacaaagaccagtggttgtgttcacagtggcacgcggacagtatgatcccaatggacaagctaaagcaaaaaaacaaacatgaaactcaagtcattcagcaagataaatatatggtctccacacaaattaattgacaataagaacagccatgcgggaaatgtagaaatcactcacgcaacatgcatgtaagaccacggggacagaagaagccttcgcaacacggctgacaacttgcagttcttggtggaatattgccttgggggttagggcctgaacctacagagcaagcccaccctggctcacagccctgaacccaagatgatctgttgcagtttatgttggttttcagaaagaggtttttttcgccttttcgatcatacaaactcgagaagtagaatttcacttcgttcggtgtgcacagacgccctcccaaatcacctgaatgaatatctttttcacattagagaatgccaaaactagacatgttcatgggcagcctgacctgccttggtaaggaaaatgatgttgtaaatcattttttttaaggagaaaatgttgcaaactagacatgttcagtgttcaagcctcgcatttcagcgtggaagcgtggtagtcacttctatgatataatgcgaaaataaaacatgcgacttcagacttaatcataatgattatttttgccacaatcaacggatcagaggcataatcataatcataatgattttgtcacagtaccataaggaaaatgatactgtaaattattttttcaggctttgtgcttggcattgccacaccaatcagtgttcaagcctcgcctttcagtgtggaagcatggtagtcggaattagtcacttctatgatacaatgtgaaaatgagatatttgacttcaaacttaatcataatggttacttttgtcacattcaacagatttgtcgaattgaaacaagttactatactatatcagaagtccagaactgaatctaactaccgaattggattgttgtgacatgtaaaataaataataagtgcaggataattagagataggaacaggtcaaactgtctagcttcttaagactaaacaaacgaatagaaaatattagttagagttgatcacgtcaaacaccatagtcccgtgtcacactcagctaacattaacaagttataatgttagtctttccctactaaattacggaatggatgattattatagggttgcatgctccacttgtcctccatcagatcgtttcatcctctgctaagcactcctactaaacaatgttcaggaaatgcatgtgcaggtgaacaattccaaagaaccaaatctcaatcagcatatcccaatgtcgcatctaggacataactatgaatattataagaggtgaatattagaaactagattccaaaccaaaattaaaaaaaaaagaaaccgggatgcttacaaagcaagcacaaacagtatacgacgacaaaatatttgcgagtcggcttagacaaccttgaattaggatctccgaatagaaaaccatttctaagaatttgaagtgcatttatgctaatgactgaattctaatataattatctgaattggcaccaccgcaccatcgaaaaaagtagtgttatctgaaaaccaatcacttgaaattacaaaaagaaaaagtaaaccatgtgcttataaataaaaataagttcaaaactcaggttggttcagttcattagattggagcatacacggataaatattcgattaaaaaatgtgtaagcatggccgtcacattcaatccgctaaattcagatgggaaacaaataaaaaaggagaaaccgcttcaacgatgaagaaagcaacacacgaaccaatcaaacaagcaatcgaacaggaaatctaactgaatttaaatttaattaattacctcttgtctccgcgaggcagttctgcacgaatccaagatccgaggtgtaattgaaggcctcattccaatcctccgtcctgaagcgaacacacaccaaaaccaaccaaaaatcatcaacaattccattgaaatcaagaaagctaaaggaaaaaagttttaagaggtcggcggcgaagaacggcgccgccgaaatgaacggggggtggggggagaagagaaagaagagcgtacgggtcggcgacgcagaagctgaagcggtgggagatgtagtcggcgacgtctctggtgaggttgttgagcgcatccggcaccaccggcggcgccgtcgtctgctggccgcgcgcgacgccggcagcaagaaggagcagcagaagcagcggcggaggtagccgccgaaaggcctcgccatcgcgcattccggtgcagacaggatcacacagagctatagctagtctcgcacagcagatggcgctgcctgtagctcgccgaggcaacaggggatggatggagatggatggaggaagcaacggcaaaagccgagatttatccgcgagaggagaaagaaatctccgcggtgcgtttgaagttgaaggattccaaggcggagcacgtttgctggttgggaggtgggggccgttgatgcgttgggtatttgagactgccggccgtgggagctagctgctgcagcttgcactaccttcggccaatttttatctacctagtgctatgcccatatgctttacaataggattaagaaaagtacgaacggatggtggttttatggttcagatttatctgtttttgtttttttttctcaaattttggtacgtggtttttttggtggtcttttcgacgtgatggtttttagaccgatgttttttttctctagtggagactggagaagtacgaaggtggagggagaatgacaattactaccactccgattttacagtagtagatatttcacctcaccatttctagttcgcactactctaccgttttacccaacggcttataagcagctatcaaattttgaatttttaaaatttaacttttgaagttgatttttcgtttttttttcaatgtaatttatttttcagcattaatttttaaattgggaagaacacatataaaaatgttttctcttaaattattttttattgatgataagtcttacggactgatagttacgactccctccatcctaaaatatatgatttttttttcattatagatgtaataagataagttaaatgggaatggtcgtgatgggttgacatgagtatgtggagaaattgttgagacaatgtaatactagttggataagttgttatattctatgataaattttaaattataaaaattattatattttgagtagtaagttaacgataaatccgtaaacctcttacttttttataaaaataaaatcatatgtacataacaacacggagggggtatgtaaaaaatcactcttttttttaattttactgtactttaaaatctaagaaaattccttcatgttgccattttgatcgattacgttgccatattaaagttataatatagatggatggaagtattgagagtcgatatcacctcgttgtagtttaccagttgcatgtcactttcaccgaattggagatttttatataatgaggcactagagtagtgaaaacccaacgataaggatggcaggcaggggaagaagcaaccgtggtgcgccccattttgtgataaccacgacagaaacgttcaacgatgcatgatttggtgattgtttgctttgtctctgttctccaattgtcgaaacaaccattcagctacaatgtggctcccgcgtgttgccttattctcttgtgtacgctcgtgatcgatgcttgacttggccacaggtcaacccaaactgcctcaggattattcccttcacaaaataaatgataaattaacaagtacgcgcgtcaggactgacgatgagaatttttcttgtatttttaatctttaaaatttgcaaaaataaattccgtaaggaaaaataacccgtgtggcacaaagctggcggcaaagcccgcaacaatttgatcatactatagacagtaattatctcacgatactagtccccgacctataaaaatgacgagcaatattattactgacactatacactaaatttctattattgtttttagaattcaaattatcctaaaatagttgttacaatatagtactaagtgtcacatcaatcacttcttattcaaatttcttcctattcttccctcaaccatcctctcacttttatttatataatatctaatgaggggcatcatagcctttcttcttaaatcttaatatatgctaaacagtttagaattataattattttgagacggaggtagtaatagctacattaaaagaagagtctactttagttataacttcataattattaattaaaaatttagaatcattcattttttatccttcatccaaattcaaatatttaaaagaataaagaaagtgaactttttatccctcaactaggacctttggtccggctttcatcccctagctaaaagactggttactattggtccttcgactcttaaaatcagtcacatttcatccttaggctaaaaacaaaattggttttcgatgatgtcgtgccatgtggcatcctagttggcaaatgaaaatttaaaaaataaaatatgaggtggaaagaaaggagggagctgaggtgatgatgccatgtggattctatttcttaatttgtttcgttatgttgttattcattattgattagtatagctattttccaatgtggtaccacatcataaaaacatatttgtttaaggccagggatgaaatatcaacggttttgtgaaagttgaaggtcaatagtaaccaagagcatagttgaggacctcttttcatttcatttctctctctctctttttttgcaaaactttttttttctatttgagaaaagtccaatgtaaatcgatgcatgtggctctaaatgatcgtttaaacacctattaaggaaataagccaaatggcatgtttgcaatcgaaaaataatttgtgagtaaaaatttttcatacttgtttttagtgatttaaaagtaaaagctgaaaaataaacttcgacgaaaaaaacttcaaaatcaactccaaatttaagattgaaaatttatttttttttcttgataagtataagcgaaaagataaggctgtatgcttgcttaggaagacatgtcgtatttttcctgtattttttaatcatgtgcgttactatgtttatcctaatccaaagttttctattcctacattcaaaagagataattgtgtgcccaaacactatttctggatgaaattcaaaagagatatctgtatgccctttggtacttaattgtcttttttagaaaaaaaaaaaccaatggagtactttattgccaatatagactatagtaaggttcaacatgtagacgtagcacgtggactttcaaacatatcaggcggatatgcagaataatgcttcaaaatcacgcggatatgcagaataatgcttcaaaatcacatctgcaactgcaagtactacacggtgctacctccttcgaagtaattaacaaggatcgcagataattcaacacggtgtcgatcgattgcatcatcgttattaccggacattaattgtaaagatcggtcaatcacacaatgttattttattggacaaatatgtataaaaaaagatccagctatctccttatcagcacaataggataaaataaaggcattgcagcgagcaatctggcagcttctgtggtgtagctttctgcggtgtacgtagtcgattgtctagttcagttcagacatgtatgggatctcccaagcaattgtgtcactgtgaatccgtccatgtggcatcactgtatatatgtgcgtacaacctgtcatgcacgcatttttttcacttgccaaattgttgaaacatttatgctttctaaattttgtgcaattgactgaagaattttcatacgcaaggcaaattcctacggttttttattattattttaaaactttttaaatttgttttattttaaaaacagacaaacttattttcaaaactaaacttttggtcacgccaacctgcttggcttggtaaaataccagtgtcacgctacctctaacaagtgtgacagttttattatgtcacgccaactagatcagcgtggccaaatggtgtcacaccatctagatcggcacgcaagtattgttttaccacatcagcctagctagtatggctaaaaagttcatatctttaaaataagtcttggaaagattttttaattaaaaattaaaaagttcaaaaatgaaaaaaatccattcctatctgcaaatatatttaactttttaataccacatttcaggttttgtttttttcttctgcaattgtccaggctcttttttcattacacaaaagacccgcatacatacaccactatacacgtacacaccacacgcctatacctatgcaaacacacactgaaaaaactacattaatggtagatcattagtctcattaaatttctgatgcgtatatcatatttgtagacgcaatagtagtaaattccaaactacttcttttgttcatattatatattttacgttttgaatagattcatgcatggatttatatatgtgtttcatatgtatccaaatccaaatttatatggacagtgtagtgaatctagacgaaagatgaagccaaaacatgtaacgcagggagtagaatgttacgctatattaatccgtgcagctacgaaaattaaggacatctttggtttgtctattgaattggcactactaaattttttgtatgacaataaactaaatatgctcatttattaccctattaaaaaatttggtagttctggtaatactgcaaatcaaacatgccctaatctcttatcaaattttgatagagttagttcggacaacaagccaaacaaagtcctaagttgctgcaaatctaataataataagaagtttaatactagagccaacttactacagtctatatcatttatagccgttttgtttgatgctaaaatgtaccgtaccaattttttgggagtttaaataataaatataatagtcttgtttgcagctaaatggatagtaatgcccacgcttaatttgctataactttcttcaccataacccatttggcttccaattagcatcaacccaaactaccctactttttaatctggatctatccaaatataaaagctagtaggacatggtagactaatcagagcgcgcgcatgtgagctccaatatttgtctaatttgttaattttggatcagatccatcacgttgagaaagctgtatcgatgactattatattaattataattgcaggcataacgtaacagacgcaaatcttcaaaggttgaacgaagaccatatatggaccatggatagttcaagatattattagagttcttctgccaagaatatgtatatatattttcttgaagtaatgatgtagtacgtatatatatagagaaggatattatgggcctaggttcctagcattgtgccgtgcattgggtttatgattaactgttaagggttaattatattgattcggtatggtcgatctcttgcaagtgattcgttaattgggttaattattgattcgcatgtaaatcatatggtattatttgttacttcctccatttcacaatataagtcattatagtatttctcacatttatattgatgttaattaatctatatagatacagatgttaatgaatatgaatgtgggaactgatagaataacttacattctgaaacggagggagtagaccaatatgtttttacaatcgagtgtctcagcaccacctaggtatacaaatggttaggacaccgctaaattaataaatgctgccaccgtttgtgctacaacgaattagtcgctgttaaattttgaattttaaaacttaattttgaagatgatttagggtattttaacgtagctttttttcaatacgacttaagtcacaacacgtatgttatgcacaaattaatttttatcgttaataagctatttggtacataatcagctctttgatcaactgatggctattttgtccagctccaccattaggagaatataacagccgaataagattttatgacaattcttcgagagcaagaacgaacgagttaaatattataaaattataagttaattttaagataattttttagtgctgaagattatttataaaaaatctgtatattgtgtataagttgagaaagcgtgtccatgataactccgcggtgaccatgatcagaaaagaatggggcaggtaatgctttggtcaatcagtaaacggaaacacgcttgcaagcaagcggagaagccagtgtcgcagtgtcagtgaacatgtttagggtgtgtttggttggggaaaagaaaatttttgggtgtcacatcgcatgtttgaccggatgtcggaaggggttttcggacacgaataaaaaaactaatttcagaactcgccgggaaaccgcgagacgaatcttttgagcctaattaagccgccattagcacatgtgggttactgtagcacttatggctaatcatggactaattaggcttaaaagattcgtctcgctatttctcctataactgtgcaattagtttttctttttatttatatttaatacttcgtgcatgtatccaaagattcgatgtgatatttttgggaaaaaaaattttaggaactaaacggacccttagtttattagttaaggtcaaacatgatcgaagtggagcgtaccttgacttgatcctgctgtcctggatgcggttgccacgaaactcctgcagcgacaaaacgtgatcctttgtgtcacttttcaaagtagcggctagtccaattctatcactttcataatacggagatataagttcaactagtaaattagagttgctttggattagccgctacttcatacccaacaaaggacgcaagatatatattttacctatgttagcacacttttaaactacttcctccatcccaaaatataacaacttttaactctcttgatttgttccaaaatataacaacttatccaccaacattctcttcccaaccaatcacaatcctccaccattcacttttactatctacctccattacttatccaataacaaccctccacgactcacttctactaactttcttactaaccgtatctaaccctaaaagttcaaaagttcttatattatgggatggagtgagtactaaacagttcatttcatacactaatatcatataaatctattttttaatatttaaaataatttaaaatataactaatcatacgctaataaatttctcgttttgtgtgcccatacttaaatcttcatcttcgtcgcttcatcggtcatcactaccggacagagccaaattggcttgttggccaagggcccttcatgtgaagcccacataaccctgtgcatgggccaaggaaacctgcgcaagttggccaggaccttgaggctgtggcccttagttcacatcaaacttccctaaactcctaacttcccattacatcatatcatatctaaaatttttctactcatgtaaactctcaatttttttttaaactaccaactttccccaaacttcttcccaatttcagaaactaaacacagcatgtgtgcgaaaccctcttttcccaacctttgtgtgctggtcccaacacagcctagcgagaccagctagcaatctcgagaatcccaacaaaggatttttagggtatgtttagactaatgctaaaatgaacatttacaaagtttggtaatactaaaattttgacaaattagtaacattagtaaaatttggtaacaaactaaatatattcacataattatcaattttaccaaataatggtatggattaaaatgtcatcagtctgaacaagctcttaattgttgctttagatcaccattgaataacgatgacaaaatctctaaattgaaatatgtaggtttttttttttgcaatgttggggtcaaatctaaagtatagtaaaatttagagctttaaattcccttgagccaattaatagtcttacaaaagaaaattcaagtaatatctataagcaaattttaactacttacaaaatttgtatcttttcgttcgtcacctcttttttgtcttttttgtccacgtttttatccttcaacgcgctaattttgttgaattggactcgagttcgccagagagataaaaattaggattcgccggagagataaactcgacttcgagctcgatacatgagcgatttcgatgggattttcttcaatttcttgagagaaaagatagagcaggagatatagatcaaaagccctcaactaagttgagattatctggttgaatcggacgcgggattgaggtggcgtggggtataggcaggttgaatcggacgccggattgaggtgtcgtcgggtacaggcagggctctggtttggctggaacctgaagaagctactgtagcgacaggaaggtaaattagacttatgctgggacttcttttccatattcagcccaaccttgaaagggaggattttcttttccatattctgcccaaactagaaagtgacgattttgattctttttctaattaaataattgttgatttataatctatcatttattttgtgttcatgttccctgaccccagttgtatcccatgtgtgctagccgatatgagatcatttggattaaatctaattctaattataaagatatagcttataattgataaatctacatcattatatctaaacatggaccaaaactttttctagatccactatgatcaacagcgtatatttttctttcaattaatgtgttgatttctaagccacaattgtgaataaatatttctttattaccgtagtaaattaatttataaatatgtaaaaaaaacatatagtgcttctacacggaaagaaaacatatctcactaggttatgaaaaaaatgtcatttagttatttaatatttggtgtacttttatttttcacccattgcaacacacaggcatttttcctagttaaatcaaatttaccatggaaattttgattttaaaaaggaaatcataaagaaagtcatccaatggtagccagtttgcgactttgcaatactaactaaacagacaccagttcgccataacgaagattgattgcctaaatggatcaaatcaccacatacgaatacagtcccgtgtagcacattgcaaatttgccatgaacctagtctaagatccagcaattatactcgaccagaactcctaatctacgcatacaacagaactctgcctacacaaacaacaggccaacagcatgggccacgtggttcaaggcattggggagtaacttccttatatttcatagttacttctttattaaaattcctggatgtaaaatggatgctcatggttagtaaatggagaaatggggaacgtttgaaattgcaagtaatcagatcctacaaagtggcctagtttatatataagaggtcatccagaatccgtcaaaacaatcatcttgaaagttcatcttttaaattgtactcagttattcactatcaaaattgttggtacattgtgccagaacaaatgtcacgcaagaactataagtaccaaaatagaaattctagatgcagaagcttgccttcagaaagtcctgtcacagggtgataattgaacaataagggctctgttcagcagccatacctgccacagctgctgaggctgcggcagttcaaaattgctgcaaactgcagccactttgaactgctccagctgctaccgctgctaaaaaacgactcccaaaacacacccaagatgttcaagaccataaatgtttgggcacaaaaaatgctttattttttagatgtatacttcctggtccttgcttgggagccatcctaggtcagtgtacttctctgcaagttggatttgtggtcaaggaacagagctggtacaatgggtttcagatgaagattaaaacacattgaaatacagattggttttcagatgataacactaatcagatgatgacaaaagtgcattggtcagtaacaaggaaaagaaactgtacctgtagaattcaatggagaaaataccatgttctgatccatgatcaaagtccatttcaacaatcaagaaataaccagtgacctgacataactgactttttcccaatcaagaaagatcatttcttgttcatattgaagacttaaagatgtaatatgcagatgcaaaaggagaagcccataggaatggcccacattatctacaaattcgtgatttctttatcgtctagaagtgaaacaatatgtcaatatacataaacaatacgctcacttgtgagcacccacagaactcagatatgttaaccagtaaatgttacagaagaaagaaatcttacttagaaacagtccatgctctaaccagtgacaattgactttagtcactcttaccattttgttatgagctatgctctggccacgcattctccacaaaggtaagaagtcaaatattctcagtgcaaaatttgtttatgatgcagtttcaacaattaacggcaatacatatgcagaaacaggatgttgcgtaggtatgaatgtgcgaagagggaactacacctggaatccatgattagacttaaccaaattgaaaaatgagtgacatgcacagttgcacacacaacaatcagaagcatttccttcaagtatcagctgcaaagaacatagaaaaatgaaaatatatcaaaatgaactgcaaattgagaactctacattatttatacttaatggtcaacatgtttgcaataatctaaagcatgcagttcagagaacatagattcatatatcatcccaaagagcaattggaaagcagtagtcaggttcataacctcattcatgatcagaccaggtgcaatataagcaatcactcgactgaatatagagaaatcgtaacatggttcaattaatgccccagttgcataatctatcggcatggagcatggtcaaaaggaaataatgaactgctaaatactgaaatggcaggataactggactcccctttgacatgaaatcccacaacccctagactccacctttgacgttaaatggaattaccacgtcactctcacaagcactacagtttatccaacagaaggacagagtacatgcacaaatggttcaaagtttaagaagtcaatcattttgtcaagcaactggcaagtatgacagtttgtgatgcacctaattagcatatctgcaccgctcaacagggattagagccatgttggaggctgcaaggcaaggaaatgtgtggcagctaggtggcaatctgcctatggcagtgtggtaacaacctgattgtaggggagaggtacaagttgcatgataggctaggcttgagtcgattgattccatgttgagctgtttgaccaagacccaagtgcacaatagtagatggggcaaagataaagacacaaggggaggagcgtggagcatatggcgctaggacaagcggtggcacagcggcaaacacaggagatatgaagcttatgtggtggtatttaaataaaagatttaatgtcgtcagtagaaaagatgcaagtttttttatgcaatgataggttgtttttgaaaagaactgatgaatttctgagaaaatatggcaggtttctcaaatcttaccgggtggaagagagaaacaatacaaagatattgaggcgaacaagagatactgggaaaaaaaggtgacatggggctggagagcatgggaatcaaacccacagccagaatgatgcatccaaggcctaaccaatagagcaaaattcaccttcttcactatatacatagatacagaaaatatatgaaccaatagagcaaaactccattttatcccgatataacatagacacaaaataaatgggtattcagctacccatcaaaattggtgcaccagccctgcgtgaggccttctttggatataaaaattccacgttaataaacaaaaattgattgtacagggtactaatttagaacaaggatccagttaccatatcagccccctgatcaaaatagtggattacagtgttctaaaaaaacatttacaaggccgcatacaaggaacaggtgccccaaccttgtaccgcttaagccacataagcggccaatccaccgcataagcggccaattatgccgcataagcgctacgaggtgtggtgaccacatgaaaccgcgtaccgcttttaaaagaattgatggattatcaagatgttctggaacatccaacccaaaaatttccttacacgactcagttttgatctgatgtttgcttgttagtatacatataacattactcaataacatttaaatgcccaacaattataaaattccaaaaaggtacatagcctgttacctgtaaatcgtgaaacgatcaagcattcttggggaaaatccatgcaaatttacatctaaataaaatggaaaatgatggcatatgagaataatgaaaattttaaatctatcactaaattccacatccacaaggctagctgtattattttaatttctgcagaagactaatgcttcggaagatcatgtgaagaagctaatttttagagaaaatactatagcatagcaaaagcaccatacctgaatctttgcagccatgccaagcattgaggtcaacaaactgtaggtcttcagtagcaagttgaatgcaccaacacattgctattgatataaatatgtccagaaagcaatgaaataaattaagcatcatataaagtcgtttcccaactcaaagacaaaaggtataattttttatgacaagggaaaccaaacagacaaaaaacattaaccactacaactatagttcttctacatgatttaagaataaacaaaagtaataaacaagaaatagagcaaacagttacaacaaaaggaaacctaatcctccaaatgagatgtgtatccacttgtggaagagcacatgcattttatttgacgtccaaaacaagcatagtaggaataaaagcatgtatttggcaatccagaaccgtcgtcttcagaatacgacaagatgcaaccgcagaacacatgtcctgagcactaaaacccttccaagcaatttccaaataaaaccttttttgttaatctgcatctgaattctggttagattcaaaaataaccagctgacagtaacagccaagtcaatttggttatgtttccaacttccaagctcctctcatgatacaacccaaggctgttccttctgcggcacaaccaaaccatgttcctacttcctagtcaaggtaaacaccaaatggaatcatctactatagcacataaaaagcgcacacggagaataaatcagcagatctaaacattcacaataactcaggcattgtttcatcagaacatcagtaccactcactccagtcctcacccaccacttacagagagctctccatttttctgccctcctctctaagaaaccatctgaatcaccccctcatttgcttgcctgaataaggcatctaaataacctaaatccatgccgccgccgcaaccgccacaaggacaatgaggttaaattattgaggagggggagacctctcctaaataagccggggaaccctaaccctaacacgctccaagctcctaaacctaacagcggcagttctaaattaattattgttctcgtcggcggcggtggtgcccgaggcggaggcagcggatgccatggggggctcgtccgcgttaggcggctgcatgaggagcgcggtgtagtaaggcacatggacgaacgcgcccccatgcccgccggcggcggcggcggcggcgaccgaggaagaaccgatggcgacggcggcggggggcgcctcctccggggtgacgcccgtcccggtggcggcgatgatggagggctccgcctggcggagtagccactcgatggtctccccgtcggtgcggtggccgagctcgcgggtgagctggaaga

SEQ ID NO: 77318 - DNA, 22483 bp, Oryza sativa
cgagctcggtaccccgcggcctgacccgccagcgcttgaatacactcaaccgatccaacatcctccacttgcgccggcgagagccttcctccactccagcgcctcaccgtacactccaccgtagctcggtcatccttagtcgcacaccgatacacgaaggcgaggtcggagcccctggtgccgccacgagcgagaggcaattcgccgttgcggccgcgctcgtcgcgcaaataccggaacgcaagtggtccctttcctaccgccgcaagcgaggagttgcgtcgctacatgcacccccaaggtcttcctccaccgatctgtcctgtaactacaacgattggctacaactcttgttcatcgcaatcccttttcttgttccttctagctttacaaattttgagggagattgaaggcgacctgtccgggttcaggttctgcttggcgcatatgttctgcatgaatacaatacgcagaacaaactcatgattggttcctcggccttgctaggaacatgcaaatgctgatgtgatgttttggttgctcagatccatcagtgggatttcatcaacgacaaacattgatagtggttctgacaaatattcatgtatagtggttcgatctacattaggtagtactctggatcaattgaatgctcaaaaaaatattttaatcaacatttgtgatctgaatgtaataaagtttatcacgactcacctttgcagctcggcccggtaatgcaggaagctttacatcaccatcgcttgcagtgacaagtaaataatacacatcatgttcgcttcttttgcaaagctattatgccgctgccagttaattgctaattgtatatctctgaaattaatttatacagatcgatggtatgtaacagcttttaagcttgtgatttcttcactatatatcatgtactgtttgagttaactaattctaatttactggcaaacaccgtagggaataccactaatttaagtgctctcgagttaaagaagatagcaagctcggatgaggtacgctttgctcaattgtaagcagtagcaagctaaggttcaacagaaccatgagtacaagcagcggaaggatgcatcaatctacaactgccacaggtgatgtaatgctctcaaattttttgcaaaagaaaaaaaaaacctgaagcggtgccacccgtaatgacatttgtgcaccaagtatttcactgcagttttactgcaatattcagggtttgcattctagaaattggggttttttccgtggggggagggggcgaaagaaccaaaatcactgaatttatttgaaaaattgatgaattttgaatgatttagaataagctttgaccaaattcacaaaaacatgaaaaaaggagaaatttcgggtgagatatatgcttgccggtggagagggggcaaaattttgaaaattttgttccgaaattgcaatcacgggcaagatttccctaatcgcaatttccccattgcaatgttgagcttgcttttagctgtcactctagctggtaatcacttaatttcggatttgtttcaacggttggtttgacatgagcctatcaggttgaaatgtcctcaagcttaaatgtaagcgtctctttcagtttgtatgtatgcacatataactccataggtcaagagagttttattctagcagacttaaatataagtgaatatcccctttgtatataccaatgatcaattttggagctcaggacaatggaactatggcttcatttccttaaaaagtgcatcagttgaatccagtgtatattctacaagttataagcatggattttgatgtttctcctctgataatttgcattgtttttgggaagtttgaatatttgctttgtgctgatgacttctaattactaatgatgtaattcataaattttatccatcagcatatgcttgcttggacggtttgttatttctttttatttggacatacgtagtttgcttgaaaattttgatgtggctaaaagagcatttggtttcttaggaagatgcctgatgctaatgtcttctcaagcttttggattgtaaggtgcttttcatgtttttaatccagtgctaatatccatgttttaaatccttttcatcaccattgtggatatattatttatttgtagcttcacgaaaaaagtgtggactccaggattaaattaaatcttaaaaagatatacgctattccaatttcagattatgccttttccatgatttgatatgtttccctttttccagtctaatagtggaaccctttccttgtgggaattccatgaaagatattggtctccagattttaagattggtagatcctttcgtggctgccacttcaactgcaggtgtgtgcatagtttagcaatatgaccactttagattaatattgtggtcaaggaaaatatagaggcgttttgacaaatgttagtgtttctggaatgttcacacttgctatctacttttttacttcaattaaggcaactatagacaatattctttttgaaattatatgtgatgaccatttcttacaagtgaaatggatgtaaatttgtgttttgtagatcacgtgaacttctgtggactcacggcaggagctgtatacacctcattggtgatcatgtaaatgctatttttagttgctggccatgagggatatatttgaagtattgttggtgaagatctgagttttttttcctgataagatattgtaggctgtggggtttaattcaataccataaatacaaatatcttgctttgagcttttcaagtgtttatcaagctatgacaaattatatgtttggtattgttagttgctttgcatttttttattgtttaaaggagtatgttaagttacattatagtacatatagttcttaaactttttagtatgttgtatattttgcctgacatatattacaggaaaatgcaagaaatttgaagtgtttttatatgattactatagttaatataggaaacgtgcattgcacgtgcacgattactagtgttagtataggtccccacatgttcaatgtgaaaactctgcgaaattttatagacccaactgcaattaatcaatgaaccgaggtcaatacgagtcatatcgtgctgatatcagcggtgttaacgggatagaaaacacgatcgaagatgattatgttcgtctgcctgatgaaattgtcattggttatgtaaacattgaagattcagtgaacgcactgattgaatatgtgaatatgtgtttccctcacttaatgatgagagatatacgacctccgcggaatatatgagcacacgggccattctctcaacagaaaatgatttcgtggataagctgaacaggaagatgatcgacaggtttcctggcgaggaaaagatttaccatagctttgattatgtcgatgatgattcccaaaataactaccctttggactttcttaacacgataactccaaatggcctccctccacatgagctgaaagttaaggttaactgccatgctattctcctccgcaaccttgatcctaacaatggattatgcaatggaacaagattaatgatcagggcattccaagacaatgcaattgatgctgaaatcgttggtggacatcatgcacgaaaaagggtgttcataccaaggatccctctatctccttcagatgatatttgctttctttcaagtttaagagaaagcaatttccaatacatctaagtttcgcaatgacaattaataaatcacaaggacaaaccatcccgaatgtcggtatctatcttccagagcctgtattctcgcatgggcaactttatgttgcattatcaagaggggtgtcgagaaaaacgacaaggattttggcaaagcctaaaaaagaagtgcaccccaaggaaggtgcacaagtcactatgatgttatatctttttcaatttgagttatcaaatgtcaccccatagcattagcatgggcatgtaatagaaaaataattataatatgaaaatgcactatattatataaaaaaaatatcacccactagtgatgcattataatgacgcagatatatacacacaagcacaccacatacagaaatgacgcttgtgagatgaataaatagatatcaacgccattgtaaattattttgcgtgtcacggatatatgcattatatatcatactattatgcattatgacttaagacacatatatgcgcattatcatatatctttaatataatattattatgcattatgacatggggcacagatatatgcattatatatctgcatcaattggtatatcatattattatactttatgttaaatatattttatgtacgaagtaaattgaattaaagctcaaatgtatagttcatatagtaatatcttttttgctaacatgaaaattttaaaaattattaaagacaaatagagttacaccgtaagcacgggcatattatagtcttctctgggcgactgggcgagcacggctgcggagaggcggcgtcggcgggcaagagcggtgcggcgtcggcggaagagagcggcggcggcggtgggcaaacgcggttgcggatggggagaggcggcgccgacgactctgcgccgctcggccttgtcgtcatcggcggctccgggcacggacctcatcgtcggcgttggcggcgggggtggcctctccggcggcggcagtggcggggaggggatggctcctccggctgcgacggcgcgggagaggccggcggtgagggcgcggagagggaggaggcggagaggccggcggcgagggcgtatgaggaggaaggcgccgtccgcggtttgctgctgctttcccttcaacgtcgtcgagctcgtcgtcctcgcggccgtccgcgttcccgccacactctgccgctacgccgtccgaggtggacgccgccgctgcgtccgctccgcgaagcggaaggccgccaaggccaggaaggtagaggccgagttcccgggcacgcccatggccgaacacctcgggtaggaggaggcggcacggcggaagtcgggactgcaggcggcgctgcaccgggtggcacgcttgctctctggcgccggggaagacacccccccccgggcgccgaccaccgcgtgctactctccgtcctcgcttgcccgctctcccccgtccccatcctccccccgccatgtatgttcttgatcatgttctctgcttcgtcttcgtcgtctatgcgaagcttggtttggtttgcttatggttggttggttgttgatggtgcgtgcaggtggcgtcgtcggcgcagtacatcgtgatgtggcagctggcgcccagcatgtggatcgtcgattattttgccgattattccattgtgccgattattttgttattttggtgctcgtcgtcgggatgccgattatctccattcctgatggcgccgtcgttcttggcgaggcccagcgggaggctcgtcgtgctccggccgggaagttgcctacgaaggagacggcgactagcagcagcaccagccattggcctcgtcgccggcgacaacctcaccgtcccgctccgctgcgcctgcccctcgctgccacagttcgccgtggtggtggccgcggcgctcgacgctcgtcacgacatggcctgcacaagaggagagaagtgagagagagagaaaaggagagagacgacgtggacacctgacacgtggggcccacgtgagtcccacgctgactcagccgccacgtagactaaaaccgaggtcaaaaccaccggaggatcctgggtgaccggttttgtatagttaagagatccaacatatatggttctgcggttcgaggatgattttgtatcccaatgacaagttgagagatcttcggtgcagtttttcctacttgttttaatatagcaagagtttattttgcctctctcacttataagctgagtcacctagtctgattcttgtccaccggatacagagactttctcagtggtttattacgaggtggttttggttgatgtagtgtctacgcggtacgttgatttggtatccatctaacgtgatatctacattgcatacgtacacgatatgctcaatgggcgtggatgtgggtctaatttttcgcccattgacacgtagccgagttttatatttgctggtggataacgcatacctgatctggtatatgtcatatgtgtatagctgtttttcccccaatctatcgtacctcttcctcattggcccatttaattagacattgttggcaacttttttgacaagttgataagcacgatcgtagcacctaatgccttgcatgatcctagagtcgccaaccacctcaatctagcaaaagctaaaccaagatgggttttgataactaaaccggctagtggagccgattctagataactacccgtctcgtgggcaaaacgaaaggttttcaggacaaacatacgaagaggtgtcgcactctcgcaacggcggcggacgatttacggcgcaaatcgacaaagatggataaactaagagaaaactaaaatcaatatgaaaaacgattcgattgattgattgtagattggatagttacaattgaaccggtcatgtcccttatataggggttggtcttgtcctctacaggccctcctccatgtccaactcaggatagaatccaaaggaaacttgaaatatgccttcccgagcaaggaaacccgagatccgacgaaaacagacccggactcagattctgcctgtctgaccggccacacaccgccggtctgactggccctcactcggcggtctgaccggccaacactcccaatcagaggaaaccagcagacttccaaactttgacaattttccctattttatctctaggtgtcaaatttgggtgtaaacagacatcgatgttgatccttggatgcttgaaaattaaagtgataactaaactagcttgttaattgtgttgctctttttgattgtactatatgaaacccagtgtgttacagaatgtaagattgtaagatggatttggttttgtagctaaaaaacgtagctatactagatgaaaccatgtgtattcatacgataatattgtggaataatgatggaagtagaatgtaagataattttggctttgtatagttatttgcatctttgaacaatcatttaaaaaactataaataattgagatgtgtgctctataacaatttagatcaaacatatattgatcatctaaaggcaaaactaaggtgatataatttaagtgaggtaaaaaggagacaaatcggatcataaattattgagtgaattgctctttggactagtaatttttatccaagtttcggtttggattaggtggttttacaaaagattcaaactggactagttttcttctccatctctcctcttcctactggttttttcttcattgagatggtgccatggatcaacccgtgcaagaacataactaggatttcttctctcagatctgttcctaagctcgaactcacaaaatcaagtcaaaaggcagctcactactgtagttattgcctgtgagctcacaatcaagtgatttttctcagctcacatgactttggtgggagaaaaggagccaaaaaaataaaatcaaggtgttggatggtcaagatagagtgtttgactggtgtgtttacttgctggtgagctaatgaaatcaaggagtgagtggcagcaaagtaggttaaaggcaaggaacacaattacacaaaggatggtccaatgtaaaaactttgacaataataaatctaaagtatagctacgtttagttatcactttgacaataatagatttttgtccaaagtaaaaacttcaaacatattataattcaaagtgaaactttgacaataataaatcacctaaagtattattcactctaaattattctttatcgaaatagctagcaagaaaagaaaatataattgactaaaattattagggatgtactatacataattatacgatacttatattattaaaacccattaggttgcccataaggggggtcgtcaggcatggtcatgttattggtttttgagtgcttagcctagcaccctattaatctgcttgtggaagggccaatattttggggaatggtccaagggagcattcgttctggtgacatagggtgagaaaggacatcgtattccgcgcgcacgcttcccaaactaaacagtacgttttttgcaaaaaaatttctataggaaagttgttttaaaaaatcatattaatctatttttaaaatttaaaatagttaatacgtaattaattatatgctaatggctcacctcgttttgcttatcttactaatcttcttattctcctcctcctcaaactcaccctaaggtcaaactcaccctaaggatgctatgtgtgggttggatacaccctgctctgctgtagccttgaagtggtgtgttgcaaataaatgtaagcagcgagcaaacatttatactccactctctatagggctattgtctccatatattcctagatagtacgcatgttgccacagaatgttagcgtgtaacgtgcagtataaaattacatgagaaacaactattcttgtaggtagagaaactatggtaatctgaactgttaaaatgccatcatgtcaaaaataataagttatgatgtaatttctagtgatggattctaaagtaatagttcaaatgcgttgttctttttagattacttcagattatatgttttctaaaaagttttttttcaactatattgcttattataccactacttttaatctatttaaagttttttcaaagaatatttagtttatccttacaatcaattgggaagatagtatgtgacaataattattacctgattatatttctatacgatttggaaaacatatctttaagctattttaagttattttaaaaaatatttaatttatccctataatcaagtagataatctgagccaacaattgaaattatcgattgggattatacaaaagataaagtctaggtgcacctaaactcttaccaacaccacatattatattgtgagtacatgtagatttttatatatttaaattaaacggttgagattattgttcggaagagttttataaagaaaaactttgtttgtacgtgtaccagtgcttttgatagatagattatgacatgccggttgaattttattgggtacatgagtccatccaacaaagggcggtgcctctccatgacgcgcgcacaccgtccagtgtgcgtgcgtgtccagtgtgggtgcgtgtctgcctgcgtgcaagttgctccgtagctgtgaagccccgaagcccctccgcggccggcgggagttagagatcgcgtgcagtgatggggatctgtgctttggactttgggaggctggccatgggccaagcacaagatgccaatcgaaacgcaaaaccgaaccataccgaccaccacccagtgataatgcgccattgtttcttttctttttttccccctcacaaacactgtgagaatttactatttgtcactgtactaaaataccggtgctcaaatatcactcttccaaatattcattcccaaataccactcgagtctttatgtcagcctcacttttatttgaatgtaaagtaaggctgacatgtggccctaggtgatatttgagaataaaaatctgagagaatggtatttgagcactactcccttcgtcccataatataaaagattttaagttttgtttgtactgtttgaccactcatcttattcaaaaaatttgtgcaaatgtagaatacgaaaagttgtacttaaagtactttgataataaagtaagtaacaaaaaataaataataattttaaaaatttttgaataagacgaatggtcaaacagtgcaaacaaaaacttaaaatctcttatattatggaacggagggagtagcattttggtagagtgacaaatagtaaattctccccacaaacacgggatgttgggtactactacatccgtcccaaaatacttgtcgctttgatttttttttaacttttgatcattcgtcttatttaaaaaattaaaaaaatattatttattttgtttgtgatttgctctattatcaaaaacactttaagtatgacttatcaatttttatatttggaccaattgttcaaataaaacgaatggtcaaacatcgtaagaaaaaagtcaaagtgaccattattttgggacggatgtagtagttaattgatggatttggttattggcaatgcgatctaaattcttatactcccttcctcttgtcattaatatatacttccttcattttaaaataaactagttcctggttacgaatctggatgtagacaaatttggacatagcctacatttaaattcgtagctaggaatttatttattttgagacaatatggtgtatagtgttctaagactattttacgaaacattttaaaactttaacaactaaaaatgtgtcctaatataacctagtatatactttaacaactaaggtcatgggcccacgtggccacagtgccacactccgcacgcaacaactcaacaagggttgtgtttagttcacactaaaattggaagtttcgttgaaattggaacgatgtgatggaaaagttggtagtttttgtgtgtagaaaagttttgatgtgatggaaaagttggaagtttgaagaattattttggaactaaacacggcgaagaagcatcaccatttttgaaacaaaagaaccatcaccatttactatttattttggggatggctaaataactgggtatagatttttagatcaaaatcatgcaaattacttacctttgaaattgctttgtgattcttgttctaactatcctagaaaatctcatacagctccgacgataccttttctaacttcggggacctctatgaaagtaatggagttaaggtttagggtctcggaattggggtaggggtgggacagggtagggagagggatgggggaggaggctgccagtttggggaaagagaagaggaagggagaggagcccgtttggagggcctcaacggcaccgttgagcccttccggccagccagcgagtccggactgcgatggtggaggcggtgcagattgggtgctagtgagcgtagggagcgcgagggggcatcaggagattgagaagaaggacaagggttttattgtttggttgttcattataaaatttaagcaatctgaaggtttataatttgcacaatttctatagggtttcagttaaatggtgtcccatttatatttacttcattgaagtttcgggcaatataaatgatctacaataaccatatttattattattattattattattttcttaaactatatattttacaaagaaataaaaatatagtacggagtaatatacaatagagtatttcggtcacactcacaaatcttctactaatactctccctgtcccatagtgcaaagcgcacacatgttctagattgaagtgttaaaacattgatttgatgttctatagttatagggtgatttgttttctataaacaatatataatttaataaatcataagctcgatattagttttggagtctacatgacgttttatgtttggcaacgccttaattaatgcgacatatgaaatatatttttttctaaaaaaaattaaatcctgatattttttataataaatcaataatttaagacctttatatttgactgtacaaatcaagaacatcatttcttttttcttgagatcgtattttctatagatcgaagttactccctccgtttcacaatgtaagtcattctagcatttcatatattcatattaatgttaatgaatctagacatatatttctatttaaattcattaatatcaatataaatatgagaaatgttagaataacttatattgtgaaacggagaaagtagcattattgattaattgatttatttctttctgctttacccggtcgccagaacagaacgggacgcgagagtacaccgaaagaaaccaactcgtgtccatccatccgtctcggtcgctcctctagcccaggcttcgcttccgtctcgcccaaatcggcgcaccaccaccgccccgccgtccacgaatcgaactgaccggagagatctcgcgatcccctccccaccccttcctgcgccggtggcgaccatgtccacggcggcgcggcgcggccacccgccgccgcacgagaacggcgtgggcgggcacgccgacgacgagccagacgaggacggcgaggaggaggaggagaaggggaagggggaggtgcaggatgatgagaaggaggagccgcggctcaagtaccagcggctgggcgggagcgtccccgcgatcgtctccaccgacgccgccgcggccatcgccgtcgccgaccgcatggtcgcgctcggcacgcacaacggcaccctccacatcctcgacttccagggtaatcaggtatcgtacccacctctttcccttcacgcatagctcgtagggcggtcgcttgctttgtgggattgggatttctggtaggataccgtggaattggatcgtctcgtctctgcgacctgtagcattggtctactgaattcgatttggttgtagaaaactgttaacctattgtttgtggaagagacgtcacaaaggtgaaattctgtttggggacacctgaaatatagattttgcagagaatatatattttaaggattgtgctagactgaggaatatggttcagtgtaaaatgttttcacgttgttggaggggattacctctggtgacctaaaaaatctaggaggactaggattgtctgctaaatatcggatataaccaagctgaggtggctgtgcatttaacaacattgacacagaaatttcaataaatggagattgcccatagcttccttcggcctgaaatcatgtgatggagcactatcagtaatgaccatggcctgcttagaaaataacattgtcatccattaattcaatacttttgcaggtaaaggaaattgctgctcacacagcaactatcaacgacatcagttttgatgcagacggtgaatatataggaagctgctctgatgatgggactgtagtaataagcagcctcttcactgatgaaaaactgaagtttgagtaccatcgacccatgaaagcaattgccttagaccctaattattacaacaactatagaaggttcgctacagggggtttagcaggtcaagtacttgtgctgacaaaaaagtcgtggggaggtggctaccataaaaaggtgcacttcttctcattgtcctacaagaaaatcaaattgatctggtgatttcaaatggttgtgtgagtctccttacatacaggttctgcgtgatggcgaaggaccaatccattctatgaaatggaggacagacctccttgcctgggctaacgatgcaggggtaaaagtgcatgatatgaagacagacaaaggaatcgcgtttatagagaggccaaaagggaattcctcggccagagtttttacttcctcagttggtctggcaggtaatacacatttatttatgcgaacactatacttttttataccaagtatggctcatttggaacatttcaatttggtcgacattaaaaatatgcacagttagggatcattttttttttcctttcagcaaatagttagtagaatacaaaggatattacagaaaagaaacatcatttcattctggcaaacatataccaaaagaatatatggtgcagcaggaaaaagtttcttgtacattgaaagctttaggattgattttttttcttccaatctagtttagtcagatataaggaactaatggttttaaacctaaaggaaaaggtatacgatagacatgttttcattgttagtcattcctgggagcattatatgtgttttatttgctgagaagtaagtttatagtcactttgctgttaatatatctgattcttttgggttctcattttcaatgaaattgtacatggcatactgactggtttgcatattcaggatgataccatcttagttattggatggggaacaagtgtcaagattgcagcaattcgaacagattcatctcaaggactcaatggcatacagaggagtatcactgcaagtaatgagaagtacgtggatattgtgggttcgttccaaacaggctatcacatatccgggattgctccatttggtgatcttttagttgtgcttgcatatattccagaggaggaagacagagaaaacagttttagcaattctgttccttcacgtcaggtaatcatgatggcttgtcctttgcactgcactctgtaaatctatttttctcctttattgtgtcatgacccgaggtcatgacaggataaacaccgccgggaagatagccgggcggcgtcatctcctggagaagggatgtagatttaggctagggagaagaacattattgggagagagagattagactaactgatattcattgcttaacttgagatgaatacaatccatcccttatatagagatgatatgacttgacccttaagaaactaactcaaactaactctatctaatcctatcctatctcctaaccaactgctacagtactcgtggtactgtttatccgctaggacttggcctcgtgggcctcggcctctctgcccaacgcctatgacatattgtgcaccagattccttttcttatgaagtgatgctgttcccacatttacctttttcgttatgtttaaacactttgtagggaactgcccagcgtccagaaatacatcttgtatcatggaaaaatgatgaacttaccacagatgctcttcctattcatggttatgagcattataaggcaaaggattatgctcttgctcatgctcctttctcaggtttaatgaaatgtgctttaacagtgaatgaacttctcttttcttcttcactgaaacttttctaatgaaggaattttattgttatatttttaccacccaggaagcagcaatgcaggtggacagtgggctgctggtgatgaacctttatattacattgtatctcctaaagatatagtggtcgcaaagccaaggtttgtaatgttgcaaaacaaaggattatattagcttctaagttctgcaattgcaaatgaaagaaggcaataattgattgagcaaaacttctctttttgaaaatgtgatcttccttcgtcatattttctctgattgtaatcttgaagaactccattagtccttcaattttctgcattatttaattgtgatacacatgtaagcttggctacttgcagtagatcacttcagttgcatatctgattctgtggcatttaattttcttctaactacaagtagcatacgtagaacaatactaagctagtttcttctgataatttccagcctatttgtgtttctgagctttctataaggacatggcaaaatttcatttcagaaaatgttgtatctttatatttctactgatataatatgtgctttcaaattagagatgctgaagaccatatttcttggcttcttcaacatggttggcatgaaaaggcattggctgcagttgaagcaggacaaggacgaaccgagcttcttgatgaggtaaagtagaaacagtttgagtttgaacagtaaatgaataatggtatgcattatctgcttgatgatgaggatgctacccttattgtttaggaaccttcaagtagacacctttaaggtccattatggcaactgaggtccccatccccttctatagttttgttggcgattatcacgttcacaatattgagcattttagctgaaaacaatgggacctgtatcatgtaccaataggtgtttatatttaagctggctcgtctttagactattgttgtcatgagttaaggtggtcctaacaatgtgaacaacaaatacattctgaaattctatgcatattttagaagtttgcttcctatcttatatatattatgctggtctgatgcatattttagaagttgacagcacttcaacaacataacccagtcagtatcttatgagcccatttttttaggaaggacgacctcagctattaagaaatctaaccacataatagctaggaacattattgaaattttgttcatgccatcttatgtcaggtgggttcgagataccttgatcatttgataattgaaagaaaatatgctgaagctgcacgcctctgtccaaaattgttgcgaggatctccttcagcatgggagaggtgagaaaaaaagaagtgttgatatacattgtatccttcatcatacgatctggaacaaacacaggagcattatgagattttgatgtgcattgtttgttttagttgatcactagtatatctactgaccataactttttttgtgccacaggtgggtctttcactttgcccatcttcgccaacttgctgtattagttccttacatacctacagagaatcctcagctgagtgatacagcttacgaggtgccattacttctttctattttgcttgcttgctctttacaacacctctgattctaatactaattctaattggtttatgtaggttgctcttgtagctttaactaccaatccttcttttcatgaacttctcttgacaactgtaaaaaaatggccacctacattatactccgcttcacctgtcatatctgcaattgagccacagctaaattcctcttcaatgactgattcattaaaagaggtatggaaacattttcttaatggatgtaagacttacacagtatttttgagctctttgacatcttggttctgtttgccatgtaggctttagctgaattgtatgtcatcaacagtcaatatgacaaggccctttctctgtatgctgaagtaagtattacctaacttgtagttaaaaggttcacattgcattaaattaatagaattttgttttattacctgtattgttgacccaacctcatttcattcagctcttgaagccagaagtattcgaatttattgagaagcacaacttgcatgatgccattcatgacaaggtatggttaaaattcccaaatgtaggataaaactgatctcacttgactttttttttcaagtttgcatttgtgaattgtcaagtgtcatggtagcaattgtctaataatggtacttacatatggttacaatgtagttgaacatgataatatattttagacagagacaggcttcaataacctccatatattcacttatgggccttgcgtatttcgcaggttgtcaatcttatgatattggatagtaaaagaactgtaaacctattgatccagcatcgtgatacgatccccccgaatgaagttgtaggacagttgttgcatgctagtaaaagttgtgacaaaagacatttgttgcatctgtatttacatgctctgtttgagacagacatgaatgctggaaaagactatcatgacatgcaggtatgctgattcttctgtgaacaagcagtctttatcatactgttcacctcctgcccatttgccctatttctgtagctctagtttttgtattagtataacagctaaccacattacactttgtgttgtaggtggagctttatgcagagtatgagccaaggatgctaatacccttcctccgtaccagtcagcattacaggcttgacaaggtcataaactcataattctcaaaagagaaaaaaaaagcattcattatcttgagaaggatgagtaatgaatgacatgtggttatttcaggcatatgaaatctttgcacaaaaagagcttgtacgggagcaagtttttgtgcttggtcgtatgggaaatgcaaaggaagctctctctacaattataaacaaattggaagatattcaggaggtcctaatgtggttatgatcattttgttaaaaatttggggctagactagcaattctagactgtggttggattgcaataacagtaaccttggatgcaggccgttgaatttgtgatggagcaacacgatgatgagttatgggaggaattgataagacagtgcctccaaaaacctgagatggtaattgagctgtgtattctgttcaatactcttgacactgatgttccttctgtttattcattgcatttttgtaaccgttgagcaggttggaatgctgttggaacatactgttggcaatcttgatcctttgtacattgttagtttggttcctgatgggctagaaataccaaggtaaatgtgccaaaatttgtttcgttcaaagataatgagaacctacccccaaaaaaaaaaacatcacatatacaccttacgaaacgaatttctatcatcagatgatcagaaattcagaatccaccaattacttatatacaaattattagctatgaccatcactcagtttattataataattatagggctatattgacactgtagaatagagatgctacaactttatttaatccaatccttctcttccctggttcaagtgttcattgaaatattacgcttttgataggttgcgggatcgccttgtgaaaattgtgacagactatcgaacagaaacttcattaagacatgggtgcaatgatatacttaaggttaatattcaagaaaaagatatacttaaggttagttgtctatttattaccccacatctatcttgacgtttgatgaccctgccatgtacaggctgattgcgtaaaccttttggtaaaatattatcacgaggctcggcgtggagtctacatggctagtatggacgaggaggtgacaggaactagggttgctgaaggatcttcacgagcaaacgagagatcatcaagtttacgagctttagagatcaaatccagaacaaggtgtggtgctcggtgttgcttgtgctttgatcctttgtcgattcaggacatctctgtcatcgtgttctactgctgccacgcatatcacacgtcttgcctcgaaggcgggttggacttgatgaaatcgaacagtagtactcaggacagcgacgaggatgatgaaggtaccccatcaggcgagtctcgaatgcgctgtgtattgtgtactacagctgctgcataataacttatttcgtaacgagtagtccatatccatgtgttgtgttgtaagtttgagccttgtaattagcgtgttattctggcgtgataaatatgtacaataggttaattctttggggggaagccatatcctcagcaagaggagttttgtgtagatttgacagatatgttgattacttgagcaaagttgtacggcatttttcttaatgccacgagtgccagaccatcggaagttcattccgattcttatccatgttctttgtttgccacgagtgcacgtgtaactatgtaaggaataattgtacctggtgctacaaagattaattgtttaaagttgcgttgtactcggttctattttgaaaaaaaaaggacattcaagtaataaacctcttaaatcgcaaattcgctagtaaggtcccttgaggtggaacctacctatccgttaggccggtggaacctacctatctgttgggctattgggctgtgttcttttcggtgagttttgctaaatggtggtttttttttaaaaaaatatatacgaaagttgttttacaaaaatcatactaacccttattaaaaaatttaagtacttaaattaattaattataagaaaatatgctgttccaatttacatgcatggaaggtgagtttccaacctcaactctcgaatacagccgattcaacgtccatccgtgttaagtctcagaaatattaaggccattaatctttggatgtggttatagagatagggttcagaaaaaagtaaacctcctaaatcacatgaaagtaacttgtcgagccatgggagctgtaagctgaacaaccaattctgatttgcgttgattccttttcgcgatctattgcaattttctacatttctctgatctcaaactactatagtgaaaataaaaaaaaaatccttcatatatttacacatgaatacatgattaacgcgggaactgctatacaacgggatctcatccaaacgggatgataccaagcaagtagccgatttcgatacctattggtgttggattttataccttatacgtatattaactaatacctcatcggtaccaaccgatacccgtatggtctctgcctgaccacttaaattattatctcctgtgactcctttgtatgagtttgatacattatcttcctcatttcatcttgattctggatatgatatgatagttcctactaaccgttcgaatgaaggaatttcagataaactaattcatttccggctttcggcaagaatttggaaaaaatatggcgtaccaatggaggccattgtaatatatttccaccgtcttcaaaattttgcatagctagaagaaatttcagctggctactagactattctcgatttgttatgatgacgctaaaaactggcttaactgcttcaacgcaccagaagaagtgaaaaaaatatattcaaaacttctaaagcaaatattttctcgtattagcactgttgtgaattgcgagtgcccgatctaacatttgctaacagtaacactatagagcctgttctggttcaacctacttacccctaattttatttttctaacagctttcagctgttttccaaatgtattgttgatttcatccacaaatatattttgtcactaattttaagaggtgcatttttgtggttgagacaatgtcagcattttgcaatcatcaaacacaatgaagtacggtgtacttaaagctctcttagtttgttctacaaatttgaatgttctcttcataagttctgcacgctcaacaaaatacgaaatgaattctgaagagaaaaggagcatatatagtagcccatgagcacagttttggtcctagcatgtgaatgaaaattatttgaacatagaatcaatcgacaacttaacagcatgtcaacattatgctcaagcttcttatatatttcaaattcaaaaggataacccatggttccctctattaaaccatggaaactatatgtctacatccaatcaactagttttcaaggcaggaactaaggcagcaggatatacattcgagttaattactagaagataaattcattgtagaatcagaaaatttagaccaatcaggctaagatgcggcacaccattacacccagaagatctacagctccagtcaccacataagacaatcattctttggtccgattaaaaattaccattgccaaatatctgcaaaatataaccccctactcaaactcctcaagtccttgtccccttctacactctgcaaaatagaccattgtataagacatggcaagcttcctaaaaatatttgttcagaaaaacaatctactactacttgcagataggaattggtttaaatagcctacatacttgcaggggtaagcaaaacaatgacggagcagcaccagcgtatgctacagaccacagaaaaactgtggctgtcccacatgagcaccaccatgcctcccgaagaacgcatggttgacaaggctttctttcaaacaatgcctcatagcacatggaagcatgttatccaaatggattttctcccgcaaattccccttggtgtcacacagaaacaagaacacagagctctgaatgtagaccagaatttccccacgatgacatacgattttccatgaaaagaaaccttcccttgcaatgctcctcattctcgccacgggcaatttaacgtggtacctcaacgaccagacctccgtctcatagtcctgaagaacccagagtttggccataccttgagtcacaatgccaatgccaagcataccaccatcaatctcaaccaaatgtgcaccataaccatcaacatttggagaaaccatccacctgaaggactcagccaccgtgtcgaaaacgagtattgcgtcttccggtttacggaggtgccagtgcaggcagccatggagcaacacgggtgggagaaagccgatctcatcaatccagaacacgggtgggagaaatgcctcaggtaatccaatgcgccgcggcttctccgacgagccgaccgcgaggatgcagacggcatcgggatacttccatttgaggacgcggtactcgccgtcgccggaagatgggtgcgggtacagggtgacctggctgccgccgccggtgagggctgggactggcgtcacctggcgcgtggccgggttgcagatgtagaaggcgcggccggagacgaagaggaggagcccgtcgcaggaggagtggatcttgaagctctggtgttggcggtagtcgctgaagccgaggacgcggcggcgctcggcggggtgccggatgaggtcgacggaatccacggcggcgtcggcgtcggcgggggcgccgctccttcacctcgcgcagccgaagacgagcgggcgcggcggctggtggcggtggtgggcgaggagga

SEQ ID NO: 77319 - DNA, 7742 bp, Oryza sativa
cctgcagcccgtccccaacttctagaaacaaacacatagtggtgttcccatgcatgtttcttcactcgtcgcatcttttgaagaccgaaaaatcaacagcgacccgaatgatgtaggaatgccaccaaggcaccaacgctaacattgaacactagatgttcctgccagttgctgaagttccacagaatctcactatgcaatcctggctgtgtgcggcacccttttttttcaacctttctatctcgtttttcacacgcacgcttttcaaactgctagacaatgtgttttcttaaaaagtttctacacgaaagttaccaaaaaaaatcaaattaatctattttttttaaaaaaatagctaatatttaataaattacgcgctaatgaaccgctccgttttaggtgcggagggaatgagttatcatccgggacatgcgaacgcagctggtgggtgatacgagcacagttggtgagagatattggctggtggcattccggactgtgaatctgtgatggcatcccgatggagtttcccaggcaacctttgcatacggacataggcgaataagaataagattagagataggactatctccctattcttactgctttctcttttttttttctccgctctttccttctaccaatgatgatctagcgagatagggattcaagtcctccaatacccacgctagatctgcacctgcatacggagccttggcgggagcagatgagagaggtggtggctgcggaggcagctgcagatgcattttgtggtaagagatcgaattatgaattctgccttgtcatgcattattttcctaagctatatatgtcattaattacgatccttcggagtttttttttcttgaacgatccttgtgggagtcggaagtgtatatacgcacgcacttaattgcatggtcaatttatttacgtcccggattaatttgtcaagcaagcttttgtatattcttattatatttaacagtttactcagacgaaacacaggatacatattttcacaaccaccacgtgcatagtccatataagtggcagagccccgaacatgaaggactctcgcttattccgacacaaagcctaagctcccacggcatccgtacgtcttgatatcgataagtgccacagtccccctcaaggcctcaagggtcaaggcagcgtgtaatctgtgaaaattaaaataagttaattgctctaaatattgaaaaaatgctaaccatcgattaattttgtatgaagaagactagaagagtatatacttgcattagaaaagccactagatgaagataaatcagtgcacataaaacgagaaagtaattaactataattaattgagttttaattatttaaatttaaaatatagatctatttgatattttaaacgaaacacatcatttaacatcatttaacagtttgaaatccgaaatcatactaacgaaaaccgagaaaaaataatctactccctcagtaaaaaaaaccaacctaattggggatttgttacaacttacaacatggcctattatgtcaaattggccatgtattggccatgttgtgtcaaaaccccaactaggttgggtttttttgatggtgggagtacatctttaaggctaagttattttattagtgctcaactcaaatgtccttttttttttcgtgcacgcttttcaaacttttaaattgtatatttttaaaaaaaatattctatacgaaaattgctttaaaaattcatactaatatatttttttaaaaaaatagctaatacaatttaattaatcatgcgacgatgaatcgttctgttatacgtccgtgagggataagttcccaggcaacaccagtctttacctccgcacttgtagccgacggggcggtcggccatgttgcagcgcttggggatggtgatggcgacctccggcttgatcccggcgaccctggccgtgttggacagcatcacggcgcacaggcagctggggctctgcccgatggtgtgcaccgccgagcagcagctgctcgacggcgccgactgcgggtcgtccgccgccgacacgcacggcgccagccgcagcgccacccggtcggcggacgccctcccgcactcgccggcgccctccgccgccccgccgccggcgaccaccaccaccaccgccaccgccacgaggatcaccaacctgcccgccctcattgtgtcaactagctagctaccgttctcttgctttgcttttgctcggatgatcacaacttaatttgtgtgtatgatcagtttagttttgctgctgtgcttactcgtatacaagggtgtggtgcttgttatatactagtgtccagggttcacgatcctgataccgggtcaaaattcgcaaatttcatggaatccgttgataaatcaaaaaccgataaagtcctaataatttctgtcgggaatttaaaattttgttttcttgaattcaattaaaaaccgagtcgtttgtgttttcgacctgattggaaagtccggatattgcgaaatccaaattaaattccactgaaattatgaaccctcacaatcccgacccagaatcaaaatccgctcacgagcagtatcatcggatttcacaaaatcagttgataaacagaaaaacaaatctgaataaattttgtcaaaaatttaaattttagtttcaatattttttaatttaagaaagacaaagtggttttttgttgttgacccgatccagagagttcgaatttcacgaaatccgaataggattccactgcaattcttgtgaacactgctagtgccattgtggcgcacagcacgcacctcaatcatgtcctggggtgaatggggagagcactgacggtgagcacttggcacttggcactcctttgatttctttgcatttgtggcagcatgaatcattagaggtttggtttctccactttggatttatgtaaggaaagcaggcatgaagctagatgtgatagtgggcttctgcctaggaaagcactgtacgtggtggctctacattcatcttgtgtgaacgcgctgcgtgcgcgcgcaacggacgccggccgtcgatttcacattgctcgctcttctctctgtggagcagatgacccacactcatccttataacatattcccaccgacctaaaatataataagtttaaattttatcctaaaatataaaatctagtaattgtaattttttttactatccgtagtaaattttacgatattttaggaaagagaaaacaggtggtgtgaaacatgatacatcgatatcatgcgcgagttgactatccatgtcatttgtcaaacgtatggttagttagttacaaaatactacctaaatccataaaagaatgcccgtatacatatactcctaaaacctataaattttttacatggttttcaatgaaatactttgactactaatttatttatattatgttataacaactatgaaaataaaaatcatatgaaaatattttaaagtatcaatctaattagagtaaatttcactttgggccatgtatatttatcagattgggacattggaccaaggttaaacatatgttttcacttaacatcatatttctttaccatactttataagttggaccagggtttaccacttgggccaccaggacagcttcggcccagcccatgtgaagcgtttgctcgtatggaggcgacgagtctaggtgcacgcatcggctcttggtggggagcagcgaccagtgacgacctccagggctgtgttcagatgccccttttcccgatccctcttcctcgttttccacgcgcacgcttttcaaaatgctaaacggtgtgtttttttaaaaaaagtttctatacgaaagttacttaaaaaaatcaaattaatccatttaaaaaaatcaacaaatacttaattaatcacgcactaatggatcgctctgctttccatgatcactgttccggatgggagctggttctagcgaacaaagccacatcgtgagctcggcacgcagacaccggacgccatggccaagggccagtttagtggacatcgatgccatcacgtatgatggcgtccagagggcacaatctgcggaatagctcgggtcgctgcttggcttcgtggaggcattctatactatatcagtctgttattcggtcttggagagacaaatcaaaacggtgttagagcaactccaatagcctctccaaaagactctccaagctaaattttgtcaattcttacccaaaaaaaaagtgctccaacggcctctctattcaactttccaagctatttggttggtcaaacctttccctcactagcctaatttggccagccaaactcactagccatctgtgggtcccacctattcccccttctctttcctttgcatccacttgtgcgcgctctctctctctctccctttgccgccaatatccctgccaccgtcgcttgccaaatcgacggcgagcagcggcggcggtgctcccgctggcatccatcgctcgcctctgccacccgccggcggtgctcctgttgccgttggcctccaccggctcacgtcagcctcgtccaccgccgtcgcctcatctcctcatcgagcggcgacgacgacgcgtggaagaagcccgcggcaacgaacctccttcctgaattattccctcggaagaagccatatggcctatttggttttgggagggggagttgcattttctattggaagctatattgataaagtcgactgtgatgtagtgccgatgaatgcttgtcacttgttattgggaagaccttggcagtttgatctaaatgcaacacatgagggtatgtccaattgctattcccttatgcataaaggagtaaatcatgtgctgaaaccaatgcaagagagtgttattaaagtggaggtatttccgactatgaagaaaaataaagaagtaagccgaggacggctttgttttaaggaagggaggatgatatgaccaaagcacctgtatcttttgccggtggttcttttcaaatttgtgtgaaacaagatgaagagaagaaaccgacaaggagtgctaccgatcagatgggcatagaagagaagaaattgatgggggtatatacgtgttggttcattgcacgtaccgatcttgtgtcatgctaattttccattagcatgtttatttacttaattaattgcagcataggagatttgtggtgttattaccaagttaattaggactaaacttaattagtctatgtttaattaggttttgggcctttgagcccatgccctttcctggtgcttgcgtgcacacatatatatgtccatgcaataggttacaggggaggttagggtctaatttgttttggttcgtcatcgaggtcgtgtcctccgccgccagggacgatggcgctcccatcgtcgatattctgctgattgttgccgctatcaacgacagtgacacaagtgtgtgattggcagtttttccctgctgagcacgtgctggagccaaggaggtctgcatcttcttctgatcgtgtgctttgccagtgcacgggtagataggtgtggtgttcagtttgcagtctttccaacctctgtaagctgaagaatttaggggctgtttggatacttctgcagctaaagtgtggcataccacaatttagatggctaagaaattcttggccacgaattaggcaaatgttggcaaagatatatgtctataacaagtagggtcacaaaataaaaaagtgtggcatgacaaagatgtggcaagcaaacaaacactaggctaaaagcatgtataaaggtagagtcagatatgagctctatattatttagagactagcatcctacaacagataaaaacaatatggtctctaatcattaatgtatcaaaatactttttcttactctcttttcctttctttcaccaccatataacaaaatttgctctaataaatgctaagagtcgactctgagccgttgtcatgtataacaaccatactattttctctttcttccatgtcatcaaatttacttacattaataaagaccattgtacatgccctaagttggttaaagtagcttaccaaagttatggcaaagtatcgtcaccatccaaacaacccctaatatcgtcgtttgtccagttgactagtcttgattaattttgttgctccatttatcacatcaatatatatatatagccatatatatattattggttgctgattggtaccgtgaaagagaggggaaagtcaaggtgctcgctgcagggtgctcatcacatccgttttcattaataatctaatcttcaactaaactttctatcgatttccaccacctctaccaaacaaggtattgaaattaaaaatcaaattcccaattaccacccctacttaggtattgaaaatgaagggtttccttcctcaattccatcccatggaaattcccaaccaaacaaaacagttaatagctccatctctctaaactcacaatccctcttaaaaaaatccctccaaccaaacaggccgtcatgtaaactcccaatcctctttcctcgagttgccaaacaaactgataaagaaattcaatggttaaatatttgctactccctccgtttcaggttataagatgttttgactttggtcaaagtcaaactacttcaagtctaaccaagtttatagacaaatatagtaatatttatattaccaaattagtttattaaattaataattaaatatatttttataataaatttatcttgggttaaaaatattaccttttttctataaatttggtcagacttgaaacagtttaactgtgaccaaagtcaaaacattttatgacatgaaacggagagaatatatatttaggaggggtttcatgataaggaataagttcactctaggtccctcaatttgtcgtccagtctgattttcgtcctcagtccagaaaaccggatacaaaacatccctcaacttacaaaaccatgcaaacatagtccctcagcagtattgaccctaggttttggatgatgtggcacctacgtggcgtctttgagtagatctgtgtccccacgtggcattgacgtggcgcttacgtggcaaatttgatcccaaaaaattaaaaggagtaaaattgaaaactgaaaaattaaacaaaataaaaaaaatgtgggacccacatgtcagtgggtcccacttaactctacctcaccctcttcccctctcttccaatcttctccaggtggcggcggcaacgcatattcttgtgtggcgaggatgaagacggggagggagcgggggtcgctgagggcccgtcatgcgcggcgtcgtcgtcgaagtgggtgaccgccgggcaaggcggcggcgctgcattttctccgcgcagcaaggatggagacggggaggcagcgggggacgactaggtcggtgggggctcgtcatgcgtggcatcgtcgtcgaaccggatgattgcaggccatggcggcggcggcggcaacgcatattctccgcgcgacgaggagggagcaggggacggtggggtttacgggggcgggagtgagggatgggggcggtcggtcttcctccgcgtagaagcgtggcgcggtttcggcagcggcggcggagcggcgggtcctgttcgccaatgcggcggctccccaaaccctagcccgatcccgacggcggcgatggcgactgcgggagctggaggtaggttggcgccggcgcgcccgtcgactacctccg

SEQ ID NO: 77320 - DNA, 550 bp, Oryza sativa
attcctgcacccctgccaagctgccaccgacgccgggtttgttgtcgaccaccaccggctggccccacttcttgctgaggtcttcgccaatgatgcgagcgaccgtatcggtggaggtgccgggcggaaagcccaccaagatggtcacgggcttttgtggaaagcccgctgccagagcgcccgtgctggtggccacagccagcagcgcggcggcggtgcgttgtttcatggagtctccttgggtggtgatttatttttgattagattattgataatttatctgatggtcatcaggtctactacctatcgcgcacgctatccttgtgtgacgggggagatctcccgctttttttgaaccttgtccttggatgaactgcacgctgacctatgtctgatggcgttgataccccccgaacggcagcccagtgggtggcggcccagcttgaagaagacatcgtcttagggcgccttcacccgcgagagcggctggttgaggacgagttgatggcccgctttgacgccaagcggcatgtggtgcgcgaagcgctgg

SEQ ID NO: 77321 - DNA, 5363 bp, Oryza sativa
gctcgccggccggcgaggccgcgagggagctcgatgaggaaggaaggatagccgggagagagagaaggaggcaccgagccgccgacgcaccgtcgtccgtggatagagaagaaggtgaggcccactcccactattttttctttcgtccgactgacatgtggcccatgtttttattttagttttaatttttttacattttgcttccagtgccactcaacaccacggaggatgatgattaagggtgtgtttgaggaggagattgagtagattgggaagatacgcaaaacgaggtgagccattagcacatgattaattgagtattaactattttaaacttcaaaaatggattaatatgatttttttaaagcaattttcctatagaattttttttgcaaaaatacaccgtttattagttcgggaagcgtgcgcgcggaaaacaaaacaatctttatcccttactcctgcgctcgaacgcagcctaagtcaaaccagccacgtatacgccacgtcacccaaaaccaccatctaaaccgctaagggcaagtggtctctacgttaattagagactatcacgttacaatagttaagacaatacggctctaaccattaatataaaaaaatactttcttactagtcatctttcctttattagactcaatgtagcgaaaaatttcgtaataagtgctcagagtcgactctataccgttgtcatgtgtagcaaccatctttctctttctttcttcctctctcttccacatcaccaaatatgcttgcattacaataaagagagaccgctaataaaaaccaatatacatgccctaagggatcttgtttgcactggttttaatagttgaggtaactgctgtatcttgtttttgggttgaaggacgaaaatcaaattcgtcgaaagttaagggacttcaagtgaacttattccttcatgataacgaggagtacactccacagtccccttaccttacctatataaattattggtgagagagagaagagaaaacacccaccgactccctcgtcgtctccgcgctccgctccggcctcccccgcacaaatcatccgtcccgccgccgaggatgccgccgaaacggggcggtaccatgaagacgatggcggcggcggcggcgggagccacgggcacagcgggagcctctccagtcggcggcggtccagcggggatgcaagtgctgctgcggggaggagggttacccgccttcgatcgagggagctagggctggaggcgacgacgggcgctggggaggatgtcgcgtcggatgatccggggccggctcggaagaaggggaaggtccagccggcgacgaagggagccaagggtaaggccgcacgagcggatccccctaccccgccgccgcgtcctagattgccgccgttccctaaatccggcgatcccatggattttctcaagtgggataaagagttcaggaggatctgcgctcttccaggttaatttatgcttaattaattactacttttctctttagccgatgtcactaggaagaaggaaaacaactgaaattttttgttctgtttgttgcgcgatttcttcagaacctgcaggtactgtcatcccttgcactgtcaggaggaagcctacgggccctcgcaccgtcagcgtcacggacatcgcaagcgtagcagacaatagcatgatccggaaggcttctcgttccgtcgtcggcatttcctccaggatacctggtaaaaagattgctgttaacgatcaatttcaattacaatcccctccaattaacagctgcttctttttttttttttaagataaaggaagcttttattcagatcaagataactacatttcttaccagctgctaattctgcctatgttgctatttcttcctatgttttcagatgggaaggagattatgcaatgcagtggtatcgtggtcgattggaacaagaccagcaggttggcgacaatcgtaacttgctctgcagccgtgtgctttgatggtgcactagtccatcccaaccccaaggtatgcagaaaacaaacctagctggattgattaatggtgacacttggactatgaaagttctctgtaaattccccttcaaatcttaataatatttggtcagcctcttccaagaccatgaaaattaattaacatagggtagatatgtttgcacaatagcactccagaattaacccttgttctttagatagctatgggtcctacgtaaactagttgacaccctgcgtgttgcggtgggcacactataaaattttcaaagtgcataaaattgatgcaaattttggtcatcgaatcagcatatgaaaaaaatagagatttacagtgttgagatagaattcgtgcctaaatgtccgtttttcaattaggaaagcaaccccaattctcatggttcctgacattctagcaataccaggctggtcgatttgctggatggctgcgaagatatgttaggtataaaatcaggattagtctcatggcaatatgattaattgaaaagttcaaaagtttatagaacatataaaaagttatctcaccttcagcagctatcccaaacgaaccttaatggctgccttcatctggataatctaggctacatgcaggccttatttatagcaactccaatctgtattacaagaaatcaatatatgttgaaactgaattcatactgaaatttgtgttttgaggtcggtagagataattggcatttgaagatgaatataaaaactgtacaataggaaagctaaggccaatactgcttctttactgaaacaaatctacagcaagcaatgaaagagagggagtgtttagttttgtttaccacttcattaaggaatgacatataccaattcgatgaattgttgcaaatcctattggacggaaacctgcgaaaataggtagaaaccaattgattaactaatagtccttgtcatatatcaggatgaagaaaaatctagcaaaatcaaccacctgatgggaacatgtacgaagcaaaatgaaaacttagatgttgttagagataaagaaaactatttacggtggaggaataaaaaacaacagctgagcgtggcctgcaattgataagttggtgagccttaaagaataatttagaaaatgtttttagttaggaatgtaaatttagagctttgtgcagtacatacaatcaatgtaaacactcatccacagcaattattagttgaacaaaagatggtactggggttacagggccatgaagtcactattgcttgcagtcggcctcccggggatgaaaacgatagaaaaacaaccttacgcatttttgcaaccattttttttcctcgtaaacagaaccgaaaatgggcatccacaatgttgcatatataaaatgaccttatggaacacagtagtatatttgctctacctttatgcattaggatatatagttgaaagaatgaatattgctatatgcaaccttaaggttaaggttagatcataagaaataaaaaaagtattttatgtattcgcaacatacatgttaccctttgtttattaggtgaatagagttttttttcgcagtgggcctcaccttaaatcaataagagaacatacacattgtagcatgtactatagacaaaaagaacgtaacaccgtgggactcatattatagctcaaatcaccttaaacatcgaggatgttctagattaagatggtgtcagaaatatggaaaaacagaactatgcaaatggaaatacgttgatattgatgggaaagcagtaattactgttggaaacaataaaaatataaactacatatatttaactaagtataattatataatatcaccaaataaatttaagtttattggatccgataattttgctggacttggaagcgctgaaatgtaaaataatcacatatttaacctaatataactatataatataaccaaataaattcaagtttattggattcaataattttactggacttggaattgaagcgctgaaatgtaaaatcacatatttaacctaatataactatataatataaccaaataaattcaagtttgcactatattacaaactgtttagacgtgtactcctctaaactatgaggcaaatagaaaatggactacatccattgaggcatttagaaatacgatttttatgtagttttccagaaataaggaaaaaaggaaatgtgtgttatatgttttcatttccatattttaaccattttaatttttattttcgttcatagcgtttttagatggttcggtcagtaccacattggaaatgtgcataggtagttcaggaatttccatgatcattttcacctactagttctcccaattaatatagtgcaaataatagtccccctccatgtattaacagacaataccattgacttttggtatgatgtttgatcatttatcttatttaaatatatatatatatatatatatatatatatatatatatatatatatatatatatatatatatatatatatatatatatatatatattatttattgacttgttttattattaaagaaactatggttgtgttcgtttgtagcagttcccaactcccatatctcgttttcagcgcgcatgcttttcaaactgttaaatggtgtaaatggtgtgttttttgtaaaaagtttctatacgaaagttactttaaaaaatcgtattgatccattttttttaaaaaaagctaatacttaattaatcacgcgctaatggatcgctcggttttccgtgcacatgagattggatcccaacacccaccaccaacgaacacagcctataagtatgacttatagtttatcatatttatattaaatttttaaataaaataaatagtcaaagcatggcctaattagcgcgcagatcaatcatcgcacggcatcgatctccgttggccttgtcacgcgatccatctccacgctgcgtggaatcttcataatccagaatgattttctaccaggagtatcttcgaaaaaagaagataatttttttaacgaaagttctattggtagagccgaagaaaaattacaagattataatctgaaagatcataaccaggaaaaagaaaaaaaagtatatcaccacccacacaccgaagatcaaatattgtgagtagcttgatatatggcttggatttgtggggcgttagcaaaagactttgggttgtacgtataaatttcagttttttagacctgactactgggaatctcttaatttaggtttcattcaacattatcattttttaatttctacacctttcattttctgcgcgtgcttctcaagctactaaacatttggttttttccaaaataattctatagaaag

SEQ ID NO: 77322 - DNA, 1575 bp, Oryza sativa
ggggaggaggacgaccggagggtcttactagagccactgatgccttctggcagtcgatgagactagggcactgggcggtggtggaggtgatgtgaatcgcgctctcgcactactaagcggcggcaacatgagggagtcgagagaaaggggatgagaagaagttttttgggcttggttgcctgcacgaatcttaaagcaatcgggtggtctaaaatttacaagatttataggggctttcagtcaaatgatgtataggcagtcccattattttttgaggtatatcaattatttcatgttttgctgtgcattattttgtctctaactatttttactcttgcttgatgttgcattgtttgtatttatactcattttttgtttggtgtcgcataaaagaaatataaatgcattctacaacggtccaagaccttccacgcatagcatactccgtatttttcattgtgtgtatgtgatctcctacaatgaagtttgaacagttcatggacacttgacggcccgtttggttggagggagtttttaaaagggattgagagtttagagggatgaggctattaagtgttttgtttggttgggagacatgagaattttggtaggataaggatggggaattgagggaattggataggggcaggtaattgggagggaattcctcctttactttgtctaagcaaatctcagccatccgtttttattaatgacgtaatctccaactaaactccctatcaatttccatcacctctaccaaacaagatattgggattaaaaatcaaattcccatcttaatgtcatcatccctatcaattctcaactttttcttcaaacttttaactttttcttcaaactttcaactttttcatcacatcgagactttcctacacacataaactatcaacttttccgtcacatcgttccaattttaatcaaatttctaattttggcgtgaactagatgtgttttatctatataattaattacatatgataaatttcagacgaagtagcaccattggaataatctttgctattataaaaattaaaaattaaagatgttttcgtgtttcgtcatccgtatttgagtcggttttaatatattgatgtgtcaagatgtttccgcggtccgtcattcgtgtttgagtcggttttaatatatatatatatatatatatatatatatatatatatatatatatatatacctactggattttttttcgtcgccgttttcttcttgcgtttttattttcaaactgttttttaatggtccatccagttgtttttttgttgccgttttcttcctccccggttttttcattgcggtttttttctcgcaccagataagggcttccggtttttcagttttctttcgtcaccgtgtttttccttcactaggccgaaccctagctccgtcgctacgttgaatctgtctatccatgcgtttcctcctccaatggattacaaaaatcaattctccactcatcgctcatcatttttcctacgattttctccttcgattcggctaggacggatttaatcaccatttaaccttcaccgatgatgg

SEQ ID NO: 77323 - DNA, 1934 bp, Oryza sativa
ccgcgtaccgctcccatgggatctcgaacagcatgtcggtgaacaccgcgtcggagtccacccaccagatcagctccgcctccgggtgcgccaccatcagcatccgcagcagcggcagcttcgcccagaacccgacatctccgcgtccaggaacgccgtgttgtagaacacgtcgaggccgtgaatgcggcagtagtccaccttgttcttgaacgcgcgcagaagcaggtggtcgccgtccgggtcggggcaccgcgccggcgccgacccggtcaccaccagcacgcgcggccgccccgcgggcgccacgcgcgccgggaactccgggtgcgccgccagccacgccgaacgccgcgcgtcgtagcccaggatggtgcgccccagcgagtagggcgggtccgtcagctgccgcggcggcgggaggccactatcctcctcgctgctcgcgttggcgccggcttgcatctgcgccggcggcggaggcggaggcggagccgccaccgcgacgtggacgggttcgttgaacacgacgcggatccgcggcacggtgaagctggaggagccggtcgggccgaggatgaggaacagcgcggcgacgatgaggatcacgacgacgacgagaggggcggcgtcgctcgccgaacagcgttggccgtgctgccggcggccggctcgccggtcagacgtcaccttgccaccgtgcttctccatcatcgcgcgcgatggctagctagctgggtgacacaaaggccgacgtgccgtccggccggcgagcgatcgagcgtgagctgcaacgttccaccttgcaagttgcaagttgccggtcgcatcgcaagtggttgtatatatattagtactagtagtaggcaaaatttgctggctaagtagcagtcgtgagcgcacgacgaacggtgcaaacgaacgtgtcatcgctgcatctcagccgtcgatcttgtggcagccgtcaacccaagagaggaatcctgcggtgcaggcatgtatgggttaaaaatacaccattgggatcgtgtcgaccgatcgagtgatcacgatcgtggcaggcagtgatagggttaaaatactgagcaggtaatttctggaagatttgggttccaaatctcgatggcgatgcaaattaggttaagaggctttaattgcccatgtgcattttctcaaaatttgtgtagggttattccttcttcccaggttgcacacttcatctgaggtcacttaaatttacaccgaatccgattttcgtccttaaaccctaaaaccaaatataaccagtccctaaactattaaaacaggtacaaacgagattcctcggtgatttgaaaaacggttttggctgacgtggcgtttacgtggttggtttgactagaactttgtctcacgtgatattgatatagcgtttacgtggcaattctactccaaaaaataataaaaaccatgggcccacatgtcagttaaaaaaagaatttaaaaaagatggggccacatggaccccacatgtcagcctcactccttccctctcccttctctcttcttcctcatcctcactcctctcttcttccatctcctctctctctccttccaggggagcggatgggcaggtgggtgacggagcaggcgagccgcgcacgagctgctccttcgacggcagcggccgcgcgtcacgggcgactgcgccagcgcgctgtgtcctgctccgtctccggcgagccgcccaccagctcattcaacacatgcaagtactagcagagcacaaaccatagctaactaactagctaatttgccgatccatgcaagccactaacatgaacatatcacattggtagcaccagcatgtctaacacatgacgtgatccaaaaactaaacaagcactaaaggatcctatgcaataagattagtgataacatgcccgggctgcagg

SEQ ID NO: 77324 - DNA, 823 bp, Oryza sativa
caaaagattcgtctcacggtttccaggcgagttatgaaattagttttttcattcgtgtccgaaaaccccttccaacatccgatcaaacgtccgatgtgacactaaaaaattttcatttcgcgaactaatcaggctcttagatcctaaaaaattttagccaaaaacgtcacatcaaatgtttggacacatgtataggacattaaatgtagaaaaaaatcaattgcacaatttgcatttaaattgtgagacaaatcttttgagcctaattacgccatgatttgacaatgtgatgctacaataaacatttgctaatgatagattaattaggcttaataaattcgtctcacagtttacatgcagaatctgtaatttgttttgttattagtctacgtttactacttcaaatatgtatccgtatacttcaaaaactttacaaccaaagaattaaacacaccctaacagcatttgtcttccgttcatgtaaattggcccattcctccagctgataggcaattctttttgcaacattagttggattctctggtgccactgcataacgactatcaatattacgaacagaccacagattataaagggtaacaaataagcctgcaattatatgattctcctgacccgataacctatcaagtagccaaaatgccaagagtttattattattacagtccacccccgggactggaaattcaagctgcaactcttcctctaccttgctccaaaccgatttagaatatgggcgctcccaaaatctgtgcaaagcattctcatttccatcacagaatatacaacgtactccctgcttact

SEQ ID NO: 77325 - DNA, 4727 bp, Oryza sativa
tgctcctcgccccgtgcaccatcttattattcacgtcgggagacgtgccgctcccccgcatccgcatcgagtacgctcgccgtgacgctccgacgatcaccgcggtggcagcggacacgtcgccgccaccaccttcaccaccgtcgtcgtcgccgccaccgttgtcgtttccgcctccaccgcctccgccatcatcaccacctccgccagctctgcctgtggtcgatgatcacagcgacacgcaacggtcgctccggcggctgcggcagctgacggacagcccgtacacgctcggcccggccgtgacgggctacgacgcgcgcagagcggagtggctgcgcgatcacacggagttcccggcgtcggtggggcggggccggccgcgggtgctgatggtgaccgggtcggcgccgcggcggtgcaaggatcccgagggcgaccacctgctcctccgcgcgctcaagaacaaggtggactactgccgcgtccacggcttcgacatcttctacagcaacacggtgctcgacgccgagatgtccgggttctggacgaagctgccgctgctgcgcgcgctgatgctggcgcacccggagacggagctgctctggtgggtggactccgacgtggtgttcaccgacatgctgttcgagccgccgtggggcaggtacaggcgccacaacctcgtcatccacggatgggacggcgccgtgtacggcgccaagacgtggctcggcctcaacgccggcagcttcatcatccgcaactgccagtggtcgctcgacctgctcgacgcctgggcgcccatggggccgccgggccccgtccgcgacatgtacggcaagatcttcgccgagacgctcaccaaccggccgccgtacgaggccgacgaccagtcggcgctcgtcttcctcctcgtgacgcagcgccaccggtggggcgccaaggtgttcctcgagaactcgtacaacctgcacggcttctgggcggacatcgtcgacaggtacgaggagatgcggcggcagtggcgccacccggggctcggcgacgaccggtggccgctgatcacgcacttcgtcggctgcaagccgtgcggcggggacgacgcgagctacgacggggagcgctgccggcgaggcatggaccgggccttcaacttcgccgacgaccagatactggagctgtacgggttcgcgcacgagtcgctcgacaccatggccgtgcgccgcgtcaggaacgacaccggccggccgctggacgccgacaaccaggagctcggccgcctactgcacccaacattcaaagcccgcaaaaagaagacatccagagcagccaggcccatgtaatgacgaagatcatatcgaaaaccgtgtaattatggagatatgatactttgattaggttgtattttcgtttggagatatttcttgaatattgatgtatgaacgaggaccggagatatttaatgtgttgtttttacacccaaaaaaattctcactttatgtacgagctaattccggttacttgacttattaaaaaaaattgcgagcaatgttttgttggggaaacgtcattcctgattgttgttactattggcaaagcatcgaaattattctgcatctatgcaaggaaaagattgcaccatagttgattcatgccagtggaatacaaaaagaaacaatttatgtatgacagctggattgagtagaaactagaaacgactatatttaggagactactattgccattcacaaatagcaccagcaccagtaatacaaaaaggaactatgggctaacaatgaaacaaaagttcattatatttccatttttctaactagaaagctaatataagctcgttctagctctgatatttgcacttgaaaaattgttgcacaccttggtctttcaccatttgagatgtcatatttgtcagtattggaaagaatgaagctgccctcttaccatctcttggactgtatctcagtggatcgaatgattgatcattgaggctgaggctaaatttaagcatggtttgtcttcagggacttcaggcacaggcacttcaatcagcttcatccagtgacgttgacaaaaagttcaagatgaaatcatctaggtccccattgaggactgaatcagggtcggatacttcgtagtttgtccggagatctttgaccatacgatatggctgcataaaggcaaaacatcagctatatgtcagaagtaattctaaaaatatcctggcaaaaatacatcacgaacttatgttgtttacattcaaagacactttccatatcccgtaatctagctactttcatggatagcagtacgttgacggttagcagttcgcagcttctttcttgattttcaaataacagcagatgtaaacaactgatgaatcccatgaactaatgcctaatgttgaggaaatattgagaccatggataacgcaatacttaagttgaaactttatcctccgaaacctagctagcaaaatcttagtcatatgataaaaaaaaaaagacttacatggagtacataagatcttatttggtttccccagctgatttcagagagtgattgcgtgtggtctgcattcatctgtgcttggcgggcaatctcaagctggtccagccgagactggagcactgccattgctgatgccttattcatatgctgtgatctgcactttttagaatgaatcagaaacattttttttctagccacgcatacgcagatataaccaaatatcatttatgttatatcaacaatcaagattatggatcctttcaaaagtagaaagaaagacacaatatgattctaagacatcactaagttcatagaagtccaaattgcccatcagctaacatggaactaaaagtatgctatattatattcgagaatagtacaatgatcttcattacgggaatgctggagtgtttcaataataatggaaaacaggagaaagcataaaaaatacctttcattttgacaagttgcagttataccagttggaatgtgcacaattctaacagcactttctgtgcagttggcatgttggccaccaggaccaccagagcggaaacgctctatccgaagatctgaatcttttatctggtatcgggtagaaccatcaccaagaataggtacaacagccacagcagcaaaggaagtgtgccgcctctttccactgtcaaatggagaaatccgtaccaatctatgaacacctacttcggctttagcatatccaaatgcatattcaccatccactttgatagttgccctctaggaatagcagattttcagtataaaatctacatttttgctaaaaggtttctcaaattaaaagtaattgactgtaggaaagataggatcttatgttaagatcagatagtttactggtttgatcatcacttccagccaaagttgtaactgaaactacttctgaatgaagcagtagcaaattcagtaacgggagttgatgagaaggaatgtaaaccttgattcctgctatttcaccaggcatttcttctataatactgactgtgtatcctcgtcgttgggcccatgagctgtacatgttcataaccattgcagcccaatccatgctctcagtacctccagctcctgcctgaacctggtcatggcatcaacatcatgaggaatcactcaccaaaaatgcatggaggagcaatagctttagaggataattctgaaaatgatacacaatatacctcaatgaagcaagagcaagagtcattatctccagaaagcaatgcattcagttctttctcctttgcacttcttctcatttcggctaatgccctcatggtttcctgcacagaatgttgattatcagataaaaacaaatagctgatttgcaccttgaagttgtaactttatgtgatgtagtgcaaggaagcactgcactcaccgtctcaagttcattatcgtcctcttctcttgcaagcctcaacatgtcaatgtgctccatcaactcctgctcgaattggttcactgatttaatcttgcccatgagctcaccatgttcacggctaaccttcccagcgaaaactggatcatcccagaggtccggcctctccaacaccacagacaactgccttgatctctcaagtatccatccccactaagaaaatcgaaataaattaattaacagcataatggaacgggcgcacaaatacatactagcacataatgacatgtgccacacaacgcacaccaggtgttcgttgatatgcccaagaggaacaaggcactcagatgcataccacgggcccaacaacgccaggaacatcaccaatttcgcttggggaatatgagaagtacaaagtacctcacaaagattgtaccttgagccgcttcttgatgagcttgacggactgcgcgacggcggcggcgtggctgcgccagtcgctctcggcctcggggaggatcgtccaccccttccccgcgatcgagtccaccgtgagcccgtccgcggtcatcggcgcctccgccaccgtagccggggaagagaaccaccgcgtcggcgggtctcgaggggaccatggtccggccgccgcagggaggccaccgcggccgagtcccaggagggaggccaaggcggcgccattatcgaggtggtggtggtggtggtgggtagggctcagggccccggaggagcggaggtgggagaggaggcgcgcggcggttgatctggttaggaggcg

SEQ ID NO: 77326 - DNA, 2187 bp, Oryza sativa
  unsure (1)..(2187): unsure at all n locations
tgctaaaaaatggtttttttaaagaaaaatggtatttttttataaagcagcatcgtcaaagtgaactggcccttcatctcggccgcttgcatttgtgagcagaattaaatcactgatccgactcatgttgtgcttgcgtcgtcattcgtcagtctcgtcgcgctgtgccgactgtgcagccctcaagaacacgtccgaagctcgaatagacattcagcacatacgcatcgaatctgaagacaaccatttcctttttttcgaacgctgaagacaaccattcatttcatcctgtttagtgcgtagatttgcatgtgaagcaagcacacccagcaaccctgcttgcagatatcaagtcgtcaaccatcgctatcggcatcaacataagtttgcacacgcacatcgttccaaaattcgataaattttagatgggagtgcaattagtgcagcattgcagcaacaaagcagaaggttagtcagtactcattagaacaggttcgacatgatttttcgatttatttgtaccccgtgatagcacaggaaatcaagcatacaagatgccaattacaacgagtgctacactgaagacttccaagctccaacagctagcataacaatggcagacttgagaagttaagatgcaggtagttaaaactccggacagctaatttgccggctgagcggctcacaatatgccggagagcacgttggcggccgtggacagcgcggcgccggcgatggcgcactgcaccacccgctcgtgcgacgcgcggtccgaggtgagcgcgacggccgcgccggtgagggcgcccgccaccacgctgttctccagtcgtgcgtcccgcgcgcctccgtcaggccgtaggtcagccccgagtgcaacccggccgcgagccctgacacgcggaaacaaataaatcgaatcaagcagaattaatcagccgtaagcatagcaaattcgtcagtaaattcagctcgagagagggagggatgcttaccccactggagagactctntgctcacgcttttcacctgtcgagaaagcagaaaaaagaaggttcaccatacaggaatcagaaacgaccattcacagattcacggtgtggcgttgtccaagacaccaaaaaggcaaaaaggtatttgcacttggcttaccatagcctcagctgacttgctgctgttccctcctgcatacgcaatttatcagaacaaaaatcagtggcatccatgttgtcatggtcatactactagtaactattcaagattcaacatcaaacgatttccataagcatatcacacagttgctaccgttgagatccgggaacgatcgcttcctggcgccggtggagtcggacacggctcccgtgcccccaccctcccctgtagcagcagcaactaagcaactaagttgatcatcatcagaaagaaaaaacaataaaaaaaaacttggtaaaacgaggatgaactgaagccccgtttggtttgctagttacgtgccttccatggccatgaagtaagactcccgcgcgaccgcctggactgcgccgatctgcgtgggagatcgaagcaagcaaagttaaagacagtagcatcgcggcggtgcagaggtgaagtgaactggagaaagcgagagaaacagaaggggaggcaaaaaggtgagtgagatggagggcgtacgccggcggccttgacgaagctctcggcgacgcggttgaggagcgggtggccgaggtcgaccatccagttcttctccaggccgcgcacctcgtccaggaacgtgcgcgtctccaggctgctgttgctgctcccgctcatcttcctccgctccggcgccgcaccctgctctctctctctctctctatctctctctagctattgacagcttcggtgacagatttgcaatgccactgcttacactacagcaagcgagccgcgtgcgtatacataaactgagcgagtcgtggtcaccgtggaacagatcatcagcaagcggcgacgagaacccgatcctactggtggcgtcctggggagaagaggacatgacacgtaccccggcgggccggacacgttgcggggagaggctctactcgtggcgctcttctggaacgtgcgcgagcgcctccgtgttccatggaatctgcggtatatccgcctctgtgcctgtgctgtgctggccagggctgcaggaat

SEQ ID NO: 77327 - DNA, 19038 bp, Oryza sativa
ccctactccgatgaagtcggcgactcgcgacggggaaattgtcttagggcaaactgacctagctaccgtgattgagagagacggagattgatcttgttttcgtgcagccgcattaaccttaattaatcctaatctcttcctcctcctcggtttcctcgcaaccaattccgccttggtctcctcccctgccgcgcccagcgcgccgatcgccggcccccccctcctcctcctcccacattatcttctccaagccgccggagacaccgccgctgtgtcatgtcgggagagatggcccaaccgcataggttgaagaacagaggaaggcgcattctggaaagacacgactcgtgaagaaggaaatggactccatggaatgtaagtactggcgtgagtgactggcaggtggggccctgaggacgagtgcgtgtgtgggaagaaaaaattttgaaataatactgtttatcgattgattgtgcaaaaatataccggatagcgaaggatttgtggaaataaaccagagcgataccaccgatgttcgctcctggaaagtgcgatagcgtggcgaaatcgctatatgaaagagcaatagcgaagttgagctggcgctctcgcgcaaacgagacgcgtgaccgcagcggtatcgcgcccgcgactacctcgggcggagccatcgctctcgcacttttgttgcgcgagaccgaggtcggtatcgtaatatgaaatcgcgagaccggttatgacgcgacgggggagacgtgggcacgcggtatcgcgctttgcgcgtgcgagactggtgacgcggcatgcgcgagagagagaaagcctgggggagggcagtgggcccgcggcgtcgcgctttgggagcacgagaccgatcgcggtgtcgctatacgcgtgcacgagagcgaggagcgcagtggggcagcattgtcgcgctttgcgggcgtgagaccgcgcgttgtcgcgctttgcacgcgcgagacagcgggcggtctcgctctacgcgtgcgcgagagcgagggtatcgagggagcggcagtgggctcggtctcgcggtccgcatgcgcgagaccgtcctcggtatcgcgctccacatgcgcgagagcgacgacgcttttcgcatccgacgccaccgacacctttatttcccatatgtatttctttttgctttttgcacgggttctagccatctaccttagctttttagggaggggtggaagatctctgtgcactctcttatcagtttactgttgtagtcacatcatgccggccatttctaaccgctgtagcgtttgaatccaatgcggtcacggggttaaattgagaggagaggagatggtcttcacagaggaagacagaagggagtgaactgaggaggagaggaagagcaagagaagagaggaggcagtgcaggcagtggagagaaggaaaaaaagacacgtaagttgattagttttctattagcacaaattcgtaagatgaggatttagaaaatattagttcacgtagttaatatttgtttttaattatgtcagagaaaaatttaggtatgtattagttactactattttatattttgttaggtcgtatgtaaaaatagaaatgtagaaagttaatagagtcgattcgggttaaaaaataggtagacgtaattaatttttaaggtacaaaagtataatataagttacaattaatttatacgtagcagtaattataatttataattaattagtagttcatatgatgtttaattttatatatacgaccaatattatatgtaacaaatgaaaaaaactgaaatattaatagttatatttgtagttattgatattgatattaatagtattgataattattaaatatggtacaaaaattaaattaaagttgtaattaatttgtagtaattttaagttacaattacttagtagttcatgcagttatttattttgtaagaaatggaaaaggtataaatattcgttaagtagctggaaatatatggtgtgcttaaacacatgcttaacatggtaggtagttacgaacgaacaaagaaatatagtactacgaagaactttgaaattgggacttttatatgagcaaattggttgaaaagaagaaggcaagacaaggtatggttctataacggaagaagatgtagtaaatttttactataattaatagacagtttgtaatttatttggtattgtaattaaagtgcagttaaataaatttatgtcgctgcaactagttttatactgttggaggcatgccatgaagcccttcggccggacctgccgaaactatagtactagcaaggattcaagccaaagacgtcaaggccattcaggcgaagccctatggcggaagccataagcgaagatggcgaaggctggaaagccgcgttggtattatgaaagtaaaggcatctcgggcgaactacaaagacttcgccatgacgagttcggcatcaaggaggcccaacaggccgcccccagccttttaggcccgtttgccatagaccaggcccagcctatcagcccatgcccatatgtgcaaatgacactgcatacccatataaatgtccctttcataagggcaaccatgtaaaatctcttgcaaccctaaaccctaggaggtgcaagcttgtgctaaggctataaatagacctctagggccatgtaatgggggatccccaaaaaaatatttcacgaatcaatacaattgcttttacattccaactactattgagagaaccacgcctttcgacgtggcatagttgtccattcgacaacagctggcgccgtccgtggggaacctagaccgaaagggcgaaatgggacccctttcgccacacccacacccttcaccacagtacccgtgaggtacggcgacaagggcttggggcaaaagtgagttaagtccaagctggggggctacgaagccaccccagcctctagacacctttcgccatacgccacgcccttcgccatagtgccaataaggcacggcgtcaagggctgcgggcgaacagggttcgccaaacgccacgcccttcgccatagtgccaataaggcacggcgtcaagggctgcgggcgaagagggttcgccaacccacgcccttcgccatagtgccaataaggcacgacgtcaagggctgcgggcgaacagggttcgccaaacgccacgcccttcgccatagtgccaataaggcacggcgtcaagggctgcgggcgaagagggttcgccaacccacgcccttcgccatagtgccgataaggcatggcgccaagggctgcgggcgaagagggttcgccacacgccacgcccttcaccatagtgcaaataaggcacggcgtcaagggctgcgggcgaagagggttcgccacacgccacgcccttcgccatagtgccaataaggcacggcgtcaagggctacgagcgaaacatgccacgcccttcgccatagtgccaataaggcacgacgtcaagggctgcgggcgaagagggttcgccaacccacgcccttcgctatagtgccaataaggcacgacatcaagggctgcgggcgaacaggtttcgcccatccacgcccttcgccatagtgccaataaggcacggcgtcaagggctgcgggcgaacaggtttcgccacacgccatacccttcgccaaagtaccaatgaggtacggcgtcaagggctgcgggcgaagagggttcgccaacccacgcccttcgccatagtaccaatgaggtatggcgtcaagggctgcaggcgaacaggtttcgccacacacccacgcccttcgccatagtaccaataaggtatggcgtcaagggctgcgggcgaacaggtttcgcccacccatgcccttcgccatagtgccaataaggcacggcgtcaagtgctgcgggcgaagaggtttcgccacacgccacgcccttcgccatagtactaataaggtacggcgtcatgggttgcgtgcgaagaggtttcgccacacccacgcccttctccatagttccaataaggtacggcgtcaagggctgcgggcgaacaggtttcgcccacccacgctcttcgccacagtaccagcgaggtacggtgacaagggctgggggcgaaaataagttaaggagttgctcccaagagcagccgaaagagatttatcatttttcaagatactccgaggggccggcaaactcaattggacacctgagtgtcaagctgccttcaatgggctaaggcagtaccttcggcactagtgtaaatatccgttcggaaaaacattttctgccgattcagtgtgccgaaagagttcattaccgacaataacaagtggtttgactccgagaagtccaaggaaatgtgcaaggggctaaaacttgaaatcaagttcgcattggttgcacacccgcagacgaacggggcagccgaaagggacgaacaacaaaaccctagcagcactaaagaaaagaccgaaagctggtaacagttaaaaaggttgaagtactaaaaagactgaaagccagcaacagtcaaaacgatcaaagtacctaaaaatacctttgccaaaggaaaaaaggggaaagtacgagccgaatagctgtaacacgcaccacaccccatttatttgccaaaaagcacaagttacagataaattccattgcccgccaaaaggcattcagactttatatccgattcatcagcaaaagcagtcctcaaaggcgaaggactacccccttagcatcttcttcatcgctagttgttaaatcaacacaaaaaatttttaagcggtgaagaaggaaaaacggggattatgctacgtcgacgctgggcaatggcaaactgacgctcagtcatataaaattcatgggtgtcttcgccttttttgtgtatgatatttcgtggaaaaatcccaaggcaaacatttgatcgacgaaaacgccaggggggcgatacgaatcggccgaagcatagctcgccgaacgttgaaaccgcgacagctcgttttcggaaaacataccgatcgtcgctacactcgacttatgcaaatacttaagcgtttctggacgcacatgccaaaatttgagagtgaatgatgagggctgaaaagtcaatgtgaattcctttcgctaacacgcaagggggccaacacgcctcgcccttccgaacgtacaagttacaaaatgtgatgatagcgaaaagaaacataaaaacatgcacaagctccatcgagcaaaagcacatacgtgttatgcaaaggagcaaaaaattatattatccatttcagaacatttttgcctcgcccctactaagtcccgcgaacacggttcgtcgtctatactgtacacgactctaaggggggaaggaagcgaaatacacaccgacgtcaagcgataacaacttgacgattagtcatttcgaagtctaaccaaagtgtggcaatgttatcacggcgctggatgtggcaccggtcataatcctctaaggttcgaccaggaggtcttcgcctctaattcgccattttgcaaccacatagctacataaaaggcgaacgcttgatcgacgaaaacgccaggggggcgaaacgaatcggccgaagcatcactcgccgaacgctgaaaccgcgacagcttgtttcggaataaagatacggaacgccgttgcattcaacttacgcaaaacacaagcgtttttcccagcgcaaaatgctacaagtcgaaaacggaagtcgaaagctgaaaagtcaacaaatcttttcgccaatccccaaaagggggccgaacgcatgactttcggtgaaatccccgctaaaacaatagggaaaaggggaaagaaaaaaaaaatacaagtcaagaatcgcgcaaagcagacaaacttggcaaaatataatcacccaatgtcataatagagcttcgccattctcgaaaggcgaacgccagtgttcatattttttctacagaagtctaaaaagaggtttcggcaggaacattggccgaaaggggacgcctcatgccataccatatagtttgcacggtctcggccgaagctccttactcacccttgcccgtgaggggcttgttggaggcatgccatgaagcccttcggccggacctgccgaaactatagtaccaccaaggattcaagccaaagacgtcaaggccattcaggcgaagccctatggcggaagccataagcgaagatggcgaaggctggaaagccgcgtcggtattccgaaagtaaaggcatctcgggcgaaggcatcttgggcgaactacaaagacttcgccatgacgagttcggcatcaaggaggcccaacaggccgcccccggccttttaggcccatttgccatagaccaggcccagcctatcagcccattaaaggcccatatgtgcaaatgacactgcatacccatgtaaatgtccctttcaaaagggcaaccatgtaaaatcccttgcaaccctaaaccctaggaggtgcaagcttgtgctaaggctataaatagacttctagggccatgtaatgggggatccccaaaaaaatatttcacgaatcaatacaattgcttttacattccaactactgttgagagaaccacgcctttcgacgtggcatagttgtccattcgacaacatatactataataaattggtagttatgattaatttgattatgtaagtaatcaagtgaagttgaacttagttctattaattttttatgttatgattaatttatagataattttgtactaactgatagttacaaatattttgtatttaagtaaagttacggtccgttagataatttatagttaaagttgtaatatattatatgtactcatccaaatttgcaatagtagtattgttttagaggtcatatctaaataggtacaaacagtccgtagcaaagaacatgatgcggctcaatgagtgtcattgtcctagataaagaatagaaagagctagccaaaatgatttttaacttagcttccgtcaatgtttcttcggtgcaagtagtcatttgttgtattaaaattaattgatatgtataattaatttgttagttaaacatatggattatgcagtgaaataaactttgaggcagcaattgttatacgagcaagatggttaaaaaggagtaggcggaatctgataaacgcaggtaaatattttgtcatatttatgtacgatatggtttggttgtattgttttaagtattacatactcttttacttaaattaattgccatagttatgtttaattacgtgttttaattaattaatatgtattaattttattgtcatgtgtttatttttttggtcaaagttgtagtaaaattataaataataaattgcgttgtcatgtattcataagtaaataatttatgtttacataattatttatttataaatttttttattacaagtacatgaattttttataaataatatggaaatataaataattagttattgataaagatttttttatcaaaaaaacagtatgcgtgtaaactaatttttgtcgtgaataggacacgtttgttctgtaagacttccttacggagtagtccgtgttgactgcaatggtaggaatgtcggcatttagagtgtatttcggtgaaggtgaaattatgaaaatgaaagtggtctcgatctgagcaactttaggcaatgcacgctataccatccaaatcctgacacccttactatgcccgaagtttggtactggttaacatgcacattttctttagatccgggtatatatagtgttaacgtgagggttatgtggagccgatcggctaacaacataagataggagttaaaaaatgtgacacggagtaaggcctggcaggattggctcgctggctgtaggagacggggatatgaatatgtcatgctggtgctagcatgtcaaggaagagtccctacggagagcgctgcagggcaatccagcaaccgtgaggtgttggggtctagttcacacgaagaagatgaagttgtagctccccatcgtggtggcgatgttggtcctgacattcaaaatctatccatacaaggagatgaagtggtcaaccgccatcctactggtgaagccgatgaaggggaggacatacctgctatagttgaagaaattgagagggtggaccgacatgcagtcgaagatgaggaaaacctcactgctgaagagaatgatgatgaagatgaacaagaagttgatgaactacctatgcctgcttcgtggaaccttgaagaccctggttatattgcagaaagctcttgtcatgattcaatatggttctacggggatggccaaatcaatctgggtgcaatgttccgtgacaaaactaggttgcaagacacagtgaagtcatggtcattccagatgcaaaggcagttcagggttgtgaagtctaacaagactgagtacacggtcgtctgtgagatggaaggttgcaccttccgtcttcatggtcacgtgccaaagtacgagtcttactggattgtgtccaaactgcaggaacactcctgtctgattcggaacactagggagtcgcatcgcaacctgaccgcggcatatgtcacgaacaagtactacaaggaaattattgaaggtgatgacctgcctgtgcggcacataataaaactggtggagaaaggtgaacaatacacaattagttaccacaaggcttggagggcgaagcagaaggccatggagaaaagatatgggacatttgaggaagcatatgacacactgccacagatgcttaacattctaaagagcaggaaccctgggacctatgttgctgtgcagaatcgggagtcaattcgtcctccaaattattttgtgatgcaatgggcattctttgcattcggagcatgcattcatgcgttccagtgctcgaggccgatgctgtgtgtcgacggtactttcctaactgggaagtacagaggctagatattaacagccgttggtgcggatccgaagataattccagtagcttttggttttgttgaaagcgagaactacgaaagctggttgtggttcttgcaacatctaaagtggggagtggtgcaaaaacacacattgatatgcatcatacatgaccagaatgctggtctgttgaaggcaatcaaagagctccaggaggatggtgatggtgcatactactggcctgacatgcacagccattggtgcatgcggcacatgggagccaagtttttcaaacaattcaatagccgacagctgatgaacatgttcaagcggttgtgcaaggcaaatcaacctacaaagttcgatgagctttggaaacaacttgacgaggggacaaggacacatatccggtcaaagcagaccaacaacaacccgcaggatgtacatgtcacccaggccctggaaccaatggatgatcttattccatcaaatggaaagaagcgtaggtcatcaaagaatatcaaatgttttacccattggattgagtgcgagccgaatgataagtgggcactcctgcatgacactaatggggctaggcatggcataatgaccactaatcttgcagaggcgtacaatgcggttcttcacaaattaaggcctttacctctaactgcttttgttgaaggcattatgcacaggacaacgatgtggatgaggacgaggcgggccgcggcgttgcaacaaatgtctaacgcacaaacacctttctgcaaaaagatggcagagtacctccaagagaaggctaacaaggcaagatttctcacggtcattaccaatgggaacgtcagacgaaggtgggaagtcacatgtcgcactaaggggggttttggatcttctactggggtcatcactcatgaagttactctagggcacgaatctgataacaaatgttcgtgctcttgcaataagccgaagcttcttcataagccatgtagccatgtccccggccgcgtgcgctaaaattaagcttgattcaacatcatacgtgttgacgttctacctaaaggatagagttctgaatgcatggagtgctgagatcctcgggtggaggtaccttcaacacctagtcgatactaggggtgataaaaggatctatgtgccagacttggatttgttgaaggctggtaagggtagaagacagacatgacgcttaagaaatgatatggatgcatccgaagcgggagggcctgtgaggcgatgtgaggactgtcttcagtacgggcaccgcactagagattgcaagaataacatggagggtacatcttcaagcatggaacctaggcaacaacgtgccaggaggaatagaaggggctctcagggtgctcacgatagggaggaaggaaacctgcagtagttgtaacatgagtgaagggtcatgttcaccggctcgcacgggaacactgtggatgccaggctaatcccccttgctcgccaaagtgctgaaggtaatatagcaccttctgcacagtttagttggggatcagccatccttgcagccacataccgtggattctgcgacgcttgtattaagaccggacaaagggaggcgattttcatggggtgtccacttttggtcatgttgtggtcgtacgagctcttctcgttcggacgtccatacatgagtgtggccgtggcccacaaggacgattacactgacgcagttgatgatcgtcctaccttcggtactcgctggtgctacggaccggtacgtatgcttgcattaaaggaatatttctatcatttcaatgatactgcattactaaatctacaatctctgatcgtgcagccatagtgggcgagaatctaggtgcacaatgtgtatgagtacttcaccgaggcgttcgaaagccttagggaaaacgaagttcgatggattccgtacacgaacgaagaggccattttgcgtgcaccacatggagtaagcatcttatgctaccgcgatgaagcgtactggatgacacgaaaaatactggtgtacgacatattcttcgaggggtataatgttcaaagggtaatgcgtcaaatgggattgtaccaacaagtcccagttcctgttgggcttcaccttctaccagatgtgcacacgtatgttgttatttcaatcctgtctaatttctgtgctctccaaaattgtcagatataactaacaactaattgttgtatttttgttgcagggaaaagaggcaagctgacaacaggtatcatcgatctatgcactcaaggatgatcccatggatagaggcgtggtcacaggccttgaatgatgtcgtccaggagaccaaggcatacgaccacaacacttacgaacaatacatggcctagtactcatcgcagactcgcatccggctgcttgcacccgaggatcccgacgagcgaggtccaccaacaattgatcaaatatatgatatgcagctagcaccccccgctcacttgacggtactactagcatttaaatattttgttgcatctgtgtgtccttatacatagggttccactttctaacattgttgctacgcttcatgcagaccgacattgcaggggagttagtaagggatgcgaaaactttgtgggagaagtttagagatggaatcgtgagtaccaaccaggaagttatggccgcggttgactccctccgtagaaaaggtaagcgaatcatgtggctcgcgtcgtgccgacattcctcggacgtctatactccggcaacatcaagaaggacgttcaagccaatgctggagcgtccctcttacctcttccctgccgtccacctcagcccgcccttcagcctccgcgcgacgatccagcgacggtcgtgctgcagtaaggtcaacttcgtttcgtgaggcacccactattccgactatcccagaaatcactgaaatttcggaacacttaggaggctttggttcaactcaaggtaaaatacgttattgcggaatgctaaaataagtgccatttatattaaagactaatttattcgttcgcagcacaaccggaacgagtacccccacatagctctacgcccatcacctctcaatggcagggtgggtttacgtcgtttgctggtacaggatagctcatcaatatgctaattttttcccaattgtttatgtgaaatgactaaatgatgttttccaattgatgacagagggaatgtgaatggtccgtcttgtgcctcatatgcctcctgcaaggccacatatgattcctcaaatggctcacgatgtgccaacctcactctggcaaggaggatttgcaccatttgcaggtccgtgtacattcagtaccatattggcatgcatatgtccactcgtaattttactttttgctaattaattgcatatacagggactagccaaggtatccctaccataccccaattgtctgcagattttatcagttaaggagggtttacgtcgttaggcggtcagtctccacttacatctaatttcatatttttattatttcaatttattaattttgcatgtatatgaatcttattgacaatttacttcctgatattaacagggcctactcagtcggttccactgcatgcacctacatatggcaccaacccatggcaaggacaatccatggattacggtggtacgctcagccatcattctccatacacatatatcgatggcactttcatgccatacatgactcccacttcaacttaagacaataactccgtgacattttatatggatgcaaggcacgtcgtttggtggtggagtacagggttatatggacttcttgcaacaaggtgattggctatttggtcaatattcctcgcatcctaatgaaattccatatatgcaagcactgtcaacaggtttggattttttttgtgttattgttgtgtgctccagctttgataatttcattgatatctacattgcttctgtagggtcatttcgccctaaactaatgtcagggtttaggccttacactgcatcataaggcgacatgtccagcttcggtggagggtcgtcatcggtacccaacgagcttcggacttcacaaattgatgatgcgccccatgtgacacagcccacacaacaagaggttggcgaaggaaacgacaatgacccgcgtagatctaaccgtgagctccatgagccaaaccgtctgtcactctcaggccctcgacatgccgcacgagcaagaaaaaaaactacaaaaaagcgagctggaacatctaggactacgactgaccatgatgatgatgacgagtagaagtgaacattacgtctttcagttcacctggcaaacctatctgaaccttgctgtgattttggctttctattactagcaatgaacattatttttttgtactgcttattcttcatgttatgtacgatgtttcgtagttcataaatatctcatatttttatgccctattttgtatccagttaacacatatgatttttggttaactaataatttttcgtacgagagctaacaaaaaataatagtctcacaaactaaattaatagtgcagtttcgatgttactcgtgcggttaaaattgcatattacttttactttttactaatatgacttaaattacccacttatgacttaaattacccagtaatttcttttcacagagatgcaatgatacgcacctaaaatggcatcctctctttccaatcacgggacatgccacagagaataaaatcattcacaattaaactttgaagattccgttgcgctgcgccgaaagtgacttcgtcgctttgtaattaataaagcaaacagttatgcagcatgtgccgccgaaagtgatgctgttgctttgtaattattaacttcacgagtgaaacagtccgacgctattgaattgattagtctgaagctagcagtccgacgcgccgtcgtctctttctaataattgagattgcgcagcttcttgccatcccctataaataacaaccaaacgtagcacacaactacatctcttcttcataaacgttctgctggttccaacttcgtgttgcatattcttaggcctggtcttgaggcaggaactgagtagttggtgaactcgctctatgttgttcgttcactcgcgacgcggttcctgtcccaagaccgagtctgtgaatatacaaatgtgatttttttaatacattcttacacccactctttttttcaagttctagcatccgtttgtgaatatgacctactcctgcaaattcataaactcggtgttgcatattcttaggcccggtcttgtggcaagaactgagtagttcgttaactcgctacgcggttcttgtcacaagaccgagtctgtgaatatgcaaaggtggttttctctgtgaatatgacatattctaaattcctattctttgtcaactttataaaaattgctcccgaatgatctctctactcctttatatatttttaataaatatattatcaatttatatttttctataggtaatatattgtttctttctctgatatcattattttgcaaattccaagatatttatttttcttctcgtagctgtgtacacaatctttgcctattttcaatataaacatatttctcatattcatttatgtatatatatgttgcacacataataaaaaaaatatgaaaaaaagttatactttctactccctccatcccaaaaaaaacgaatctagtactacgttggttttttatgggacggagggaaaaaaattatgaaaaaaattatactttttactctcttcgtcccgaaaaaaacaaatctagtacaaggttggttttttttgggacggagggagtacgtaccaatggcgacatgaaatattagcgatttgcacaatggattaatgtaattagctgatcgctctcgcgcgcggggagagccatatcgctcgcggtctcgctctttcaaagagcgagaccgaaggcgtcgctgtcgcactgccgtctcccaggattagcagatgaattaggggacgtgggccacgccgcaacggtatcgcggttggaaagagcgatatcgctggcgctctcattgacacgtaccgcgagactgactcgctctcgctatcgcgtagcgcgagaccgctcctgtcattcctcgggccccacatgtgtcagtcagcacacgccgctacggtctcgcgcagcccgactgtgataccgcacgcgctatcgcgcccttgaagagcgagaccgcttcgtgccccacgtacgtcaggcggcgtcggacggaccacggtatcgctttacaaaagcgcgagatcgcctcgctctcgtgctttcggagcgcgataccgatgcattagtgctccctcactccaaattagtgatagcgccaccgctttcgcgcacgcattacgcgatgccggtatatttccacaaatccgcccctaatcagcttattcttgcaattccattcaagaaaacgattactttcaaaaaattttctgtgtgggaagttgtcagctagggactaatgtcagctcatgcccagagtttttccatttaggccctgtttatatccactgagaaaattttacaccttgtcatgttgaatgtttggacatatgcatgaagtattaaatatagatgaaaaaatagctaattacatagattgcgtgtaaattgcgagacgaatcttttaagcctaattgcgccataatttgacaatgtggtgctacagtaaacatttgctaatgacggattaattaagcttaataaattcatctcgcggtttacaggaggattctgtaatttgttttgttattagactacgtttgatacttcaaatgtgtgtccatatatccgatatgacatgccaaaactttacacccctggatctaaacacagcctcagattgctataaatcggatgtctgatattttgcaaaacatcgaacaatgttgcattgtattgtttaaaatgtttcacatgttgcactcctcaatgaaaaatgtttcagatgtttcatcaatcagggaaaatgtttcaggtgtttcatcaatcagggaaaaatgtttcatcatttcaacaaaagtgtttcaatcaaatgcaatcgaaacatatcatttgcaagatgaagaatcaatatatgcaacatcgaatcaaaacaaaatgaaacaccttaatacaaaaaagtgcaacacaaagctaaacccacctctatcttatttttcaactccggtcgccgcccccggacgattagttgcacaaagtgggcgacctcagctaggactagccgcaacagcatcaaccccccatcggtggccatgtccagtgccatcgctaccgtgtcgctgggatgacgctaagtttttgtgtgggcaccagctgcaaggctgttggtatttcttaacgacattactagaaatataattcccagcaatggcgcataaatactcctggtatattatggttacagagttcatccgcaagcgcatagatataccattataacatttcacccgagagtactccaagggtatcgtatttatttaatcctgtgggaagatcatagtagagagaaccgtactaacaatttatatgttacttgtaataatcagtctaagcaggggttaagataaatcaaagggtagagtgacacacaagcatggagctactcgttctcatactaaaatatctaagctaagtggaaagaaaatagaaagagaatctactcctatacttctagtatacatattatacacacactctagttatatgattatctagctaataccctctatccgatgccctcctggtacttcaagaagccacccctggttgccgagttccttacaacagcccgtcatgaccatacaaccggggctaaatacggaggagtaccctccccaggaaattaacttatgattatatacacgcgcggagtaatacccatactaagctatcaccatcagcggcccacctctcatccacagcatataaccccaaataatgatatcccgtaatctagacaccacgcctaaactaccagatactactctaatatcatcatcatgacatagagtaattgcataagtaaacattatacccgtacctatgcatctcctagataagctagcagtataatcagtataacatgaatataatgtaaagttggtattcatatacttggaaagtatttcaatactagaaatgtataaagaagagtattctaaataaagtacaaaggttacaaaagaggaaatgaaagctactagagccatacccgaactcttccggactctgatttctattctattcctactcctctagcttaagaacactaaactaaatttgagagaatatgagagagctttgcttggagtgtgtgagtgaagtaagaaggtgaagtccttatatagaggtaggtatgaaggttgtgggaggggaaatgtccgaagtgccctccaaccatcattgggatgcaatcctggacgtccacgccaaaccctgacatcaacggtttagatgggggttcggccgaaccccctggttcggccgaaccatgggctggcccaatccagcccattttcggctggtgacctcctggactttttctctttacagacttgtgaattttggcccaattgatcatgacatttctaagttgtcggcccattctacataagtctaattctcgacatcgtccaattgatttatcgtttgatttgatgtcgattctccttcactttataattattctatgcaaaaaggttagtaaacctaatactagtggaatattattattctaacacaaatatgcattgcaagcataactagttctcctctattttggtaatattgacggtcgaaattgatcgccaatgaccgtcaacaaaggctagccacatgtcaaggatgtagaggccaaatcggtcgacgaggccgtccgccgccaggtcgatgctgatgagtgccttgcagaggaagcggaagatgcactactggagcgggataaggtagctggtggaggccggctgggtcagtcgccttgtcttcctcgacggcggcgcggagctcggtggcccagttgtgtgcggcacgatgaggaggttggtgctgaaggccttggtgcgcgtgtggtcaggctcctaggtatcgtggtagacaccgatgtgggtgccttgggtgaaggcgacgttgggaacgcatgggctgatgaggacgtcgcacttgtcgatgagcgtcgggtcaaagagcatgtgaaggcagcggtgccgaaggcggtgggtcaacgccgagaaagaaaaggaaggtgctcgggatagagataggagggagagatggaggagtttgcgtgagaggataaagttgatgtgtgcggtggataaatgctgactcgagacgcgtcgtccgatattaactcagcgtaagacgatcgatcataagcattttcgtttaaattagggttggcaactgggcaggtgggggtgggttagataggaacaaccctgccttcgatcctcgatttctccacctggccccggcctctaagcgacgaacatggcaaaatagccccctaccatgcccctgatacccgacgtcttactagggcctcgcatggtcagctggcctattgagaagactcagaattgggtggcttgggttgcagtgagaaggttccctatggacagtgacaacgaagaaggccaatgagtgttggtgccgcaagatggtgtaggccacctagatgcgtcgggccatcggcaaggagcagctcgtggtgctcctacatcgatgacgtcggccgctaagatgtgctagtgtgaggtcgcaaaaggagagtgaggataggtagagtagaggaggcagtggtatagggcaaggcgagacgggataggcggttgtggctaggccggggtcggccgatccctggctagctcccctggctgtggcctttctcctaggccttggcaaaatactccttggcccagtggtgtattgattgggcacaatttttggtattcgatgagtttgtgagcccaagactcaatgggtgaaattatccttcattttctatatgtatttcgtctcaactttggtagtttgtcacctg

SEQ ID NO: 77328 - DNA, 738 bp, Oryza sativa
ccactcgcgggatccgccgccggtggacgccatcgccgcccctgctcacccctgctcacggccgccggcacatgctcttggagaggagagaaagagagagagacaggggaggagagaaagagagagaggggagagtaaaataatagagggggagagatagaggagatgggttgcaaaaaaaaatttgaaatcgtgggagggaaaagagagtggagggagataaaaaaaaatagggtggcatttttgcatgcggtcctcttaaggggccgcatgcaaaaatatgagaaatttgaatcgaattttatggtactaaatcacaattcatgtgaaaaaattgtcaaaaacaaagttatagaattcattgagatctaccaattttcttttggttatttctccatccgagattgattgaactatctaaaatttaaattttaaaatataagaaatttaaacaattttttgggtagtaaatgatttcaaatgaaaaaattatcaataacaaagttgtataacttatcaagatctacaactttcgttttgaacatttttctatatgactctgtttcaacaatttgaatttgaatttcaaattaggactacttcaaacaagattttgaaataataaatgatttcagctgaaaaagtcatcaacaacaaagttatataactcatcaagatctttaacttttattttagtcatttcttcatccgacaaagtgataataacatagttcacaa

SEQ ID NO: 77329 - DNA, 638 bp, Oryza sativa
tgtcattccttcgtgaaggtggctgcttgacatccccaggtcatcatttatattcaattgtttcaggaataacaaatagcttcagatgtagtatgattcttcctgcctgataggtggtatgccattgatgtactgcttgttcatatacactcaatttttttccatatacagtcaattgatgcaagcatgccctcaaatcgattgcaccatcctgattcttagagtttgcgtgccctaaaaaattgattgtatattctttagtcatacaggttgattcttccggtcatgggagttggttcccaagtaaattgctcattacatttttacatacaccatctttgcaggtgagatatgtggggtgcagcattgctggtgattcaagattagaaagactaaaatgaacaagaggccgcttaagaaataccatagaacaaccaaagacagaacaatagagtgaagacatgctgctttctgaaggaatttattctgggagctatgtgtgtggaagtagttagttttgcctgatgtatgtagtctttctttgtaatatgtactatgtatagcctgtacatggttaagagtttgcaaggattgtagtccagatgctataaatttgaaacccatttttttggttcaaa

SEQ ID NO: 77330 - DNA, 3522 bp, Oryza sativa
ctttttcgcttcttttcttttcttttcttttcttttctttaaaagtgcttgatttaaatattgatttgaaaggtacaaaaattttactaaaaaatgcttgatcaaagtggtcatattttcttttcttttcattgaaaggtaccaaagcacgttttgaagtgttaggacataagcgggcatgtgcgcagcgcagtggccttcgagcaatgcctacatattgtccaggtgccagagtgccggcatgtcacgccctgaaaaaaaggaaaaaatgtctcttgaaaaatggagtattgacaacgaagcacatcttttattcagatcaatacttcagcagaacaatggttcccaatacaagtgcatcgatcgttctgaaattaaagcaacagcgaactgtcgtccataaaagaagttcacgacactccgacccactttcaaaaactggaaccacaataatcggattttcgaggtcttctcgaccatttatgaactaatgccaagctgagtgcgccaatcctcgagctgtttttttacttgctccgagcctgtagagccgtaagatatgaacttgtttacggcgttctccactcccagatactcgtacacatcgccctcaaaaacggggtgaacagatttcaggtcgtctagtccaagttcggcgagctgacagttcttcgagacgcatagagctacagaccttccaactatctcgtgcgaggttctgaacggcacgccctgaaaagcaaataaataaactagaataaataatctgattgtagtacaacagcatagcacctattataagattaaggagaacgtgagcggtgagccctagtgtgtgtgtgaatgtgtgtgtgtgtgtgtgttttgaacgaacaataatttttttttactgaggttacaaaaataggttttgatgtagttcagagttgatttatagactttcagatagtttgggttgtaaatgaactttacaagctatgggagaagcttaccttcttcacaagataatctgctagtgttgttgcatccaaatagccagcaggcagcgaactttgtattctttttgagttgaaggagatattttgagcaaactcggtacatacttcaagcattcctaatacagccttcacgctgtcaaacaagggttccttgtcttcctgctcaaaacgaaatattgagagcatgcaatgacataacatcagcatgaataacttgtacgaaggataatcacctgtaaatcacggttgtaggcctgcggaagtcctttacaaagggtgaggacagtcatgagatctccaaaaacacgagcagatttgccacgaacaagctccattggatctggatttttcttctgtggcataatgctgcttccagttgaaacagagtcacttggtgtgaggaatccaaactcctctgatgcccataagacccactcttcaccaattcgtgaaagatgaacagcagcaattgaattggcagcaagaaattccaatacaaagtcgcggtctgatactgcatcaatactgtacaaggaaaagtttccagattaagtgaggaagggcttatcatatgtcaaaagtgaggtaaccaacaaagaggaaagccaaaaattatgtttcagagtttgctttacaaaggcatagcatacatgacaaatcacagtggagattccagcggagaaaataggtaattcatctacacatgtgctatgtgagaagacatacttatttgagcagagattacttatttgagcagaaatgaagagcaagtatttgctgtgtgttaactttgacataggtgatataggtcaaactactaaaataccatagaaatcatgcaatgtgactgaaactttttaaagttcacagtactaaaacaaactggggatttacctgttcttcattggagctgtaaacttcaaatctttagcagttttgaacctatcgataggaagtccagtaccagccaaagcacaagcaccaagaggacagaaattcaaccgttccctgcagttgaccagccgtccagcatcacgctccaactgtgcaaagtacataaataagcggtcaagttcattgatggcttgttctcaaagaagtaagctttatcagatcatgtagtgtttgaagcactattatatccccgcacagggaatacaggaagtacttgtctataggctactcattgtgtcatactggcatgatatgccagctaattcaacaaataaagctggagttgctgaagtttattaaacaaaggagattgtagcttaagtaacacaaacatgtactgcagtttctttatattccagatttaataacttttttgtgaacagtatatagaccgttgatatatcagcattggcgagtagaggcaagcctgaaaatcatgtaaattttggcattgtactggcattggtggaacgaacaaagagagagagagagagagagagattcaccacataaattaaggagttgaatgttttggcacaaaatgttcattttatctacataagaggcatcatttttctatttcacaaaaaaaaagagagagattcaccacataaattgtccaaatcatcttttgatcagaacttgggataaagtagattatttgattaacatacatagtggagagaggattcaaccattcaggtttgttaacacaataaccaacatatgtaatcataggaaataagtctaaaaaaactgcatgggattgacatttgacacgcattgacaatccctggattacaccaagaaaactaacattaaaaaacccaatgggcatgaacggtatcagggaagggtgcataagaaaattcacctgttcaacatatgataagaggagatgtggaagcaaaacaggctgtgccctttgcaggtgagtgtaaccaggaactattaagtcaacatattttgaagctaacagaacaagagacacctgaaataatgtaaagtggtgttagaaaagtgaaaaacatccaatttagacttttatcagaaaaaaagagagagagagaaaccagtgttaatatttacaaaatggagttgcaataatcaaccatatttcatgttatacataatagtgaggcatttctgcacatcaagaactgcttaatcaaaaaaagtttgcatctggaagtgcttaataagtcgttcagtatggatgccagcagcatggctattagataattttctagtatagtaagtcaaccatatttccttgaaggcttgaggcaaaacttaagatatgtcaatctaatctcttgctccagcctttatatagtgaaagaaaggaagcatatgctctggttctcttcagaaaccattgccccagactcagcactacagtagaatcaacacttaaagctttcaacttaactagtttacctgaatgattgcttaggtataccatgaccaaaaagttttataaatggttcatgcaataagaatccataattttcactatgggttgataattttcatcaagtgttggatcaagcagaaagaattgtattgc

SEQ ID NO: 77331 - DNA, 2624 bp, Oryza sativa
tcaaccaaactttcaattttaatatgaactaaacacagcctcaatggaatatactaaatgaaattgaaattttatagtcctcccagtctcccatgctactgacgcaagatgtcaaagcacctttctgtctcaaagtgctgagtctgttcctgacacttccaaatccacagctccatcgagctgtctgattcccatgtcgtcggaaggaacagttgccaatgatatcccaccgtccgattcgtgccacgtgtcgtacgcttcatgtatacttgtacatcagactgtatattcatgttagcatgtatgatgtatacgtatctctatgccattcatgccttgcttgaagtatggaccaaggtttgcaacagcagatcagcagagcagagagaaaagaactggtctgaaaaattttgcctttttgccatgaacaatgatgctgtctcatgacactgtattagtactccaagatgcataatcttttttgcctttttttagatcttggtgaaatggtgatcggtgagtgctgtactactactagtctctggaaggaagaacacatcatcaacctggcattgacaagagtgattatctatcagtgacactgaagagagaggcagaactggcaatggcgtgcgtggtgactataatcatatcccatgcatgtgtagtgttgcctgcgccttcttgatgatggccattcgttttcagttcatcatcgatctagtgcttcacccatgtcctttgctttgacacatctttgtgcacaatggtattgtttatctcaacaacttgggggattgcagaaggtcaattgattaaattaactgttgctacttggtatctgttctgaattctgactgaaaacaggtattgctcttctcttgtctctccgtttcagggagggtgcagcaatttatgaaattgagatgagagaaataacaacagagaatgttgtagcttactcttctgtttctgttttccaatatacttttacagggggagaagggatagatctcattactctgcttaaagatatgtaggcctgaatcattctgaataacagtgctacctgattatttcctacctgaactttcagaaagtccctctatgtaatgtagcacttgacccctgcatatcacacacaatagaatcatcaatgaaacacaagcacacatgtacacaatgcaatagtgttcatgtccaccctataaatatattgacaaatgacagctgatctaagcacctggaaatgctgtcttgcacaacagaaattacttcattgattgatatccccagtctgaataaactaaaccagatcaaaatgctgataaatctagctcttattcctgctgtttttgagattcattttacttttagtccatgcatgaaaaaaaggcatgctacagagacctgttactttcagacttcagtgctggaaattacttaaaaggtgtaccagacttttgtctgtcctgatagctgctcatgcttaatgtttctttcctgcaattgtgcagtactactgctagctattgctcgctggcctaccattaattagtatactgtcctatcccctaactaagccaaataagcaaaggtttataagtagtgttcattgttaatagtcagcgtggttctcggtatacgcaccggcttatggtaattagtacttaaccacaagtgtcaatcatgtcaatccctgctcaattgttccataagcctaccatattttacagatcaatattactctgcaccatcacacagtgttgttgattgcacttgcatgaactgcacaaagttattacacacacaacattacaagctaatgcaaattccacgcaactacgtttaattaactgcacatgttgaataacaatcctgtcattcaatggatcaaaactagcatgacaatgacagtgctctgcttctataacctctcttgtttacttaagctcaaagattcagacagttcaggcagtttgcagaaggccacaaaatttgaccatggttaatcaatcaatcagttaattacacaattactcacatgtatgcatgggccgaccaggatggcattggcattggcatgcatccatgagcagcaatgcagcatcattggaggggatgcagccaccatcatgacaacacataattctcacagcctaaatcgcaacacctttccttgcaaccaaagccaaccttctagctagctagctaatctaagctatagtgtgttgttgtgaagtggagtactagctagctaccactctatcttcttcttcttctacctcctcctttatatcttgcccctcacatgcacgcatgcctctccatctccattgccgtcctagctagctagctaagctagtacactagctaggccatggcatggtggtgatcaagaaagcgagagaggtggagcggcaatggcgggcgggtgcaaggcggcgatcgggtgcgtggacgcgcgtgtgccggtgagggcgagctacgtgagcctgtacaagtggccggagtcggacgcggagttcgtcaggtcggtggccatggcgcggcgccacggcggcgaggcggcggcggcagcgccaacgacggagagccccgtgtgctgcaccactactactaca

SEQ ID NO: 77332 - DNA, 2305 bp, Oryza sativa
ccgttatcaaaccctgcattgcaaatgattccccaatgtgaatcaaggtcgacagcacattggtacaattagcatctacaaagtgcaaaaaaagaattagaggcaggtgtttcatcaagcatctgattaacatactgacaaactctaaaccctttgatgaaacactaagaactaagaaagttagatttagaaacttgcagacacatctcaagcattacagtggagctagcaatttcatcgaacacatggcgagcgcattagcagcggattaaccccagactaaaactccccaaaacggcttagccgcagctctccagcgcaggcatgattagccgaacacctaggtggatcgcactaccaccaccaccaacagagacaacgaagcagatgggcacggtggaggcgcgcgcacacagtacctgcgcggcgagcatggatgcgtgggccttgctgcccatgatgtcgtacttgtagagctgccagtcgtaggagatggactcggtgaacccttccacggcgtcggtgacgccctcctcgaatcgcccgccccacagcttggtctccttcctctcctcgctctccgaggacgccatcgatgtggacgccgcggcgacggacgggaaggcggggcggcggccgcggagggacacggacccgccggcggggaaggggaggatcctcgggcggagaagggggttgggcgccggcgagaggaaggattgggaggtggcggcggccataagtatcgtcgccgagggtgtccgcttcgcccacgactgtggcgcggcggcgcggcggggaggagggagtagttggtgacggactatggtcttcggctacggtgagtgtgtgtgtcctctcagaactttgtttggacggtccttttagtccgagtccgtgcaatgtggatgggccggaattaaggcccaaccaaataagacccggaataattagggtacccaaatctatttttaactcgtgtatgtatattagtgctagtgctaattaatttggacactgtaacggcaagtgcaacagtgaagtccgatatggaccctaaggagaagaaatataacaccattgtacaatccggtcttcaatatgaatcagatgaagttcttgtgaagagtcaacttgatcgagatagttttcgggggtagagttattttctaatgtggattgtataatatttacactgtaccataatttggggaagcttttaggcacaagaagcataaaggagctagtgactctatggactaatttaaaagctcagactgtaaagcgtaattaattactccctccgtttgttttgacttttcttcttagttaaatcattttaattttgatcaagttcataaaaattgtataataatatttttaacccaaaacaaacgagtattaaaacatatttaattttatatttaataaagtaatttcacgtggtagagattattattactagatttttaaaaaactttgttaaatctaaagaagttttactataaaagattaaaatgacttatattacagaatgaagatagtagaaaccataatttggggaaagtttttttaaaaagtagcctctttccagtaaacagcctgatggatggtgtaacatccataacttaccgtctcagccagcatgacagcgtggacgcggctgcaggcaatgtcgtgcgcccacaattcatcagcctctcccgccaccggaggcccggtgaaccgctcgccggccttgcccttcaccgcgttgccgttaagccacacccttgtcggctcggtggccttcactaccgccggcttccgtttcgacgacaccgtaagctgctgtggcggatcgttggcataatccagcgacgacttcaccgacgactccgcggagacgtcggccgagctgccgaccatctcgatgagcccgacgtcgtgcgctgacagccgctcgccggtggccacctcgacgatctccaggccctccacctgcttcggctgctgccactgcggcgggaacggcgacggagctgaggctgagctcgtcgagtgcttgcccggcctcggcgtcaccggtattatccggttgggcgtcgccggagaattagtgcgcccgtcctcggtcaccgcgggtgaaggcggctgtgtcgcggagggcgtcgccgcttgcgtcttctcgggcgtcgacggggagtgcggcggatgcgtcaccaacgacggcgccggcgtgagcgcctggcgccgcgcgaccacggcggcggcgttggccttccgctccttgttcttcttgccgcggaagcacgacctgatggac

SEQ ID NO: 77333 - DNA, 1049 bp, Oryza sativa
agaaaatccgccatagaagaaatgagcaaataccacgatttcgtgtgtgtcgggggtcgggaatgcttcgccgaacgccggtcgccacccgataatctccttcgctgggagaacgccgtgcgccaccatctccttcagattatcttctgtcacatcggagggcgcccactgactctcgaagctttctctttcttccgccatgaatgtgaactggatggtttaatttggtctgagatatggctggagaggaatggggaatcggagcggtggacgcggggagaaatttcgcgaagtttttgagggtgggttggagcagattgatgaaccctagcttcgtcggcgtggttctatactgtagcacggagtggggaatggcgagagtctcggcggggaagacgaaacgacgtttggacttcggtgtttttagggtatcggaagtactaatgggcctgggcctatacagtacttcagcccaattatgttttcagcgtggcccattgtgatccctagggacttaggcgctttttgctttggcaatatgtgctcataatgatgtggcccgatgctattaaaatcctttttaacgcgattcaataattctttggaattattatgatgcatatgaaaaggtgcccgatagaaaggtgttataccatttttgtaagcttttttaggctgcaaaagctgtttgggttgatttgagatgactgatttattaatagccattcttttagcatgttatatgcttattttggttatggtaagggtcacagcctaggctattagagtcattaattaccatgattttctatcatgtttggtggatcattttatgagatttttactcagatttctatcgaacatgtctatttctggacctttgagtgtttatcactcggcccttcttgtattttttgtccttgataagttcaagttgagaaacagtcggctgggtatcttactaagtaccatgcgggcttcgctataaaaccactcggttcttgactatatgtttagtttttcaactaatcacatagtcgggggctaca

SEQ ID NO: 77334 - DNA, 13435 bp, Oryza sativa
tccgtgctcgacgcctccggtacgtacgtgcgcgcgccatgtcgctcgtacattcccctttccccccttctttcgccggcgttgtttgacagacctgtactagctatggtaggctacgtgttctccgacgaggtggcccccgccattgacgggtacagcaaggaggtggcggaggcggtggtggagaaggcgcagaagctctgcacgctctacggcaaggtcggtgacattccaacgctccacgagaggcaattcgggattcgaccacccattgatcgaatttagcgtggcgatttggtgcttgcaggaggtcggtggcgacggtgaggctggccataagatgaaggtggaggtgaaggtggcggtcggcgacgccaggaacgtcatctgccagatggcggacaagctcggcgccgacgtgctggtgatggggagccatggctatggcctgttcaagaggtcactgaaacgatctcgttttcaatctcagaagctgtgagagcgcagcttatctgctttgcatatcatctgcttcaatcagctcgcgctctcggtgacgatgatgtttagcttaattacgctatatatgctcgttgattttgcagggctctgcttggaagtgtcagtgattactgcgtcaggaacgccaactgtccagttctcatcgtcaagtcgtagctgccactcactccagtgcttgtaactgtgcagcagcatgtgtgctctgtccggcttttttttttgtttttgccttgtgttctgctttgtatgtctactttagttcgcttcgcatgtaatctgccggaagaggacgtgctgagtgattactcagaactctgaagttatccagcaacctgtatatagaagaactactttctgtggagatggcaaatttagtttttctgtcatcggcttccacttttagcactgatttctgaatttggctgtataattagcaaatacccagggtttgctttgatctattcgcgctaaccattgcgcagaaattcagaactcctttataaacaaatctctaagagagagaattactagcgtttcttatatttgacccaatttcatctgcgatcctcttttgtgcagttgcttttgttcctctttcttccggtgtgtatcactatctatcttgggcctcgacattataaattgggaaaaagtttatttttggttctcaacttgctgtcaagtttatattacatcctcgaaatcacaataacacgttaacagatactccctccgtctctaaatatttaacgccgttgacttttataaacatgtttaatcgcatgtttaatcttttgttttattcaaacatgtaaataaataaataaataaatatatatatatatataacagagaatttaaattttttaataagacaacggtaaaaaaaacatgctaattttaaacatgtttaaaaaattaacggcgtcaaatatttagaaacggagggagtataacgtatcccttgactagcataaccggtgttcccgagatctcaggcaatatagtgtcgtgttttagctaacgtgatgagcgggatccacatgggtctcacatgttaggggctattagggctatttttttcctccaacccctaggggcgtacctatgtgtagtttataggtgtcctagaaccctgggtagattatccaattatagttaactagcatagtggcccgcgcagattgcacagctagcatcattataatttcccatataatatcatatatattttttctcattatattgttcaaatatattacattaacatcataattttaaattttacaataactttacgaaactacaaatgtgtaatattcatattgtattttatatacgtgttagttattaattattttaatatcaaattttagttatttgtaaattatatattctcatatatctactctagactcgtcgtttaatattcttttttttaattccgaattttatgtaagttgtatttctatatagactctaggcttttcttccaatattatttatttttatttctaaatttttattatttttaaatgtatttctatgtgaactctaaattcatctctcaatattctttaatttttaatttcgaatttcagttacttctaaattgtattcctatattgactttaaactcttcttcccatatttttcttaattttgaattttagctatttgtaaattgtatttttatacggactcaaaactctactattaattttattatgtttattctgaatttcagttagttttaaattgctatatggactctatactctacttctaatattccttatttttaattccgaatttcagttatttcctaattgtatttctatatggactctagtctcctcttctaatattccttattttttaattctgaatttcagctatttctaaattgtatttctatatggactctgtttttttctttttctccgattaatgtgagaatttctaggctatgagagcgaacatgaaggctctttttttattactttaataatataatatatttatgccatgcgaatcagtataatcagttaataattaaataattagtatgtttgggaccttcgataaattttattctggtgcaccactaccaacctctcctctctctctctctccatctccaaagcttatggtcggggaaccaccggcggcagcagggtcccatgcagcctccatcgaattagcagttgccgccattggtgaaaggggaggcgagaagggagcttggcttggagtcccaaatcaaccactggttcactgttgtaggagactaggggaagagagaagaaggaggtggtggcgaagtagcagcacgccaacggccgtcagtggagctcagcgtcgttgctacagtcaatggatctcgactggagaggggaacggggagacgggacgacagtgagggcgcttcagtcggtgggtggacccaggtggagggtctccgctgtcaccgccacgctcacggcgctcgggccgtgtttagttattttcaaaatttcttttaaaatatacggacacacatttaaattattaaatatagactaatagaaaacaaattacaaacttcgcttgtaaactgcgagacaaatttattaagcttaattaatccgtcattagcaaatgtttaccgtagcaacacattatcaaatcatgtcgtaattaggctcaaaagattcatctcgcaatttacatgcaaaatgtgcaattggttttcttcatccacatttaatatgctccatacatatgtccaaacatttaatgtgacggaatttttgaaagtttgaaaatatgagggacccaatgtgtcaaataaaaacgagggacccaatgtgaacttattactactacaatttgcaagcgaccaagcgtaagtttggggccgtttggctatcgaataaattcattttatgtaccttaattttacaccgaatcctattttcgtcattgaaccccaaaaccagatacaaccggtacccgaactatcaaaactggtgcaaaacaggtccctctgcagttttgaaggctgttttggctgatacggcgcctacgtggctggtttgactaggtctccatcccacgtggcattgacatggcaattatatctcggaaaaataataaaaatcgtaggcccacatgtcagccacacaaacaaataattaaaaacggtgggtcacacatgtaacctacacaaaaaaaaatatggcgcgcccccgttggccccacatgtcattctcaaatgaccaaatccaatcctcttcttcctcctttctctggctctccccatctctctgctccctccttgccaagcggcggggcgacggacagcgcgtggccggtggcgggcaacgacgcgtgtggcggcgcgcgtggcggctgggccccctgtgtggcatgtgaaggcggctcgttttctttctatagctcttttgagacaacttggtgagtgctcgtgagctactacggccatggctgtgatgtgttgtactactgtcgtcatcaagctgaacgctgaagaggagaggcgtcctgctactagcggccgttcgagtgggagaggctagcgaccgtcggcgggaaagcccagtgggagtgacgggctctcggaggttggtgggtagaggcccgcagcggccccttcatcttcccctcgccgccgtaaccgcgcgctgccgtcggcgtcgggtcgtctcgatctgtgcgtacatcttggaggtgaggacgatgacgacgccgtggcttcctgattcggcacaaatctcagaccatgtcgccgccgcccctcctcccgtgcttctagtcccatcttgaccttgggcagcggcggcggatcctgctcaccgctttacacttcaacatgacgctcatgatgacaccgccacccaggcaaagcaccttcggccgcggcgaaatcggcccagcgctgtgacgggagcgccttcagctctaccttcgtcggcatgctgcggcttgacgaggaagaagagggagaaccgagtggagagaaggagatgacatgtggggcccacgtgggacccaccatatttatttatttatttgtgtagcttacatgtaggtcctaccatttttaaattatttttttgtgtggctgacatgtgggcccacatttattattatttttccgagatataattgccacgtcaatgccacgtgagatggagacctagtcaaactagccacgtagacgccacgtcagctaaaaccgccgagggacctcttttgcacctgttttgacaattcggggaccggttttatctggttttggggttcaaggacgaaaattggatttggtgtaaaattaagggacctcatatgaacttattcctttggctattgttgagttattgtcgtgggcttttattcattgaagaaagaagttcctgtgaacttgactcgtggcctgcaggcctcaggttcgtagcgttcggtcatcactgtgaaatggctctccttcaaaacggtttgggccctggttgtgttattgcgctgccgatccatactcaatgctctcatacttgggctgtaacgatgactggatgacctattattgacttgttcctagcaaagtttgatttattctccgtgtttttttttacttcgacgtaatggcgttctaaagtccgaattttgctatgctccgaaactctgaagtttgaaattagcatttactgctacatccgggcgtctttgagtttgacatttcaaaaccagcagcatcggtgatcgttccgatctaattgtcggcgactgttccgccaaggtcaacttgccagaaatcccagtcaatccaattggcgatgttaattacgagttaagtgggttcgttgtcggtcggtgctgaactttgcacgtcttctctgtacatgcgcgtttgaatttttcaagttcagacgttcatttcgccttcgccaacttgggaagaagtagattcttaatcgagcatagacatgtacatatgtattgcaaacattgctcctttggatatgaacaatagatcacgcctaaacactggccaatcatttcgttgttaggttgcaactaacgccagaatctccgcaatatcgtgttgctctaagataatgccagtaaattttatttcgagtttttagatgattacatgtatacctgacccgtcaactaattcatgcgagtatgcaacacaacagtatcgcttgagcaataagcgaactgtccctttcagacaggagagtttaaaaaaggaacgagctttattaggcttcagaccaaaccgtaggttggttcgactggcaatggcagtgcttaattagattagaagttccggctggtccaagtagtattagattagattataataggatcagaacaatgtatctcggcaaaacgaagcttcgtacttcggtttggttatttggtacacatccctctccaaatcaaccgaaactatcattccatcgacagtcactaaggaagcaatttggccaggctcaactcctacgcaaaattcttcctttctttgccctcactggaccatgcagagccatgagattctggaagaaatgttgtcaaatttggtgggatttctcttcattctttttgttattcttgtgggcaggtgatgccgatggattgtaacactgttgccttcccattttggacatggtgatggagctaattattgttccatgtatcttctgagcaatcataaactgtaaagatttcataatgtagtagacagcatgatcgtcaggataattggcaacatctagtttctgacaaggatacgattcgtttaggtgcagccaagacttggatggatgtattcctcttgcatggttttccatgaattgcaggtaatattcaaagactgttaggacatgggagttcagattacagagtaaggtttacataaagtagggttggcaaagactgtactttgcagcaatgaagtttgcagttagaagcatggcagtttggtaccagtttcatcggatgcaaatatgttgaactcgccatcacggtagggctagcattttcttagctgtagtccacaaaattccaaattctttctgcccaatttatggtctcaacagtatcttcgtccggtcacaattcatttgatctgaaaatctgtaccgtgcaggaagaccgttttcatcgatacaacgaacaaactgaacatcataaatattgcagctattcattttttgacgaaatgatacaaaatatttttttcgcgaacgcgaaatgatacaaaatacgcgtgattagctgaacccagctatgacctgctccttttgatttgtcaaatgcaaaaatccagggcgcactagctttcgtgagagcacgcacaggaagatctcgtcagatgcaggacacacgcctgaaaaattattgtacgaactgctaaacatcaactgaaacatccaaaaccccaacaggagagaaattttggaatacttcgattatcttccaagcaatattttgtatgaagaggagtggagccccaacgacaaaatggtcgcacgtcaccgtcggcgctgagacaaaaagtacgcatgcgaactcactactactaccattttgccaaccaaaccaattaacccattcttaaacactgtccatttctaacccgctatagctatcactcttttccctttcattaattttgtaattatctccttctcctgccacttccctgtctctttttccccaacctgtagctgtagctgttaccccgcctgttacggccggaaacccagtgtgcacacgctgcaaccgtgccaattttgtcacgaaccttccaaaaaaacgtaaatttgggcgtcgtttctgcgtacagtgacattttacagaaggtgttctttccgtgcgagttcagtgcgttcagagaagagacggcacgagtgattcacaaattttgacgatttgtccatttggaaaaactaattttacaaataaatcgtgaccaaaacttatttcagaaatgataatttttttcagcgccaaatcatatggcactgaacttatacatctcagcgccacatcaactggcgctgaatgccgtgccaccacagatgggaggctgagtcggcgtgccaatgtgcattcagcgcgatgctatttggcgctgagacgtctaagttcagcgccatacgatttggcgctaataggggtgaaaacggtcacggaaattaccgatcgaccgggcgttgtttccgtttaaggggtaccgttttcgaccgtaccgtttttggctatttttaaattttattttttctaatttctttcagcatcgtattaatgtcgatattaagtagtttaaatgataaatatggtcaattaccggttgatcgagcatcgtttccgaagagatgctactgattctgaccgtttctgatcatttttatccctaggcgtcgaaaaaaaaagtcatttttaaaataagttttgaccacagttcatctataaaattagtttttgtaaagggttaaattatcaaaattttgcgagtgattagtgaacggtgcaacgcgtcaaggacgagtcaacgcgccaacgacctcacgggaggagcagttcggttcaaaccgaacccgccatttttcttctcatcgtctccaccgcgcgcgccacaactaaacccctcgacactttttttttttttgtcgccgagtattcgtcgtccccgacgaccacgaaaaaccgctaggaaaacatatttgggtttcttgatccatccgattcccgatcccaccaccacccgccgctttaataccctcctgcccatccacccctcttcccggcccctcgccgcgccattagcggaaggttttgctttgcgtcatccaggatgggcaatctgatctcgtcgggcgcggtggtgggcgcgagcggcggagggaaggtggtgatggcggacgggagcgtgcgggcgctcagcgagccggtgtcggtggcggagctgatgatggaccacccgcgccacttcgtcatcgacgcgcgcgacctgcagcagcagcggcggcacaaggggaaagctggggctcctcctcctccagggggcaaggtcgcgccgctgccggccgaccacgtgctgggcgccggcggggtgtacgtcctgctgccggccaccacccgcggcaaggtgtcggccgaggaggcgcgccgcgcgctgacggcgtcccggtcgctcgagcggtcgcggtcaatgccgggccggctgaggaggaagctgtcgtccaagaagatgacccaggaggctgacaacgacggcaatgcgtccgagaaccacgcggcggcggcggaggcggagaggagggaggagacggcggcggcggcgaggccgccgccggcggacgggttcgaggagcaccggccggagttcctgagcagggagctgtcgagcagagggtggaagccgagcctgatcaccatcgaggagcgcgtagcgccgaagaaggtgtcccattggctcttctgagttctgacctcgtcgccgacgacgacgagatcaacaggaagcttcttaatttgacttgtcatctaatctctctttcttctctttttcttctttcttgctgatcctctgctgaatgcttgtcaattgtcatcatctagtccgtcaaaatgcatgcactgatgtacgcataatggcatgttgtaatgagatagcacaaatgaaatgtgcactgtaattacaaactttaattagtaggtgtttggaggctgcgtctgaaaatagctcaaattgaactggataaacctctctgtatccatattctcttctttctcttttcccccttttctgctatccacagctctatatcctccttgtctaaataagggtaccattaactctacattaaacgtacagccctgataaaaaccttcactaaactgaaaaaagaaatacagagcatatgccccggttcgttcgctaaggagttcaagtgtacttgcacctgaattacgcctaacacaactgcaacactgtcgcaacaatcgagatggtcagtaataagaaaaaagagaaaagacaacgtaaagatggagcaggatagtacattgtacagactagcgactaccgagagacagaccgaacaggacaaaaccacaacgttgtgcagaattttgccacggctttggaacactggattgttgttggccgttgccgtcgtgcttgcgtccaatgtactgtctcgacgagtagagtagagactggagaggcatacagctgtaggcctgtagcctgcagccaaatactttctctatcctaaaatattctccatttagcgggtgtttagatctaccggtaattttttttctcacatcgaacatttgagcacatacattgagtattaaatattaaaaaaaactaattatatagtttgcgtgtaaattgcgagacgaatcttttaagcctaattgtgccatgatttgataatgtggtgctacagtaaacatttgctaatgacgaattaattaggcttaataaatttgtctcgtggtttacaggcggattctgtaatttgttttgttattagactacgtttaatactttaaatgtgtgttcgtatatccgatgttacacgtcaaaactttacacccatggaactaaacacagtcttataattgaatgcaacgtaatatagtatactacgaatctgaacgggctgtttatagtatagaatatatcacatttaattttacgttattttaagataaatggaatatgcaatgcatgataggataggataagcgggcactgggcaagcgccaaacatggtgcccacggaattggcctccgcttctcgtttcgagcggaagggcgcccacgggctcggaatccagctgtggcaacagagaacggcccacgcctattcaagctgccgacatggtcacatcaggcatgcaccctggaccctggttcgacatgggccatgtgatgagctacgtggaggcccgcacgacggtaatttcgcaacctggcctgcttaccagctctgacatactcctatgcagatgctactctaaaaaaaaaaacaaaaaactcctatgcagatgataatgtttcatgattgtgtttcgaaaggaaaaaaaaatgtttcatgactggattggagggaatatacgatactacgagttctatcacatgtactctttttttaaaaaaaatcgttttgacgacaaattgttttattttagctgcatgtttagaatgcaggaattttgtaaagaaacattttttgcatgacaaaaatactgcccgtccgcgtggcatccgcatttgatgcaatgaaccaggacaagggtgttcaagatgtcagtggacacaacttgctgccgcttgcatcagcacttacctcacattcatatggcgccaggtcatcatcggcgtccatgtgccatcagaacaaatcagcgattataatcaggtccgacaaaatgaaaacaaaatgataaaaaagaagctactgctgcactacaacgctaatctgggcataggacacaatagtattaccaacataatcatacctcatctttaaattttaagacgaaagatgtactccctccatcttaaaaaaaaaactaaacacataaaataataatcccttcgttttttaatagatgacgccgttaacttttggatacatgtttgatcattcgtcttatttaaaaattttatgcaaatgcataagatatgaatcatttttaaagtatttttagtgataaaacaacttacaataaaataaattgtaattatgtaaatttttttaataacacgaatgatcaaacgtgtgtacaaaagtcaacagcatcatctattaaaaaatagaggtagtatatgatctaccctagtaaaacaaatttagatccagatttattatactaacattctattttaggtttggttttttctaatggagggagtaggttcataggcttaattggttgctcaccaagatttggcaaaataaaaagggctaaacataagtgtccttaccaaaaattttaactgtaaatcaagcacatatgcttcaccataatgtcgacctaccagcaggtttcccaaatcgtttggaatgcggttactgccatcccataatttgatactaaaccgcgcagttatcgcgagatataccgtggtttaaacagcaccgatttataaaccctgccttccagtacgttgacaacaaccagataaatttcttctcccacaaagaccggttcctcccttgtggccgtgccgtttcgtccaaagggcccaccggctgacacgaatttgggagaattgtaacgcaacgttctgggattcgaagcaatctccttatcagacaatcatagagatccactgatgacagcaatctcatgggtttggaacacgctaatctcactcaaaattccttaggacccaaattttccgacccgtttgaatgtttctccaagttgtttggcttactccagtgcagtgatcaacgacctaaacttctcccctaagctgcccgattgttttttcctaattagccgccctgatgaaagtatgaaactggagccatacagtaacagatttgtggttttcctggtcagcagcaatacaacagaggacgagaagcaccggtaatgtgatagtgaagtcgtatccacctatcagaattcaaattatagtggtcacaattcacgaatattacatacacgcaagtaggcttttaatatgaatttagtgaaataaaagatgtacaactgatttttgccttttaacatgttttagtagacgagttcgcatgtctgtgaataaatgtggtactccctccgtcccataatataagggattttgagtttttgtttacattgtttgaccactcgtcttatttaaaaaatttatgcaaatataaaaaacaaaaagttgtacttaaagtactttggataataaagtaagtcaaaaaaataaataataattcaaaatttttaaataagatgattggtcaaatagtgcaaaaaaaacttaaaatcctttatattatgggacggatggagtattaccatgtgtgcgtgtatgtacacttcgtaacagttactctctccgtttcacaatgtaagtcattctagcatttcctatatttatattaatgttaatgaatctaaattaatatctatctagatttattaatattaatatgaatataggaaatgctagaatgacttactttctgaaacggatgaagtaaaaaggaaaagcaatatagcatagcggagcactgctagagaagcataactgtagcgtatagccaattagccatctggtggagtccgtgggccatctcgacagagcccgtacggcccacttgacagtggagaagtccaactccaagtctctcgcctgccattacgcgaggacgatcccgaccgtccgtcccctgccaaaccaacggccaccgtggcgtacaggcgctatatatcgcactgaccgtcgcgcagcagcgttcgcctctgtctgtcacacacacacactccagtacccccacgctttcggcacattctcctcgcgcgagaggggggaggagaggggaggggggaggagcgagagcggagcgatgggctcgccggggcatggggatgcggcggagagggacatcgacgatctcccacggaacgacgccaactacacggcgctgacgccgctctggttcctggagcgcgccgccgtggtccacccggacagggccgccgtcgtgcacggcccggtgaggtacacctgggcggagacctaccgccgctgccgccgcctcgcctccgccctcgcgcagcgatccgtcggccccggctgcacggtaaatttctttcccctttcttttttctttttacccgctacgagccccgtcagcgcggtaaaatt

SEQ ID NO: 77335 - DNA, 1844 bp, Oryza sativa
aatgactaccgattaattaataataattagtgattaattatcatgattaacagtaattaaggctgtcggtctcactggttgaggatgcgagaccgctgctcggtctcgctggatgggtatgcaagaccgctcagtctcacagctcgagactacaatatcaacgatatatttgtgcgaataatttgtacctgaatatttctaagagcaaaaaaataaatagtatattttcaaattttatgagggacctaagtaaattattcctgtggatgaaacgtccatacacagttcatattgtcggccaggtggggcccaggcccatgactgagctctccacgtcagcacaccacgcaagaacactggacaataaacgtgcgtctacttaccattaactatgtctaaatacgtgctgcattattaattgtgttatccaaattgtagacagtactaggactagtagtatattagtagtagtagaaatttaaaacacagtacgcatatatatgtacagtactatagatcactggctaacaataattaattccttctagacaacataagacaaattaattatctagtctcagctcatgccaaaataaccttatatctatattttaatgaaattaaacatttatttgtttttatagattcactctatccaaaaatcttaaaaatatttctttttttttcaaatgtccaaaagtcttaagtatattatttcatttttctcaaatgatataatatttttttatttgcttatggcctgacgaacaactcatgggtctctgccatccgcggtgccctcactgtcccggtcatctcccagtttctccttatttgggatgcgatgcttcacgtacagctctcgccgggggtcgaggatcgtctccttattagatgattcttttttctaaatgtttctaaaatcatgctctatcatattgttgtgttcttactgctattattttggccattttttcatgtgactttgttttatcaattaaaaatttgaatttcaaaacttcaaataatattctgaagcagtaattgatttcagctgaaaaagtcatcaacaaaaaagttgtataactcatcgagatctataacttttattttggtcatttcttcatacgacaaagtgatagtaatattttcacaaaatttacatagtttataaaactatataagagatatgttcattttgtgaacaatcttacaaatcactttatcggatgaagaaaactcttttcgtctaatatattgacgtgcaatccttttgcgcgttcgtgaaaaaaataatatttttattctgtagtacaaaattaaattgttcggtacaacctgagcagcagctgagggagtatagaaatactagtatatgcatcgtcgtacatgagtacttcatacgcgcgtgttagttggatttgtcccactgaaatactcccttcgtctctaaatatttgacgctgttaacttttttaaacatatttgactgctcatcttattgaaaaacttttatgaaatatgtaaaactatatatatacataaaaatatatttaacaatgaatcaaatgataggaaaataattaataattacttaaattttttaaataagacgaatggtcaaacatgttttaaaaaattaacaacgtcaaatatttagtgacggaggtatggtatacgcggatcctatacgcagataagcacagtagcaacagtaatgcaatatatatgtgcgctacagtacagggccattttgcactgcaactaatttactgtaccggtactgtttatctgtatttctattggccggatagctatatggattgcatatactctcctaaaga

SEQ ID NO: 77336 - DNA, 2169 bp, Oryza sativa
tattagaagaagagcctagagtttatatagaaatacaatttacagaaaattaggaattaaaaaaattaaagatgagtctagagtccatataggaatatatataatttacaaataactaaaatatgatattaaaaataattaataactaacatgtatataaaatacaatatgaatattacacattagtagttttgtaaagttattgcaaaatttaaaattatgttatcattttaatatattttaataatataatgagaaaacatatatgttattatatgagagaaaatataatgatgctagccgcgcaatctgcgcgggccaccatactagttttttagtatatcatgttcaaagttacaatttaactatctatttaagaacgaaggaagtaatttaaagggtgaatagctaatttagtccctcaaatttcagcgaagactcaatttggtccttcacgtttcattttgtccacatagatccttcaaatatttgttttggcttgaaatcatcattgggtccacttaatatgccatatggctatttctagtcaatatttctattagaaaatgtcaattttgcccttaatttgtatacatctatatactagaaaagagaaagccaacatgaataaacaatattacagatctacttcccattatatcaacatatgcacatgaaacttaagcaattgctatcatatacacttgctagtacataatttttttttcgttttacataatatactatgtattatctataaaaaaatttaagcatgcaatttctctattatatatgtgaatgatgaggggtataagtgtcatttatgaaaagagttgttggttcaaggataagtttgaattaaaatgaaaacttgaaggactaatatggatagattgaaacatcaaggactaaactgagcctcagataaaacttggaggaccactttggctattcaccctaatttaaacccgattgtttgagtgtttcccttgtttgcataaaattaaaatctcccggccttacccaaacaagcagtaaggaggagacataattgttgcatgcatatgccacgtttatggagcatctgttcgaagtaaggtgcgctacgacagtacggtgtacaaacaactttatgccatgcattgcacatgtgtcagtttttcctttcaagggttggtataattaacaagccagttaagtgtccattagctgtaccttggtatcaattcatataattgcatcagatgatgcgccgtgcggctggtgaacggtgatcgatcccccagcatattaggaataggaataaaccatgctaatatactcatgcaggtgttggtcctgcaaatctttttgtacacactcgaaacgatcgtgtcggttctaatgtcggtttaacctaaagcatcgagtcatcagggccaaattaaggaccttgtgatctatataagcaacaacagctactactcctacttaataggccgccattattcgatcagctaattattattttgagctgttaagcacctagccttctactaatcaaggtcgttctttatatatgcatgcatgcgcgtaagcgatggatagatagtcagttgttgacacgtaccgtatgtttgacagcaagtgatccatcagtatcacctctagttgtcttcacgatcgagactctatacgcgtctgatctatggtccaatcaagtaagattcgatcatcatattggcaagcattgcatgatttgcttgcatcgaactttaaactctgaatatcatgtagggcaccttttatgtgtaacatctaattaactcgtttatgtaggcaaattgaaatcaccgtgaagatctttcacatgatgcattacattgaaggctctcatgctcgatcgacttatatccactagaatttgatccggcatcttctctatggcttgccaaatcatcgaactgcaattcaaaagatctgcacaatgcactgaagcatggtttatggtgtcgaactactcgtctaaggtcgtgtttagttccacagctaaatcttttttaaaggatacggacacacatttaaagtattaaatatagactaataacaaaacaaattacagattccgcctgtaaactgcgagatgaatttatcaagcctaattaattcggcattagcaaatatttactg

SEQ ID NO: 77337 - DNA, 2144 bp, Oryza sativa
tcctgcagcccttcgttctgaactattcgttcagcgagcaccatctttctgttcccccaggtctcggccgcatgtgccgcttcgtcttgttgctggaagtcacaattcgagcgtgccgtcggtcggctcgccgctgctggggcggcatgtgcgcgccgccaccaatgcttttcattcaacatgaagaaacaagcaggcattattcttatatcacgttgattaatttcaattacacatgaatgcaaattaaatttgatcgtattaactgcatgtcctaaacatatgacagaaccagcctttcacagagaagaaaaaaaaaacaatcattggatgcatcttcgacctctatttaggggtggacggaataaaaccaaaccaaaaaaccaaatcaaaaagatcgagaccgccgaattcggtaagtagtccggtctcaaccagtgaaagaccaaaatttattccgttaattcggtcagtggcctcggttaatcgaattgaccgatatgaccgagccgtgacccaatagacctagtacaccgaataaacccattaatttagcaaactaaaccctagagacagggtagagagttgcacctccgcctccatcattcctcggttcactccgcccccgcctccattattgtgctcgcgcatccatcctctgcgtgactgcatcaattgcacaccacattggtatgcaccgccttgtgcctccgcctccattgcacagctgtgcgctgcctccaaccagctccccttcacccggtgcctctagcctgcctccgcctttgtttctcaagtcccccacaatcgagttttggtggaaaagaaaaaaaggagcctgaagctccttaaggtgcggcgctgcaagcggcgacttgcaccacgctgagatggatgggatttgaagcttctcatggagtggtggagatcgacgacatccaagtcatggcaggattgatttgcttctttttcttcccctctgaatcgtgctctatttgttactggcatcatattgtagttcttcgtttgagttgcttcgatttttcgatcttatatggtgttcttatttttcttgtgagtaactttgtttgccattcaaaccactcttatgattagttcggtctatgaccgagaccaaactgaactaaacgaggaacgaagtgcgtggtcttgaattttcttgaagaccgatcgatcttgtgattctaaagactgaattttccaaaagaccaagaaacggaaccgaatttctcaattagaccgaatggccacctctacctgtattagagctggcacatctaaagaagtgaaaggaataacatttctcgcatagttaccaatgccacgtcatgtaataaatatggaccgtttgatttttagttcaaacgttgcaagccatcggatcccttgattggtgaaatccccttccggtccatctagagacttctttttgtaacgaggtactttcacatccctggtcttagtatttttcatttacgcccctacaaccctcctgtgctagtgagatgaggcacccagcgtccggcgacctcttccttggtcgctacgccacctccgcctttccctcccctcccgaaagatcgagacgtcgctcgatgtcttcccaatcccaaccgctgctgcatccccctcccccaacatccaacacctactggagcggcatcgtcgctcctcctcctcctccatatctccaccgcctctagtttacattgagaatattatgagatggttgttgctaaaattcaattggttaggatggtcaatgaagcttgcaaaaatatttaactgttaggcatcttctttcaaatatacacctataccattctactatccatagttccatactactacatggtgtagtataaatgaatacggtagaaaccagtatagtcatctttagagtttgagaaaattccctacatacctctgaaaagtttcgcaatctcttctatacccttgaattttgccttatcccctacatgcccttgagttatcattttgatctcctctatccctattccattagttgaccgtgagttgactgttaattttttctaaaatgaccctatcgcccatttcccatacttacaggtacatgctatctactctacttcataattcac

SEQ ID NO: 77338 - DNA, 609 bp, Oryza sativa
agaaaactaattagcatatgattgattaagaattaatcattataaactcgataaattggtttatatatttttttaaacatcttctatataaaatgatttcgaaaaaaacaccatttaacaatttgaaatatgtgttaatggaaagcgagtaagttgaagtttagctgctaatctgctgaaatgaagtttagctgctgctgctgtccccacatgggtgtaacgcccccacggatatagcctgactaggtgggacagaagcaaacttaccagattaaagatttactcttttttttggatgtacacatagttggacagctagctatcatacgcatcagctattagagatttagagctatctcttgctgacatgtgggactaccttttttacagatatcagctggtgatattattaaatttgttatgttatggccctattggataaccccacgaaagtggcagctgccgagtacaaatattgagtctagcatagtttaaactacgcgagtaggaaacaaagagctaaactctcctcagttccaagcgcagccaaatcacctcgtcaattattctcgtactggatgacaagtctgcactgtgctgattgcaaaa

SEQ ID NO: 77339 - DNA, 10624 bp, Oryza sativa
tgacaaattgattgagagctaactaccgaggatatatggaaagatggtcggcgagatcaacaccaacgcttggtttgtcctcttcacgggtggcgttgcaaagaagatatatttccctatatatagcgtcttgcagagcgaagtaatatggctgattgtacgtagtggagtggagtagccgcaacagcttcctaatcgtgcacgcgcgcacgaagcacgggttgccggcctgcctataacgatcatacatgagtgtgtatcccccaggtgagagcctccaggactccaggtgtggatgaaggtctctaatgatgactaatcagttcgatatatagatgtatcaactggatgtatatatggatgattggtcgcacggaaagcagaccgttttgcttcgtcgtcatgacacggttggctagctactttttttttaagatggatatttttttactcggcctttacatccaaccggatatatacaatctttttaaattaggaacttagcctgtcaaacagggaacttagccctcgaataacccaatctgaaatttgctcctataaaaattaaaactcaggactttgatttgttacttaggtcactgcaaccactaggctatatgccctttcacgttggctagctacttggcttggcatggctggtggcaggggtgaaaacggtacggaaacggacggaaacaacttttatcgttttcgttttcatatttttttcggaatcggaaaccccggaaacgaaaacggaaacgaatattatcgaaaccgaaaacggagcgaaaacgaaccggcgcggatacggtaacgaaaatttattggaatacaaaaacccctcaaactgagcttcaaacttttgtcaagtccaattctcaactctagtcaacaattcataataaaacataattacatgaaatcgtctcaacagcaaaatatatccctctatgacttcatatagattacataacaagtattctaaacaaagtacagcagacaaccatggtacaaggtgtacaatatacactattatgcatgctatactgctaatctggtatgaactatcactccatcatcagtacataagttcatgaatcatcattcatcagtcatcacagaacacagcaacacacatcagtccatcagtacagtacttagttcaatcacaaaactacttgcatttgatgattcgatccatcgtaaatctgcagcacaaagaaatcaaatcggtttaggctcgtcggctcgtcgctaggctgctggctgctgccgctgggctgctggctgctgcgactgctgaggcgaggcgtcgtcggctcgtcggtgtggctgtagcgtcgtcgtcagtggtggtagcggcggcgagacagcgggatgacgccgcggctgcgagacggggccgcgaaacggcgggacagcgccgcaagatagcggcggtacgagacggcgaagacggtgggggcgaggtcgcgaggagcagaggacggcagagaagcggtggcgcgggcgccgggcggtgggcgctggcggtgcgcggagcgcgatgctccgccgctggctcgcggtctcgcgaagtcgtgtgcctgtctctctcctctctagggttagccactatttgtgttgggctggaaatttagggatgagttatagactattgattctatgggcctttttaactttggaaattccgaccgattccgagttccgatggaaactgctattatcatattcaattccgtttccgagaaaatatttccgttttcgattccgtttccgagaaattccgaaaaaattccgactggctgattccgtttccgaaaacaggcccggaatccagaaagtttccgtaccgttttcacccctagctggtggtggcgcgtatggccctcctccccctcacacacacacactaacgacacaaccgctggtagagatatactccatccattaaaaaaaaccaagctatgcatggatgaaacataatgcatgacagcgattctgaatatgaacatgtctagattcattttcctaggttatgtcttatccatacataggttagcttttttgggacggaagaagtagagtgttgtggaaaccatcggataaaagcaatctgaattgcagataggaattgaacacaaataataagttcagggttccgtaatgagcaaaccggcgatctaactgatcacgggattatacggcaaagtagcaaagctaaactttaatctaaacaaaacccaagaaactctgaaggggtacctaactatttataatggtgtgagaacgaccaagtggattctagggtcgtgctccacctggttggggcgcaccccacatgggccccacttgggccagggtcccaaacgaagttacaagcccaaaggcccatgacaggtaacacagcaccttgtttttgtgtttgcggccaaacgatatggagtttggtgatgaggctggatccgttagaaagaggactctgagagctttccatcaagtactcatgggctgaaaacggaggtcgtatgcagattcggtagccgtttgaagtcagcagggtagcaggtagccgaatcggattgcagaacttggacggcttgatcttgatgtgaacgacggttgtatctatagtagccatggtcacatcatatacttatgtgtttgagatagattaagatgaggagcttaagattaagaaattcgctagtgaaaatcaattttcacagccaacacttttgactcaaccgccagccaagagatatttttagccaaaaaagaaaataaaatccattttcatgacaaaaacacatcaacttttcaataaaaacatatttaaatcactccagtgacattcaaacaccaatagattagcatcaatagattatatatggacaaacaaaaacacaaaccactaaagaaacctagataggtgccggttgtgaaccctataggtgccggttgtgaaccttgtcgacgtttgatgtcgcgattccggtatttgcatagtatggagatcgttggtactaggatatatgcgagattgaggtaaaagagatggggacgaggattttttatacaggttcgggtccctaaattgtcaggtaataaccctactcctgttggtcgaagccggtcgttgctcttattgaccataatcacaccagtacaatatttggggtagcctatctatctgttatcgacatagcggactgaagtatcatcgcgtagtcgacaacagagtactctttctccttgaatccgtgcttggcgagatcaaagacatcgctagattcctctctttggttcccgtaggtaccatatgaggttttccttggcttatctctgatgtcgatatctagcagcttgtcttgtcgtatgtaggcttgtggctttgtggcgtctatgttgtccttgtcccctctcctcctagggggccttgtatttatacccataggtgtccccttgtccaagtagaactagggaaacaaatatggatacaatccgagtagtccttgtcgtttccatgtagaactctggttgtctttccttatccggaactccatctatatccgaggtcaatttccttataagacatggtatgtggtgggtcctgccgagatttagtcaactactattaggtatgtggtccataaccctgacaaacccggaataggtgccggatttcccatccgacacttagaaggcggcagagatgagagaaatcaaaggtgccggtttggaaccggcacttttgtggtcccaagaatccaaaaataaaaatggcttgatgcatagcttccaatcacccaagaacacaatcgtacaatcatgaataaaagaaacatccacaaaaatcatgaacaaaatcgctgccaccaccggatggaggagtcgatgctgccgctgaggagaatggagccaccactgaagagagaggatccactattgccaccagggagaatggagtctccgccactggggcttctccttcttctccacccttgccacaagctcccctctcgctgggccgctgccgcctcccctcccgttagatctggcggaggggagggtaccgccaccgtcattggaccgctcggctgccgccgcctcccctatcgttagatatgacaaaggggagggcactgccactggcgccgggtcgccgtctagtggcccacacctcaaatcctgccagatggagagatagagagctgagagagagggaggatataacggtgggtgcaatgaggagataaggaggagagagtgagcagtggatgggtgcggtgggttggctcgtcttgattttacgggtgtagtttgtttttttttaaaaaaaaacgacatataatatactataagtgtcggttttaatatataatatattatagatgccagtttttttcaaaaaccagcacctatagtattggtgttagtttttctataaactggcacctataatcgttcaaaggtgcccttttttgtattttcagctcgcgaaggtgggaaatggtctatcaataccagttttagcacttccggcacctatagtgccaacctctatgtgtctttttgtaatagtgacatcatcgtcgtctcatatagcgtcacgacgttcgctgtatcatcgagctccatcgggggaggtgcacgccgatctagccttcctgatgacgaatccaaaccacgatgagtcgccaccctccccttcgtgctaacttgaatagaatatcggaattaactgagaaaggtctagtcacgccgatacaagcgaagttgacataacttacttccttactaaagatcgaaacgatcttgtcctgctcgaaactaagaactcatcgaaataaatggtgacgatgcgccgaaagtaattatattgattcatgaagatatagtctacaaagactttgggtgtacatatttataccctcatattgatacaagttcttatcgggcataggatatgactcttacaagaaaagaaaaataactaatcttccctatttaagagatatattaaaaatatgaaatttcctctttgaattcagcttgatctggataaacttccatctaccaaacaatttttttcgtaaccaaatccactagagaccgtaccaaattttggtgttaatgtcaagcgaaagcaattattttagaaggaagaggaaaacctagggggcttacgtcctcatttcactctttttgctcctacgagacacaactcaactacattacattttagacgatcaaatcactaaatgatctctctctacggcacttttcacttcttttaggaacacgaggagccttaactacgactgttgcacttcactcagccgccaacactagatctagcggccatcgaggtctgtctcagctagatcttgtagtttcgaagttggctgtaatccctatccaaagaccggtcctctgttgctgttgtcgttcggaggccggcctgtcgtcgccatcccattgctgcctacttggtgagagagaggagagggaggagtgaagaggagatggatgcatgagaatgagcagagaggaatatgagaagagagacagaacgaggagactgcctgatattttataaggtccgtgtcgaaacatgatttcggcaataataaaagggggtagcgtacgagacctaaagtggatggatgcagagacaaaggatttagacaggttcaggccctctcaatgagaggtaataccctactcctgtttggggatttgaatccgccgggtgtagtatagatctgacgatctagttgtttcatcatgcccctagaggggctccctgccctccttatataggttggggggcagggttacaagatagaaaccttaaccaatacggcatcggtttcctaaatctactttacaatcttatcaaaccaggactttaggccgttccataatatacagggaaacgtaatacccaagtcatgatctgttacatattccatagacataagttatcccctatagccagtcggataactatgccatgtaggtatggggtacccataatctccacagtccgacggttctgtataaggttcatttttacaaatggctctcttaaaattgtcgtctgtctgaaaatcaagcttttggtacattttcggtacatttttcttgtgttttgtttgtccaccgtcattaagaaaaaaggagtgcgctaggaaaaaacattttttataatgctctacacgatatcttaactgattaaatttccatataataaataataaacgaaggcaaacattcctcaaagttgccttgtttctacgcatctgacggtgggattaaaaaacaaacttctccgggagaacaccacaaaatacaatacccacatgtccttaacttaagagctttccaattaaatcccccaacaatatatgaacagccggatcaatgaatatccattatccaaatgacataatgttgataattagagatggcacaacactagatcaatgtgaatccactgtagccacttcaaatacttgtaacatacccaaattctagaccttaaaaatttcctatcaaaatagttggaagctaacttttccgattttgagagctaaaaatttccatttttaacctaggtgtggtcaatctaacttgaacctaagtaaaatttgagaacaaattaaaaatttttcatttataacctaggacataaatgcaaacacgagtaaaagcatgcatacttgcataaaacatgttttgacttgagtccttcatgtgcatttgaatctttgatttgcatttcataatagatctcatgaatattaactaagatctagataaacaactaaaccattagggcctagtgctagctagaggaagttaaaatagaaaccatacaccttaaaatatatcaacatagctaatgtcaagcctcacaaaactaatttggatatccatctgaagacatgtcatgaacatgaaagtgaacaaataaattatatcatatagggtatattctatcttaatcatctctataagcattctcttaatttaatactgaagtaaacttatgcataaataggtaaggagcttatgacatgtgtaaggtaaactgtaattctaacatatcaatatcacctcaggttaatgagagtccaaatataacttttataaacatttacatgcatttaggaaagggaaacacatataagacataagtcttgagaattatctaaaataattcgtgcaagataaaatcatgggaaaattcatgtaggctctactcaacacatacaactcactgtaattttggtataatttaataactaaatttggtacctcaaataaatcagtcaaactaataaaaactagattaactgtagttcttaatcggctaaaaccatactttgtctaaaagtgcatttaactgcataaaagtgtataagtaaaataatttattcaaatactaggtcatttatcatgaataaaaataaattttccagaatttatcttctctgtttaggtctcctaaaaattcgaactagtttccaaagaacccatattcctctaatttctgtgagtattctatccataaattttgagtgcaaccaaagaaaatagaatctaggtatcttcatctaccttcagaaaaatccacaccaaattattctacccacaagttaaataattgaattactaaattgggagagagaaataatcctgaaaatcattcaaaccttttgttcacccacgtttctgcgcaaccctcttaccctagcttagtttgccacgacctggacccacttggcagccactctggctcatcctcaccctgtgcaaatcttccagccgaccagagacagccgagagagagagagagattggcgctggctgtgtacgacgcgtggccacaacgtgtcgacgccatcaaactcctattctagccttctcctcccagctgcatctccacacatcattctccacctctaagccaaagaaaccgagggaagaggctctcaacttctccgtcgccctcatccttgccgccggccgcgaagaagacgactatcgtactcgtcaataagccagggtaatccccatctctttcgcgttccatactctcatcaccatgccgaggatttatcctttgaatttcatcctctatcgtgcagcggatcgacgggaacgccgtcgtgcccacgtgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaaaaagataaaagcgagctaagcctgaagacttgactcctgcagcgggcgactccagtccacaggcaaaccttgacggcagcgacgaaaccaacctcttcgagacatcttcaactgagaaggacttcaactctggtgtgggggaaaagagagcaagactgagtactacccactgtactcagcaagtcataccggaagaggaggtatgatgcaagatatatccaagggaggctaaaggttcttttgcataaagccggcatttcaaagcagcagttgaaagcagtaaaacggttgtagtaattaatccatattaaccaatcactgtccaacgttacaccacgttgcaacaggcccaaaccacctcttgaactaatcagttccaaaagctaactagggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaaatgccatgggtgcgactagcaagaccatgcacccacagcccaccatgaagtatattttaattaaccaacaccattgcggtggcactaaatcaaagctatgccaataatcaagtctatgctttaatgtgatccccttttgtgcactagttgaactaagcatggctaagcatctcctaaaccaacatctagtcattttaatacccaagttatcaatggcgtaagggaaacaacatatagctgagtaataggacccatcccacatgatattgtaaaacaatgcaatatttaatagaaatgcgggacatttgtaaattaggtacaatatgatcaattgcaatgtatgacttgccttgctctcgcactgatggaaccacagcaacgtcttcgagaaaccacgaatcgacgaaacggccgaaatctacgcgacaaacaaagcacacaagcaaaacatgctataagactactgaaacagagaacaaaaccatttttaatggattctacacatttttatgaatttactgagacttgaatggacttaatcggagctcggatgaattagttatgatttttagaagattctctgtgtttttactataaaagaaaagccctaatcaatttattgcgcaatattgccccagggctgacgtcagcaaggggtggggcggcgccgacatgcgggccccactggtcagcgacactaaaagagagagagggggcggctggcaggtgggcccactgggcagtggcacaaggcgggaggggcgcggctggcaagcggggcccaccgggcggcggctcacggggaaaggaggaaggcggcctggctcggctcggcttcaagccggccggccggttagggcgagggcggcggcggcaagcggcctccgacggcggcggccggcgagaagacgacggcggccggcgacgcgggcgacggtgcatcgcggcgatgcgcatgcggggagcggcggcgcgcgcgggaggaagagagagggagttctcaccggggttcggccggcgcgggaggaaacgacggcaaacggcgacggtgagcgaccgaagggcgacggcgaacggcgaccgagctccgggacaccctaagagaggaagtgtgaggggttagagggagagagggtgcccacgacaagcgagagccatggccgacggcggcggctatggtggtactcaccggcgcgcggagagaagcgggccctgatggcgggattggatggggatgcggcggccggggtagctttggcggcggcgaagctaatggcggcggcagattggctcggcggcggctccagcggtggcgagcggcgaccggaggagtggaaaaggcggcggcgacgggtgtagcggtgcgggagtgatggagggcacggcagggctcggccgagaaaggaaaaagagagaggaaggtgcgggcgtgcttaaataggagggggggcgg

SEQ ID NO: 77340 - DNA, 10089 bp, Oryza sativa
gagagaaaatatattgatgctagccacgcaatctgtgcgggccaccatgctagttcatgataaaatcaaatggggcataattatttattgaaacaaaaaaaatgttgaaccatttttttttgacaaaatccatataagagttttagctagaaattatgaaccaaaattatttatttgttgggttcaaattttgatgaaaactatatatgaatttcataaaagttaatttaaaatttatttacaaatttttgatttatttttaaaatttgtagtcagatcattatattccctttgtttatttacaaatagatcttttacatataagaattgtgttttatcattaaactagcatataagtataagagaggggtaatatagtcaatttcaaaaatatttaactgtcaactcacggaatgggcatagaggagattaaaatgagaactcatgggtatatatggaatgaggcaaaattcagggtacataagggattgaacaaattctcaaaaatatataaagaattttctcttagagtttataaacacgcacagccattgaagaaaaaccgagcggttcataccaaagaaagatgagtattccgctgctcgacaaacaaaattgcaggaacaagaacaaacacgacatttgacaaaactaggaggaatcttgtctcactagctctgcttggctgctagtgctagctatacccactctggcccggatggtcaaattaaacgatggaaagttcatcaagaacaatctgcctcgttttctgtgccataaactacggtttggtcatggtatatagggtatgtttagttcacactaaatttaaaaatttaattgaaattgaaatgatgtgatggaaaagttgaaagtttgtgtgtgtaagaaagttttgatgataaaaaagttagaagtttaaagaaaaagtaactaaagcagggcatagctaggcttggacaatacagtactgtcagcagtaaactatccggtgcaatttttttaagactgtatagtgcagctgtactacagcccagtggaggagtatactggagtcgtagggcaccctggcctttggatttttggttaaagtgcggcaactttcttgtgatcgctgggctcgcttctgagctcagatgcctctgtttccaccgtcttttttccttgctctacagcggcgtgccctggagcttggcgcggtgtgtgttctgctgtagcaatggccaatggccatggctatacgacgctagctttccctcaagtgcggctgattccattccggcagcgtccaaaaccaccaaaatatgctgcagcgcagcaattagcattgctgtagcggcaagcaggcagccgcaggaccgcagcaacgcgtaggacgcaagcgtttttctctccatcttttggctggttgtgggaactgccgaactatacgcctaaggtagactacgggcaggggtagtcaattgccagcagagaagcgaaatactccagtacattgagatttttttttttttgagaacacagtacatagagatttgaaataggatcggaagagtacatgtactcctcactgcatgtctactccgtgcatctagaacttatttcttcctttctttttgttacctcggttattaatggagttcacactcttaactctgcctagctagaattaatcacacatgagtatatacttcgtgcaaatactggtgcatgtaccgttatatacatctcagtggatatacggtagtagaatagtacgtactctctccattttatattataagttgtttgatttttttattagtcaaagttatttggatttgatcaaatttataaaaaaattagtaacatttataacaccaaattagtttcattaaatttagtattgaatttattttgatacaatgtttgctttgtattgaaaatgttgttatattttactctaaacttaattatttttttaaaaaataactaataaaaaaaatcaaaatatttataatatgaaacagggagcagggagtactaagattaccgcagaatcgcagatcaatggatggtgcggatgtacgttttcgtctcgggcgcttatctgatgatctataaatccatgggtcacatcgtgtgctactgtgaataatcttctgcatggttgcttctgatctgggcatgcattgacgctgtcaacaattgtacgactagtatgtgttaacttctgcacacaaggtagctatgttgctgtgtgaagcaacagtaatgaactaggcaactatctaagctaatactctgctatactacataggaacaattccagtacatggtcaaagcacagtttatggcatggaactcgggtaattgttttgtccgtggcatatgcttgttcaacctgagttccttaattccgacatttctattgctaaacaagttgaaggtggccgcgcccgggcaacaacaaacgctaccaaacaaacaatagccatcaaaataatctataaggccatactgtaataacttctattgatacaggaaaaaaaaactatactgtgccactaagaactgagctgctattagctatcctgtgtgcttgaaacttctgcccccgtccccgattatagcaaggagaggcctgcaggggacgcaagcaaagtgacgcaaacgggatattgattcatttccattgataagagattcgtgtagtacacagcaagtacgtgtcggagcccctgcatgagagacacacgatatgatgacttgcaggacgtacgtacgcctgtcgatgtgcccatgcatatgctactactgactacactatactccgtatggatcgatcgatagttcgtgcgcgagcgcgtgaatgcactggccgtacatcgcacggacagtcgcaagccggggatggataagcaagctagcgcggcagccgcagcagttgttaatggcgcgtgagagtatgagagatgctacgtacgatccatcgatctgttcgtgactcatccatatccatggataggtttgtagatgcatccatccaaatgcccgggcgttggcgtgtgcgaccggtggatggatcggcccgtggcgcgcgctgtgcgtgccgcgccgcggggcgcgcggatgccttgcttgccggcgcacgcctcgcgctgctgcgcgcgccgcgtgcttttgcgtgctcccgtcgccgagctacgtacacaggctatacagcgcgggatagctgaacgcgtgcgtgcatagttatacgtacatacacgggtaaatccgatcgatccgctggtcaaacgggaacacatacgtagggccgttcgttcagtatcatcgatcacactgtgtgaagatctccggtgatccagatctgcattgccgttcctgtacaaattattatcattaggcatcttcttaattgggatgaccagcgggaatgagctagtagtaatcatagtcgtgccattatattttacgtatagtacctggcatatgctacaagcttgtggagcatcgcagtttctttaagggcccgatacacgttgtacgtacactgcctctcctgtaagcttgtaactcgtaacagtgtgtggcacagtggctgtaacgtgtgggatcgatgtgtgtggcaatttaagacgcatgcagctcgcgtctcatcgactttactagcagcgcgttgtttcttgtgatcgatcgatcgatcgatcgaccagccgttggagacaaacagaaccgtctcagcgcattaacgtacgcgaccctagcagtacgtacgtatgttccctgttgaatccactactgcgcagtacgtacgtatgccgatgcgcgtacgccccgttgcgtcgtccgcgcgcatcgacaccggcgctacagtatatgtccagccgccggcggcgccgggtgaaattaaatacacgcagatgtggtagctcgagttgcaatctgtacttgtcgatgaaatcagagcgatatcctagctacagatcaagtggactacaggaggagtacgtacgctagtggtaactgagtgaggtacagtacgtacattagtggtaactgagtgacgatttattgtgctttcactttttttccttctgtctgtgtcagctagctaaccatcgatcggtctttcgaataaaaagcagctaatcctttgtttgaagatgtgaaagcgaagtcccgttccgttccagcctagcttgacactccccgtcccagctcctgacaaatgtggcataggattccccaattcgacagcgacgcacgcacattgaggaggccgctagctcttcctctatgcgtggctccatcgcacggcgagcgattgggtcgtggtacgtactccaccgaggtaggagtagtatcaccgtatcagcgcgcagcgcacgtacgtacatgcatccgctcgccgctcgcaggcacatgcattgctggctgtaaagtggccggcgtgcaccgtggggtatccgcgacgtgtcgcgggcttattcgttagttgccccaggcctttgggtgaaaactgttcgctcttttcttttctttgtttttgtttttttatctgtaatactcctacacggccacacgggtgtaaatcaaggttgtcagtatcccgatacgtatcctaataccttacgatactacgatcctactaaatcgaaacgataccgatcccatctagtatcttaattttcataatttctcgatcctactattcattactacacgatcctacgaaatcttaggtggtatcccgattcgatccctacgatactacaaaatattatttaaaataatatggtttgaaaataatgtaaataaatatgctcaatttcttataaaaattagttgaatatattaaaaccaacgtggtttctcttgataaatgtctctatttgcatggaatatatcattactatatttttgtaatatagaatagctatatataattaatataaatattaattaaacttaaaaaaagaaaatctcatagtatcccgatactacaatacgatcttacgatacgatattactttgagaaaaaacgatattatctagtattccgatcctgacaacattggtctgcttgctaccatcacggagtgaaaaaaaaagaataaaaacgtactcgtaaatatcatgattgcttcattgctagtaggcggatgaaacagtgggagggttctgatgcagcggctgcggcgctgcgccgtgcggggtatgtggcaggcaagcgaacaactgaacagggcaagccccaccggcgctgttccggcgacccggccgccgggccctgtgggtggagggcacgtgacctggccccagcttaagtacgtccgcgtggagcatttaacacccacgcgactgctgctgccccccctgggccgggccgctcacaacgccccctggtgggcccgcacgctgaggctccggcccccaggccccgtcgccttgggcccaagcaggatgccagcataggattggacaggtgatgtacacggtaagagcgataaattctgagcgagaagggaacgcggcattagacgaatgtggtgagtgtttgggttaaaaaggtactagatcgatccgagtttggttcacgacgacgctagccaaagctattaagcgggtacgcgcgcacgatgtataatgcagcatattgttatactctgctgctacatatagctgcagatcgatgccctggatctcgaatacgtgcgtggggttcacgaccgtgtggagctcgagcaacgctacaacagaggtagctgtgcctgtgtatgtatgtgttatacgccctgttacgtttgtctggatctcgatcgtcgcgtgggcggatgtactgtgaggctgggcggttttcggttttcaggtggacgacgcaggcaggaggcagagcggctcgcgtagatctgggaaatgattggccgagcgtcctgctcggagttgggcaccggcagcggctggtagctagctttggttccatgccgccaaccaatcctgcaacgagtccatccaactctcttctcaaacgcccccgatcgacgaggcgttttgttctgtcacctgcacagctgcgctgctggcctgcggggtcggggccgatcggggcatgtgtgtacgtgagccccgtttcgcgtcgtcgtcgacaccgatcgagatgagcagcagcaatagcgagagcatgcagcagatgcatgcgtagctaagctagctaacttttggcaggcaggcagtacaggccggaccgcgggagtcagggaggagagtgatgctgagtagtatagtgagtatgtggtccagctgcgtgcgtgacatgtcaagttgtttcagcagtgcaaccactgtgcaagcagctggaccagtacacatacagacaggcatgttagacgccaatgttacgaagaaaatatcgtcgattgatgatccaaagtttagcgctggtttaccaccatgttcgcgcgcatctacgcatgcagagagtagcgtgtgcaacagcgacagcgcccgcttaatttgtcccttggtacgtactcctgcatcatgcgtgcactgctccaccagctgattgcacaatggagaggcaaacagaaaataaagcgggttttagaccgtggtttttgttctcttctcccagatgaacccagcctgaacctgtgactgctccatagtttcaccatgcagctggcatttgggctcccagtcccaattggccttctcatggcgcgacacataggcatggccacctaatcgatccatcaagagatcccttagcttcaaacttactaccttcccttctttcaactgtaaagttgcttccatgatgctggctactggtctccactgctttaatgggttctattccagctttttcccaaccatacatatactatacacttatacagtacccggcttttgaatggacgcatttgcatctggatcaaccaatgcaaagtctgctcaggagcaatgctgaccaatcagccaatcgcccgtgaacaattttagtgagaaaagatgaaaccgggatcttatccttaccataattattgcagctttataaagatcataccaatccaataacctaatcagtatccctctctaaaggcaaaagggaaggtgagatcttgatcaggatggtcaatcacccaatgatattgctggttacaaggcaattagggagggcatgatcaacatgattatgatgacctgttttgagccacaagaatccatggccgctatcaggacgtctgtaaaggagactacataaccatatcaagactttaactttatcccactttgaagaaagagagtgtgagagaaaaataattacaactggattatcaaatgactcatgcatgttgaacatgagttgagttttgaattatttgtagcaggttacagaagtctgatataagtctcaaagtggattacagctgaatttaatgattaagcatggtaaagattgccacaagatccaaggctaaagggagtaagtgcaagaaagtatatggtactggtccaattgacggctcatgtgcatctgtggccagatctagataggtacaaaatacaaatgtacaatggtacacagaactgagaaaggtgggcagattgtcctagatgatggattttgacctgtcaagtagtagatgccttcccgttgctttatgcgttttgattgggtcatgactcatgagacatttcaagatctacacacagattttctttacaagctatatatttttcgttcatgaataatactactaaaaacatttttatgtgcccgcttagaacacatggatttccaatgaaataattcagttcgtcatggggcagaaaaatcccagcggtttgtcaatgcgagaattgtgccgatgcaaattggatggccaggaattcttacacggtgtgagttagaatcgcaaacctaaatttatcagttatatgtatttagagttgtgtatactttacacttgtattacagtcggtggccagctaggcttgccaactagtgcaatcgtgtaaagttcgccactctgtcaatatgtacctgctgcccaacaaatgttaagggcctatttggtttgattgtcacggtgaccatggaaaaatgttggcaaagaaatcagagtttcagggacaacttggtttgatactaaattatgctaagtcattcgcctttttttttcatccatttttcagatccaaaaatggccaagacatgggcagtcaacttggcccctgattttggtttcccaacatttcgcctagctttcttgggcttccttggagccaaactaagggcctgtttggtatagctccaactcctaaatttaactccaggagttgggtctagagtggagttatggagctgcctaaacccagctccacaactctagttcattttgtgagaaacctccacccagctccactctcagttttggtggagctaaaactgtttggctgagctccagctccaggaggggtggagctggagtgtagctgaagctggagctgtgccaaacagaccccaaattatcttaagctgtagtagtacttgtctgggactatttaatcacaggatgcctataagcaaagtctgggctaggctggtaaaagaggcccagttcggttcgggcctaaaatatctgccaaaatctgggccggtacggtgaactgggcctaccgtttttaatccattctccggcccagctaacttcaacaacacaaagcccaaccgctgtaccaagtgatatcattatcaatttatcatgacaatgttcgttaatccctttttttagataatggagatatcactgagcaatggttaatccgttctgaattctgatagacatagaggctgcaactgccagagaggctaatctgcaaatgcagagttgctgggctgtttctttccacctacgatttaggacaggctacaacactgatcttagtccacctgtccccttgttgcttcgaggtctccagctgccgctgcattctgatatgcctgtgagtgacatcaacagcaacaatcaagcagagaatgggccatgcctcgtggtgttttgcttaaccatatgtctgcaaaaaaaaaaaaaagttggggttttgagtttttacctcgcggctcagcttgatgcgcaggttggcttgcgaggagggagctggtgatgaggcgttctctgaagataaaaaaaggagagtaaaaataaataactagtatttttcttttaaaatttcacagccaacaattctggaacagtcattgttttactgaaccttgagcttgggcttgagagtctcaaccgcggcctttgaaccgttgctgtttgcagcttgctgaaggaactccaggatacagggttagattcagtctgatgacatgcatgcctgaatattggactgatgatttgtcatttaccttgccaagaacccagtctgcggaatcaaagtaggcgcgctcatggtcctgcattagcaccaggccatgcagccaaaggaatagctcagattcgctttcagatatttatcatatactagtactggatagtctagatgctgcatttttttgaactaactactattaccaaaacttgcactcccatcagactacatactagtactacaagatatcggtatgttctttatctagtgagttgaataaaaactgaaaacttgatacagcaataaataggatttgaacactatgaaactgtaagactgacaaatggctacaaaatttcagaaactgtatacctttgaaatcagaggcttctttggtgcaatccctccatacttcttctcaatgcacgcctgcaattcaagatcacactctttcacaaaccccaaacacgtgcagaacaaagagaacacccccccaaaaaaatcccatcttgctctgactgaaagcagccggaaacactgaactttactccggtgtactaagtgtaccagagatgaggcttatccgttcgctcaagaggccaagagggtcaggaggacacttcacttctcaatgccggtgcagtgcagacacagacgcgggcttgtccacttgtccagtgaaccgaacgacgtgacaaacacacacacaaaagcaca

SEQ ID NO: 77341 - DNA, 1357 bp, Oryza sativa
tcctgcagcccccaagcagaaattgaaaaggtcattgaaaagatagtcgagagaactagcttatcggaggccaaaggaagcagcacctggaaaaatgcaccctctagaacaagagtgccactccggctattcctctttccagccaagaaaaagaagccgtcactattggcatgtgtaaacccggctcttcagaaacagcatagtgacatggtattcttcactaaatgaattaggtactcctgtctatctgtctaatgcaaaagtgataaaatttcagctatgttcttatgagttggtggaatactggactaacccgctccctgttttgatgatcaggccttctggatgtaaccagattcgtcatcgagctaattaggtgcatagcaggtcagaaaacaagacttaaaaatgatcaaatgatgacatgttgtagccaaatgccatagacggctccgttcacattgttagtgtttactaaacacatgcctgtattccatggggattactataagatgtactttaaggtgtatttaagtacatttttgacaagaaagtatatttgtcagtagaacattgcagattgtgagatcattcagaagatatattcatagttaattctttcaacaaaacaaaatcgtttcaggatataattctttttcggcgggccaattgcattgggatttagcttgtgctgttgggtaagaataaaccgttctgtgttgggagtttataggcacgcacctgacacttgcgaggcaagcattccgtcgagcaggtatcgagcattgccgtcgacacgaatagcccacccatcccccaagccccggccgggatgatcaactcttcaccatccaacgcaggggatggaggaacgaagcagtagcacaagaggggaaacgggatcgccagcggccggcggccaccgcgcgccatgaatccctcgctccctctctctctctctccgcctctccccagtttgagccgcgaacgagcgtgacagatgggccctgcagaaacgggcctcaagtagatgggccgagaataaggcccacacggtccccacctcccctgccacgtggcggcgcgtcgtcgtttgcacgcagctcgacgtgacgggaatatatctatccatccataagagcaggtacaatagcaggctataataagccagctataaatatattttaaacatataaatgagaagagagaaggacaacgggctatagatttatagacagctgtagcacggactctaagacacagtgtgtgtatgatatgtgggaccatatatcaatagtgtggtatgtaactattgtatgaatgagctattagattggctatagatgaattaaagcta

SEQ ID NO: 77342 - DNA, 18518 bp, Oryza sativa
ccgcatggacggccgtccctttcgatcgcctcaaccaagcggaggaggaggggagggatcacgcttatgagacccaacaaaatctgcacagcgttttgcacaccaccaccatcgtgtggctgctcttgatccacccaaaagcaacatgtgaccgatcgatctagcgatggcgatcccctaacaacggagccgtgacaacgacacgattcctgaagccgttgagcgcccccggttctgttcctaccttcgctactgctatctctcacgcattgcccatgcagtattgcagtcatgcagatgctggttagttgcagtgttgcagaggtgagattcgcaggatcggtgaaagaaaaaaaaaagcagtggagaaaaatgcaggtgttaagtagtagtagtagtggtcagtcatctgtgttcagagcctcagagagtgcttgcagtcaaatagattcttgggttggaaaggagattaagatcaggttgaaagtttagtttgcctttttcgtcattcattccttgctggtaattaattagttttggtgtgtgcggctaaagtgatttcttctagatgcatataaatctaaagtagtgcgggtaaagggtagtaattgatagtgcagaatctttaattgctcacaggttttggagagttggtgttgaggacaagttaattttggtgcacgttaggtaatgttctggtggttactttctttaaacagattaaaaattattaactagttaattaagttcctagttaagatagaattaagacaacggcaaaggaacaatggtgacacaacaaaaaactgaaggtgatctttactgacgaattaagcacagttggggtattaattctgaaggcaagactgttctcattttccattagacagaaaagagagacaaaataactctacaggctcagggtcacacttacctcttcctccattgaagccaacgacttagcttcatcacagcctgccatctcctgtactcctctctctgtcttctctgcaagaaacaacaccacaactttcagttcctgactaaaaacataaaagattaaacaagatggtgaagcattttggcctgaaaaggagaaggaaacaagtgcaggaacttcttgcagaggtacacaaatgctgtaagagatgaaaatttcaagctttgggtgattaagagagacaaagagttaaccttgtgtgctccttcgtcagggaagatggagaggaggttatgaaaggcaaggagaaatgaagtgtgggcagagctgaacctgatatttatagagagcttgtacgggaaaccaacgaaggcccggtgcacaagatacatgcttactgtatgttagtacaagatatgcatatattactcacgtttctaatccagacaaaagtatcttttctttatgacgctaggagcaaatctaaagctggcactattcctcaatcaatggatagatagggaagtcatcacacatcccatccaaaagtttgagttgatgaataggggcggaaaattcactatatactttaagcaagctgcaagcctaatatatatgtgcaagttttatagggttttaggtgtgaaatactcctttcgtcataaaatatagacgacatggagggtctataagttaattctactccctctgtcccataatataagggattttgagtttttgtttgtaccgtttgaccacttgtcttatttaaaaaaattagaattatttttttttgtgacttactttattatccaaagtactttaagcacaattttttattttttatatttgcacaaattttttaaataagacgagtggtcaaacagtgtaatcaaaaactcaaaatcccttatattataggacggagggagtaatttttttaattgcatcagctagaattcaaacttaaaacctttttggctctaatacagtattgagtcgtatgtactagttagtttgtttgaaagttgcggatacacggttaagaatggactacccttcgattgtaaaaatttacaatccatcatttagccttcagtttttaagcacaagaaagaatttgaattttaaatcccttccattgtggaaatttacaacccattgtttagccttttgtttataaatgcaagcaacaatttgaattttaaaacataattttagagtcgatttcgggttttttttcattgtattttgttttctagcatttcttttaaattactaagaacacatataaatatttcaaaattatttttttaataataatccattttgctgataataagtataagcataatgacgtggttgttatataccttgtgttttaataatttattatgtagcggtcatgttattaaaaatcacacaattgagtagtctttaaccatcaaaagcaaatttatttttcctaaaaaaaatgttcctaaaagattgtctttttagcttgaaacattgtctacaaaattagagtgaagtctaaatttggttgggtacatggagctggatgggagatggtcgtccaatttttatagtgttttgttagatgacagtgtgggtaagacggtctagaaaaaaaaattctttcaatatcctccatcgtccttgtctcatcctcctccttttttcccctccttgttttcttcccatattaaagaagggtatagtctcttgcatgctttttgcgcaagattgcttggtctcgcactctccccacgcgagaccgctcggtctcgcgccgtccccatgcgagagcgatcgcgtcgccatgtccacattactttcgtgcaacggttcagcgataccgacggtatatttatgctaaaaaaattgcatccataatatttttgagaaaaaatgaacaatatattttcaaatttagttccaaaaatggcttgttttcatgactggatagaataatggcgtgtttgagacgagggaaaagaactagattgagaagatccatacgcaaactaaacaagatgagctattagcgcatgattaattgtgtattaattatttcaatcttcatgtgatttttaaaataactttgtgttgagaaatacgtaacgtttagtaatttgaaaagcatactcgtgaaaacaactttttttctctttctcataagaacgaactcagcttaatataatatttttttaagcttatgaacttatgaattatgcgtacatggttcaccttagggggtaatatgaacggttttgcaaagtttagggagctggatgtccagttttaaagtttagggtgctagatgaacttctatctaaagtttagggggtacttggactttttcgttttataaacgtggttaactaatgtgtgcaagtttgttatatgagagatttggcgagagacatgtgagatcgttacagatctaatcaacgagacatgaagatttttgtgagatgtgaaatctaggcgtgcgcacgccaggtggatctaatagcggacaagaatatatgggtcaagccaacaattagaacacctgtaaagctataaaatgacctgattctagtaaaaaccctatatcaatactactccctccatcctataaaaaaccaacctagtatcggatataacacattctaatactacaaatttagacatacatttatctaaatttattgtactagaatgtgttatatctaatcctagatttgttttttttatggagggagtactaattaagtagatgtggttatgtatgggtcgactagacatgagtctacttaaatgctcagaaatatcagttgattgattggattcatttcgaatggttgtctatcattctaacctcaagactacgaaatgagaaacatgttctttattctctctttctcatgtcctgtgctcatatgattttacggcattacagtcctaattaaagaccggattctacatttctggtaggtgaaatatacaattttacggttcttttatatgattctataagtgcaatcctatctggagacctctaatctggttcagggtcatgatttttaaaaccttgcctatgccgaagagtttcccctgctcttgttagctcaagccgccagttgcacagccgttcccgcttgccgcctcctcactcagtttcacaacaactccaaccctacccattgctaaactttctctgtttctcacccatagctcagctccgaagatgcctcaccgtattgcctaaatattgcccagtccgccactgcctagagctacctctaaaccttgattaaggtggactctcttcccttccctccccctttatctcacttaggtgattaatgttagcaaggtgatgcataacttcacccactagaatttaaatcctagtagccattaatatgatcgtgtgcatccttagttagtgtagagattggaagttatactttcttttattaaaaaaaatgcaagggtatataataccacaacgaattaggagtttctcaataagcttactgttctgtagtctattagacttctcttctccattgtttattttcagttcacctttgccctaggattccaaaggcattcttcaatcgctctcttccaaattctcttgctttcttctaccctttcttccacctcactgtaaatccaactcaatgtttcctagcaactttgcccatatggctatatcctcatggattcttgtctctgcagctttcatatatattctcccattatctaattcgcgcatgctttgtctccccttatccgtgctccgtgcatgccgcagtgtctccggatggttggctgctggagctttgcctggtacgccgacaggtcaaaattctggtgagtagctatcttggtgtgtgtcttttatgtgctccaaatcttttatatatgatccatatgaagttataaaacgatagtgtcggcatacgctagggagaaatatatgtgtgcatgttatgtgttatggtcattttgttaagttgtgcgttcgcaaaatgaataaatgatcatttttgttgtgtggtttggtagggtaaacccctatcagtcatcctggtgtaaccctattaacaagagcgattagctctcacagttaaattacacacgcaaagcaaccgatatggcgatcttggaaggcaagctacatacatcgatctatctgcagagtagttgaaaacttgaatcggataacaacatcaaaagtccgtactccgtagcttaagctagacagagagataccgataatgcatcgattgagaatgcacaacgtttggcatttcccctatttgtaggggaagatatgtgtactcagtactcccttcatactcgcaaagagagtcatttaggacaatatttaagtcaaaccttaggaatataaatcatgaataactctaaagttgttgagtttgaaaatgtaaaaatcatatgaatagatttgtcttgaaaaatactttcataaaaatatacatatatcactttttaataaatacttttataaaaataagaagtcaaagttgtgtttaatttggagaccgtgtcgatgtcctaaacgacttcctttatgagtatggggggagtattaggttgagcagaactaggcatatacaacaactaagatggttgttgtctacaccctccatcccatattataagggattttgggtggatataacacattctagcattaagaatttagacagagccttagtactaagaatttggacatgggccatatccagattcttaatattaggatacgttatattcacctaaaaccccttataatatgatatggagggagtaatatatttctccgatggtctattgatagcactagacagtacccataaaataggctctcgtagcaactaacaaaattaatgcgagttaatcaaattcagattagataatctattcagattagataatctatcactttgtttcgttaattaggattaaactttgatcaataattgctttattaggatatttaagtgataaaaacataatcggtgctcttaatagagtaatggttggtcaaagtttagcctaataagacaaaatatgacctacttcctccgaaaaaaaaaagacaacctaggaagagatgtggcccctcctagtacaacgaatctggataatcctctgtccagattcattgtactccttttttttttgagacggaggaagtatattttttggatgagagagtacattataaacatagctataaaataagctatgacatttattatggagacctataattcctgacggtaattgtgaaaaagaaaaaaatatttgcaccattagatcatgatgggtctagattataatggcatatattgattaataagttatatataaatacaaaagctcaaatttgtatatcaaatcaaactctactttttagaaatatacaaactataactgtatgaatgaaaacataagctaacaattgtatataatattcaaatatattttcaaaatttattaattatgtagatagaaactgcacttgtatttatggaaatagaaggcaagggttatatatcaaattcaatttcatctttatatagtttcgtgccatttgctcaagaaaattctctaattatattattattatggtagaaaaaaagctgccacatttgctctggggtctaaaaatttgcacgttgattgaagaaaaagataaatacttacacaaatattaggagtcgtataccaaatcaaattctatagttagaatatattgtatacaaaatataattattccatggatacataatctcaaagttacatgtcaaatacaattcaactttaaaatctattagctccgtgtaaatagtgctaaaaaaatccgctagttgctttcagatagcgctgaaaacgacttatgtcatcaaatgcaaattagcagaacaaaacagccctgattgcgtaatttcggaatttcaatatcccaagaagaccatcattaaggtagaagatattatcgctctgctttctttctgccgttcctttgaggagcaccattcaccaaagtgaagaatctttacgtctcttttcctccgagtcctctcttaagtcttaacgtctttctcgcctcactcaaagtcaaatcttaccgtatccatagactagacccaaaaacaactggacggaatatatgttctgaatttctggaggacatggtggagcccacacatctggtttcagatttgccacgtcgactcatcatatatatgatcaaacttaacattgaaactgtacgatgtcacgcgtgtgaaatgtttgggggtgtgtgtgtgtgttagtttttagttctttcagactcatttaacatctggttcttgttcttcgaccaaatgcggaatgaatttgagcagatttttcagtcttgcacttgctctggtataggtaattcgtgcatcgccttacggccttaccgtatcaaggttattatttagttacaagaattttagtatttttaggataataaaaatattttacatctccggcatctgccgttagacatataatcataacaagcattttagttgtgtgaatcatagatgtagagataatataattcatcttattaaaaaagggagatcgattcagtatccaagccaaaaattcaaaattaaaaccccacaagaggttcttccaaatgcatagtcattctagaaatttaatttgaacagaattaattctcaactaaaatgttttagaatgtgttgcaaagacggcgtgccaacgggcgcgctactttttctagtgtgaaactaaccattgaaaaaatataactgataaaaacatgaccctttattacataacaagaaataattttataaaatactccctccatccttaaaaaaaaggcaacctaatattagaatgtggcacatcctaaagtagtttagattcgttttactaagataggtcacatcgtaatatgagattggttttttttacggatgaagtatatgtcaagctaacctgtagcatttaattatcttataattagataatagaaaatgatctagtaagtttgaaactatgagggagtttacagtgcgctggacaattttacagattctgggctgctatttaggatgaggaacttcgtaagtaacaagtctcatagtgcgaaatccctatacatattatttttagtgggtcccacatatcacaagtcacttttcatcaacccctcctctcctccctgctttctcctgataaattttgaggaggttcggtggccaaataaagctctccgttcttggctgctcctccctccataccgatgatgccacctcaccgccctgtgaatagcttgaagagacattttataacagcaacactagctccttttcccgggtcttttcctgcctgagagactgagagctgagaccgctggctgcttgagggaataatatggcgatgcgacctgctcttttgacgatggattcgactgtattttccagctgtgctgtcgactaggaatgctgtccacgtcagcgccgcgccgtggcgacaaacctctggacttggcgttgcatgttgttgcggactgcgcgaggcactgcgaaaaagaaaaggcacttttgcgctttgcttaggaataggatagcaggtacagtggagatcgaggttgctggatgacgtgtccttgcccttgtggcttagtactgctgccgaaaattgacacgttggtgattggaattggactggctgctcatttcggcctagctagtcctcttttgacgtcgtaggccggaaagcgaaaggtgaaaagatgccgtaagcatcacctaacagtatctctaaatgaaacccgattttaaaattaagatttattttatgacaaacttgctccaacagctttcttagagaagtttctggaaattagaatcccttctcctcctttctcgccctccacaaatggggagacgctcttgctcccaatttccacaccaaaaaaggaggggcgccacgcggagagatcattagcgcgagaagggatgggcggagttattttttatttgtgtatctgttggtagttaagaatgggtccactttttatagggagttaatttaatgtacctattggagataaacatcacttacatcttaaaatcaaattaaagattccaaaaacagaatgttagagacagatttttgggtatctgttgggcatgttctaagggcgttcagcctgagtaccacatcatcaattccacgtcatgtatgcttcacctggtgccaaacgaagaacacagaacctaacaaagacccgcgctcctcgtcaatggttgtcagagcgggacagcctttgcgcgttgctactgctgacaaggtttcacgcatggcaaatgaagagaagggaggaagggaagatggcagtggtcgagctgttgccactgagacattgtcttcgagccgttgccgccgacatgctgccatcgcccgaggtcgatctgaagccacctctctcgatccgcgcaaccaatggcatggcaccgccagcaacttggcagccaggggagggggatgtgaggggaccgagcggaggtgaggatgtcgtcggctttatcaggctcccaccggatcccccaaggtcgccagccgagagggagctgagtccgagccagatatgcctcgagctccaatccggcgggaggataggagctcgacgacggttgggtgtggcgtcgacaggagctaggcggcggttgggtgcagcggcgacaggagctcgggcacaattgggtgtggcggcgattaggtgtgaaggtggtgaagcggcggcaccccaaccccgacggatggatctggctggcccgtcgctgctctgcccggtgccgtcgccgcttgggccactgcgcccagcgccttggcttcatctaccggtggggaaaggaggagaggagagagaggggggagatgaagagtgaaggagggagggagggggagggtacttgtgggatccactgtaaataacttgtattatggagcatgtagctaaacatgttcttaatctatgtagtatgtgaggttcagcaaatctggagacacactgctattccctaaatactgctcttttagattcaagtaaattaggcttgccgtacacaaatttaatataatcatattaccttcattctctttcgtatatcatttttcagctgagggcatacttttttctcaatgtaacatagatacatcatgaggcaacaagacaagggtgaagtgtgggtattggtgatcttaagtactagaatgagatgtgtgctctagctaaggcggaccacttatttgattttgaagcaaaacacactcactagccaagttgctatagcaatacgcttttttttttcaagtttcgatttcaaccttactattctaacaatctatcctcaaggcacttcatcctgacgttgccgtcttgtagcagtatagtactcataggttagcagttgagatagcaaatcaacacaagggaacaagttggcaacagtgttcattcacctgcttttgtattatttcaagctctttaaaaattcactcatcaggatcaggtgtgttcgtgatataaaaatatgagtatgagattacagtttacaacacggtcctaaaattcgtggcaacgatgatgtgacgatgaccatagcagatacagtaacaagagttcagttcagagcgcagcaaattcagagagctcaagattgatgggctcacatcctgctcttccggaccgggcccaattccttggccttggccctcagctcgtgcttcttgatcttccccgtcgccgtcttgggcagcggcccgaacacgacggacttgggcacccagtaccccggcagcctctcccggcagaaccgcatgatgtcgccggcgagtgccgcctcgtcggagctgtcggcgccgtccttgggcgtcacgaacgcgcatggcgactccccccactgctcgtcggcccgcgccaccaccgacgcctccagcaccgccgggtgctggtacaccgccttctccacctccaggctgctgatgttctccccgccggagatgatgatgtccttagccctgtccttcacctcgatgtacccgtcggtgtgcttcacgccgaggtcgccggagtggaaccacccgttctcgaacgcctccgcgttcgccctggggttcttgaggtaccccttcatgacgccgttcccgcgcatgacgatctccccgagcgtcgagccgtcggcggggacgggcgccatcgtcttcgggtcgacgacgtcgaggccctcgaggcccacgtagcggatgccctggcgggcgtggaggcgggcgcgctcgtcgtccggcagctcgtcccactccggcttccacgcgcacaccgtggacgggccgtacgtctcggacagcccgtaggtgtgggtgatgcggaaaccgagcttcgacatggacgcgagcaccgacggcggcggcgcggcgccggcggtcatgacgttgacgacacgcggcagggggaggatggcgtcagccggcggagcgttgacgatggtgttgaggacaaccggtgcaccacagaagtgggtcacgccttggttggctatcgccgagaagatggcctttgctgtaacctgtgatgatggcgaacagaagtgttagtgaatcaatttctagtttgctactcctagccagcatcaaccatcaagcaggtaatgaactgggtaaagtcactaggcatgaacaagagtccatccccaacctaatctatggtatcaaattcattcatttattatcttgcaacttatgactgcatcacaaacaagtccatcaagcacacctagtcctaatgtctgcatattcatttatctgggaggcaaggaactgatgagcatttgtgtactgaaaaatacccccatgagctagcagtacaatagaaagatgaccagaaattggcttcttaaatttcaagatatataccaactgaactaattatcctgaattccaccctggtattattgcagtaatgcatcagttaacaggacttgattttcatgtttatatgtctttcacgtaacaagtgaacaacttgtaccatttcactgcaatgctctttagagttgaaaaatgaaagtaacattgataatgtagtatcaggactagtttaaatttgtctgggagtattcatacttgaatgacgcacttttaccaaaaaataattcattgcctctagtccttatggtaattttgtagacatgaacatgttgtgaaggttattgcgttaatctaagtaatatatttgctaatgatatgattgttgtctcatacttactattcatataggttcgatagaaataatgaataggtctcaggtgtacacttgctacttcagttttgcagattgttcatgttccacatgaatgctcgagtgataaagttcttactgaagaagttctagatatagcatagcatacctgacgaagacaaatgcttgttccacaaagagcagcaagtgtccatgtatagcaccagccattacagtggaacatcggcaaagtccacaaataaacagcgccttcattcattccccataccagagcaccactcagtgacattaggtaagcacccctgtgatgcagtaccacgccctttgggttggaagttgtcccggaagtataacctaaggcaatactcttccattcatcctgtggtggtttccaggcaaattcaggatcgccagtttccagaaactcctcatactcaatggctcctttactcaaagcacttttgagggacacgggatcacaagtttgatcaccaataacaattagaagtggctgtttgaaagctcctttcttttgctccgcaataatcctcagagaatcctctgctagggagaaaaattcctggtcaaccatcacaacttccgctgatgagtgctccaagagaaatgcaacagtaggagcatttaatcgaatgttgacgcagttcaccactgctccagccattggaactccaaaatgggcctcatatactgctgggatatttggagctattacagctacctaaaaaaattagaagaaaccagtaatcagtgcaaatttgatccaatatgttgtgtgcatgcaaccacagaggttttagctagcacaacttagtcagatgaaagtattggagtatcacataagaagatattattgtctgccatatgatttctacaataatttgcagcagacagttgtaatcttctcatgtgcatccaatatatcttactggatttggaaggttcccatttcccatcagcatcaagagaaagaaccattcagtttccattgagacatagcatggtaaaaacctaattttcgttttgacaataactgatatgttcaatcttagcatgtgtttgttcaattaaaatgcataaaacacatgcattggaaaaaggacaagttttaggatgcacacatctgaggactgaagaagcacattatgcatactacatctaccaccagtctaactacatgatgggacctgccctctgtttttctcggcctatttagttcgcgaaaggaaaatttttgggtgttacattggatgtttgaccagatgtcggaaagggttttcggacacgaatgaaaaaactaatttcataactcgcctggaaaccgcgggatgaatcttttgagcctaattaatccatcactagcacatgtgggttactgtagcacttctggctaattatgaactaattaggctcaaaagatttgtctcatgatttcccccttaactgtgcaattagttttttttaatctatatttaatgctcaatgcatgtgtccaaagattcgatgtgatgtttttaggaaaaaattttggggaactaaaccaggcctaaggaaaacagtagggcaggatctatcatgcatatcatgtgaagatattctaaatttcttcttggtccgccatggattaccatggcaaactcatgcttgatagttgatagtaatagtctttaaaaatcctgttatttgtgttaatccaaatgctccaaagtccaaactgccagtataatggcatccgtataaaaaaggtttattgatacatgatttcaaattgacaaaaggcttcttcagtacgcagattctgatgttactgaaatgaagtcccagcattgggaggtgaaagggcaatatattgctgtccaatgttatctcccacccttcattagaaaaataatatgctgcgtttgaaacctgaaaattgatttccccaataataagccttctcctttattgaaaaacaagtcttttttttgtgttcttgaggggaaaaaaaagttgtggcacaaatttaactttttactgctgccaacttggaagcttcatgtgtttggggtgtttgactttgacatcgccatctccaggattacaggggcacacagaacagtagaacactaacaggaacaagtagagggaggcggaaacgaatcggagaacggggaggagagtgggagccgtaccgtgctcccgtggccgacggaccggcgctcgagggcggaggcgaggcggcggcatcggcggtaggtgtcggcccaggtgtagcgcacggggccgtgcacgacggatgcccgcgccgggtgcgccagcgcggcgcgctccaggaaccagagcggcgtgagcgccgtgtagttggcgcccccccgcggcaggtcgtcgatgtccctctccgccgccatccccgcgatgctctctctctctctctctctctctctctctctctctctctctctctctttctctctctctccgcacgcacgcattcgtttggggtggcttggttaggctttgactgggcaccggtaagccggacaaatggaagatgatgccccaatggttttttaatattcgttgaaccagcgtgccgccaaccaaggccaataagaaccggtggctggcctgccgaaggattctggttgttggtgcccgggccgggaaggaattttccaagtttttggcttctagggctcagcgcgcggagcccgacagctcgcgcggggtggggaagttgtgaactggtggtggtggtgggtccgtgaatcgtgtgagttgagaaattcctgttgctttttaacgttttttatgtcgcctgcagacggggccggcgggcggcggctagtatggagatctcgcttcattggtgggagaatgcccgcgcgcccatgccacccacccgtgtgtgatgcacgatttgcaggccacgtctcacgtgctgtcagtgcacccgtacatgtacaatagtattcccacgtcgattttgctatacactaccccgtctcgaaaaaaaaaaccttaacataaatctgaactagtatgtatccaagctcataagctcatagttatgattgttttcttttttgatggtggagtatgtaccaacaattatttttataaaaatttaacaaatataaatatagtacaatcacaatgtaattatattgtaacttgcatgtaattgaacagttcgatttgcttttaaaattcatgtgaggggattcggtactattatactttcgtataatggtaggaaataatcacaacccatgcactaccattaaacctttgttttcacgaaaatagcatgtcacctagggatttttaaaagttacatataattaagttacattataattacaagcaatttataattaaattatatcacaattctacttatatgtacgtatgtgaaatttttgaattaaaatctgacgacaaatgtatagcttatcctattttctgaaaaatatgagtattcaagtgaatatccatgagtccccttggcccgtccatgtggacacgtactggtatttcctccaaatgattttggagttactaaatttatgtccatgcgctgcaatagaatcacaagatagaaatatgattcgctttttttaatgtctgtttttcacgatgggttatgtttctatggctttttgcagtttttttaaggggaggggggttttgagaggaaggaggacgtctgtgctttttaagtactactgtactagttaagataagatgaataacataaaaataaaaactaccagtacacccttaccttatcacgtatttgaatgggtacgaaagatgtttaggttggttgtaacagaagtttcaatatattggcgcgctggttctacaagggcgtacgtgaagctacataaggcacatgtacttaaaataagtcaacaattgaagtttgactagtttgatcaatttattagtcctgcaattttagctataaatgattctaaaaggatttttctttttctgaattcatgtaaaatttaaaattcataagcattttagtgtcacgtcatccaaaattatttttaaattgtcatggttgtgcactgtagaagtttaggatcaaaagttgtctggatataaagttcatattaccttttaaatttgaaaaaaaaaaggctataaataaatttccaatatataaagcatattcaggagaactagttaatgcagagctgcagctacgctacagccgtagctacaacaactgcagcgggctgtttgagtgggctgtgcgcaacagccttgcacaatccaaaataggggtgaaaacggagcggattcaggcggatagtggtaatataattttttccttaaaccatattttttaagcagatgaaaagcggattgttttggatgtcggaaatagtgcggagtagatgcggaatcggtttggaagcggattaaatttatcggatgttacgtgtatgcaatcaatacaatatcaagttagcaatacaaagaacaataatatagtaatcaaataaacgacccatcgtaataattacgtgcttaagtgctaaacaacatgaatacatgatgtccataatataaaaatacagttacgcaagtgtgatatgagacagtaaaagcctcaaactaagaaatctaggttaattgatgaattatgccattggatggacgaacttatgttatatgcaacagacaaagtggttacatgtgttgataatttcggattatccgatgaaacgtcatataggataattcaacagaaatgtcggataatccgcatccgccggattttagagataccatattctcatccgcatccgcatccatatccgtcggatttctaaaagctcataccgtatcctcgtttcggacggattcggatcagatattatcttatccgttttcaccacgatcccaaaatgttgtagcttggccgaccaaacatgctgataaaaatgccagtcaactaatgtatggcttacttcattcattttaaaataagtttttttttcataatactacatccgtcctattttaagtgcagttgtgggtttccgtgtccaacgtttgaccgtccatcttatttaaaaaaaattatgtatttttttataaaaatagtcacacataaagtgtattaatgctttacgtatcatctaggaacaataaaaacattaatcataacaaaatttttaaataagatatacggtcaaacattgaaaataaacaatacaaaactactatctttgagacagaggtagtattattttgttcatcaatcatctacaatttaaatttcttccatcttagtatcttatccgaaccagtatcccactattaaccacacccatttaataaaggacatataactttttttttcgaacaataatctttactaacccattaaaaatggtacttattatgggagtttctcaatattgttagaagttataaaagttttaatttattttaagatggtagggagtatgatagcagatagaatgcatgttagacggaaagataacacttctccacttgctgtgagtcgaggtctcgaggaccaaaactcaggagaggagtatatgccgctggtcacattccctcaatggcacaccaacctctaaagtcaaaacagtactgagtactcctaatccagtgcgcgccgttcgtcatcaaaagattagcttttctgactttctccattgactcgccggccacttttgtcctatctcaagccctggaccgctgtacggatgcagacaactctgtgtgtttggataatggaaaatggaaggtaagattaagattaggaaatgaataaattgttgaaactaaatggaggaggaagaataaatggttaaatttaaagatgaatgaaaaatcatttcccttttccatttgccaaacattgccagtgagcatcacggagaaactctctcagtacgcagcagccaacggcaacggcccaggaataaaaacggaggagcgacccgcgaggccgcgactcgcgtcgaagaaaccgcaatttctacgcctgctgccaagccgcgctgtcatggtgtcacctcgtcacgccaccacgaacaaatccaagcaatttgcgttttgcggccggtgagcgggtgattcgtccatccacatggtcagaacgggacgagcaacgcaagcatcagcacgcgactctccatctcgcctggatcaagtcaagct

SEQ ID NO: 77343 - DNA, 4716 bp, Oryza sativa
  unsure (1)..(4716): unsure at all n locations
catcgtagtttcggcttgtttcctggtgaaataatctggtagtatatgaatcaagttggcaacacttctctaaaaagaaaatcaagctggcaaccattctctcgtgtgttgagatatgattagttattagttgtcacgcgttgaatgccttgtttctgttcaagtatttgcacgttagtcatgttctagagtcagaattttgcaacgaggattggtatggtaggtacaactacttttatatttcccagtaggatatggctaagatcggagctgtctttcggtactatatagatgcctccacgctgttcattgcacaacatcaatggttggttttctgatgagagtggatcgtttcatgtattggaaatatcaaagatttatttcatgccatctcattccaatttcaagaattcagtttgctcataccatgatcatcctactttgtttcagatagcttagcttgattggggtgggtgacaatgggaggtggcaaggacaagcatgacgagagcgacaaggggctcttctctaacatgatgcacggcgttgccggcggccatgggtatcctcctcaccagggataccctcctcagggctacccgccgccgccgggagcgtacccgcctcctccgggggcttatccccctcctcctggggcttaccctccaccacctggggcataccctccacagcatgggtaccctcagcctggtggctaccctccacctggtggttacccccaacatggtggctaccctcctgcgggctaccccggatcatctgggcaccagggtatgtaattcttgttcacttatgtgctattaaggttctgttcttgtcatttttgtacaattcttgttgaacttttaagcaaattcagtattgagttgaattgtggtaattccctcctgttggaccatgcatgatatatgatgctgatcatgctgtatcacctatgccgtgatatgtgaagtttttatctttattgcaatcatttgcgctcatgatgccaactccattcttaccacttcgtcttagttgaatgcatgatgtttcttctccaattattagatgccattatgtgtgtttttaatctacatcgtactgcaattcctgctgaactcgagtaaacacctctgcattttgcacatattctgaattttaggattgatttggattactctagttcccttctgttgtaccataccacatacaactcttgatgcttcatctacactttagatgccatactatgcgtattttttgttaccatcattgaactgtttcagcaaaatggtgtgactctgttctcagcgttctatccttagagagtttctaatgtaatgttgcaggcggccatgggagtagcggtggaggacacatgggagcaatgctggctggaggcgccgctgcggctgctgcagcctatggggcacacaagatctcttctcatggccatggtggacacatgggctatggaggccatggaggctttggtggttacggccatggctacggcggtcaccacggcggcaagttcaagcatggcaagcacggccaccatggcaagttcaagcatggcaagcatgggcacggcatgttcggtggtggcaagttcaagaagtggaagtaatgcgcatgatctgatcatgctggaactctgtttaggctttaactgaagtgcttgcgcttggctggttaaaagcctaaaaaaagcctctcgaatgtatctaagcaggatggagctntgctcagttgctgctcccatccttcctctatgatttggtactctagtatgtggctcaatgacaatatggcttgctaataattaattaaataccttctgacgcttatgcacatctgtgttctaatgttctatagcctgatagatatgatgtgttgaaaccttctttgctgcttttctttcttctgtgaaagtttatgttaccatttattggtaactgctgtctcctgggacataattgttggtttctgattgtgaatttataaatttttaaaattttggatgtgcaatgcaacattagactggggagatccagatttttttcagagatctgagctcttctcgacttctcctagcctcctgatatagttataaaagtggtcagaactaataagatagataagttgtcatatatgttgacaaattgtcattgtatccctataatttggatggaggtatattcttctttgcggagttgattgataagtaccctttatgtaattgtggttatgaattaaagtttgttttagtctggtgttgactagtactctctctgtttcatattataagattttcgtattgtccacattcatatagatgttaatgaatcttaaacacatatgctagaaagtcttgtaatataaaatggggggagtagtttttaatttcttgtgtcaattaaaactatacatttacataagcataaaatcaagaaaaggttttgttttaaaaaaaagattagccatgtcattctaaagggacaatgttacaacaataattttgatcaaagattaagctattttgactgcacaaattagaaaggaacattctttttgtgattaaacgtactactccgccgtttctgctcaaaacttaccgacaacgacacacagatttccggcgcatctaattcccccactatgataagataagcaaaagcaagggctatgattttacacggcagagttcaagattctcacaattaaataaggaacataaaaaagcatgctttatttatcgccaaaataaaccttactaatttctttccataagccaaacaaaccaaataggacctcaccattatgacctttaccaaaatctaataaagttccaaaaccaaatagcactttcacactaataaccttatgatctttctgctttacaacatattggtaagatttattttagcaacaaagtaaacatgccataaatgaacaattagaacaaccagtgcaagtctccttctccaataaacatctccttccatacataaacaccaccaagtcaaaaatcagcacgtcactacggctatatatatagtacacgtgaagaacaatcaggtcgcaatttagcttttactattctaatcagcaactccaaccgatccactaattacacgtcagcttgcttagccgcgtcgcgctgctctgcttgatcatcatcaccttctccgatcgatcctcctcgacgccgcccacaaatataaatcccacacgcgtcctcctcctcctaataaactcctccaattcctcgacgaatcagttttctcctctgattttccaccacaagatctctagtttctttgatttcttgatcagacgacgatgggagggagcaaggatgagcagcaagacagggggctcttctccaacctgatgcacggcgtcgccggcggcggcggcggccatggctatccgtaccctcctcagcaggggtactacccgccgccgcccaccgcgtatcctcctcctcctccggcggggtacggcggcggctatggctaccctcctgcaggttaccccggctcgtccgcgccattccaacacggtacgcgtctcgttcttgttcctgttcgattctgttgtgaacttgtgatgattatatatagtcgcttaattggaattgtgattttgttcctgttcggctcgattcgtcgaattgatcggtagtagtattaggttggatcaatttgctgtttctatttcatagattttgcattgataggatctatccccaatttagacccttttttgatcttattccctgttacatcggtcacatcggatgtttaacactaattaaaaatattaaacataaactaataataaaaaacatttcataacccttaaccaatttacgagacgaatctatttagtctaattaatctatgattagcctatgtgatactccagtaaacatgtgctaattgtagattaattaggcttaaaaatttatcttgcaaattagctctcaattatgcttagttttattgttagtctatgttaatatttctaattaatatttaaacatccgatgtgacaggtactaaaatttagtctcttatccaaacaccaccttagctgccataatttgcaaacctttgtaacctttctttggcctgatttagttcctaactttttcttcaaacttttaactttttcatcatatcattccaatttcaatcaaactttcaattttagcgtgaaaaacacacggtttgaatcctctgtttttggtgattcagacaaagaacggtggaattctgttcgtacaattttaatcgttttgaggactccctgattggttttgcaggtaaccatggcggaggaaacatggggatgctagctgcaggtgcagccgctgccgcggcggcgtacggcgcgcacaagctttcccacggtcatggccatggaggctacggctacggtggccaccacggcggcctcttcggcggtcaccatggccaccacggcggcttgtttggaggccatcacggacaccacggcggcggcctcttcggcggccaccacggccaccatggcggcttgtttggcggtcaccacggcttcggtggccaccacggacaccatggccaccattgatggtgatcaccatatcgtgttgcacggcgtgttcaatcagtgcgagtgataagatgatcatgagttggtttgattatactactataaact

SEQ ID NO: 77344 - DNA, 2208 bp, Oryza sativa
attcctgcagcccaacgtgataagaacaaatcgttaacagagagggtatgcacctatatataagtccttccccctgtagattgttgatatctaaactgtaattctttgggcctgaaatatattatgttggtgccattttggttcttaaattttgagtgacaaactatttgaacaatgtgatatattagtaaaaacaatagcaatgacaaaatatgatgctttgaagtctaaattcgcaatttgttccatggaatagcaaactaagtgtttatctcagtacttgttgagtgcttcacatttcctcatgcaggtcagaattcacaggaattatcttgacatgtgatctcgtttgcttgaaagtagattcaaatgctgttttgttattttctttcttatcaagctttcacaatttcatgcttccacatttttacaggcgtttggaaactgttgtgttgcaatttggtgttcttaattttgtcggtttaagggtacttagcatcgtttctgcctgtagttttttttagtacttgatggacaatgatattttccatcttttcaccacaagaatacgctgcaatcttcatgtaatgtatattgctgatcccttacacaacctttttgttttccagttagaggatgcacagaggcaactagaaacttcaaacaaggaacaagaagcattgattgacatcttctcagaagaaagaggtcgacgagacctagaagaggaaaatctgcgagggaagctaaaggtgagtgcgagagaccgagcaagtatatctttgtactaaatcgcagtatcactgctacttcactttgataagcaattcgactctttgccaggatgcttcttctaccatacaagatttgctggagcaattaaacgctgcccgaaaaggtcgcaagttttgagaaaaaatagctattttgctaccaaaaattcactaaccggaagacctctagttttcagttacactgacgtgaaggattccagccattctagcttgtgtagggagaggctgtaggctattcccctatgtttagtgttgataggtagttccatcatctcacttccagatcacttccagcattgtgtacaggcaaggaatgccaataaaggctactgttagtgatcggtatgtgagtttgtaggtaaaaacactcgctaggccttttaatacttaattagtcatttcgttcgttgtgttcaatgttacacgtggttgtgtcaaatcagtctcgattttttgtgcctgggcttttcatcctctttatctcgagtctgacagtgaaacagtgttaatcaacggccgtatgggaggtaaaaggcatggcttgagccttgaggtaacggactccagctcactactcaactggtgtgaacacagctatgtgccatttgatagggtagtagattgtcattttattttcttttggaagtgaagcataagtttgccatttgggaggtgccttgtagcttcttttaagtaaagctagacaagctatcccagtaaggacctcaatcacattgcttattgtagtgtcaagaaagttcgttgcagattagtgtctagataacggattgtgtgtctgtagtatattagtgtctggattgcggatagccgacgctaagtttcaatagtggaattaagaaaaataaccataaaattaggttgtgtatcaatattaatatcaagtttcacttaaaattaaaatttagaatgcatgcttaatttctctggcatttcataacataaaaattatgaaataacatataaatatataagataaagaagatacacaatgctaaattattctatccatatgttgaaagaacatcgcttacacattgtagcgatgcgataaagtcaacaacggtcgtgaagcactgtaacaggctcctatagcgtcgtgaagctatagcagtcgctaagttccaatacgctaaatgtagtccgctatcttgtagcggtatcggtatagcggccgctattgcggtcactacaaacgtgctaaatatagtccgctatcttgtagcggtatcggtatagcggccgctattgcggtcactacaaacgtcgagaaccaatcttctagggctccttaagaacatagttttttttttcttttaatatgaatgcacatgcaaaagcagaaagtcgaaacacagggtaggaaagattcaacgaaatttcacatgaaaacttg

SEQ ID NO: 77345 - DNA, 9752 bp, Oryza sativa
ttcctgcagcccttattatcaatggccggtgaaaattgaaatagttgaaatcataccggatttacttttacaaaatctaaagaagtgctacaatattatcgcgtttgtgggaggatagcgaaaatctgtcaaatctaaggtagattaggtgagatgactagcaaaactttcttttgtgggactatcggttctttttatcagcttattttactctattattaaaataaatgatttatttcacgtttcaaataaaattctagcaaagcaccgtgcactgtacagcgccacgcctacgcccaagcagcatacaacagttgtctattatatatgaaatgaattatttacttactccacgcttctataccgtgcactgtacagcgctgcacctgcgcccaggcagtatacaacggttgcgtcggtgatgaaacagaacaaaatttaccctgatcctatgcatactaattatctaattgttaactgatatattaattaaaattaaaatgatataaattagttataattagataatttacatgggttcttgtgactttgagaaaaacaacgtaggaaataggaagctacatagtgctgcgagcatatatgcactaaggctataatattataaatgttatgcaacgctatatagtgtagccgagcatgctctaaggctataatattacacacccgtaatcaaataataaatatgtagcaaccgatattaaatgtatagtactattacacatttatattaaaaaaagatatttggagggaggatgttcctccaaacatttttttaagaagtaattgtgagcgtgttagagattaaatacgggatcttggggttgaaaccgtgcacccttgccactacactattaagtgcatctcattattgcccacttatgaaaatcaaaaacagtagaatggattcgattcattgtccatgaatttgatatcttccaaatggaacttattttgataatcaaatagagtggtttcgaccatctagcactctcccctgtaactatgtttatgttttgtcgtttatttataaaaataagggacatattctcaagactccatattggacaatgtccacgaccaagaatgagacatcagtaactataatttagactataccgaaaattggaataattaactttttaccgcaacaagtgtgagtggaaaagaatttttccactttacgagatgatgttacgagattaactaaatgtattattggcactatatagttaggttagaacccattcactttggattcgagtatgagactcgatacggatattcttgtttaccactaaggccctgttagtttctcctactaggagaggataaaattttggattagtgtggcatgcttttcaaactgctaaacgatgtgtttcgtgcgaaaaatttctatatgaaagttgttctaaaatatcagattaatctatttttgaagtttctaataattaaaactttaattaatcacatgttattaccacctcgttttacgtggaacacttaatctttatcttcatcttcatcttcaagagattcaaacaccaccgtattcttttagtgactaaaaaatatacccgtgcgttgcaacaggtaaatgatattttaattttattgttgttatatggtttagctagagtaaattcacagtaggattcgcttggatatttttttagaaaatcataagttgtaattaggaatcattatttcattccaaattagcatgcgagtttttttaaagagattttttatataacttcttttgtatttctaaaagcaagttagcttaaaatccaacttaaacaaggatttgtatttctaaaaacgaataaatttaaaaaccgactcaaacacagatgacgtaccaaaataccggcaaaaaaatcttcaatttttataatagtagaagtaggtggcatgcctatcaatagtaagttaattatgatgattttatcaagagtaaaatgcagtagcgtgtcggcgcgaccatcctcctcccctagtcgccgccgtccccctccctcccatcagtgccgccgtcctcctccccaagtcaccgccgtcccctccctcctgtcagtgccgctgtcctccctcccgttgcgcgcttgcctctggcacggctgctcggcgaaaccgcggcagtggcggcgctcatggcgtgcggtggttcagcatcgccaccgctgtcctccccccatcaacgccgccccgcgctctcgccgccctccttccaccgtgccggttggccggcgcctcgccaagcaccaccgcgacggcccctcccctcgtgccgcctcttaccaccgagaaaaaagaaggaagaaagagaaaaaagaaggaagaagggagaaaaaaaatttcatgtcatcgtccacgtgacatgctacttaggcaagaccacggtcaaacgcggctttggaccgggatgatacatacaataaactaagtttagagacctcgatgtgcgctttacaagttcgtgaatctaagtgaaacctcctgataagtttaagaatcgctggtgcattttactcttttatcaatctcgttttgtatttgaaggtagggggtaaaatatgtctacttacattctagaaatacttacgtgtaataaagtgtgtctttaaaagaaaaaaaaaggttaaatgcattcctcccctaccacatggacgacgcggtccggtcgcctatggcccacatggcagtgacgtggagcacaaatgacacgcttcatcccgcccaccattccgggtaataatcaggttgctaatcctccatccatcgcgtcgccttgcttagccgcgtcgccatctccctccatcaccttctccgatcgatcctccccgacgccctccacgcgccaccgccatcgcgttcgctatatataccccacacacgcgaacacatcttcttcatcttcctcagctcgatcacttcgatttctcctctaacttcccgcgacaaagctctagtttctttctcgatcagaccacgtacgacaatggaaaaggacaaggggctcgtctccaacctcatgcacggcgtcgccggcggcggccatgcctatccgtaccctcctcagcagggctactaccctccgccgcccaccgcatatcctcctccggctggctatgctgcgccataccagggtatgtactcgatcgtcaactgattctagctttctgttcgattctgtgctgcagatcttgttctgttcttacgattcatctttcaaaagagattctgttcgatcgtcgtgacgaattcatcgccaagatttcatggtggttgttgtttttttttttcaggttatggaggtagccatggtggaggagggcacatggctccgatgcttggagcgggtgcagccgtcgccgccgcggcgtacggtgcacacaagctttcttcccatggcggccatggaggctacggttacggttacggcggtcaccatggcggtggcggcttctttggcggcgatcaccatggccacggcggccatcacggcgaatactatggaggccatcacggacacgacgaccaccatggcggcttctatggcggtcatcacggacacgacggccaccacggcggcttctatggcggtcaccacggcggtcaccatggtggccaccattaatactgctctcagcttctcaccatgcctgctcaataagtgagagtgatagatgttggcttggcgacatatatatatatagtttgatcatgctaaactcaaatatgtggataggtcttaatttctagaggtgaagtgtggtttggagaagcttttctccatactttgatttcatttactctgcttgtgtgtctgagtgatgacaatatatatatgtggtatgctaattactaattaagtgcttatgagtgtttataccctgtgtttactgtactgatagtgatactcaaggcagtcctgccgttggcatgtctggaagcttaccagcggagaggcatcggtcaggtgtggcggaggccatgtgccgcctggcctctggtgttcggatggtggttttggattgggagatataccacggcggtagggttgtgagggttccaagcgaaagcttagcccaatgtttcattgggccaacagtggctactgtttcgggcgtggtaaccctcctaagggcactgttgaggtacccccttcttcctcggcaagaaactctgggtgaaagccttgtccagttctttggatggacgacgacggtgtctttcagtgtcgtgatcttcttgggggtgtcgttttttagagtcttcgctccgtggtgatgttgtaggcccagtggcgaccggtttcgtatagcgacggctggttcggtgctcgctttccctttctgtagcttgtgtttgggtggttggcacatggttttgggcgtatgctctagtgcacatctttccttgacacttcgaaaatcagctattgatgaaaaactttcttgtaacattttcttcctatctaaattacattggatgacctccttcggtcatcccgacaaaaaaccctatcagagaaaatttgtttttatctgggttccaccagctcatgctcttccttatgccggtatttcctaattttgtatttacaatagtttctggtttatgtaggacaacgtccatgaacatgaatgagattgaagcatatagcatttctgctaaattacaatatgaaagataagaaaatgtgccagcaattataacttgggagtttcataatttggacatgccccctgaaagtgatattctacaacatatttgagatgagcaaccaaaaagaaatcctggtgagagaggtgatcataagaggttatgggtgtttaacattcaggagatcttttggcccaactgagacagaggaatggactgagataaaattgtaatagagaacactgagctgagtagaaaccaagataagttggtatggggattaacagcaaataagagatatactagctctatgtatagtacaatgacctttagaggggtagtggataataacatgcaaaaggtctggaagtccaccttttttgtttagagagggtttttctttacccggcctctaaatctagagaagggtaaattaaatttttttacctggcctcgcaaataccccaatctaatcaaatatatgcagccatttaaattgaaaacttagccccgcaaataactcaatctaaaaattcgctcatacgaagatttgaatccaagaccttgaaatgctactcaggtcactacaaccactaagctataagcctttttgcacatggagatcgaattcagtcaactgagcagctaaaaaagaaaggttgggaggggtgatgtttactgtctcctatgtggagaaactaaaactactaaccatatagtgtttagatgtcctatggcaagttttgtttggtgttggtctagagatgttttgggttgggcaaatactcctagaaatttagatgatttttttttctcctgtgcaatatcagaactaatcccatcaaggaaagaatcaagcttacagtgctggctgccgtttgctggtgattgtggcttactagagataacatggtctttatgaatgcgttggttttatgttatactctgcctttccaaatcatttctatgttgctgcagtggaagaagctgcttcgctctgatgaggagagcacgctgatggtgctgactcaaaggatgaaagagatggtggcaagactaaaaccgacgagaacaggagttggttgattccctgcttagtctgttgttatttttcaatagtttgatcttcagtgttaagttgtcgattaggcaggacttcactatagttatcttttgtgttggtattggaagcacgcgtataattttttcttaagaattttttgtgatatttgctaattgtacggaaagctcgtgtacatataatacgtttccatcttatttgatacatgttgctgctccatctcgaagaccataacaaactcctacaactgaaacctgtgtgatggagatcagatcagctttttgggatcagctgaaagtctgtccaagatatgctaatcccaacccaaatcaaatcagagacaatttattatggagaaaattaacctcaagacatacactctagtttctcttttatcctactaactactccactaattgatttactacttagtactaagtactccctccgtcctaaaatatagtaatttttagctataaatctgtccagatttataattaaaaattgctatattttagaacggatggagtagtaattaatcaaaatgctccactaatttgtatttttgaggataacttcggtacctgttgctataccttgaagaccataaaagaagtcctacaactgaaaccatatgtgatggagatctgctaatcccagcccaaattagagacagaatcaagtcatcaacacatgatttattatggaagaagaaattaacctcaagacatacacactcttactttctctctcgtcctactaagtaagtactcaacaactaattactactactactaatcactaagcagtaatccataatgaatcaaaatgcaaggtgttgtggaagagggaagattagtcggcggcgaagacggcgtcgttgagctggaaggcgccggtgaagaaggccggccagcagaggtaggtggagaggatgctgctgacggtggaagcgcccatgagcatgttcatcaccacgatctgcagctggatggcctccagcggcgacgcgccgcccatgatgaggccggtcatggcgcccggcagcgcgatcagccccaccgtcttggcgttgtcgatcaccggcgacagcgcgatcaccagcgacctcctcacctgccgcgccgtcgcctgccgcggcgtcgcgcccagcgccagcgccgtctccaccacccctcgctgcatccccacgtcctccctcagcttcttcatcgtcaccccggtcaccgtcatcgcgttcccgaccatcatcccggccaccgggatgatgtaccgcggcgtgaacgggaacacccggagcgccacgaggagggccatggtgacggaggtgccggcgaggatggagacggcggcgatgtgcttcccccgcgggacgtggcgggcgcgctgccccgcggtgtagccggcgacggtgaccatgaagaggtaggcgaggaggatccaggcggcgctcttctgggtgaagatgaactggaggacgaagccgatgacggagagctggaggaacgcccgcgccatggcgtacagcatctcgccctcgagccccagccgctgcgtgaagctcagcgccaccgccatcgccaccaccgccgtcgccgccaccggcttcagcatgcccaccaagaactcccgccagaaccccggcgcgcccgggtccacctgattcaccaccaccagcagacgctgcagcagcgccgccatgctcgccatcatgcgttccagagcgaggcgaggcgaccgagcgcgttgatgaagacgaggaggagttggtggtggtgagcgagcggaagcgggggaggcggcgagcgagggaggcgactacgccttcttcttcggctttcgcggtgtttctctctgcttccttggcggcgtcggcgtggcgtttgggtgctacgtggggaaggcacgctggatggtggggcccacgctgcagtggcactacagtatttgtgttttttttaatcttgtcagttgatgaagaactacagtgcccgcctctcttttccatcttttattaaaaaaaattaatatcgtcagttgatgaagagttgaaggatgctgtctgctcatgtcctgaatttcctcgtccctatgtgagaaaaaaaaatgaaaatgatcttgtactacccttcaacctcaattcctcaaaataaattcatttttcacaagtctcacacatattgatatagaacccaaaaaactataataccctcctttatcaaattccaatgtaattattctcattttaaaaacacatttatctttgatttttcataaactcagatacaataattacttttataacttattttaagttaaccaagagaaacaaaaataaacttattctacaaagtatttgcacgagagaaaaattcagcagatgctggaatcctttgctttgctcggtgctgactgatgtgtaatgcagtaatggatcgcacgatgcaaaggttgatgggtctcttatgctgaagataaaaaggcagaaagaagaaagatgaaagagagataggagctgcaggatttcagacacagattgtgagagaaacaacaaatccatggattccatactccaccttctctcctcctttttctgccctttatttgttgacaattgctcacccattgatgagaagaaacttgtcctatgaaatctctcatcacacactacttatcaaggggaaaaaaaagcttgtaattggtcattaccattggagcctgcacaaccaatattttttcaattattctcagctttggacatccaacaaaacaaaccaaagccagtgacactgacagtgactgcggccggtttcagaggtccagcctcagatgggaactggaaattgcacacgcaaatagtaatactatgataaaaagggccagaagtcaaacaaagctaaaaaatgcatccgtcaaaatcttggtataagcataaattaatgataatgattaatgaagccgaggaaaagaaaatgactccttaaacagtcctgaatcatggcacttgtactagtagtaagatttttaaacatgcacatccatacttgtagatcatgtccaactgcttgaataatccttacccaagtatatgttcaacgaacctgctgtacacgactggtgatcttgaacgagcaaggataatagagtagaaagattttccattacttagcgtaaacccaaactaaaaacgattagacggctgtactgaacatgatggagtccttcagtttttgctaccgccaggcttcttgtaagactcttcaacttcctttgctttccccatccaatccctcataagtttcttcatgtttgggacgtcatagttctgcgcaatgtagataccacacccgatgccgacacacactgagaaagtgttttgcaggaaacccattggagctaatctgcagaaaaataaagagaacattgtgaacatatgctcagaaaccatgaaccagctagctggtgggtctatccaacctgtagctgcacttgaaggttgtatgcacatgccaatagtaaattgataagtaaaatatattgcacatgcagggatgtttgttttggggaatcacatggggagaactgaattatattagtccaagaataaattagcatgacaagtgtaaacaaccaaccctttcttattttgcttgtaattgacgatttgcaacaactagcaatttaatagttgaacagcagcaaggatctcagaattacacatgaaaacctgaaaagctcatagccacatagaaacaacaatacagctcaagcattgacaaggctacacgactgctttctctgattatcccgttgagttgcaaagccaataacaagtcttgactcttgactatagccgtatacaagaaatgacatatataaacagaagaacttagcactataattactggcttactgatccacaggcatggaaatccagatagaataaacaaaaaccatgcaaaaggtcacctgatcccaa

SEQ ID NO: 77346 - DNA, 613 bp, Oryza sativa
gatgaatcttttcccatgatatatgttgtcctaacgaggcagacacgtttttcatatctttttttgcatcgagctggttttaggtgaccaaccacatgtaagctatatttggaatgcaaccacccatagcagacctgattaaagcatttatgtggtgcaagtgattcatattgccgatacatttttgtgtttttaatgaaagaacatacagtttgttgggacaaaatattatcttagcgaacatgggacaaaatattatcttaacaaggagagagctcatccttgaagacctgtagggagaaggcgggagcttgagtaaggaagaggatgagaatgggtccgcaccaccttttgcctacttgggagtttaggctatgaattttccattagttgaccgttaaattcttatgagaaaagcccattttgccctttgctttgaagaagcatataaattaatagagtgtattatcggagggtaaaaatttgttaaatgggactattatatttatgagttagttatgccccatattatttgcgataaatatacatttagagatgacataaaaaataatacttaattattacttattgaaagttgtgtatgttgcatata

SEQ ID NO: 77347 - DNA, 1932 bp, Oryza sativa
tgggttggtcatatacaggttgaaccattggcccactccacccaatttatttgcagtgacccattaagtaagttacccatctggtgtgctaattcttgctttaagctttgctcgatctagttttgatcagtttgaattgtaaatggacacccccttttaggagagacctagcggtgggagaagacaatagggctaccaccttaaaattgtttaaccaagttaggggacccataggagaaaagtgtacacataatcaagggttaatgatattaccaagacttggtatggttagccagctgtggtgaaggttgcagtagtacccgctagagacgaggaagagattgtaatagttgggacaagctcaaggttgtgatctagttgttgtagaggaggaataaggaaggcaccacgagacaaaaggagataatggtgacataggaaaaccagtagcgctgataaaattacgagaagggtgattacagtagattttgggggaaagaagaaattgtggttactttaaaaagggttttatgaatcttgatgcgatcctaatatatattcaaagtacatgttaagaaaggacttgagaagttgcacggcaaaatgtttaaacgatcaacttaaactgtttctacaatcaattaacagtagaggatttgaaattaccaccaaagttttacagtttggtgaagagagcttgggttctagttttctactactactagttcaattcggatcaaaagtccttcccgagttaaattgtttggcagggatggctggttggtcgttcttggtgaaaacgatcctcttctaaagaaaatgttggatacgatacttccgccaaattaaaagaaatgaacctgcttgttcttgggagtggtagaaacaaaccaatctccacgaccacgacatgaacggtaaatatttaagaagtgaaaacgatcctctcctaaagaaaacgttgtatacacgacttcttccgagaagaaacgaaaccgtgttcttggcagagggtggtagaaactaaccagcctccgtccgcgaccatgacaggaacggtaaaaactggacagacgacgtcacgagaaatgacggctcgccccggggctattggtgtcgtttcttctcgtagccaaattacccccgtacctgcttgcggcaacatattgctctctgtgatcactctcagtccctcgtcttcggaagagattctccggaaaatcactcgccgccacaccgatcgatctcacccctatttacgtgtctatctagctatggttgtgtacaccacgtcaacttcacttcctacatgcaaagatcaaaggcgctactagcctacaagaagcttattgaattggagacaactcttgattctctctgtgtatgaggagtacttaatctaaatgaatttggataaaagtagtttagattcgttgtattagtaaagatcacattcctttatagattgagtgttttttttttggacggaggaagtatcacgcattgcgtgcgtgcatagcttctgcatggaaatttggagaaaacagaggtggtggcacggacaaagcgcgcagacaaggatgaacacagtgtccctttcagctggcgagggaccggccgatcgatcaattggatatgcgctcagatatgttacggcttttgacacattcagctcatcttttcgtaatctcacttacatatgcatgctatctaatactagttggctggctccatctttatcctaaactgatgatacggtatataattcctgacatcatctgcttacctccaagaaaacaacgggggcacttggttattgcgtagatatatttctgttgcgtcccgtgtttgcaagcaaggttgcagctatccgtacaccagtacattgccacagcttgcgagaacgtacgtaagcatgcatataccctgcgg

SEQ ID NO: 77348 - DNA, 529 bp, Oryza sativa
gtttgccagacatacctatgactttctatggtagtctgtataaatgcctgcagttgatcaaacttcacacaaccaagagtgaacatgtttggtagtctgtgccttgaggaaagaaattcagttccagtttaactggacagcacaagataatcaactttgttttcagtggtttgcgagtggataggtcgtgcgtgatcaggatcaaatgatcaaatctcacttttatatcacagcaaatttgcaaccagtggcatcacctcatgcatatgcctccagacatggacgtttattagagccagagaaacagctaacatgtaacagacaattcagataatatatgctggctatcaagttctcttacaaaaaagatgtagctaaataataatcaacatgcagcagacgatgaagctacatgcactaagatcagtttttgttttcaccataagaaaagcataactgcaaagatgctctgcgttcttgcaaaacacaaacaatgcctagagcatccataagatcacttcttgttttc

SEQ ID NO: 77349 - DNA, 3995 bp, Oryza sativa
aaaatgtttgacactgttgactttttagcacacgtttgaccgttcgttttattaaaaaaatatatgaaatatataaaactatatgtgtacatgaaagtatatttaacaatgaatcatgatatgaaaagaataaataattaattaaattttttgaataagacgaatggtcaaacacgtactaaaaagttaacggtgtcaaacattttgaaacggaagaagtactagttttttccccttgatttggaaattaaaggtcagcgatcgcttgctacccagtacccacagtcgtctcctgttctaattgggcatgcggtttggttagcgtacgtgtgcgtgttcacagtggacctgaagagttctcatctccgtcgctcccattttcaacttcgccggagagcgacacactgtacgtgtcacggttactacttaatagcggacgatacatattttccatgataattaatctacgaggggcatgcatgggctaatacaatatggtgtgtggtacaggatcggttgcgtggtacagttatagatgcatcacatgaattaattcagctcgaataggggtatgtagccgcgtacctttgtacagacaaggcggttgctatgcgcatcggagtaaatacttactcccctccgtttcagccggtacgtactgtatttgtcattgactatcatgtgtgcacacattgactacagaagaccacaaaagttgatataaaatgactacatgaacctgccttcttaatatctttcaaaatgacacaccgaatagtaatactatagaactatttattttgttccaaaatatatgagattttagatggacgtgatatatcctagtaatcaatcttgacagagagtttatccgtattcattgtgctgggatgtatcatatccatccaaaatctcttatattctagacggaaggagtactaaaccattctacagtgttaaatcggcgcaagcatccagtcgctagctgagctaatgagcaccgaggggcgaaagagagagggagccagagctcgcacgggccagccccaaatccccaatagtatatctgggatctcactggcgatggatatactgctgcagctcgccgacccagaaattttcattatactgtagcacgaaatctccatttgccccatgcactcggtcgcctcagacccaccacatcccctttccctgtttccccgtcaaactaatgtccgcagtcactgctccgtgctcactcgcatgtgcccgtgtatgcacgcacgccaccacgctgcatggcggcaggcgcgcgggcacacagttgtaatgtgtggcacacctagccatggactactagaacacgcagcttgctgcatcgtcgacagtgagagagaggccatgggatgacgtcgacgtcggcacacacgctgttgcgatgtgcgagccggcatggcgcgcggcatccgcatgaagcctacttacgtaccgcatgtcgtgtctcccgctgcacaatctccgtggatatacgtggtggtgtgcgtgcgacgctggtgttgacgtacgatcgcgtgcactattgccccgggatcaggttgtgtagtgtagtgtacagggtgcgtgtgcgggactgatcgggacgaactattgttaaatatgtgatctgaattttaggcccacaatatatttagattagttatctaataggactctactttataggattagtttcctattaggacttctagttttctcctatatatatcccttgtaagctgcacgggagggtgcaacagcccaatgtatcccctgcgtttgtatccaattcgatcattgccggttggcgcctatagttttttcccacaaggattttccatgtaaaattcgtgtctccgttatgcatctattttcataacaggtggtatcagaactatgaaaatccgttccacaattcccccgttgtcgtgttcgtcatctatgttgagttcatcgtttcgcctgttcggcgatatcgatctaccccacggtgtcgtggtgactggtgagttttcgtccagttgaattgatctgttgctgagatcgatcttttctgctgccgcatagatctgttggctcatcaagtccgacgcggagtcggtgtttttgtgcgaggagaaaaaggcgatgcagcagccgtcgtccacgtctacgcagccgcacgcgtcgaggaagcagcagccggtgtcatcctcgagcacacacaggtggagaaaaatcagaagccaccgagagccactgcttctgttctgttcacgtgaattaattttcacgtacggttggaaatttgtgacacacggagtttaccaggaattcaagttctgtgcattgcttggttctgtcgaggtgaacccaaattcactttcaattgctacgttcacaagccagatttaccaggagtttagatacagagatcaaaatacttcattttatgcacctagagtgtttcgcgtttctgctagggtttcacaaattataccagcagattcagaattttattcccaaggcgagtttgaagtttaatctaccgctcctggattgagatgcaatattctcgttatggcaagtgaagatgcaagttggcgtagccatcgaggaggagaagcaagtattgctgtgcaccggagagaaaaaaaaaggcaacacattcaagtcgtcgagagggagccttgttcctgtctagatcacaaggtgatcaaattgtccggcgaattttgctaccattgtacccaatgtaccagaaggtttatcaggggatctaagtacttcgttttgagcacaacagtttcgcgtttctgctaggattccagaaattaatgccagcagattcaggattttattcccatggcgagtttgaagtttctgcatcagtttcgcgtctctgttgggttccacaatgtcataccagtagattcaggatttgacgcacattgattttatcatcatgaggttgtttagaggttgaagatttttatgctacaaggaaaattcgtctcaaggtggagattgttaaatatgtgatctgaattttaggcccacaatatatttggattagttatctaataggactttactttataggattagtttcctattaggactcctagttttctcctatatatatcccttgtaagccgcacggggagggtgcgacaacccaatgtatcccctgcgtttgtatccaattcctctatagtgatcattgccagtcggcgcctatggttttttcccgcaaggattttccacgtaaaattcgtgtctccgttgtgcatctattttcataacacgtgccgtcgtgccctaggcattcgcttggccaggctgccgcatcgtgctaggagcctcgccatatctatgtccttatgtatgccctactatagatggactaatatgttttatcatgatttttgagaaggcctgagcaactgcttacaactgaagggaacttaacattacgagaaacaacttattggtagctaacttttgagaatctgaaaatgtttggttttcaatttcgtagctatagtttattttctagattatataattatacatactattagaaactggttgagaatatgtattgattgtgaagatggatattataagagagcgtgcgactactataaattccttcaaatagggtctacataaactcaagagctagattcaatgatgatcagtttgccgagttgacgcttgcggtgtaatgagatattacgctagcatggcaaaacgaggaaagctttgttcgtccgatcttaactctcttcttctcctaagctatgagtttgttctcgtgggcattatcatttagagaaaatttcttatgtaacttatgtaacatcgaatttgagttttgccttatcccttatatactcttgagttttcaatttgattccctatgtatttatcccatatcttcattttccattttaaaaaaactttagttataaatgttcgagaaggaaaaaatt

SEQ ID NO: 77350 - DNA, 4975 bp, Oryza sativa
cccagagaaaatatagggagggaagaggtgggaaagaagacgatacaaggtggaagttgctaacatatgggtcccacatattgtttcaacaagtcaaccgcgatcaaactgccatgttggtagaaaccacttttcaaaaaaccatcgaaggggagttgatttgcattggtttttgaagacgaggagacattataccggttttgcggttgaggggcacgattcaacatgagcgtgagagggagataaaatagacgtattccaaaattaaaagtctaaaagataagcagtattttctgggccgactaaagtatgggccgtggtccgatggcactcgccgttacatatcatttgcattactgacaagtgggggttagcgttaggtgggacccaacacgtcagcatcagaagagagttaataattcggtcacgcccgtacgaataccactatgtactcctaattaagaaaaacaaagtactctatagtcacaaaaaggttaatgataatttgttagttggagtgggcttgtcttgtccgtgtttagtcttcctcctccagtctcttccttttggttgggagaccgccggtgggccccactcagatcgatcggccgtcggattcacgcaacacaacgcatgcatccatgcaaagaagcaaaggtcaattagagcagatacagtagcgggctataagccagctataaacatatttttaaataataaaagaagaaagagaaaaacagcgggctacaaatctgtagccagttgcagcacagactttaagatgtaacgagtgtatgacatatatgcccgggtattaatagtatagtaagcaactattgtatgaattggctattacactggctctagataatttgtagctaatagttggctatagtattaaacttgctcttactcgactatagtccactccacgtagtatgcacaatcaagccgagtaattgatatccatgctaattttatactagcccaatttaattaattaatgaagcaacgtcgccgtcgacatggagtatataaataaattttgggttatttatatagtacaagaagtacactatagagcactattttctaggcaagcaaagctccatcaccaccgacgccgtaaatatatacttcttggagtatatgtatggagtatgtaccgattgagataaggtgtagttatacttgcaattgcaagataccactgcacataattttgaccgtccgtttgtaactttgtatgattaatggttcagatcaaatgctacagtaatcatgcgaataatactccgtgctgtactgtatgcgtcgtacagtatataatctagacttttcgatttgcatccaacaacatgcacttttactgcttaagttggagtcataatagtgactgcagctgatccgaatccagtagctacatcctactagatttttgttttgtttagattactgggaaaaaacatatgatctatttaatcgtataggtaaattaaatataaaaataaacttaacaaatagcttaaaacaattgatctaaataatataacagaaaaatatatttttagtatgtattttttaaaacacatagaaaataatctacttttaataacccgataaataagctaagtcattccaccccataactcattttgttataaatacctacccctattcagttttgtcgcaaaaaccacttcaatgcgcttgtgtttaacccgaataacatgtttttcataaactgtgagcgtcaatatgatctttattaaattaaatatttcaaagatatcttaacatttttcttggagatcccacaaacaaaattgttgattagagcttaaacattgtcgaactgagttttcgctatatgcacacaaaaaatcaatgaaacataaagaatagtttaagtctaatacaagtatttggataagattgactcgactagcttagcctatgatggttttacatgggtggtaatagactgcttcggttaagcatgtgtgtattgggatggtttttgtaataagatggaatagaaaggtggcaataaaataacttatgaagtgaagtgttaaactttaaataacttatagggcaatttttgcataagctaaaaagaataacatggcgtagctaatcgcagtcatggagtcactttctcatctgcatgaaaaccatcgtaagccgtaggaacatgggcttctttggttaggtttaggtttattggcttaaacttttaagtcaacttattggcttatatgatttataagttgatggatttactgtcctaagtttaatgatggagtcatatatctatcgtacataagtaaaaaccttctccatctaacttttagcttaataatgtttggtttatggcttaaaaaaaccaaacgaaaaaactaggttagacttttcgacttataagctaacttataaatcttgaccaagagggcctatattcaacacatattagtatatgatatatacgggttctggttagcgaataagccaatgtatcagtgtcaaggaggttggttaatcactctatccatctgcctgtaaatttctaacaccaatgagttcatatctctttattttataaaactaaaatggtataaagctatagcttctggcttattcttaattttcagtatgtaatcaatattcaatcgatttttttaaaaaaaaggtccagctacttcatatatatgtatgtaaattaattactgtgtacagtactaggtacattctctagctacatgcatgcaaatgtgggccatacacaataatataatcgcacatgtcaccactgatcagtgttagttacgctatggtgtttatactaccctggcatacagtactttatatgcccatctgtccccataattatttctacctcattatctttgctttgaaaccatgcttaattaattcttgatcatatccggcccaattaattaattaattaattaagtaatttatgccttgcataatgcatcacatgacattatggtagtggtacgtgtatatagagctggcgtcatcatgcaattaaataattaattaagcaggtactagtacatacagttatatactactgatggtgaatgctattactcgcgtgtgtgcatagtttacgtacattctgtttcgttgtcaaattaaagaggaattttctttgctaccaagcacacaactcgtacaagtactccacttgtactgtcgattgatcttccttacaagttttgtttggttggcagtcacagcttgcaaagcgtgatgcgtcgcaattgtgtgatcattaaccttaaattatgttcaaaattaagttgatattgctttgcttttgaaacttatttattttataaagccttggtgatactacatttatatttttcctctacacgaaagataactgcacacatatcgttctacacgcacgacttacatgcacccccggacacacgtttaaagatacggatatcaaccatccatgatttcactgaatttctatcaaaagcgcactcgtgtgtacatagtattcgacgacatcaaaatttttatctttgatagattaagtcatgcacccacgactgcactataataccagcggtgctttctctcatttttttcaaatccaccatgatgaaaaccttacatttctaactctattttttatggtatttaccggattgtgagagcgtacataatggctttctttagcttgtgtcaattgtattataatatagatttattctacctccgtcccaagaaaattgcatttctagctctaaggctttgtcccataaaaattgtatttctagccatgtgggtcctaacaaattgattcatctagataagtttccttaagttctctcagcttgtaattaaagtatgctaattatatgggttaattctctcaaacttccttttaatcatttatatatatggaatgtgtgtatgcaatgggttcattaaataaggtcattgtggtcatttttcaatcctattgttttgtcctaaattagctagaaatgtaatttttatgggatggagggagtaaattctctactatacacaaaccccagtatttatatagatatggttgatcaaccttacctcacttagccaaatgcctccaaagatcagtccaaatggtttcccaccatcttaattaaagaaaaagaagaagagttgagagtccaaacagtgccactactcactagtactactactgcttgtttctacttaccaccacagttccataataatcaatttaatcatgcatacaatggtttggtgggcaatgctaattgctatggcatcgggatgcaatcaccatcagtaggtgaagggagttgatccatgattagcactcaccagctagcttagctaatcgctcgccgctgccgctgccgctgctggtggtggccgtgacggtggcgctggtggtggtggtagcatcatccatcatctttgtctttggcatgtgcctccttttgcctttggctccctcctctccttccttccttcccttgtttgccttttgcctttgcagcctttttcgcaagggagcccacgcctccctctcgcttcttctcctcctcctccttctttgaagagcgaagagtgaagtgtgaagagttctctcttcttcttcttcctcagccatgtccacaatgctgccctccaaatccaggtgtgttcttggtagttctctctttgtgtgtgtatggattggttgatgttggtttgtttggttgggggatttgttttttgttgccttgtgttcttggcagatctaaaccggtcactgcgttcactcagatttgtttttattttttttccctcgcgctgttcgttccaattgagtactggattgtgctcgctctcggaatctggaaaatgtggcatcttgaacgaattggataggtttcagttggaacggcttcttgatccgctcgattcctct

SEQ ID NO: 77351 - DNA, 591 bp, Oryza sativa
  unsure (1)..(591): unsure at all n locations
atggtatccgacggatatagagtgtccggtaaattatacgggtattacccggtaaactacccgtacattacccagattgctggcaccaccactccatcatgttaacaaccaaaagcagccagggagggggcaagcagtcaccgtctcatcgagggtgccgcacgccggcacgccgcgcgcgtgcacaaccactcgccactcacgagcngccgccagcaccggccgtgacggtacgatgccgatggcgccgcacatatgctagccgctagtggctacgctgncgcgcacccgcgttcggcgggcactgtctcgcacatcgccgcgtggatgcgcgacggccgtcgtacccgcgccgaccaccgncggactactttgatactgctgtaatagcactggtacttatggtgatgtacagtagtagtttactactgatatgcagctatggtgaacaacagtctacagcattgagtctctaagagcccactactagctncaattcatctatagccgatctaatagctaaattatataaatagtgcttactatactattaatatatactcccacatatcatacacacgttgtgtctta

SEQ ID NO: 77352 - DNA, 2786 bp, Oryza sativa
tttttttaagaaaaactcaaaggtatgtaagaaataaggtaaaactcaagagtacgaaaggaattgaataatgtctgagcgacacattcttttttctttttagttgtactcttcctagtgacaccttagaaaaaaataatttactgacacgaactagtttgttgaacaaataaatttttcgagtggctacgtaaaccattatatcggtccaacaaggttaggcaagtttaggatggctatgtaaaccatttaggatgcaaaacaaccacaagtagtgggttaccatggacagacccgaccttaatagctaaattgacaacataaatgctaatgcaaaccgcacagatactattaacatagagctttagtttttgctatgtggagttttatgtttttactgagcaaaataacggtttcctaactatgtagcattacactaaaaaaaaacatgcgcccgtcccttataagtgtcaatgtgtttccatattttgtagatataatagaaatgatctccacaattttagacaattatacttgcatgaaatggaaaaaacgtgccttttgaaaagctaaaggctgcatgcactttattacaagattaattcttggtcttgcgtcttctctgctacatatactctccccggacagctgtctgagggtgaagttaggtataagtcaggattcggcatttctacatttgcgaattcatgccgtttaatttgatacgcgtgccattttattgtgagatggagggagcatgtattagcgcaaagaactagtcaaatctcaaatgaaccagcgtggacttgccacaagtcatccgtacacaaatgtaggccaggcggggcagcatcggatcctttgctcagctagccccctctcaccaggcagcgcgggcaagggcgccgtaaaaagatgaaccctacaggtagaaaagatgtgtcagctaaggcagatactactatagcagattagcagctgttgcatcagtagcgcatctcgattcctgaggcaaaatctctggccctctgaaacggaaaagcatgcaaagacctgcatgctggcaagtgtggcaagtggcgactcacccatccagggaaatctcctcctgctgatccatgattcatcaataccgcagtgacagggagcacacacaggcacagtaggggagaggttggcaactggccagtgagcgagagctgagttgaatgcacagcggaaaggtggtcctgggctgccggtttccaaggataataaaaactacctcccccgctcgctgctacgcccacccggcgctctgtgccctcctccccgtgtttatttatacgctcccagctaccactcttcacaaagcgatagccggaggaagaagaagaagcaacagcagcagtcaagccaacccgtccggcgagcaagaagcaaccgaggcagcaaaaggaggaggagggaggactccactgttcgcttgtatcgtcttatgggggaagaggatatcagcaacgacagcaagagcagctgcggctgcgaggacggcacggtggaggctccggcggctgcggcgccgaaggagaacggccgagccgcggacccgcgcctccaggccatctccgacgccatccgcgtcgtcccgcacttccccaagccaggtccgccgcccgtactcactagctagctaagctcgatcgatcgatgtcgaaaccgttttaagaccacgccaaatcagttgaccacgtgaaaccaagtcacgcgcggctctacgttaatttgcagggatcatgttcaacgacatcacggcgctgctgctccggcccgccgcgttcaaggacgccgtggacatgttcgtcgagcgctaccgcggcatgcgcatcgcggccgtcgcaggtaaacactataaacagccgtacgtccaagcactctcccaaccaaaccggtcaaaccatgatcctttgcgcggcgcctttgccctcgcgtcgccatgtgccggcggcgcggcgcggcgccgagcctgacaccaacgccgacggcgacggccgagccgagctgtgggactgaggcggcggtgttgtgagattccgtaatatctttgggggagatctttcctgctccttttgtccccctacgctttgtcgtttgatcaggtcatcatcccagtcaccacctgcagcaattttttcccctctcacctcctcctactatttctcaatataaacaatttttgcgataattaaactccggcagcatcagcagcggccgtgcgggcgcaacagtggtggtggtagaccggtaggtgcatgcgctgctgaactgtgacaactgtcgatacacgcacgtatgtcgaacataggagtactatactagtgtatcataggagtatgtctttctcgccgtctggtccagaggggcaataaatgcaggggccaatgcctccccgggccacggctgtggatggagcagccgcaggaaaggcgccgcgccaaggcggaaaggagaatgccgatgcctccctgcaccgcacgctacgtactacgtgcgccccgggcccgggcgcatgtggggaatgtgcgtgtgcatccgtccgtccgtccgtgcgcgcgtggcgcgtagtagcccggtggtactgtatggtccacggctgcgcgctcgaggcgccgatccgcgtgcgtgcgtgcggccagaatgtacgtacgcctcgtcgcgtcgcgtcgagcgagcgctcgctggttggctggcgcggctgcggctggctggctccgccgctcgcggggctccgctggggccagcggaat

SEQ ID NO: 77353 - DNA, 22220 bp, Oryza sativa
  unsure (1)..(22220): unsure at all n locations
ctttcgctcagtgcatgtactgcacgacctcacgtttttcgttctagatgcaaaccgcccgcgagtacaatgatctgatttttttagattgggagttggagtacagagtctgattagcttttcccggccgtgtgtgtttgctcgaagcactttactttcacggcattatggcgtttgttgtgacataaacctccaataattgaatagccatcgcaacgtcatcgtatttatactggctagttgaaagtttttactcctacaaggctacaatgaacatcgaacactgtgttgcaaaagtacatatggaagttctatcagggacgtttgctagtgatggatactttaaaattgtagatttctagtagtaaatttggtgggaaaaactgtagttctacgaaaaatttgatgttaaacatataactttgggatcttacatcttaaatttatagttttgtcaaatatgtgtgttttgtgaattttactgttataaatctaatttccatgtgtatatatatatggtgaaattctccaacttatgctaggtattgaagccagaggattcatatttggcccagcgatcgcactagcaattggagcaaaattcataccgttgcgcaaacctaagaaactcccaggtgaactacggactatgtcatttcgctcatacaaggagcatacctacatcctaaaacataaggaattttacccatatagtttacatgagtaaaatcccttatattttaggatgaatgtattaatttgtttactcgcacacagtacatttgcttccactgaaaatgctgtagcaacattatatatgtactactgctactactcatagaacctgttagcacatgaaccactcatcatgtcagctactgaaatagttatagcttgagtacactcaataaatgttgtttgaggatcattgaaatggtctgatgaatagaactgtagattttattccgctttggtactggtatacagctatatactacaaactcaatatagagttgctagtagaatgtgctaacagtggcttttacaaatcttaaaggtgaggtaatttctgagacctatatacttgagtatgggacggattgtttggagatgcatgttggagctactgaacctggtgagcgcgtagtggtcgttgatgatttagttgcaaccggtggaacactttgtgctgcaataaaacttcttggtgagtaactaaccgtttgtctcctcagcatgtatgcaaatgtaattcattgactgtggacaacactaaacaagtacgtacgtaagtgttaaaaaaatactattgttattttcagtttgctatgctctataatgctacttctaggtgacttatcatatgttttaacttctcaagtctgtcgaataataaaacacacattttaagctgaaaatttggttttcctgaacagataagcaatagaggaccttgagttatttaggatatttgctgactgttgtggaaaggatattctgatattttcttgtgataataacaaacattatattctgacttaaaatgattcatattaaacgaaaatatcttaaatacatagtgccggacaaagaaagtgagagaaagtggaagaaaatggagtactgaatgtgtatatcatgtactactaatttagtaaaacatacaggacgtgaagctgaatatcatggatcatagtggagaagatcatgtaacattgtcaagcatcaaacagctcagtgataatatgtagagtagaggggcatcatgttctgttgaccttaagaaaagtatgctccccagtgagtcaacgggacaaactgtttattcatgggacaaaatcctgtccggaagatatgtcctattgggtggctaatcacctacatgcatgataagactggaggcataattttgatcttatcttacaaccgaaaagttcgtggataagaatcgagcattcaagaccctcccttttctctttttatgacactaaaacaactaactattctagtgtttacatctgtttatgcttattgctcaaactatttgcattccagaacgagctggagctgacgtagttgagtgtgcatgcctcattggccttcctaagtataaggtacactcatattttggttaagaaaattgagaatcgcatctcacttttaataccttgatcaattatttgcttactggacttgcatgttttatacagaatttctacaagctcaatggaaaaccagtttatatactggtggagtctcgcaaatagaaagtaacaaagcaatgatcaggcaagcatcacttttatgcttgaaattttctccaatatctccttttattttgataataatgtttgtaccatgttgtgcaatacagctaggctgcattattgtttgttcatggtcttttatcaatgcactgcttccatacacagtcgacatgagggtttaaaatgatgtgtactgttcttgacaagagtacacatgttgttaggtcctgacaattggtttataaaactttaaaatttctggatttttttatccgggtcagtgaaatattaatattgaaacgaggggcaaattgtgaatattgagcttctaattcatgtttccccctcctatcctttttcagaaagattcacagcttcattcctttgcaagagcacgttggaggaattggatcggtattggtgagcagtgactctgcacgcagcacaactgttaatgtaatctcggtggagagatgatgagatagatgaaatgtaatctttgtagcacgactagttttccaggtagtgtcgacgacgagagcttgtagttatttctgtcgggaactgttgattacccggaagagaaagggattaagggaattgccatcccgcttgttcagttcctcttttcttttctagtgacaattgtccttttcgccgcacttgatgatttatacttctttggtaaaactaccactcctaccgtagtattattggcattagattagctccttgtcggtgaagattattcagaactaaaagcttaagccaatcataaggccagcatgaaaaaaaagggcatgggaatttgtttaagcgtcctagtgcacggttggagtgccaggctgccagaggcaggtagagagaatgctggcgttactagattgaagcttcaaagtatgctagcgatccagcagccacttggctagaccaccgtgagttcagagttttaggtatcctcttggacactaaactaagatgccggcatgcattagacattagactattgaatcatctacaccgatagtccgatactatacattagtaagcatataaaaacggcttggatgcaacaggttggcaggaatatctgtctcctgttctacgatccccagacaagggcgttgtgagatatgggagaggagacagtcgcagggagacttgcctgcatgtttggcgatcgctgctttctcgcgccccctcgattccgcctggttccaagggacggccgcttctgcggttctgcctgcccctgcagttttattactgctgcccgtacagggtcagattggcatcggtttacctgaagcaatcacacatcaacagtgcacaccattcgttaagataaattttgtgtaaatttcagaaaactatgactattttatcaacattttcactctactacaactttaactgggcatgttagagaagtgcaataatggtgtatgattttattagaaagctacaactttatttatctcataagtttaaatccattttgttggttgatttatagggtaagtccaataagttagaaaaggataagcccacagcctaattctaacaagaaaataaaagaaagagataagttggttttgtgatcggttaaaaccaattttgaatcctaattgaagataagctcccgaaccccaccaatattatataacgtagaggagagagaggatgcttaatcctatgcgcgaaaacccaaaaccctaaacaccgccgatcggttttaagcactggcagagattcgtgtagccatatcagggcagtgccagtggagacccgaacgtcatcgagacttgcaagaagccagtgacaagaagttgatcaagccagtgtccatgttcatatattggcgcaagaaccaaaagaagaagaagagaaggaaaaaggaagaagagaaggaaaaaaaggagaaccagagaaatcgacatcgatggcttcacaagcaagtcagtagattaagttattttgcatttagagaatgactaaagtaataagatcttataacttagaactccaacacattgtcatacacacatgtaatactcatgtgttatagttcagttcacatgtaatgacatgcaggagatanatttgtagttatttgataaattcatttgttaaagttgtccttatatatatatatatatatatatatatatatatatatatatatatatatatatatatatatatatattctacaccctccctcccaagagtcacacccaccttccacctctgtaaaaggccagtcaaagccctctcctgccggtcaaacccgcctactaactccccccaccgcccacctcttnttagctctcatcccacagaacgtgcaataacacgacgaccaatgtgcagtaacactgtgtcttatgtgtaataacaacgttcaaatatagttgaaatatagtcatgacggatctacttttgataagcactttttttctagcatcatcgtgcaaacggttttgaaaaaccttacatcacttgggagatattgttcttcaaagcttgactttttgtaatttgtctctctacaagtagtaatgctatactattatttgttactacatgtctgttgtacgttactacaatcgcatagcgatgttactgtaagagtgctggaaacactataagttcagtaacaatgcatcttactgtattttttggatagtgttactacataaacatgtggtaacgtgtaactgtcatgtagtaacacttccacttttgtgcagtaattcagttctcgttttgcaggaacgacgtagtaacatgatggtcaacgtgtagtaatacgactgctttccgcagtaatgacgtcaaaaaatagtcatgatggatctagtttcattaggcacttttttacgagcactatagtgcaaacggattagaaaaaaaagatatgatctgtgagagattgctctctaaagatagagagttacctcttttcagttttcgtctcgtaggaacagtgtagtaacacgatagtcaatgtgcagtaacatgactaatttccacagtaacagcgtcaaaaaatagtcatgccagaagtgcagtaacagactataagttttacagtaacgtatcatgttactgcacttctacagtcatgccagaagtgcagtaacagactataaattttgcagtaacgtatcatgttactgtacttcttctataacgttactaccgaattatagtaacataatgatatctaatcatacagtgtcatatgttgaatgggttaggagagcttctcatgaaccatgagctcatgtgttcaaatcttgaattcaccaaattatttttaatttttctagaaaaaagaagaaaaaaaggtttatttccaaaaaaaatgagagaaaagaaggagaaaaaaaaagccaaaaaacgagagaagggagatcgagcagggaggggaggcgctagaagaaaaaggggaggggagggagaaaaaaaaaggggagaagagagatcgagcagggtggggagggcgccagaaaaaaaaaggaggagcgcgcataggagacgtagggtgcaggactggagggagaggggtacagaatagttattctataaggggtgtagaatagtctatatatatatatatatatatatatatatatatatatatatatatatatatatatatatatatatatatatatatatatatagagagagagagagagagagagagagagagagagagtgtgggttaaggttgtaagttaattaagtgataatagaccaaatgattgtagttttatgaaatttacttttcgttttttgacgaaaataagaactgagattttttttcaggaaaaaaaagactgtgcaaaccatgaaccctatgtattgaagctagggtgtttcacccacaattctgccaattcgaagattcagaaagaatttcacaatgcttattacataggctgaacctgactaataagtaatagcgcggccttgaaacatgaactagtcccgacctaaatacagaagccgacacggcaatcgggcaatgcattattaagaaaatgaattgagatctttctgtgctatagaactttgtgatcttcgaatgctacaaaaccaattttgccaaaatgaattattcagagttgcacatgctaactgaaagagaagaaggaaccagactggttcaggcttcagggggttcgtggaatcccccttgttgatcagtgatcctccttttgagcaaaatcttgccacgacgccgatcttggcacgccggcgcagggcgggagctccttctccgacgccgacctcgacatcccggggtccaaagggtgctggttcgcgaactgcagctgcgacgcggacctccgcatggcggccgcggagcagagcagcggcgagctctcggcgccaagctgaagctgctggcacgaggccgacctcggcatgccgccgcgccggtggagccggcaccggaaggagccctcgtgcgtcgtgggcgagcagatgcactgtctcgcctcccccgccgccgccaccttcgccggctggccactgtgtccgccgccgcagccgttggaagccatgtacgtacctcgacgcagacagacctaaccttaaccgccggaatcttgcacgatatccacggggtattttataaagacggggtttcgatctggaggagaatccgggctcgttacggcttcggatttcctattgaaaatcgcaacagatctttcgcctaaaaagtcgattgaatttatatattcaaatttgaatctgtagcgagagcgtcgttacaaagcacaacttacaaattacatgtggtatacggataaattcagtaacttctaaattatactacacgaagaaggggcgtgtcgcgggcggccggcgattcaaatccgactgaaagaacgcgtggtgattgattcatgcaacatcgaactgaacgagcgaaccacgagatcgattgctcggtcgatcgatcgatcatagcgttggcagcatcatctggagcaggggagccggccgggatcggcgctgccgcgatttgaacttcctgatcgccgccttgagcacccgcctccacccttcctcctgaagaatccaaccagcagaagcctcgtcgtaatggcggagatgattcatgaagcgtaaggatggggggatctgtatgcagaaagctaccttggccgggagaggcgacgatggtggcggcggcgagaagtccagcctcgcgcagcccgtctcgtggaggttcaggaatgagccgtcctcccgccgcagcctcagccgccgccgccgcgacctcgacgacctgcccccgatggcggccctcgccctgcgcttcgggttggcgatgagaaagtccctcgagccctcggccccgcctccgccggagcgcggcggcggcggcggcgacgacgacgcgcggggcaccttgttcagcggggaccagatgccgctctgggagtagtcgaagtcgaaggcggaggagtccgggaacatgccgagcaggccccgcgacatggacggctccaggtactccaccgtcaccacgcgctccaccaccaccacctgcggctccacggccgcggcgccgccgcctccctcggtctctgtctccgccgcactattcatctcggcctcgaagcttactagtggtggtctccggcgatcgtcggagctaggagaggaagtgatgggagcggaggaagaggtgggaaatgttaagggagttcgcggctaaagtagccgttgggtgtggcctgtccggacacttgaccgttgggatctgggggttgctcggtcactgacgagtggggcccgatggtccatgtgcctgaaccgagtcatcagtagctttgtgttcagggagtacttcttcacatgaatgccagatttattggcccaacaattcaacaaaatcacatggaaggtttgaacacaaatttttgcagaactataccagatccatccgaggagcaattaaactgtactccctccattttttaataaatgacgccgttgactttttctcacatatttgaccattcgtcttattcaaaatttttatgtaaatatacaagatataaatcacacttaaagtactatgagtgataaaacaacttataacaaaataaattataattacataaattttttaaataagacgaatggtcaaatatgtgagaaaaaaatcaacggcgtcatctattaaaaaacggaggtattactctacattaaatcttctgggcacttccctgggaaaaaaaacaaagataaaacacttctcagcacttacagtggggaaaaggaccacccactttgcttcaaactttgcagaatctcgctatagtatgtttttaagggcattcagtgggaatatagagtgggtaataaaaaataaattacttatagttatatatatgtgggagtagcaaacaacagtatgatgtaaggaataaacaaatgttttttttcatcgctctctcctgactgtggttgtgggacctagcttactaccatttttattctttcgtccttttagctacgacaactaatacctactgaagtatgatctactctctagacatcactaagatttactctatctactttatgaataaagataggcctacatcagtgggtattagttgttgttgtagccacaatgatgaaaaaataaaagtgggtagtaagctgaaccccacagtcactagccatgagacaaggatgagagaaattatttctttattccttatgactaggtagtaagcatattacctagtaatccctccgtttcaagttataagacgttttgactttagttaaagttaaattgtttcaagtttgactaagtttatagataaatatagtaatatttataatactaaattagtttcatcaaatcaatagttgaatatattttcatattaaatttatcttgggttgaaaatgtcactacttttttctataaacttggtcaaacttaaagcagtttgattttaatcaaagtcaaaacttcttataacctgaaacggagggagtattagttacttaccacttccacaatgttataacctagtagtagtagtattttgttccttattatccactttagatacacattatggatgcgttaagggcattctcaatgtatgtttactaggtatgtagtaagggtgggacctacaaaaccagggcgtatagttgttttagttcacacaacatatttaagagaatggataagtaaaaaagagagggaatgagagaagggagaatcttaatatttgtttattccttattgtctcgtagtagcactactaccggatgaaactattacccatcttactgcctactccaataatgatgaaccaggtaatacgactccttactacccacttttttacacattgtgaatgccctaactagtattatatgttaggtggaaaggtgtgttctctaacaagaacttctccccgagttcatcattgatatatggacatgtggatggtgggtcctatatatcaataaccacgtccctctagcttcgtgtcaaagatccgtgtcaaagatcatccatgtattttatatggttacttgataggacttgttaaaaagagagaagagcttgtaagtttcagggttagggcctattgatagtctgatgggattctagtcctagaagaacaagtaatcctatatttttcctattggcaactgaaaagaactctctgtttttgcaatattcagcattagcgatgaaccctgaaagttactgtttgccagtttattttttaaaccttttcttgagacggatattttgaaaaataaaaacagggttgtaaaaaaaaccccaactttattgtgataaattttctaagttgcatatctcaatattttattttccaggatataacgtgttcctacatcctgggtttggaaagaggctctgaaaaactaaaattaaaatagatgcctataatatggcatccttctcttgggcagtcgagcgtaggtcaatttggtgcacttgcgcagtgtataagtcgccgtatgtaataaaaaaaatgtacgttgtattgtagaataaaaattaaaaaaaatataaaacaaactcagtacagctttatgtaaactcgatatgccacattgaacacacttcgcagcaacccagattaacacacataagacggaaggacactgtcgtaaaaaaaaagtacctactgtattagcgactacagaatctactaaacacgactcgacttcatgatcgaacagagatcagctctttacttcttttttgagttcttccccagggtcgggaagtgtgccgcgtcatcgaagctcggtggcggagtagccggcctaggcggcggcggtggcggagacggcggcgccgccgccgcctcctgctccttcttcttgtccgcctccgggtccggcttcttcgtcctgatcggcgccctgtactggtagcctatgtacttggccgtgtcctccttcttgaccgcactgggcttcttgttgcctgctgcggcattggcggcacccttaccggcctcctgcggcttcttcttgttcttgctgttgttattgtttttcttcttcttgtcgtcgttcttcttcttcggcgccggcgccgacttggacggccaggccgccggcggcacgggcggcttcctgtaggcgacgggctccttctccttgctcagcggattgtcgccgggattgttgcgctcgagcagcgtgaaggggtttaagcttgggtggagccccatttttttaaaggacgatcggttgaattggccaagaaacccccggtaaatacaccgagcgatcgtacgtgatctgttgcttgttgctgtgttgcgctttgtgtttcgttggtgggctacggcgtgcgacggccgagaatataaagggggggcgggcaggcgccgccgggtacagctcgggttcggcttcgagtttggaagcggcacaccaccgcacacggtacgtgtcgggatcggttttgcggtgttgggtcggcgtcggaagccagtcgcgtggcggcggcccgtacgcggacacggattgcgcttgtgggctcttgcttgccttgttgggccgtgaagggaagttctcgccgggtcggaccttgtgcacatcggactccgggctcatgtagttagtactcggagacggacccaaaaggtgcgtaagatagaaaaggtccaatttaactccctcaaacataaatcggatcagatttgtatccctcactcataaaaaccggatataaaaactcctccaactattaaaacaggtgcataataactcatagtgaagtattcctccaactatagtggatctcaattttatgcggaatcgtagtcaagtaaaaaaaaacgagacccatatgtagtctgtccctctccttccttcccaattaggggtgggcgttcagtctgaccgaaaaattcggtctcagtcttcggtctttcggttatttcggtctttgaaaagtgaggaccgaatttcttccaaaaaaactcaggatcgacaaattcggtctcgatttttttgtctcggtctaaccgaattttgacagagggggaccggctcaaacgcgaacgcatcgaatcccccaccgcagtctggctggagacgaaggcgacgcagtggcggcgttgaggcagaggcgggctcgcggaggacggaccggtggaggcggcgtcgacgcgatggaggtcgaggatggaccggcggaggcagcgccggcgcgatagaggtggaggacgggctggcgcccggcggaggcggcgcgatggaggcggacgggcggagcgtggagggcggggaccggagagcggaggcggcgccgcggaggtggaggcggcgccgccgcggtggaggcgtaggcggcacggtggaggcggaaaggcagagtcggcatggtggaggcggaaggcggaggcgggggaggcgccgtggaagcggaggcggtgcggtggaggcggaaggtggatgcggcgtgaccgagccgagtgtgacgcgatggggagaggcggcgctgcgtgaggctggtgggaggagggattggatgtgtggttgcctctagggtttagtagtttattgagtttattgggcctcctaagcttattggaccaaaattcggttttctcggttaattcggttaaccgagggcaatgaccgaattactcgaataaatttcggtctttcaatggccaagaccaaactactaaccgaatttctcggtctcggttttttcggtctcagtcttttcggttcggttcttcggttcggtcttattttgcccacccctattcccaatcatcttctaaaagtaaagatggcggtggtggcaagatggaacccggaagagggcactagtggctccttccctcttctcccaagttgtagtaaatacaacaaattaaattaaacctagtatacgcacattcacaattatatttatttattttgttacatcttgtagaaagtcaaattaaatgtagaacaatatatgtcatattttaaaggtaaattgtgttgacgatacaagaagttggtaagtgggtgtggttgggtgcaagaactagaaaaccgtgcatagcgatacaataacttggttaagtgggtggtgcgctcgtagtgtagaaggttgccacatagaaaatttttgttacgtgttccatctcagcgagattgtcacatactcacatcagcagtgacatgagagagatgctctcctatctcattttacataaaatcctttgtagctgttgaaggagaagtaactggaatacaaaagtataaggggttcactctataaaatcagatatataggagagcacctcttccgtgtcactgctaatatcacaatctcgctaaggtggaacaacgacgacgtggcaaaatttcctaagttgtaatcttctcctaaagttattgtatcgtcatgctcgattttcaagttcttgtacctaattgcacccacctgccaactttttttaccgccaatgtaatttacttattttaaaaaaataaaaaaaaataaaattatagatgacacgtataaaaggatgaacatcttaccaaataaaacactttaaatataacaaggtcgcccgtatattagcatatcggacaaaaatgctctacaataatgtacttgtagtagcaaagactgacaggtggatccgatccacatatcaacggcagctactaaagatacaatattgtgcggcttgtcaggttgggtgaatccctttgcacttaggttcctcctttcatcctttgctacaaccaaatacaaatttcctttagctaaactagcttataaatgcatcttgcaagcgcacttgttttatagccctttagtgccattttgcagtagtggataggcttgccttagaaattttacgagagaaacaaaagttctaaacttcaaatcgctctgaaccgcgttgagcccatttgtaccaaaaggcaaatgcacttttcagcgaccggtcccacactacaagatgttcaggtttggagtatctaatttacccttaattatgtggtcctagagtcactgttcacaaaaaccaaagattactttgtacttaatcatgattgaaatcttgaggaagtccacgcccccctgcacggtggtccaatttatacacatcggagagaacattacaaaagcctgtaacagctagggagattgtgcgtgcatatgcacggggtctcgctctgtcaggttttaacctgagttagtcgtttgaccaaattaagggctcacgtttcgttattttgttctttgggagaggaatctttcgggggagaattttgtctcgagaggctcccgtatccacgagaggggcaagggaaaaaaatttaaaacatggagcttctctaaacacgaagacgtttttgcagtgtagctgtgtaggtagcgtcactggaactgttgactggccgagcgagcatgcaccggccgaccagtcggcttggatttttcatccttctctcgttgatttttgtttaggatgcatactggtactagcctatactgtgtagccactcaatataaaattgctggatcaatgggaactaggggtgcaaatgggtgttacgacctgcgcttactgtttgtataagtacacaactatagagatcacctgctgctttagccttcaggcctcagctagcgagcacttagccacttactcttctttcccccattctcacagtactgaccttgctagctacacctgaagatcagctggttgccgacttgccattgccgatgcaagattccggtagctgcactgatcgatcaaagaacaatctggctagcaatcttggttcttgtttgcaaattaatcagtgaaaagatacacgaagaaagctaattaagctagtgattttggtgtctagtagctaatggcttctgcagataactggctaggcttctcgctctccggccaaggcaacccacagcatcaccagaacggctcgccgtctgccgccggcgacgccgccatcgacatctccggctcaggcgacttctatggtctgccaacgccggacgcacaccacatcggcatggcgggcgaagacgcgccctatggcgtcatggatgctttcaacagaagcacccatgaaacccaatgtgaggaagccaggttgctgatctgatgagcatgcagctagctagctacagcgcagtgatgagggatttgatatgtgtggcgtgtgcttgcagatgggccgatgaggggttggactacggcgccggctcctccgacctctcgatgctcgtcggctcaaccggcggcggaaggaggacggtggcccgcgacggcgtcggcaaggcgccaaagctggagaccttcctcgacggcaactcattctccgacgtgcacggccaacccgccggcgggtacctctactccggaagcgctgtcggcggcgccggtggttacagtaacggcggatgcggcggcggaaccatagagctgtccatgatcaagacgtggctccggagcaaccagtcgcagcagcagccatcgccgccgcagcacgctgatcagggcatgagcaccgacgccagcgcgagcagctacgcgtgctccgacgtgctggtggggagctgcggcggcggcggcgccgggggcacggcgagctcgcatgggcagggcctggcgctgtcgatgagcacggggtcggtggccgccgccggagggggcggcgccgtcgtcgcggccgagagctcgtcgtcggagaacaagcgggtggattcgccgggcggcgccgtggacggcgccgtcccgaggaaatccatcgacaccttcgggcaaaggacgtctatataccgaggtgtaacaaggttagcgatttccatcaacttttgctagtgttattgttgctgatcttgttctgcatcttccagctcaagtattatattgcttatcgattttctctcatgttttagtgtattgctcattgatctcaaagcaaatgtttggatcgaagtatattaggatgtgtttcatctaaatatctaattagttgctgagagcatatataatgcgattctcctagtagtcgcttctttgctgttgctctgctacacagtgctacttgctcttctcacttagcctagaggtaacactagcttgtaatacaaggtgatttagaagtatacaattcataaaatgtactagatttgaccaacacagaagtggagcacatgtaatttccatgatttcttggtgatccgctttgccaatgcaagtgcttcttttgacgcttcgagtactgaaccgttagcgtttgaagtgcagtgatgatcatctgcaatgaacagatgctctctaattagttttcttgttgtccacaactttaattatttttacaattttcttctagtcgataaaaaataatatatatgcatgtttatataaaaatttttaagttcttcatacgtataatcacgttgttaatctgtctttcaggcatagatggacaggaagatatgaagctcatctgtgggataatagctgtaggagagaaggccaaagtcgcaaggggagacagggtatgtatatatagtgagagatatgtaatggtagttaattactcccttattctataatcttaaagataaattaactgatcaatgattaatcattcttccatctgttctgtgactgaatactgaatttttgtcgcctctccatccgggatatgacacttcacactcatgaaaatgcagtttatttgggtaagagctaatcttgtgcaatatattcacctatcatgtatagcatatatatccatttcgtaaaaaaaaatgtaaatcttatgctaatacttcgaagttctcacttatcttcttcacgaacatttgtgtaggcggttatgacaaagaagataaggcggctcgggcttatgatttggcagctctaaaatactggggcacgaccacaacaacaaatttcccagtacagatattcttctttttaaaaaaagacttaaagagatgatacaattctgttaattgctttttagatttgtctatttccatgtgcatggtttgtttgaatatcaaaattctgtgcagatgagtaattatgaaaaggagctagaggaaatgaaacacatgaccaggcaggagtacattgcacatcttagaaggtattgcttgatgcatgctgattatactatagcatcacatgtttggaagattgcacagcacgaaagcacgcttctgttgcatagcaactaattaattacgtgcatggtcattcaaccacaggaatagcagtggattttctcgtggtgcatccaaatatcgtggtgttactaggtaattaaatctaccatcaaattacatgttgggtaaaagttatattatatatgtatgatactcctattgttcgagctgaatatatatgatttactatgtttatgttgagatgttggaatttatctagaatgacggtttgacaggcatcatcagcatgggagatggcaggcaaggatagggcgagttgcaggcaacaaggatatctacctaggcaccttcagtaagccaattataccaactagcacacagaagctaatctatttgttaattaagctagttaagatcctctgttaattgaaatatatccataaaagtacttactggaactggaggtactaggacggcactgtgctttcaagaaccccgagtcatcatcaagccctaattatttagtaatccattttctcgaaatctctgcctcgtagagcggagagagggtgcattattctatcctgcccaatgggtattaataatagtggagtagcacattaattatgtcccaaatgttcctttccaagtttgtgtctcggagctgtctgaggaaaccggggcatgtggtcaagagctcattttagaaaaaccctagctactgcatcgagacgtcacagcttgcatgcagtgcgcgcggcgagtacacacacatgcacgcgcgcgtcggtgggctaaccctaatcatggcgtacgtgccgtgctgtgctgtgcaggcaccgaggaggaggccgccgaggcgtacgacatcgccgccatcaagttccgcgggctcaacgccgtcaccaacttcgacatgagccggtacgacgtcaagagcatcctggacagcagcacgctgccggtcggcggcgcggcgcggcggctcaaggaggcggaggtcgccgccgccgccgcgggcggcggcgtgatcgtctcccacctggccgacggcggtgtgggtgggtactactacgggtgcggcccgaccatcgcgttcggcggcggcggccagcagccggcgccgctcgccgtgcactacccgtcgtacggccaggccagcgggtggtgcaagccggagcaggacgcggtgatcgcggccgggcactgcgcgacggacctccagcacctgcacctcgggagcggcggcgccgccgccacccacaacttcttccagcagccggcgtcaagctcggccgtctacggcaacggcggcggcggcggcggcaacgcgttcatgatgccgatgggcgccgtggtggccgccgccgatcacggcgggcagagcagcgcctacggcggtggcgacgagagcgggaggctcgtcgtggggtacgacggcgtcgtcgacccgtacgcggccatgagaagcgcgtacgagctctcgcagggctcgtcgtcgtcgtcggtgagcgtcgcgaaggcggcgaacgggtacccggacaactggagctcgccgttcaacggcatgggatgatctagctacgcagcggccgcgatgttgcaagaagtaaattcttgagcttaattagcggcaagtttaggattagttcatcatcagagtctacaccacttgaccagtacatgcatgagacacgtatacgtgcgttggtagtataacatgtgccttctgaaggctggtaatggcaggtattagggggtaattaagatttgttgtaaattgccgcctctccttgctgttagttttgggaaagtttcagaaggagcagatctgatcgatctgggacatgtacactgatcgatacaataatttcacggttctatgcatgataggctaattatccaatcaagttgtctttttcaaaggcccttttaatttgactccttgacatgcatgagatgttttatgatgcttggaggagatcaattgcatgaatcataattagtaaatcagacaaaggattgtgatgcgtcctttgccattttcttgcctccatttgctcgattcaacatgaactgtgttgaatggcactaatctgattggatggttggaagtctaggtgataatccattcaaatagccgaagcaatgtcattggcgactccacaactccacgagtagaaaaacagtaatccagcacagcaaacaaactaaagaaatgctccaaatgtcatacgtacataattaatcaccaaatttaaattcctccaaaaaaatcagattcaagtggattactgtttgtttagtttgtttatcagcaaaaaaatcagcaagcaaacaaacagtaatctatgctatctgaccttcagacgatcgagtggcttcatcccagagatccagactagcacatagcaccggcataggccccatacaacgtcaacacacctaacatgtaatcgttagggttgaaattggccgtgccccttctcatgggaggcgcaccatcgtcggctcgtcgctctccctcttttgctcgccgtgtgtcgttctttctcctcgtttgccgccgccgccggcaccggggattgcttcttggccttaaccttgacacgcttcccggtcttgtcgtcgccggcgagaccaaaacaggccagcgaattgtgcatcttcattgtgtcgtctcgtcgtctttgtgtggagagagatccctgcctctctttgatcgatcaggtcggcagtgcaggggtgacgctgtctcgagcttcgttggttttcgctccgtttcgtgttgggatatggcacgcagatggagagaaccggtgaaaatatgtagcggccgggtaatggacagtggagtagcttttcgcaatttgtgtcctggactccacgagtcggagtnaatcagactccgattaaaatcgaacaggaacccaccgtgggccttatttcagcccgccgcagacggcccaacatgctactcattaatgggccgcccgggtctgggcccatgaaaacggcagtgaggctctactactactcacgctcacgctgtcacgcaggggagcaaagcgactgaggagagcgagagagatggcgtgccacgccgccgctctcctgcagcatccgccgccgccgccgccgcccgcgtcgctcccctccaccgcgtgcacgtcctcctcgcgccgccgcgcctctccgtggggcggcgctgggcggttgatacggttacgcctgcgggggcactgcccctcgcccgcctcggcgcgcgccgcgagggtggtctccccgcgctgctcctcctacggcgccgccgccgacgccggggagtcgcccgcggaggcgctccggagggtcctggagtcccccggcgcccaccaggcgcccgcgtgctacgacgcgctcagcgcccgcctcgtggggcgcgcggggttcaaggtctgcttcacgagcggtacgtgctcgctgttttgcctctgggcgtggggcttccctctggcgctcattgtaattctagttcatgggcataggggatggggcgatgggcatggttgtgggactgtgtattgtgcggtttgtgatccttagctgatataacgtctgactgcttaggctcccaaatctattgttatactagctgctagtaatgccttgaatgtcgcaaagatgagaactttgattgatgtgaggatttactctgtgttgatctgtattggataattgctcgtgtctctgctgagggaactttaatcaaagatttaaagtggcattacacttgtcaaaaccactaaaattatgcgctttggctatatattcagaacctaaaaaatgcaaccacactatattttgcttctggagctttcacatgactatgtataaagaggtttaacagtgttcaagcttcaactatattatgtcttttcaggtttctcaatatctgctgcgcgacttggattgcctgatgtgggtctcatctcctatggggaaatgatagatcaagggtgtctgatcaccgaagcggcctcaatcccagtgattggtgatgctgataatggttatggaaactgtatgaatgtcaagagaacagtaaaaggatttattaaagctggttttgctggaattattcttgaagaccaggtatgcttttcaagtgatattgagttgttcatggcggatgtccttccatacactgtgtttgttctagttatcttgaaactccacgattagggaagtctgttgtgttcattgtacaaagatggtacttccagtggcaccttcatatacatacttgactgtgggatccctgtgacttctgaaatgaatagtgaccttttatttttgtgatcaatctttcccttttgtttagttttgttttagtgatatgatctgtagtattctgaaggtatctccaaaagcatgcggacatacacagggaaggaaagttgtctcaagggaggaagcaattatgcatataaaagctgctgtagatgccaggaaggagagtggctctgacattgttattgtggcaaggacagactctcgtcaagctttgtctcttgatgaagcattatggagagtacgcgcttttgcagatgctggagcagatgttctatttattgatgcccttgcttcaagagaagagatgaaggcattttgtgcagtatcacctggagttccaaaaatggttagatctgttacatgctatcttgcttatccaagttgtctgtgatggccatgaaacaattgtctcatcatattctgtgctatcttctgcaggctaacatgttagaaggtggtggtaaaactcctattttgagccctgctgaacttgaagaaactggttataaactcatagcatacccattatctctgattggggtatcaatgcgtgcaatggaggttagttgatttgtatatgttaaatgcatgtttttttttccttctcacagattttgtaagctacaactgaaaactggttcagattgcttaccatttgtcctgtgagtaatagttatggattctgaaatactagtataacatgccgggtgccccataatcagtatggaaactccaacctatgatgttagtacgagtttaggatactattgcaacctaaaattttgtccagaccttccataatatgaccctgctttagaattgcaactaagggcgtaaatttcaataacaggtcttttgactgaaatcaatgggccttc

SEQ ID NO: 77354 - DNA, 6698 bp, Oryza sativa
tccccctttttttttaatttacttgtgggccccacatactggtttggtttttttcttactaggatgccacgacagcgaaactagacatctatactgactcaggactagttttacatagttcacgggtacacatttctggattgcagttaggggacctcggacagactcggcgtacaattgaggacgtcaagtgaacttattcctttccacgttgtacgatcttttctcagaaacaataattaattttttcctagagtgatggaaaatgttaaatgcatctgtaattctgtatgcacgagcaatacgtcttctttccccaccgaatatttcacaagcgttaaactatgtactcccacaataatgtatggggaatcatccagcatattttacatgtgtgggccaacagccgagatggaacaggtgcaacaaatagattagcatctgagaaattttagcacttataggattattttgctatagaaggcaagttccactgctgttctggtggaaaaggtacatgtgtgtttgcacagatttttttttattgataatggaagatttcatttggtcattggacgagtacacatatgatttcactctcggaaaccacctgcctcttagttacatccaaaatgcatgaccggtgcacatctcaacatggtgtaacatatgatatcttaaccaactttgcacaattaaataactcctaatgataaccttaattaattatcactcacttcattgtcctaaatcaatttccattagcatgttgatgccttttgtccattaggcaataattatcaggcatttgtgagttacatccaacatagtgtatcattcattcgccttgtcatgctattcaaatgaaaaccgcaccacagtatgcgacaaacataaaagtgtaaatcatggagcctttaggaatggagttaaatgccatcatatgtgtggcatatttacatgaatgccaccgtctattctgatactacctcctggttagttgataatacttattcttttggataggataaggacatggtcttgaaaaacaattttaactattaatttttattataacatatataaaaatattaataaatatatactttttgaagaattttttaaaaccaatctctatagatgatcataattctaagaaaagtattttagatgctatttatagttaaagtttttaaagtttgattataggctttgtccataaagataataattattaacttggagatagtagttagtagtgcgttatgtagctttccattaagatatatattagcattttaatattatgaatgtgttttcagtagaaactataatgacacaattttctagctaactttaaaactgtgaaggcgtagattccatctttttaccattagtttttgcaaattcttatggtttaacaacatgcaaattatatgcataaaagtatttcccatggtgaatctaaagaaaatctgatgatattatactatatgagtttttaaaagttaatggttaaagatgaaaatatttgacttcagatgaactagagtgtaagaaaatttgaaataaaggagtacacgaaaccaaaacacacattgaacaaggacggtccagtggactcttgcccgagaaaactccaaatgctgtacatagtggcttaatggtaatttacctcgtagcaaatggccacattggggttcagaaaaatgtcgtcagcaggcccctcgaccagctacaattgtatatcacttggcctctggccagattggtggagaaaggcaagttctcaggctgcagaggaagcagagctccaatctgttcatgccaatggctgctggcacctgggtgaaggtaatttctcttgcttactcatacatatgcaattgattgtgtactcccttgatctataccttttcataagaaaggtttggttcagttttgggggaatttttttggctgagatttgttcatgttgcaagagtatttggctatttgctgcttcgagtgatggttatggacatggattagttgggaattggggcttgtttctgaaggttgttcatatattttggggagggttgtggattgaccctgctaggatgaaactttgttctaacccaagaattttgacatttggggattttttttttctagagcagatcactaaggaatcagaacatgaggcttagaatttttgtttttaaggaattagacttcgaaaattgagtagcatgttcagaagctagggatttcagattataaaaggttggggtttaattagcgaagaagtttcaggttgtgatgctatgctgcggtgttgattgggtaacagtgacggattgatagccatggacatgaaaatgagttgggaacttgggttttatgttggtgatagtaactgtttgaagattatataaagggtcaaatatcttcggtgtatcttgttgattccagttttccaaggtttgttgacaatgaagattattcgggagggcgttgtcagaatccatttcagtttcagctctctggagttgaccaagggattttgattccaaatttccagggcgatagcaaaatgctgacttcaaatttatgtgtcaataacatttccagtcagttttgagaagtacaatttgtgttattcaggtgtttctgaaaactgtcgactgtcttcaatatcagatgcacaaagaaaccctggaaatgcagaaattcgggccattaggctcatgaacatatgcaaataaaaagcgccgccacatatagacatccacatattagatgtcacttaaactaattagtgaattcctggaaattttatagaaattacaatcctgtatagaacgcaagaatttcatagcaaatactaataatcttcgaacacaaattgctcagcgagagagtagtaattttctttgcagattgcagcatccagttttgtctaatttgattagtaattgacatcagttaattaattaattaatcacgcgcagctagagcagaagggagatgggccgggagcaagaagctcccacgccatcaccctcgtcggcggcacggcgtacgcgttcggcggcgagttcacgccgcgcgtgccggtggacaacgccatgtacgccttcgacctcaagtcgcagtgctggtcggcgctggacgcctccggcgacgtgccgccgccgcgcgtcggcgtcaccatggcgtccgtcggcgccaccgtctacatgttcggcggtcgcgaccaggagcacaaggagctgaacgagctctactcgtttgacacggcgaccaacagatggacgctgctgtcctccggcgccggcgacggcccgccgcaccggagctaccactccatggtggccgacgccgcggggggcgggaaggtgtacgtgttcggcgggtgcggcgacgccggccgcctcaacgacctgtgggcctacgacgtcgccgccgggcggtgggaggcgctgccgtcgccgggcgaggcgtgcaagccgcggggaggccccgggctggccgtcgccggcgggaaggtgtgggtggtgtacggcttctccggcgaggagctggacgacgtgcactgctacgacccgggcacgggcgcgtggtccacggtcgagaccaccggcggcggcggcggcggcgacaagccgtccccgcgcagcgtgttctgtgccgcggggatcgggaagcacgtggtggtgttcggcggcgaggtggacccgagcgacctggggcacctcggcgccggcaaattctccgccgaggcgttcgcgctggacacggagacgggcgcgtgggcgaggctggacgacgcgggcgagcaccacccggggccgaggggatggtgcgcgttctcggcgggggaggtggacggccggcgagggctgctggtgtacggcggcaactcgccgacgaacgatcgcctcggcgacatctacttcttcactccgccgctggcttaataattcctgaaccggcgagcgaccttgtcgacctccgtcatgcaggtgtccgcgtgcttcccttctgagcgttgggtagttgtgtggtttgtcactgtgtttgatgttggtgttggtatcatgttatcctgtgttgtgtagctgatgaaataaatgtgatgcattggtcattggtgctgcaagaggcttcaaatgcctgttttccaaacaaaatgtcgcctaagtaactaagttcatagggtacttaagggctgggctaagatagcttgaaattttgaagtattatttcatttcctttcggtcgttcaaatttggttagaatcagtataaatccaacgtaaatctatatctttacctacttggaaaacaaagtatgcctctaagccccctttgtttcatgggagtagctatatttatggcgttatatttttcatcaaaaatagtcggtatgtatttatattgtaagttcctaaattacatatttaattttagtgtatttataatgtagctctcatatttatatacataagtcgcaaaattacatatgtaagtcccaaataaatttacatatgtaatcagtatgtaattatagtgtaagtacgatgtaattagtatgaataatttatccactagtgatatagtttaatctccaagtataaaagcaaatactagcacaaatcttgaagataatctgttgagttgtgatacaaattcatttgcacttaataaatgctagcttctaccgtagtaaagcggaggcccgtcgccgggaggcttgggccggagcgtagcggacgaaatgacagtgggcttgctttccgttcccctattcctaatttgaagagctaatttgcgggattaacaagaggatggtagtggacgttcgacgcctcaagtcctcaacgcccgcatggattcaatgcaagtaacaaaaatggggtcctcctatctgttggactgggggccatatgtcatacaattagtgatatacctggcgccagtaatttttgagtggggtccagggcccccacaccttgtatggtaaatccgcccatgcgcacaaccattgctagtggactagattgctttctgtcgcctacgtataatatccttttaggtggccatcataacctagccgttgcgaaaacattcttcattagtgactgctttacgacaaccgccaacgaatatattgcattttctgtgaccttcggtcgctggcgtatgagattctcgccacttaaaacatgaaatggatgccaaggattaacggttatcctttttatagtagtgaaatgtagcctctactctatacaaactgtagagaatagcgtggattgagagcaaagtgtattttttttgaattgagagcaaagtgtataggggttatataatagagataattagttgcatatataccctagctttaaaattagaggtggcacttccccgaaaaaaaaaaaatagaggtggcacttctgagatctaaacaacctcacgaaacacgtggcttttgacatctcaaccaccccactaccctacagtctaaaatcccaaattgtgatcctgatacagataggctgctacccaacgaccgaaccattgtatcccggtactgatatggccgatccgatccattgtatcatgcgaccaccctccctcctccccaaccagatcgaccattatatccgtctctccctccaacctcctcgctagaccagagccttccgtcgtgtcagtgtgccacccaaactcaccatggcttctgacttcaaggcaatccccttgatcggtaagctatgtctgtcttttccaggttttttttttcttttgagctaaagagagaatttatattaatgactgatgactgactagggggttacactcctgacttgacaagtcaacgatccttattgccagttaagcaagcctattttttactatggccatgtttagttccaaagtttttcttcaaacttccaacttttccatcatatcaaaactttcctatacacgtaaacttccaacttttccatcacatcgtccaatttcaactaaacttttaattttagtgtgtactaaatacagcctatgtctttttcttgtgcacctgcacactctgcaagcactacactctgcaagtactttagaaatcagcattatccatgaggatccttatggactccttatcaagttaaaacaaccactaaaactagcacagtttttatggcacttttaacgttgcctataatactttgctatatagacatttttaggcatattttgttaaatctatcttgtagaggtatatttttggtacttcaaaatttttctcatatgtaaagtcattttctcaagacatctaaacctcggttgagtcactttctaaatattaatatgtgcatatatagaattaacacaacacatacatttacaagtaatgatataaggttcagataattagtgcattgaagataaaaataatatactcacgagtttaaggattggtaatacttcctccgtttcacaatgtaagtcattctagcattttccacattcatattgttgttaatgaatctagatagatatatatatttagattcattaacatcaatatgaatatgagaaatgctagaatgacttacattgtgaaacggagggagtagcaaggaaatatatttttttctattttcacattgctttgctataggtatggcaaaatttaatgcctgt

SEQ ID NO: 77355 - DNA, 1760 bp, Oryza sativa
cagcgagaggagagctcggagaggatggagatggagctccggcaatggctgcaggaggaggaggaggatgattgatcccccacgcagcggtggcattaattctgacgccattgatgcctagctcagctcccagcttgtcgacccagcttgtcgcagatcaaggtcttcttccttcacctcgatctccacctccaggcttggaatggtgaccaccaccgacagctcagcttcccggcgaggattcagcgccgccatcttagggcatgtttagttcgcgaacgaaaattgttgacgtgtcacattagatacatggacacacattcgaagtattgaacgtagactaataacaaaacaaaatatagattccgcttgaaaactacgagacgaatttattaagcctaactaatccgtcattagcaaatatttactgtagcaccacattatcaaatcatggagcaattaggcttaaatgattcatttcgcaatttacacgtaatctgtataattagttttttttcctatatttaataattcatgtatgtgtataaacattcgatgtgatatggtgaaaagtttttctttgggaaggccttagctggtagatgcatcttgcatgcattgaggcactggttgggattaaatacggatcggtaaaatagtaaagttattagtgtataattaattaaattttaattattataaattgaaaaaacgaatttatttgatattttagataaattgctatataaagtatttttgcatgaaacaccatttagctatttgaaaaatgggttaatggaaacaaagataaaatctgcatgttaataaaaaaagagttgtgcctgagagaagctatgatgtccacagtagctagaatgttttcgcacgaaacatcgtttagttgttccggagggctgaagttcttgaactgcaattcaaaaactttggagagctgatacattgaaggttctttttttctaattaagatgtggattgtaccttagttttcattagcactagcacgtttttttaaaatgctaaacaatgtgtatcataaaaaaaactttctatataaaagttgctttaaaatatcaaataaatataatttttaaatttgtaataattaaaactcaactataattgcgctaatgactttctcgttttgtgtgctaactttcgtttgatgatgtaaaatgaagttagtgcacacaaagcgaaaagtaagaaagtaaattttataactcatatccactattttgtcatataattctctcgcaaaaacttgcggggttcttatctagttaatacatgatgaggtgatcgagattagaaataagtatgggaagggtgcaggtctcagagggctgatgcgatgatggggcctatcagagttagtaatggaataaaactcatcttttttagctatatttatgacaaaatttacacctaaaatagctacattctatattctgtgaggaatttggtatgcaactttttaacttttgataccattaatattattgaaatttacatccaatagatttaaaatgtcaaaatggatttgatatataactcttagcttctttttccattgacacaattgtattttctatacaatagttttccaaagtgtttcacagatacaatgatgagaaaattccctatgtaacatcagaaaaaagttgctcttccctctatagcacccaaacttcaaaagttcccttccctatgtagcactttcattagtttttacacttgac

SEQ ID NO: 77356 - DNA, 4096 bp, Oryza sativa
acaggtgaccgccggcagaggcggagccatgcccggggagcgagcggcttgagccggagctcgcctgtccggcagaggaggcggaccgggtggccggcggtggaggcggagcacgcccggtcaacgagcgattgaggcagagctcgttctggaggttggcggcggaggcacagatcgcccgggtggcgagcggctgaggcttagctcgcctgggcggccggtgccggatcgggtggccggtagtgaaagcggagctggtgccacgcgtgatagagaacttacgctccagcgaggatgccctccccggggcccgccgctcgcccaacccctccgcgaccttctttcttcatccagatcaccgccttctccgcccggaccaccaccgccaccgcactggggagtgagtcggaagagaaggagaggggaaagggaggagcggcggtgccggccctcctcgctgctattcgcctcctgcacagctccatctcgtgcatcgccgccgtggacgcggccaccgacacccgtcactcgtacgtcacgtccgcagtcgcctcctgtcctccgatccccgccccgcccaccaacagcaaagagagagggatgaggtaggagtaattgacaagtgggcccatagttttttattactttttttatgattggattgccaaattggcgccacataggatcaaaatcgctccagattgagccaaggggggtaatttatccggtttcaatactttaggggtatcaaatgtccggttttgtgggtttgggggggtggtaattcggtcaaccacgatagttgaggggagtaattcatagtttttccttctaataataaagaagaggggaactaaaacagatcaaagatgagaacttgattttagtttctttttaattattttaaagatcagtattttttttcatggcagagcacatctgagctgtgcatggttatatagaatttctcactggatgatctagcatgagatgcttctacacttctgtaacattctaagcatgttctaagatgcataagtaattatgtaattaccatattacagttgctgcccactgttcatatttagccttaactgggtgaagcaaacaattttgatttgagtgaaatatctggtgaatatatttcaggtcaaaaaccaatcaggtgagtggatttatgccaaaccaatcccgggaaccttcgtctgcaacattggtgacatgctgaaggtctttttttttcttcgtttgcaccttcattgtcatctttttattgtcatcaaacttgtgacacttatcacatgtcatatttgggttaggtttggtcaaatggaatatatcaaccaacacttcatcgagttgttaacaattcccctcgttaccgtgtatctgttgcctttttctatgaggtatattacttgcttaatcccctagctcatcttaatactacacatcatttatgtgaagttgctctctcattgttctttctttctgaattcatgccacagtcaaacttcgatgctgccatagagcctgttgagttctgccgggagagaacaggtggtgtcgccaagtatgaaaaggttgtatacggggagcatttaattaaaaaagtcttgaataatttcatcaaataaatttgcggaacagaaaaaacaaacgtgtatgcactccaagatcatatcacatcatttatcaataatactgtttgtgaaattttattgtagcacttgttgcatttctataatttgctacattttaggggctatcttaacactaaagatagagttcctttatggttcaccgtactatgctatagtagtgggttgtactagtgatccaacgattcgttggcataataagcctggcctaaggtcatgcctgtaactcgcctggcatctgtttggttgctaccctgaggattctagcctgataaatcttgcctgagtgtactcgcctgagtcaggcgtacaaaatgggtggcctgagcatttcgctccacctgcctgagtaaaatcaccgctcttctatacagtagtgaaaacgagaccacttcttcctcctcctcactgctagcctagggttcttgcggagaccagttcccatcgattcttccatggctccagcagcggtgaccaaggaacttgcagatctggtggccagttgtttctttttccagtaaaagtcctgcatttggtgatctgttagagcgtagctctgaccgtgagagctagcaggtaagtagaaaaagaagagtactttgtccagatctgaagggaatcaaaatttctaactctctcctttcctctgtgcgcgtcagattgccaagcccccacaatctttgccacgattttctgcagcaaggtgagaacacaatcgcagtttttttttttacttttcccctctcttgctgctttgttattcaaggatccatagagagtatgcctattagaagtaaaactatgtcaaaatgtgtgctttttttcactagtttctttttttttcctttgtcgtgtgatgctcagatggatctagattctactcatcagtatattgtccatcaacgaactagaactttgggtgttttagctgttgtgttggcaattattcgctggcgacgtcgtataagaaatagacgacatccaaggaagtatggtccattggtggatagagatttggtcaggaaaacaagattagatgatttgtacaatgggagtgatacaacttgcatcagtcagcttcggatgaggaaagaagtgttctggaaacttgcctccaaattacgtgataatggcctactatgtgacacaatccatgtctcagtggaagaacaattagctatgttcctgcacacagttggccacaatttaagaaatcgtgtgattggattctatgtcataagatccagtgagacagtgagccggtacttcaatgaggtgttgaaagctttatgttgtcttgctaaagatatgatacaaattaggtcaatagagacccattcaaagatagttagtaatcctggcagattctacccatattttgaggtatctcacgtgaaatatacttattcaacattctaattaatgtaaccactttatgtttgtatagtaataatttcttctaacttaggattgcatcggggcattggatggcacacacatccctgcatttgtcccagagaatatagttaacaggtttagaggtcgcaagtcctatccaactcagaatgttcttgctgcggttgactttgatttgaggtttacctatgttcttgctggatgggagggttccgcacatgacttagtggttctcaaggctgctcttagaagatcaagtggaattcaaatacctgaaggtgtgcatgaagctttagtattttcaggtgcacaatattttgtgacaaggcaataaaaccattcatcttctgttgtaggcaaatactatttagccgatgcagggtatgcagcaagacctggtatactaccaccatttaggggtgttcgataccacctgaaagagtacgaaggcgggaaatcaccagaaacacctcaagaattattcaatcttcgacattcctcccttcgcacatctgttgagagagcatttggaaccttaaaaaaccgtttcaaagttcttgctagcaagcctttctttccatataaagtccaagtgaagatagtaatagcgtgttgtgtactgcataattggatccttgataatggtcctgataacatcatatatgatgaagctcgttggtatagtaagctacctagatcagctagagtagcgacagattatggcgaggagcaccaacagtgggtagaatttcgagaaaatctagctaatattatgtgggaggaacattaacagtggtgttgtatggcatggatattgttctatgactgttagctatttctaatgaattcttctttcagctcttcatattatagcattttctactttatgtttttttgttggatgccattattacctactgtgcattgctttgtagttcataacatggatataggaggaagcaacaaacatggcaagggaaaaagtaaggcacgcaaaggagttgggggatcaggtgtga

SEQ ID NO: 77357 - DNA, 5000 bp, Oryza sativa
  unsure (1)..(5000): unsure at all n locations
tacttgttagacttgtacaagaaacaaatttttagagaacccggcaattgttccaaagtctccagctggggcctttctttgtccatctacctagctactactccatcaatcaatcttttcttgtgcagaaattctggagattatttgaagcatgataggtgatgcttattgattcttcttggaaaaggatgtgcaagaattttgtgcctgttgcattgccgggggcaagtcaaatttacaatagtttttgataattttaggacccccttctcaaatgtacatgcaaatgttctatgtatccgaggagctagttgtttgattaaattgctaagaacatgtatataaaagtttaatccaataatcttttctggagaatatttgaaagcgtgatggtgctgcttgctgattcttggaaaaggatgtggcagaattttgtgcttgttgcattgccggggacaaatcaaaattacaaattttgttttgatgatttgaggaacacccttctttcgcaaatagaaaccccttctcaaatgtacatgcaaatgttcttctatatccaagaagctatacataatattaattatttgattatatatgtgtgaaattgccggtaattggaaaaaaaatcctaatgtgaaattgtaaaaatagagagtaaaaagtacacgtattcagaaattcagataacataggatatgcatactatgagcttttgattagactctacccaattaccaatagttttgtcatcacttctacaagttgtaattgttttgaagatactagtactagtagtagtacgttttgaatacacaaatacaaacatatccatgcattgcttgaacaggactactgaaataatatattgtcaagtttaactaaggtctattgcgtcaaggaaagcttttccaccaataattcgaggcaggtgacattctccttgatagtgtcactattagttaattaagcactgaaagctctgactttgctagatgagcctatttataatgtccaaaatatttcacaaatggggggtttcattttctcaaatccagctagccctctgtaagtctgtatacatccaccattcaccatcaagcaataaagaacataaaactgctggtccctcaaaagaaaatcaaaagaaaaaggaacaaaaaaataattatcattgtgcccatatttctttttcttttaaaaaaattcctgttccatatcccacgtgtcaagcacccattggccaagatgacgaagtggagaaaagtcagaagaagaaaaaaaagacattagaaatggtattcactgtagcgcctttctgtgcaccctccaacaagatggcgcactagccctatggtacacacctttggtgtgtccttgtctgtggggcccacatggaaatcctggaggtggggcccacatgtaaaggtgtgggagcaaggcaggtcaaggcaagaaggcaacaactctggggtcaattccggagtgtgctttacaatgatgtgtgattagtgattactactacaacggcagcaggattgttgaagacgtcagcttctgtaattaaacatgcagatgcaggaggaggaaggatccatgcagtttcttgcgttttattattgcaatttgcaaccagttcaaggaggcatatggacaaaaataatgagaaacctcggcgtttggatgcgcatattcgtagccacacgctggtttatttttacataacaattcgttatctatcccacgctctagtactacgctatagtcctgcatcgtttttaacacgtgcgtttttcaaactgctaaatggtgtgttttttttaaaaaaattctatacgaaagttgcttaaaaaatcatattaattcattttttaaaaaaatagtaaatacttaattaatcacgcgctaatcgctactctgtttcccgtgccaccctcactcccgaacgcaaccctaatggttgattctaaataatgatcattttctcgtgcttttcaatgctagttttggttatattcttttacaattttgtacgggctatgtgctaacaaatatagtattgtgaaaaaaataattcgatgacaaaattactgagatttatgttgcgaatatctaatctagatggtttcaattaaatcaacggtcaaataataaaagagaaatgatatacattttttttcttatgaactctcttaaaaagttgatgtagtaaaatgtgattgcatcttggctttttttttcgcggggaacaagaactttgattactcagctaaattgtcctcccacacaaggtgagaaatggaattacaacttccatgcggccagagtccgtaagggactcacacctggctttattagctagagtatgaccagctaagaaatgtgattgcatcttggcttttaataactaaacaaaatggttaagaaatgtagtgcatatatagcactactcactatttcacttagggcctctttaaatcgcaggattgagaaaacgtaaaaataggaaaaacgtaggattttaattggaatgtaagtgtaaaacagaggattgcaaaacgcaggaaaaacacaggaatgaccgtttaattgaaccgcaagaaaaacgtaggaattggacgagagagatagactcaaaggaaaaataccaagaggttaaagctccgctaaatttcctccaaaatctctataggattgtccattccatagaaatttcaaaggattggatatgatcaaatcctttgttttaaagagcttcataggaaattttcctataggattgaaatcctccaaaattcctatgtttttctccaaattaaagagaaacaacataagaagtaggagtacataatcagctttacacgtgtttactatttcctaccgtttgcctttcttgatacagacaaattgtatgggttaattagcagaatatccatgaacctctattgatatatgcaaaacagaagaggaaaataaatcgttcaatcttggtgtacaagcacaaactgcgcgtggaaaagacgccaaccaaaaaaaaaacaatccagggagctgcatgaatgaatgaatggatggtcatggaagtagtatgatatgattccattggagtggaaaagagtggacaaatcatagaaaaagcaaacccaaaccaaagcaaaatcactgcctttttcgttcctcaattccgtagtcctccaactctactcgccttcacctagcacatcagataggtataggtgcgtgcgtgccacttggctgctgtacagtgttaacaatttttaccggtccggcatttcgaaccatgtcacgatcataaattgctccgtttttcgaccaagtctaaaaaaatgaaactaaaattttagttttttataagatttatctagatttcacccatttggatccnaacgaaatgangaatatncgtgaggggcggtttttctggtgtttcttcgtacacactaaaaatttatctattctgaatgtaaaacatgatagttattatagtatattaattaagtataagcttaaaaaaattaatatgatgtttttaagtaaatttttataaatttattttggaaaagtaatgtttaacagtttaaattaaggtcaacaaagagataggagcgaggtttacgttaccgctggtaaccgcgcggttaccgggcttaccgcggagtacagtaatataaatacgtggtaaccttcttagattcaaataaatttaaaaaataatttaaatgtttgataaattttacacggttttgtatgatttcacggttaccgtggtaatcgtgtctaccgctggggcgcggtagcctcggccccaggcggttttgggaaaccctggtaggagctgagaaggatgcgaaaccaacggtgctggctgctctgaacgctgttggttgctgctgccccgtggcgacgacacctcaccggaggcaacacaacgcaacgcatcgaaatcgaaccgcagcgatccagcgagcggttgagtgttgccgcatcaccgagtcaccgagacatttttccttttttctttttttgtaattgcagccgcctcgcgaagcttcgtgccaccttcctcccgtcgccactgcgtcaccttccctcttttcaactctctccctctcacacaccgcattgcagatttcatttgctgcaccgccctcccctcccctgcaaatactactagtagcacaagagccccgcatgccgttcacacctgcccaccaccaccactcgtagcccccaccgcaaccacccacacccacaccactctcgatccttcttccccgactccggccggcattggcggtggtggaggaggaggaggaggggaggactctgggctgtgtctctgtcttgcgcggcggcggcgcgagagggagagattggttgtgattttgggagtcccgacgtcgcacgcgcgcgcgtgtggagtggaggaagaagagatcgcgtctcttcgcccgaggatttctcgggatatttttatttgttagttagtatttataaagacgccgcggcggcgagggcgaggtccccgattcagtttggtttttcttctcgccgacgcgcagatcgatcgcgtcgtggactgggaattcttccccccgcattgttgtttgaggtgaggtggtggtggtggtgatcacgatgggcgaggccgggcaggacgcgccgccgccgccggagaagggcgtcgaggtggaggtgttcccggcgtgggcgcggggcgtggaggagtgcgaggcgcggctgggggtctcggcgtcgcggggcttgtcgtcgcgggaggcggcggcacggctgcgggcgcatggccccaacgagctcgccgagcacccgggacccacgctgctgcagctcgtcgcgcagcagttcgacgacacgctcgtccgcatcctcctcgccgccgccgccgtctccttcgcgctcgcgctctcctcctccgccggcgccgtcacgctctccgccttcgtcgagccgctcgtcatctt

SEQ ID NO: 77358 - DNA, 1921 bp, Oryza sativa
tcgtcactcgtttagttttacgcaattatgcgggtctttcagatgacaatgctactagtacttcctcattaattcagtatcacactctttagtcccttactttgcacttaagattttttttaataaaagaaaccctgatcatgttcggagtggacgaatggtgtttgttgtttggtctgatgacctcatgtgtcaagctaataatttgttcatatccagcaatagtttttttctatcatgcccccaagtagaccagtacatttcatactccttggttctgtttggtgaagcttgtagcagtttatttcaaaatctttagtcacccaaaatttttacctacattgtgaggaaaactcagcttttccagatactgctatgttaagctctttctggatcaggcctttgcatgtatctctctctcttgacacaaaggctgagctgctgaggctatgttgtctcctgtgctctccaaacccgaagccagactagtccagcaccattgcgctaacacacaaatacccaaccgcaaaaccagatatccagcatcttataactaatcaaaaccggttacaattggtgctttggtggttttgacccaggttttgtcctacgtggcagctgagtcagcgtgggacccatgcgagcctcacatgtcaggatgccacgccatctctctcccctcctttctctctccctctctctctcactctcactctcactctcactcttctcttctcttctcttctaattcaccggtcatgccggtcggccgaagcagaagcaagagccactggtggaggggctaggggggtttcgtcgccagcgatggcctagatggagttgagcgttggtggtggcggtgttccgtgacccgccgcagtgttttcgcatcggggtgcagcagattgtgagcaccacctctcgtcatcgccttctccttcttccccgccaccggcgtcgaactcgcgttggaggagcgcggcctcatcggagacatggctgccgccatgaggattacaaacgcgaggcagccgccgtcgccgccgctgcctttgcagtcgacgtcatcacccgtgcagttgctcccccgccgcctgcgcccaccggttgccgcccgtacagctgctccctcgtcggtgcccgtgaaaaagagaggagagaggaagagaagtggagaggggaggagaagaagaggctgacgcgtggggctcacgtgggtccctcactgagtcagctaccacatcagataaaaccggaatcaaaaccgtcgagaaacctaatttgcactggttttataagttggggatacgtcatatctggtttcgcggtttatggacgattttatatcttgatgacaagtgtatggtctgagcgtccaaaactggacccatcttaatttgctttgagaaaactaggcccagcttaatttgttcttggcccaggccccttattctggtctcttccccgaaactgggaaaaggatcgagcccgaacggcgaacacggccgagaaagatccggtcttccatataccacaatcgtgaagcagagagcgaactttgcgcaggccacggcgtcgacggcgatgggctccgaggcgccgcctcccgcgcgacgcggttatgccgacgccccccgccgctatgagtctcgttggcggagggaggaggatgcggtcctcctggctgcggcgcccgcgcgggcgcgtacaggcacctggccggtgcacgtccccctctcgccggggcgtccggcctgtagtagattggcggcaggatgcttctggatgggtcgacggtgaggctcgcgtcgtcgcgtctacgccgagtcacttccatgtgagcagccaattgggtacccatatgctacagtgttttcactagaccgcttctgccgctagtatagggatctggacttgctca

SEQ ID NO: 77359 - DNA, 4089 bp, Oryza sativa
actttccatcacatcacatcacatccaaacttttctacacacataaactctaaacttttttttccaaaccaccactttccccaaacttctccccaatttcaggaataatttatttatgactgttactgtgtttcaactttcaacgaaccacttactatagtagtactacctaacatcagagtctaataagatttggttttcatggtgtttcagaaggtgcatgataacgcgccacacgtgaaactatattcatgagggatgactgaaatggaggattccttaagatcctgcacagagcagctactccgtgttagagaagagaaagaacgccttatcatcgaagcagctgataagatctctttggagcagaagaaagtgtggagtctgcagcagaagttagaagatgcaaataagcggtttgcaaaggtcaccactgaaaactacaatcttcgcaatattgtcaactccaaggataaggtgatcactgagctgagtgagtctgcagcactcctgaaccaaaagttaattgatgccacagccagacttgaattcacacacaaacagtgtggctctcttcagtatgaggtgcgcatccttcagaaggaactcgagattcggaacaaagagcgggagtttgacctcaaatcaattgatgctgcccagaagcatcagcaggaaagcaccaagaagattactgcattggaaactgaatgccagaggctgcggaccatggtccagaagcgtcttcctgggcctgcggctttggcgaaaatgaaagatgaggttgagcgacggggcagtaattgtgttgagaacagaaggagaaagccacgttcatctgcacagtcatcaccgcaggtggtgactccaaggcatcctgtttctgaaggttaccttgtcaagatgcaggaattggatgatgaaaacagacacctcaggcaattgttggccaagaaggagaatgacctccagtttgtgcagttgcagtatgcagatgaagcatcgaagctgtcagtagtgcaagggcagctcaaggagttggttggtagccatgaactggatgacgacaaccgtcctgaaccatgggcaaatagttctttagtttccaaaggagagcattttagagttgggaagcaacatgcatctcacagtaggggaagaagaatagcaggatctgacatgcagttgcttgtagatatatcggagatagagaagcttgaaatgatttcaaggccttcaagtgcgccacatcaatgcgtgccagatgcttctgatacagagtccaaaactgccctgacagaaacagtttgccaagatcgaatccttgaagatggtctatctgacaagtatcccgagtggattcaagatgttttggaacttatcataaagaagcatcaagtccttaaaataagcgtcgatatcattattgatgaaataagatctgcattgaggactgagatttcagacaaaggaaatgatgctgcaaatgtgacatatgaccaggcagtaatagacagcatggtggctactcttgttgaaagagtgagttgcatgatcgaaagatcttctggaaacaatgttctgagttctcaatcatttttgcatgagaaatctgaactcacttgtcatcttgagcaccttatctgtgtatgtagtgatgtactggatggaaaggccaatcttcgaaagttcatcgaagaagtttgcttaaccctcgagtggacagtgaaccaatatatttattgtgtcgatgctctcgaaactgtggattgcatcacaaatgatttcgatggaaatgtatctcttagatcattaaacatgcaggaaaaacaacaaatgcaaagcacaaatccgaaagtggctgtaggagttcaacaagaggtacagaaagaaccgtttctgatccctggtgaccccgtagaaaatcattctcaggttcagtttgtcacttgtaagcttgataaggaactgctggctgttaggcaagatcatggtgataattgtcaagaaaagcagtcagtacattataaagaagaaaggtaactatttctgagaaccatcaatcatgtaactattttcagcactgtacactattattgagaatcatccaacataaatatgtaacatctattttatgatacagtgctacggctgatgggagcatgcaattgttaccagaagaagaggggaaacaactaacagtaatatcttatgtccttctaaacgttcttatgtttttttgtttgtaaattaatacacatctgaaatctgatgtttcaattcacaagttgaacttcacaacattccttgtttagctgagcaccacaatgcccatagctatcactcaatcactatcgcatgattccttagacattttatttttctattttatacatattccatcaaatgttcaaggtgcagtttatgtagcaagtgttgattaaaggcctactactgaataaatatagttgtacacttgcatgacactgggctatccattagtgagctttgaataagcgcaataattgtgaagtatattttctagtcattttcatgttggtatgatgagaaccataatggttgcaactcttgcagaattcggcaatatccgcagcagctgataaacttgcagagtgccaagaaacaattacaagcctaagcaagaaactgcaggcgctaaaatgtccagcaaatgcggatgctgtagacaaaagaaagtctgataacttgcacctgttagttgcaaatcagaattttagttctcccccatccatagaagcagcatgcaagaaagagaacgatgaacgtgttacaactgaaaagaaccttctacaggagcaagatgttggcactggccataaagttgataacaatggttcaacacaaatcgctcctcgtcccgtgatccccaagtcgccactaaccactgtttctgttgatatgaagaagaggaagaaaaagaagcagggtgggagcttgctgagtagactcatctttgggaagaaggcataaaacagctccttggctgctagcctgctacgctcctctgattaagttgttagtgcatccagcagtgctggagcttgttcttctaagttattccgatcccatgtccaataagagggggcaatgctacgtagctaaaatataatttatcggttatgtcatatgtgttgcgacgtgatcaacactatatgtttgtaaaatcctgttccagacatatgcatatggtcttatgattggtggatttattatggtacggggtactaaaattgtgctgtgctgtactgatgttggatggctttccgagaggcacgggcattgcgggtcgaatacggaatacatataggtagagccctggttcggccccatgctgtgcattcaagtgtgctgtacttccttcccatgacctaagcaaaaagcttgtagcaacatgtgatcgatcggtaccatggtttatggttaggctagcttagctggtgcaacttcatctcactcaccttggtcgttgcatgcacataaagaacaaagaaaaatatagaacaaaatagcgaggagggtggctctcaggctctgtgccgaagttctatgagcaagctactactaagggtgtgtttagttcacgtcaaaattagaagtttggttgaagttggaacaatgtaacgaaaaagttagaagtttgtgtgtgtataaaagttttgatgtaatgaaaaagttgaaagtttgaagaaaaaattagaaactaaaccaggccacaccctaaaaagcggatagcggggcggcaaattcctatgcgtagcagatagcgggtgatattatggatgcttatatttcaatagaaaaatcataaaaaaaactaaaatatgtaaattgtgtatattcactttttgtcagactattttactcgttaaaattataaattgtagattagtgtttaatttatattttgttataacatagccaagtaaaaaaatatttattttataacatataccaaataatggatgatatttttgcacatagcccccgtaatattctcttcgctattttaatagcgcaacaccatcgcgctatcactattacggccag

SEQ ID NO: 77360 - DNA, 710 bp, Oryza sativa
taatgtagctctactggaagtctggaactcaactgtattattatcatttttttgtattgttatcttatgtttattgcatgtgaactagaaaagcatgtctaaattttatagagcttcacattgaagcttatctagtgttgcaatgccactgatatctcaagttaacccctctggtttttatataatgtctgaaccatagtgtatttgcatctatgaaatccttatcgcaacaagcaagccacctgattcttttttttttaatgtagcctagtggaagccagtttgtcgttgttatttcatggaaggtagaaaatcatgtctaaatatttagaggtcaactatgaaactaatctactgtgggcgtgttgactgatgataaatctaatgcaatggtgctgataacatattgtcaagttaatgtggtttgttaatttaaggttaacttgttggttcagaaagtacaggataatctgttcaaacaaagcttgttattccaaagtttacttttgcttgagtctagttctgtccaaattaatacagtgaagtactgcatatatatgcttgttgtaatagcttgtaatttctagtcttgttaacttaacatgtttcattttctaggtgctggagaagataaacaacccgcattatctctaccgcatgaccatcctgccagctatttcattgctggcccctgtcatgggtgccgaaat

SEQ ID NO: 77361 - DNA, 899 bp, Oryza sativa
aggcggctatagcgtcgcgatgccgaagtgggaggagatggaggctagcttgcttgagaggggtatcgaaccggcccccgctaattggccggaacgatcgaagttctggtactgtgctcacggtggaacgctccacccagctgatggctcactggtcttcggcgatcagatacgagaggctgcgcgttgactaacagacgcagtggaagcctcttctcagggcacgttccgaccggatagagagagggacgagctgtcactcgccctgcagactccagagcatccaggacgaacacgagggaaaggggtgattccttggaagattgggttcaaggaggacatccacacgtacaggagtcggatgaggagcaagagagataccgaggcgaagattgcagatcttgagttcagggtatcgagctacgagctcagcatgcaagaggaggtagcaaggaaggttgatgaacgcatggccgcacatcggtccaatgatccccagccgaccattcctcctgcaatggtgagcccgttaggaaaccgtagcagctgcgcctcaacggggcaggtaggatcacagagcatggacgccatgcaaacccagagcatggacgccatgcaaacccaggacgaatccacctgccccgttgatgacatcactcagcggacaccatgtgagctgcatattcctttcaagaacttatcaataaaggtaagctcgtagtttatatattttagatttgcccattccactagttgctgcttatatatgttgattagtaataaataacctctcaccacatgaaggtggcgtcgggcatggccatccaacggacccttcaggtacttaccactgcaggccgattccagcaggatactccaaggtcgaagttgggctgcag

SEQ ID NO: 77362 - DNA, 1705 bp, Oryza sativa
aacgcagcatcccttttctgctgcagtctttcaagagaagtcagttcctttgccacgacagcagcctcttgttgctcaagcatctgctccgatttcgtgactgtctccttgaactccttttcctgctctttcagctcatcaaactttttcttaagcgactgctcaaggccatggaaatggtcctcaagttgcttccactttaagttcaatgaaacagcactctggctctcaagctcggcaaatgcacgctgaagcagctgcagcttggagcctgtagactccataagggctgtcatggactccatgtcggacatggcggcagctcctgcaaatgagtaaacaacggaagctgttggttcgcgcaacccaaatagcactgcaaacaaatccccgcacagtacagcaaaaacttcatcgaaactacgcaatatctcactaaaatggttcggttaatttcttcctgcgcatggatgaaggaacattgaagggaattttatacgctattgcacacaaatcggagaacatagcaacatcatctacccatggacggatctaacgtgggacatggtatactgtgatgtaaatttttttgggggaacaaacaaactgttatttgtaaggtgatcaaaattgagagaaaagaagcttccagatctggaagagaagctagaattaacgcagggaaattcaaggaaaaaagtgggtgggtagagatgaacgagaaagaggatggatactcaccaggatgcggcggaagcagcaggacaaccgacggggatggagatcggcgcagggcagcggcggccgaactcgcgacacgggactccacctccacgcccagccgacgggatgggatggggacaccctcaggcgaggacacaatgattttggccagcagatatttcctcttttcttttttttttcactactgttcaatcgcctaatccctactacgtctctgtttctttccttatccctaagttataaaaaaataaaaacatttccgtccgaaatttccatacattttccgtatttgatttgattattggtcgacatttctgattcgaggtgagtctagaataaatattataccagcccaacctaaccagtccacaccatctcgtcacctcatcctcatcctcacccccacttggcgccgcactagcccctccctcgatcggcatctttttctctttccatttttcttttttctcccaatcatcctaattctcttccgatcctttcaatctcgtctattttctcatttttcttttctcttccgaatttctcttctcataaatatttttcttttgaaattataattgtttaaggtgtgtatgcggcaagtttattactttgcaaatactttccatttacagtaaaataatttcactaattgaataatcaaaattacaatcttcggtcaatgaggtatagcaaaatacacgtgtcaaataatagaatagccacccgatcaatttgtgaggctatgggaaagtgtacatgaaggatccttcatatgatgatgcatgaagctagtgtgctcaatacttatatatgatttctgactttgttttgccatggttttgtttgtcttgtttcggtttgtcgtttaaattggtagagtttttatcaatcgtgaaattgtctttacctgttgtaacgcacatgcatctttgttgctccctccgtataagatgttttc

SEQ ID NO: 77363 - DNA, 723 bp, Oryza sativa
attttaggtttgaatttgtaatttcaccactggtacaccccttatttctgcatgttacaaatatattgtgcctgctcagaactgcttgccacggccagggcttcgatctctactgtgacatctagtagagctctttaatttgtgtaggcagcaggtttgagtaggcccattgtgtctctgtattggcatgatctatagaatacaactctgtatagtcgctgatttattagtatacaaattttttgatttttaaaaatattattgttattttttgttggtactcaatcaaaaatatttaaacatatttgacacttaaaatttaaaagtttaactaggcatactatttatctggtattaattgttgagcaccgagatacatatattatatatatatatatatatatgaaaatggttctatacacctgggagtatgtacacctgttctcatccaccgttgatctatgattagcttcgatggaacctgatatcggattaacgagcggacccgtttaactttttgacgagaaaaaaattacgtactccttaattagccacggaaaccggaatgacctgagtacaattcctcgttcccaccagtgcatcggatccgaaaatcaggtcactaggagagaccgcgatataccagaactcggagaaggcggcgccgattcatcgtcgatccatggctgcgttgcaggtgacggcgtgatcccggcgcggcgg

SEQ ID NO: 77364 - DNA, 10568 bp, Oryza sativa
aattgggctgggctctgggcctgctcggcccaccattcagtgactcggtgaacgttggtgtgaagcatagaaggcgtgaacgtgcacgtgccccgcgccgccgagaggaaacacgacaactcaaaccaatcctgtccgtccattcatcccgtagacaatctgacccgtccatccagatctgcgacgccgaataaatagccctcctcctcccacatcccgagctccgcccttctgacagccgccgcatccgcgccgcccccgacctaggatttcgccgccattctcctccaaggttcgagatcctcctccccgagctccggatttttttttctcaatttttctctcgctgttgttcgattccgttcctgcacgcgcgcgcgcgcgcgctcgccgtaggttcgtttgtttcatcgattatagcaacctagtgtggggaaggaagggataggagcgaaatcggaatcgaacatgtcagatttggaggccatcgaccatggctgccccatcgatcgccggcgcgggtttgtagagcttcgcgtcgcctgtgtgccgctcgcagagaggatttggtcatgttgcatctgattggatttacttttcgccgagggcaacaagtaacaagctctagataatttttgacctgaaatcagaaagctcaagtaaaaagggtaaagctgtgaagcctcttaaacccatatgtttaaacccccacccttgtgcttaaacccctcttatgtataggtttatgtgagtattaatgatagcatagactgttggtgacgcgctgctttctttgtaagtggacattgatgattctatcatatagtgcaagcgccccagtttttagtctctgctatgtgttaattagttcatgcaacctaagatgctacaattgctcatattgtgattctttgtagttacattgaattgtttgcaggcacgtcaagtagatttatttcatgttagtcctaagattacaggttcttataggggatgctatggctagacttgccttaactgattctttgtgaactttaatggctgcatctatgcctgttgatcttgtgtatgctgctctgggcggcaaggcctatctaatcatgccatagctcatcctctaatgtgattacttgctaggccccctaaatatgagtctattctgtagtgaaatggatgttgtaattatcaaaaacttctattccgttagtttttcctgcataaaaaagcatccactaactgtagatcttcatttgtaccagtattcatcctccttccaatcattcattagattttgaatagtactgatgtatttttgctgttgtcttcaggagatgccgcgctatgatgatcgttatggaagcacgcgcttgtatgttggtagactgtcttcccgcactcgttctcgtgacctagaataccatttcagcagatatggaaggtacggacagaaccatggtccttaagattttatttctctgaagcgcagattttttgcagaagtttatggattttttttctgttaaatttgtaataagctgcattttctgtgtataaatgtaaaacactattactatgataacacttgctaaacagttgatattacaacaacttggtacgttcaaatttcactgtagaaatttaattatttcccattaaaattgtaacctttccaaattgtgtgcgagtcttctgtgctgagcatagactagtaagcactggatccttcctaccctttccaatgggccagctcatagcagttgttgggttcagtggtaccactcttttttcagctactttgtggacgagttccttgaagccttttggtgtggcattttctattaattcttaaagtatgctgtagaagtacccccccgggtcttgtgtgtttgacttgaatgatcttgttgaaggtttttcggttttttacacaaaccgggaggtctgtgatggtctggtggaaggggtgcccttggtggaattggtggccattcttccaaagtttgtcgaggactttgttgaagggcgcccttggtgtaatgttattgactgttttagtggacgttgcaagtcggtgatgcatttgagtacttgaatcatgatggcttactgtttggcaaccattggtgcagaatacgtgaagtggagttgaagcgcgactacgcatttattgtatgtgaattattcttccctcatttttttctctcttttctaaattgtaccttttagttcacaagtccaacatttttcggatgtctcttttaccaaacaggagttcagtgatccccgtgatgctgaggaagcaaggtacaaccttgatggcagggatgttgatggaaaccccattcttggtgagtttgctaaaggggtatgctgttcttcggttgcttctctaagcacatcctgattctattttttttctttaatatgaagctgctgctgaattgatctgtattttttgttgactgatgctcttttcaacaaattgagcatgcaggttccacgtggtcctggtggttcacgtgaatatatggggagaggacctcctcctggaacaggtcggtgttttaactgtgggattgatggtcactgggcaagagactgcaaggctggtgactggaagaacaaatgttaccgctgtggggagagaggtcacatagaaagaaactgtcaaaacagcccaagaaatctcaggtattgattgataagttgatctgataaagagcagcacttgcaattgttccgaggtactgtatttgaataatttaacttagatttctccaatgcatacttctttttttttcaggcgtgagagaagttattcatgctctccatcgccacgccgtggacgtggtcgcagtcggagctatagccggagccggagccggagccgcagttacaggtatgcttcaaacgccacatgttcaaattataatacaccatgctgtctgtccaaatcacagatatgttatgttgacctcaccctgcttcttttacattctttatatcagccggtctaggtccagatccctgtctggatctcccagggcacgcagagagcttgaaagatcaaggagtcttagttacagcaggagtcccaggcgatccatctccccagcagcaaatgaaaagaagcgcagccccacccctgatggtagccgtagtccaaggagtccacaggaccaggtgagcccaccacccaaggataatgctgagcgtaatggctcagatcacggtgacagcccccggggcagggagaacagcaggagcccgtctgatggctaccgtagccctgcagctgccaacgggcgcagcccaagcccaaggaacaatggaagccctagcccaatggacaacggtagccgaagtcctagggatggaaatggtgacggtggtagccgtggtggctcacgctcacctagaccgagcgagtctcctgaagcctgaaatttaatcgcagtctatggcgttcgtcatgctatggttgtaatggttacattcccggtttaagacgagatgagtgtatttgctcttttctcaaaaacgacagcgtattttgttactttgtgaatgtcatgctatggttgtaatagtcacagtcctgttttaagacgagataagtgtatttggttcttttctcaaaacgacagcgtattttgctattggtgtacgatggatggtccgttgaacttccaaatcacattgtttttgcagatagatttgtatcttcagattgaaaattttgttgctttgcgcgctgaacgacgtcgatggcagttaccttttatctttgaagtgctaaatgttgttgtagacctcagaagctgctttggaagtttgtggtggctcaggtgttctcgacttctcgtcttcgtactctgaatctcatctcatgtcagctcgtggcaacaaatgtgtgcagctagtagctactgtaaacagctacatttgtcttgtactcttgtctcgtgtttctgttggtcagaaacatgcttggaattaatgcccataaagagagcataaggaaggattaccccagttactaacgctaacacgctttgcagctgtcaagattaccccagttaccccataaagagaccatcactaacacgctttgcagcgggcatttggagtagcacttaacaagcagagcctaaaagcagtaaagcacgcagtaatcggaataagggcatgtttggttggacaccagacgtaagcctgagaccagccgggaccttgtttggttggtgtcctgaccttagtttctccttccctggcctgagctcttttggagccttattagcctgagtcaggcgagctccagggcggcgcagctacgctcattaatcctaattaccgcttataataatgtagtataggtactgtaaattgtagaagcaaccgaccatacaaatatattttatttgtgctttcaaggagggatacaacacatccaaatattttatttttttgctaacactttataacaaccgtaataattaaaagcttaatcacgtttagttttcacaggcgcggaagaacaaccaaacagacaagtgagacaagtgttcaggctgcctgagcaggcaaaatttatcatcctatcaggtagctctcaggcacccaaatttttcaggcatgttggtgagggcatcaaccaaataggccctaagtgtgcgtacgactgcacctgttcgacctgcatatcactgtacataagctcaagttttaaatcgttttgacaggtccaagtgaatgcttatgaactccgtgattgattggttcagcgcagttgtatgagagttggatgtatagcactactccacagtaatatgaacgccagtggtcatatatggatgtatatatacgacgccagtgttcgactgatggccgacttcattacggcatcacctgcgcgtgtcagattctattacagaatgagacatttgccgtctgagcctttcattgtggctatggtcatactctcttcgtcccatttaatgtacaatcatgcttttccgtactaaattttgttcattcgttttatttattttttaaaaaaaatcatacctaaaatattatttatgttttatcatcccataacaataaaatactaattaaaaaaaattaaacaacatggacgatcaaatttaaacacgaaaatttatggttgcacttagaatagtatggaggacacaatagctggacaacaaggttgtaccggcacgtatatcattttcgccgtaatatagctctcttgtactactgacgtgccgaatcggtctcggtctatagagccccgaccgagccggactcgtccgaccgagtcggactccacctcggactaatcgatcccatttaaatcgccatcactccgcgcgctctcccatccatccatcatccaagtcaacaagacaagcccgagttttgtgccactctacacaacacacacatggcgatcctccccggcgactgcgtcgtgctcgacatcgacgacgccgccgcccaatccacgccggtgccgtacgccctcacgttcaccgacctctcctacaccgtcggcagccgccgcgccggcctgctgccgccgttgccgacggacgcgccgccggccaaggcgctgctcgacggcatctccggcgaggcgcgcgacggcgaggtcctggccgtcatgggcgccagcgggtccggaaagtcgacgctgctcgatgcgctcgccgggcgcatcgcgcgggggagcctccgcggcagggtggagctcaacggcgaggcgctccacggccgccgcgtccgggcgatctccgcgtacgtcatgcaggacgacgtgctgtacccgatgctcacggtgcgggagacgctgctgttcgccgccgagttccgcctcccgcgcgcgctctcgccggacaagaagcgcgcccgcgtcgacgcgctcatcgaccagctcggcctcgcgcgcgccgcggacaccatcatcggcgacgaggcccaccgcggcgtgtccggcggggagcgccgccgcgtgtccatcggcacggacatcgtccacgaccccatcctgctgttcctcgacgagcccacctccgggctggactcggcgagcgcgttcatggtggtgcaggtgctccgccgcatcgcgcagagcggcagcgtcgtcatcatgaccatccaccagcccagcgcgcgcatcctcaacatcctcgaccgcctcctcctcctctcccgcggccgcaccgtctacgccggcacgccggtggggctcaagcccttcttctccgagttcggcgaccccatcccggacaacgagaacccggccgagttcgcgctcgacaccatccgcgagctcgagcaccagcccgacggcgccgccccgctcgccgacttcaacgtcaagtggcagtccatgcacgccgcactcccggcagctgacagcaaggacagcaagcgatgcaccatgccactcgagctcgccatcacggagagcgtgtcgagggggaagctcgtcgccggcagcggctcggggacggcgtcgtcgacctcggtgccgacgttcgcgaacccgctgtccgtcgaggtgtgggtgctgatgaagcgatccttcacgaacacggggcgcatgccggagctgttcgtgatgcggctcggcacgatcatggtgacggggttcatcctcgccaccatcttctggcgcctcgacgacacgcccaagggagtccaggagcgtctcggcttcttcgccatggcgatgtccaccatgttctacgtctgcgccgacgcgctgccggtgttcgtccaggagcgccacatctacctccgagagacagcgcacaacgcgtaccggagactctcctacgtgttcgccaacgccgtcgtcgcgttcccgccgctggtgttcctgtcgctggcgttcgcggtgaccaccttcttcgccgtcggcctcgccggcggcggcggttcgttcctgttcttcgtgctgatcatcctggcgtcgttctgggcggggagcgggttcgtgacgttcctgtccgcggtggtgccgcacgtcatgctgggatacacggtggtcgtcgccatcctcgcctacttcctgctcttctccggcttcttcatcaaccgcgaccgcatcccgagctactggatctggttccactacctgtcgctcgtcaagtacccgtaccaggcggtgctccagaacgagttccgcgacgcggcgcggtgcttctcccgcggcgtcgagatgttcgacgggacgccgatcggcgccatgtccaaggccgtcaagctcaaggtgctcgacgccatcggcgccacgctcggcgcgccattgacggcggagacgtgcgtggtgaccggcgccgacgtgctggcgcagcaggctgtcacggacatcggcaggtggaagtgcttgctggtcaccgtggcgtttggtttctttttccggtttctgttctatatcgtgctgcactttggcagcaagaacaagaggcgctaagccctttggtatgtatgtgtcaagtgcatgtttgtaatacttcattttttaaaaattttgtattcatacttgaaagccatgtaaaattctttgatcagatttgatgataataaagaattgaggaaatgttcaattcatattaggtcttgtttggcacaattacagttctcatatccacattggatttgaagtttgtatgtttatttatagtggttcaaaattctatatttcacctaaaatgaaaataaaatgattaattcaaatgttatcaatttaattatagttccaggtccatggatagaggttgaaatacccagctctaagaaatcttggatctagagctatgccaaacactcctttaatatctgatatatgagttcaccaatatgcaagttcatattcggtctgcataagttctaaaaaaacaacaaattaaattttaactaagaacggcaaaacatacttttttttagaagaacgacggcataagttctgctggaatttaaattagggaaaaggccgaagcctagcaaagagtttacagggactgtaatagagatgaaatacagcttaagaagcaaagtaaatcagggggggcttaaaagctagtttgcgcaaatccaaatcttgcttgataagatgtgctacttcatttactgagaagtaaaaattttgaaaaaatcttctgtttctttcttgcaagatgttccaccaagtagtaagtagcgagcctctgataatccgtatttgagctttgcttcccacatggttggttccattccaccaagtttcaacgtcagggggatgggacgaggttataggggtcaggttttggaactggtagattagaactacaaaacatactatcgagggattaaaagagtttccctctaaactttgtaaacttgttctgttgtaaaggtgggtgacgatggttccgtcgtacgcatatgctatacttatgcagaaataatagtttgacccattcttacaacacaacaaaaaaaaagtataacaatcgaaaaggggattgaattaatttgaagcataaggttatgcaaattttcattaactttagattgagactcatcaatacgagtgcttcttaaataatgatgtatcttcttttgtgttggtgtgatttatgagtgggttatcagcatgccatttcatcttctgcctcttaccggctggtgcattgcttcgctcgatcgatgaatatgatcgagagggccagtcttcggtaatgaatggttacatttttatgcaaagttaaaatgatggaaagcacaggagtggaatatctaattctgaataagatgacaagatggaaacacaggaagctgctatcgtacaaatatggagtaagcggcagtaaaccagattttgctaccgttctcttgggtggacgatttccctctatcaactagtcaaagctgaaatcagaaagcaaaatggattaattaattaacgttgttcttttttttaagaaaaagaattgtatatctgtggagattatggttaccccatatctacatagcggttatattccagctggatatacggtaccaaatatagatagaatatctttatgaggactcgggttagattctaaacttgtatgtcaagaaaatacccgggatcctagtcggttacgattgtattttatctgtaatcccatattccgttaggatatggactgtactttgtaatacggatcccttcccctatataaggagaggtccgggttcctcttgggacgattcttttttctcccaatcatacaatcaataacacacttggcggaattatccccggacaggagtagggtattacttcttgaataagaaggcctgaacctgtataaaattccttatctctaaacccatccactttcctagcttgatagccacccccttttattattgccgaaatcttgtttcgacagttggcgcgccaggtaggggtccgtcaagttctcgccgactaagtgcgatgggtttcatttctggcatcgacgacttcgccttcccccccgggcaggcgtttcagttcggcagcctcaacttcatcaccaacgacttcggcaagatctctctccttgactcggattcaaaccagtcggggagagaccaggtccccgtgcccttcggtattccgaactcggccgaggcctactccaagatcatctctcccgagtcggcttcaaaccactcgggcgagatccaatctactcttccgcgaccagatcaagacgatgggtcctatccctcaatcctgatgaaacttcctgatgatttggccgctgtcttcactgccaagacatctcccattcgaagatctaggcgagctccggcttcggccccgatccaatctagatccagagaggttggcgttatactccaacctcttgggacagtctcgacgaaagagttggatggttaccttagctcccccggcgttagttctcgactaaccgagatcctcgactacgacgatttcggctaccactacgaccacggcgacctcgacaacttcgacgacagctatgaggataactacatgcccctcttcttcggcgtattcatggctgacaatgaaacggaggaacaacgccaagcccgagaagtagaccaagatcgtgcacgccaagaagctgaacgtcgccgactggaggaagagcgacagcgacaggagcgagaacgactacaacgtgagcagcaagatcacgaacggattgcaaaggaggctgaagatcgacggcaacgcgccttggaatctgggcgccgagcgagagaactcattgggcaacaagacgtcgatggaacagcggtctttcgcaccccccagcagaacgtggttgcagcaatcactctcctcgacaccctcctcaaggaagacgcactcaaccaagctgatcatgttgtcaacatcttgaaccagacgaagaccatgatcgctgcctcggttccagccaactccgcaagcacccgcaccctgactggtagccgaatccttcacttccgatctcatgattattatcagccaagcctcagcatcaccggcacaggttctagtcgca

SEQ ID NO: 77365 - DNA, 12976 bp, Oryza sativa
ttgtaaatttgttttattttgaatttgatttgaaatttcagtttaagttctcaattgccatataatataccactttaatatttttttccaaattcaaaaaaattgcaatttaaacatatcttttgaagatagtatcagagacaaacagaaaagaaaaaaaataaagagtgagagagagaagaaaaagaagaagaaaaagaaaaaaatggttttttttttctctcgactattcactcttattctttacaaaatgacagtttcgtttgtaaatttaaagagtgtgagagagaagaaaaagaagaaaaaaagaagaagaaacagaaaaaaaaaagggagagatggggggtcgaaagaagaaaaaacggagaaaagaagaaaaatggatgaaatgggggatcgaaccctgctccatagggttagagtagaatcctactaccactatgctatcgttgagttgatgaagatgaatgcctccgtagaaatttaaatcatcaagacctcagcgccaaatatgatgactcaacaaattcatgccacctcggatttgagcttagcgccaacaaaagttggcgctgagacgttatagctcagcgccaaggtccatggcgctgagttcacggcctatttttggttgaagttttttgcagggactagtttcgaaataagtttttaaaaaagactaatttgttaaaaaaacggtggttgtggcggctccattttggggaattttttttgacttagattctaatttgctacatcaatgtctgaacccaacaaaccaacgtaggtgtccatcaattcatctagcaagaaaaatcatagcagcatacaagtggtaaaacatgttgaaggatacaaatatattacattgtgaatctatcaaatattaattaagagagccatcaatgcgagcagtgcttttgcatacgtagcaggtcgatgaccacatccaccaccctagaatccattgccacctctagattggtgcacccttcctctccactaccaccattccgccatggctccaccctcattccgccatggctctaccctttgaagccctgccactaccaccatcgctgaaaaaaaagtaaagggaatatagggactcacctacgctggctagtaatgatgacaatgatggacgaggcgttgctcggtcgatccggatggggcgggagctcggtaagaagagagcaacaccaaagttgttgtttctctttccaagatagcacacatgctaaatttaaagatagggttggtgcatctactagattagctgctgatgttattgctgttgatgagggacgaaatagataagcaagcagctaggaatgctctaagcccgtaagtgtcatgattagctggtaaagaagctgatgtgttatccgtgagtagaatgatgggttttttgtccggaaatcatacgttacaaactgttttagatcttggtctaaaaacaagctcaatcaaatttttgactaggaaatggtgcaaatcatatcaaaggttcagattgttcctcaggataatgaggacaaactctattggattcctacttcttcaagagcattacttcaaaaagcaattataagcaggtttctaatatttctcacttccagttcgtttccactgcaaggagcggataaaattttggatattctcggcacgcttttcaaactactaaacagtgtgtttcgtgcaaaaactttctgtatgaaagttgttctaaaatatcagattaatctattttcaagtttgtaataattaaaactcaattaatcacacgttattaccaccttgttttgtgtgaagcacttaatctttatctttatcttgtctcctctaacatcacctctttacagagtaatctccttttgaaaacttggtccactaaatacattccttctaaagttaaaacttttatttggagactaattagacaagctcttccaacggctgcaaatcttcactcaaaaattttggatattcctgatttttgctcccgttgcaatgatgctgaaaatgttcatcttttcttccgctgtgcttttgcaagacttacctggaaactttaagaactctcttttcacaatctcattattgactcaatgcaaaatgtttctaatattatagcatatttgcttgcaactaataattctgaaaacagccttcaaaaagttccaatccttctttggtttatttggaaagctagaaatgatcattatttcaagaaaaaagaatgggagcctttgcaagtttgtaatgtagcaagcgctatgtcaaagaattatatttcagccttgtctaatgagaatgataatgaaactattccaatcatagatgaattctgttgcttctgttaatttgttgccagtaactggatgtttccttgacgcttctgggaaggataatataacaaggtttggtcttttttctacatgactctataaatcatcatatcatctttgtgtaggccaaatcaactctttatgtgtcgccaattcaggcggaacttgcaacttttaagcttgataccttcatctgtgatttccttcaaattacaaatcctccctattttttcaagacaatcaagaactggtgctcttacttcaaaactctaataatatcaatcataaccatcactagagccttttgcctttgcttgcacaattacataacttttcaggtggagcttctttcaacgtcaaatggatccccagagatataaataaaagggtatcaaatagctgactactagtctaaaaaagccagagaatctaaatatgagttagcagctctaaattaccaaaatattagtcatgcttgtaataataatacttgtcctacaaagcaacttatgcaagctactccttggaaagacaattgtgtatctcttgtgcacattttccttctaatgtttaaataaaaaattactaagttgtaaaaacactgtttttagagcacatggcaaaccgcttttctgcagaccgaggagtaaaaagactatcactgacagatgggacccaccaaccattgtctctcactctctcccctcgcaccgcagcttctccaatccgtcactttccccatccctcccgcgaaaagcagacagacgcccacaacccaccaccacgtctagggttccgccgctcctccggccgccgccgccgccgccgccgacccccctcgatctcctccccgagccgccataggtggtggcgggggcgggggagctagcatccgtccgtcaacgcacatcgtcactgctgcttcctggtgagcatccatccgtttcgcatatcctctttctcatccctctctacccacccactttttcccctcgaattcgcgtcaaccctagcttctcttctagatctgaaagctgctgcttttctttcaatttgctattcttaatacgaataacagtttcgtttgttccccaaaaaaagtttgggatgaatccccatgtcccacgttagatccgcccctggttttatgtgcggtattgttgtttgtggtatgggtaccaacagctttcgttgttttcaccttttgcagaaatctgccaccatgtccgacatggagtccatggctacacttatggagtccacaggctccaagctgcagcagcttcagcgtgcatttgcagagctcgagagccagagcgctgtttccttgaacttaaagtggaagcaactggaggaccatttccatgggcttgagcagtcgctcaagaaaaagtttgatgatctgaaaaggcaggaagaggagttcgaggagacggttgcaaagtcagagcagatgctggagcaacaagaggctgttgtcgtggcaaaggaactgacttctcttgaaaaactgcagcagaaaagggatgccgcgttggctgtgatctttggcaagtccaagctgaacttgtctacgcctcttatcaacccaatcagcaaatccgtgaataacaatgctgtgtttaatggaaacatcggtggtagtctttctgttaagtggcccaaacctgcaactgcgcatggtgcatacctgcaagatgaaaacactgctgtgaagcctcgttctcaacttgttgtcctctgtgaagagatgaatgttaacgggcttcataagttcatatcagacaatcgcaaagacttaacatccatccgtgaggaaatccccgttgcacttaggggagcaactgatccatatggcttggtgttagcttctctagaagacttctattttggagacaatcttatattggatggcaaaaaggatggaaaccttctgggtgtacggaggacgtgcctcatgttgatggaatcacttgctcagctgcaaactgatgctactactggtttcatatcggaaggtcaagtgcttactgcaagtatcaaggagcgtgcaaaaaagattgctcttgagtggaaatccaagttggatagccttgactttgatgctagcaatgggaactgcctggaagcacatgcgtttcttcaactcctggctacctttggtatatttgctgaatttgcacaagatgagctgtgtaagctacttccctcagtcagtcgtcgtcgtcagacacctgagctttgtagaatacttggattgtcccagaacatgccaggtcagtgctatcatcgattaataatgcagcttgttccattgagcatcaataataaatggaattttctatttctctttgtcactcagatgtttagagaacacattctgaccacttcaataattgttcatatatctatatatctataccatgggatttattttctagttagtggctgcagcaagagatgcctacaagtaatcagaattgtagcattgctgtttagataatttgtatggaaaatctgcaggctgctacttataatttggcagccgcacaccgaacctcactatctagtatctgtattgtacttagtggcagcaaagtttccacagcttttaagctatgttatatgctcagttgaggtcttaatttaactgaatgtatttactaacttataaataacatatatgatcatatattctggagcataacaagctaagaggacgtcattcaattcgccgaccttgcccttgagcttgattacatactgggatgtgcttttgtgcatctattttagaaaaagaataatacgaatatctaagaaatatggttaatattattaggaggcaaatatgcattaaacaaaaaaagataaccattgaaagatttgccacccgcatggttttgaaacagtattaacctagacgctagtcagtggtcggtcaatgactagcggctgttgactagttagtaactagtcggtggttccaatatgtccaaaaataaaatattgctcaaaagtagctagccatttaacatgttttatagcatattttcagatcaagtactgactattgattattgagaaatataagactgacaatttgataagctgcatgaggtgaaggcgagagagcacgtggcggctcttgactgctccagacgtgtcatgggagggaataaccataggacctttcccacccctcttatcccacccgtttagcccaaattttcagtccatgccacttttctgtttcctagttgacctgtttaaccgactagtcacttgactaatattgatcaacttgaacgtactagaccgattttaaccaactaattcaccttttaccccctgacctaggtggattgttgctgactagtgactagtcaccgaggtccctttgctccatacttttaattttgcctttcttcttttccgcctttctgctgctgcatgttcttttcgtttttacaggtcagcacattttctcatgagatattttcttgatgttaggtgtcattggagttctggttgaaaatgggagaactattgatgcaattaatttggcttatgcatttgagctgactaatcagtttgaaccggtggaattactgaaagcctatctacaggaggtcaagagtgtgccacatttcaagactggaaagatatctctgcaagtacaggtgcacttttttcatttcaattttaaactgtatgataccctgtaaattttctttcacagaaccagggttcaagattgaagtgggaaacatagtaatcctggtctgctctgattttctttttttttaaaaaggcatggtttaatttagttccattttttccctcgaacatgcaggagggaatttagttgcgaaaattatcactaagaatttcaaaaccaaacactaaatcattgcaagacttcccttaaaaaaaatcaatatacacctgtaaaggctgagtgaaaatggagtcgaaatgaacaggattgcttgtagattgtagcaattctgttcgatggatcggttgccagttggtgacacatgcattcattctctaattgaatacgataaaagttcttttttcgtgaaaattacgacaatattgtgctggagtatttggactgaaagcaacttgttctctagtattctttcatgtggcaccatgacatcctgtcactacaatccacaaacggctcctcatgcttcatacctagtatagagattgttccagaatttccttggattgactagtttggatgggatttttcttagatccatgaaagtgaatcccgtgtagaactactagttacaccaactctgttaagaagctctgaaccacatgaaagtttatttttttcagctcgtggccctttgccaccataaacaaagttccagttcttttttctaacaacaggatagcttaacagtcttttaggagattatttagtacttgctctgtttttaactctaagctagtttcacctgtgcaactgtttgaactttctaattatgttgtgtgatccagcactccagctgatcgtgtttgaaaatttcctgatataaatggtaatgagacatttggccctttcagcaattgaattcagctactttgattcattaggttctatggctgtcaagtcgtatactgtaattgttcactcacttatttgatttatttatcctggaatagttaaagtacggggtttgatcatatcataaagttagcaaatcatttagccaccaatcagcttcaatgtagaagctgcagtgctgttctgaagaacttgaataataaagagctactttagcttgcaagatactattcagctatagttgcttgctaccttttctttcttgtgtggggtaacaaatattttctcttcttgctggtctgtacattttttaagcatatctgcgtgcattcctaattaattgtgattgtagtatatctgatgaattaccatattattcagaatgaaatgaatgaacgagagctgtctgccttgaaagctgctattaagtgtatcgaggagcacaaacttgatgagaaatatccgattgacctgcttcagaaaagagttatccagctagagaaagctaaggcagacaagaggagggctgttgaagctgcaaagccacagtctaagaggcctcgtgccaatggatccgtatatgcgccacatactagctttcctgacaaaagcttctaccaggctgctccgccgcagaggcattcctacccttacgagaggcagtatgtgtatggtgctgaggcccatcaccatcccacaatgataagctcagctccctatggcatctcacctgcccacacaacatattatggtaatggctatcaggttcagtaccaggtaccatatatccactgatggagagagcgtaatgtgctctttcctaactatgtactagcttttaacctgctgctactatgtgctgtagttgtatcaatccactagctagactgcctagcttaaattagttcgaccactcttgtgtgtgctgagtggccagtgtgaaaatctgttaatttccctcacgacttatgacataatttacttctaatgtctagttaaaataatttgcttttgtttaatatatagcctatggcatatatatgttggagttgagatagtcccagtactgcagaattctggaattatgtgctctgcttggtggaattatccactaattcctttctgttgcacttgaaacaaaattgttgtcccaaatctttttatttgatgatggtagatttttgtattttacgagttcaactgcaaagctttggatctactatttcaatgagtgtgcctggagtccaatcgactcaattaagtaactgttagttcatattgaggttactaatcaaatacagaaaattaatcatggtagaatatcagatgacccctggatagtatagtactatctcaccaatcatgtcatttaattcctttatttttttgttctgtacaacgccgccaaacattggcgttgagttcttatttggggtggcacgaatttgcttatttgctttgtcattggagctcagtatcatttagattggtgctgatcttcgttctttctaaaaccagggtttacttacattaagcaaagtatagcttagcgttagatggttttggctcccaactatagatttgaaccccaccctcatttctacaattagtttttttttcccaaaaataagggtcttgaaagggccataatgccaaaattttagcctatataagcctgatagattaggctccaatggatgatacatggtagtactaccttcgtccagtatcatatagatactgctagcatttaaattttgtcatataatataataactacttccacgtctactttttcatcttaaccaatcgcaaattcgcaactctctaatttaaaatcaccctcattccttaatttcttgaaaaagaagtgcagaagcatgtccaatattacttcacattctaagctaatcacaatcctctaatttaaaatcacccattctttaatttcttaaaaagaaagtgcataagtccctacagtataggacagagggagtacataaaaaaagggaagtgcacaactcctggacagaaggagtacatctaccacagagggtgtcgcatgttagagtgtgtttggtttggtgaatgatgttggatgggagatagaccgtctgattttttttttgttttgtttggataaagagcagggtggatggggcaacccaaaaagaaaatattcccttaatatccttaatatgctggatgagtagatccagctaatttggccaaataaagccatccatgttttaatttgggtgacttggcctattccaattggatgtggttggtttaattttctgttaacaagcttaaaatgttttttcctcctgaactatttatctaatttgtaatccgattatactattatactaattacaattaaatctctagttatattttgataaaaaaaattaacaaatgtgccatactaaattgtggcttatcccattcatgttatatctctctaaacaaataagaaattggaatcatcctatccatacaaaccaaataaaagttagatcatcgtatccaacagagcatggatgaccatatattatccatgtatggctttgaagcaaacgcaccctatgtgatgggatgtgatatagcacgaagaacatagaacattaagatactgagtaaatataccatgttgaaatcaattgccaattataccccttaaagaaaaggcaaataaacgaaaattgactaagacatctatatatatatataaagttttcgcaactaatgttgtcacgaagaaacaaagaaatacataattctatatagcttatccagagggggaaaccctaagataagtataataaaagggtggttccaaccgttctgtttcctcttcaaagaatagaaaaaagaatcttttttttaactaaatttgacgctgttcttaattatgatgaaatcattcttagctttttccgtggattatggacaactatattaattacaaagtaattacatcaaaccaccacagaaagaaagaaaaaactcaaagaactacaaatcattcacacatctatgtttcttatttgtaattgaccagccataccaaaaaggaaaaaaaaaaaacaaattcgacacactctgctctgtagagtgtagattgactgactcatgcatcaagccattagcatcaatgctgctacggcggcggccgcggcggcggtcacccaccgggcgagcggcgccggagcggcggcgcccttgtgggctttgacgtcgccggaatcgtccgacgagtcgtcgctgctgtcgtcggccgccgacttgtgcttcttggacggctcgggcgcgggcgcgggggcctcgacgaccttgtagagctccttgggcttgaggaacttggtgacggcgtagacggcgagcggctcggcgtcgccgacggtggcggtgacggcggagttgacgaccctggtgtcgagcgtgacggtctcgcccttattctggacgtcgtagctgtagtccttcttggactcgctggcggtggcgagcgtggtgaccatgccattgttggacttgaggagctgcagcgagaagtagtccgggacggcgtggtagaggaggatggcggtcttggccttggcggtgaggttcttgtaggagggcatgaaggcgccgacggcggcgtcgacgggccaaaagagggtgaggccgttgtccttggtctcgttgacggcgcgaaagacgtcggcgttggcggcgaggaggccggcgaaggacttgcagtacttcttggagaggagctcggtgaggttcaccggcgccggcggcgggacgggcgcctcggcctcggaggaggacagcacggagctcacctggagcacggagatgtcgtaggggatctccttcaccgacttcacgtacctcgacggcttcgcgctctcgtccgcgtcctccgagatgaagtcgatcttcccgcccttgtgcgacgtgatgttcacgtaccccgtcgtccccggcgccgaccccgtcgcctgcatgcaattttattttcattcatttcaattaattcatcatcgtggttattatttaattaatcatcgtgattattatttaattgtattacaaatggacggatcacgtggagcatgaaaataacaaaatttgtaaacactggctgtaaacttcattaattggttcaaaagcacaaattaaagagtagtagaaaattggattaattatctttgaacttcatcaacaccgaaatccgaaagcaaataatactgagggcatgcatttttgtgttcagactaagatggtattcttgtaattgtgaaatatgatctgtccatatgacaaaatagacgttgagtctccattgacaaataatatgatctgtccaggatggctcaattaattaatgagtatcatatttttttttccagagaaggatggggaacctaatcgtggatgatggatcctctgtgatttgtgttcatgatgagtgatgactgataagtgcgtatgcaagggcccacaaatcaatcatgcaattaggtatgggaaaaatagggagtgagcttgataatgttgagagcaactggatgcatgaaattccaatcctagctaaccaaccaactttgtcggtggaatcggtaccacgtgttttcttagtcatcttgggcccaccactgggcttagctgttcttcagtgacctggcacccaacggcatgcatgtgtggattttggaatttctagttgtatatgcatcgcgcgcatgacaaaactttgtcaaaaagttttatggcaacttgatggtgccattcaaacagctccattaattccacttaattgaattaagaacatccctactataattaatacggtgaaatatatactcccccaatttcttaatatacgaggcagttgatttttttaagagatgttctaccattggtcttatctcaaaaaaattatgaaatcaagaacattcctaccactgcgacttgatttaccaccaaatgttatttaagtgtgacttatattgttttatgtttaaacaaaaatgttaaaaaaacgaatggccaaatgtttatcaaaaagttaaggacatcatatattaaaaaaaggaggtagtatacgatgtaaaccgccaacaattttttttacaaaaaatattacaaaatgattctgaaccggcatgcttgcattgcataatgatgtaaactttcaagattacacttccaaacaaaatgaaagctgagcttagttacttgaataacccatgagtaatactttaagttaactagtgcataaatccacctattttttagatgatgagtgtctaaacccacacatatatatgatctgaacttacattaattaaatctataacaatatagacttgattcacacgtatactcctcgtcttggatttcgtgaccaaattaaaaggtcaatatctggctaaccagtttttgtaatcacgaagctatattgacatgtgggcttaactaagtttaaatgtacaattagcccacttgcatggagaaaaaccatataagtatagtgagcatgtagttgcacaacaattaactctgccatgtactgtgttatctctcaactaaacgttgaacctctcgattaatttagcaccatggcgaaaatttcgggtccacttgaatttctttaaatttattctaaacttgttgaaactggagtatttcaaattaattgattttttttaaaaaataaaatcttaatcagaaatactttgttcaagatggcaataagatctcgcttaacattttcccccaatgacaagagaaattaaagaaccctgtctatgaaaataacagcaccgaccctatcagaaggtggatttataatacagtacagtagtaaccaagaaaataaataattagctgtatgtacgtgatcagctagcttgcatgttcgataacacgtgggtactgtggtagtactagtacgtacctagctataattaattaatcaaacaattaaaaaactaataatgatagctaggtaattatactctcgttaattatg

SEQ ID NO: 77366 - DNA, 2141 bp, Oryza sativa
cccacgagactactctcgcccgcgaagagatccgactggctgcgaccacggcaagcgaaggagaagtgcctgcaaccaagctgacgaagaccgaagaaagtgatgccaagacgaaaaagattcccttagatccctccgatcctgataagactgctgtaataggcgctgagttagattgtaaataggaaagcgcgctcatcacctttcttcagaataataaagacatttttgcgtagaaaccatccgatatgcctggtatccccagagaggtgattgagcactctttacatgttaaggaagacgccaaacccatcaagcaatgactccgccgttttgcacaggacaggaaggatgcgatcaaggaggaattaaccaagctattagcagcaggcttcattaaggaagtccttcatcccgactggctggctaacccagtcctggttcggaaaaagacggggcaatggcgcatgtgtgtcgattataccgacctcaacaaatcttgtcccaaagacccttttcggttacctcgcattgaccaggtggtcgattcaacggccggctgtgagttactcagcttcttggactgttactcgggatatcatcagatccgactaaaagaatccgactgcttgaagacttcgtttattacgccctttggggcctactgctacatcaccatgccctttggattgaagaacgcaggagcaacctatcaacgcatgattcaaagatgtttttcaactcagatcggtcgcaatgttgaagcctatgttgatgatgtagttgtcaagaccaagcagaaggatgacctgattgcggatttagaagaaacttttacaagcattcgtgctttcaagatgaactaaacccggaaaagtgcatcttcggagtaccgtcagggaagttgctcggatttatggtatctcaaagaggcatacaggccaacccggagaaaatcaacgccatcctcaacatgaaaccgccaagctcccaaaaagacgtccaaaagctgactggttgcatggcggcgctcagccggttcgtctcacgactcggcgagcgggggatgctcttcttcaagctgctgaagaaaactgacaatttccagtggggacccgaagcacaaaaagcctttgaagacttcaagagacttctcactactccaccagttttggcctcgccgcatccacaagagccgctactgttatatgtgtcagcgacctctcaggttgtgagcacggtcctggttgttgagcgtgaagaggaaggccatattcaaaaagtccaatgaccaatttattttgttagcgaggttttagccgactccaagaccagatatcctcaggttcaaaagttattatatggtgtcttaaataccgtcaggaaattatctcactactttcaaagtcactcggtcacggtggtcacatcatttccactcggagatatacttcataatcgcgaagcaaatggacggattgcgaagtgggccttatagttgatgtctttggacatatcattcaagccacgaacttcgatcaagtctcaagctttagctgatttccttgccgagtggaccgagtgccaagaaaacatgctagagaaaaagatggaatattggactatgcattttgatgggtcaaagaggcttacaggcactggagctggggtcgtcttgatttccccgactggagaaagattgagctacgtattgtggatacatttttctgcgtcccataacgtggcggaatatgaggcgctacttcatggactaaggattgcattatctctaggtattcgccgactaatcgtccgtggagactctcagttggttgtcaatcaagtcatgaaagagtggtcatgcctagatgataatatgaccgcttatcgacaagaggtacacaagttggaaaataaatttgatggacttgagctcacccatgttctccgacataataatgaagcagccgacagactggccaattttggttcaaaacgggaagcagctccttcaaatgtgtttgtcgaacacctttacgaaccaaccgtgcccagaaaagagacagtcgaagccatggatactcaaggcataagcatgatcgaagccgactagagagaaccgtttataaagggctgcagga

SEQ ID NO: 77367 - DNA, 2073 bp, Oryza sativa
ccacccacaaccttgccgccgccattgccaccgcagctacagcctacagagaagctagctagctagctagagagagagaagaagaagaagcagtgtggcatgcagcgcgagtgagagcctgagaggaggggtatgtatgtaaatgtaaggcatggcagaaagaagggtggtgggtcgctgtggaggtgagatgcatggagagaaagggttggagtaatttacgcaactgccacgctccggtgccctgtcgctttcactcttatatttaattgctccgttccttcctcctgtgtttggtttttcttattggtcttaattaggggttcataattatttattattactgattgacttaattgggaatctcgaggtgtgctagctagatttatttggagggcaaaccgacagttcacttcttacttcagcatatatacaagcaactagccagggactttcatcttcagctatatatactatgtacttttggactagcttagggtatgccatccgcaacggttgaaacaccggtggagaaaccatctttcgtcggtcggtcgaattccacaatagtcccggatgcaataaaaaccagggctaaagatgatctttagttccggttaaaaagggtaacgggcatatttgatctttagtcccggttagtacaccaaccgggactaaagatcatctttagtcccagttcaaatgctgtcagggcatgtcagcccccccgggatctttagtcccggttggtagatctcggggatctttagccccggttggtaactaaagtcccacccctatatatatgtcttcttcctcctccagctgcccgagcaagcttcaaaatttcttaaaaaagaggggaggtcatgccaaaatttctagtgaatttattttggtgattacatacaaatcggaggtgcctaaaaggtttgcaacttcatcctccaatgttttttttgtcatattacatttgcagctatgttttgcacacttttttgtctccaaaatttagttgtaagttgacgagggagaaaatttgtgtggggaagaaagaatatatagaaatttagttgatttgctaaagaaggttttataaaatagttgagaaggaaaactatagtgaaagttaatcttgaatactagaaaacaaactaaaatgaaaattaaaagaagtaaaacacattaaaattagtttaaaactttagaaatagtaaataagaattatttggtgtaatattttatgatttttgtatgaataaagatatgtcattattgtatgactgttgaaacagtttgtaattatcttataattattgtatgactgtcattattgtaagaataattatttttgtacgattttttttcgactcatgtagatggatcggcaatggatgtacgctgaccggcggtccaaagagtttattgacggcgtgcactattttttgatagtagccgaagctaacaggcaaaggggtttatttgttgtccatgcaataagtgtaagaatcagaaggagtattctgcatccaggactattcatttccacttgtttgagtcggggttcatgccaagctataattgttggacatcccacagagagcaatgtgttgaaatagaagaagatgaagtggaagacgacaatattccggactttgctcagtacgttggatttgaaggaaatcaaacgggcgaggaggaaagggatgctgatggtaacgacgttgcggatgatcttggtcagatgttgcaggacgccaaggaggactgcgaaagtgaaaagggagcccataaattggacaagatgttagaggaccatagaacttcgttatacccaggttgcgagcaggggcacaaaaagttggataccactctggagttcttgcaatggaaggcaaaaaatggggttagtgacaaggcatttggcgatttattgaaactcgtcaagaacattcttccggagggaaacaaattgcccgagacaatgtacgaggctaagaagatagtctacccgctaggactggaagttcagaagattcacgcatgtccgaatgattgtatcctatatcgcgg

SEQ ID NO: 77368 - DNA, 1951 bp, Oryza sativa
tgccattttcttcagagtccaccttttcactttgtcctctgtacccgcgggaagggtgaatgtctcgagcattgtggtccacagcatctctttctccaaatctgggacaaagctctcatgatctccgcgtgcccttgttcttcgccaatacaccgtaatgacaggcacgttatcccgcacaacccaaccgctgtgacgtacatagttcttggtggcttctgccggggcactaggtcgtccatcttcttccacttccgttatgatgtgccgaccctcaagcttcttcgtggcacctcgttgcccacgtgccctcttctgtccaacggagggttgacttccactagcctcctcctcctggttcccctccacatccctttccacgtgcccctcctggttcccctccgcatccctctccacgttcccttcctcattcaaatactggtttgggtcctcgttcccctcttcttcgttccagtactggctgcttccctccgcgattgtatcgtacaatatctgttcctcatcgtgatcagccatctgttcatacaggaaacatctgctaagtcatgagacatttatgttttaacaatcttatatgctaacaatcatatgctaagtctaggtgacgtatattataggaccctagctagtcaataaattatatagtaagtctaattacaaatctaataatcttatattaaaactcaaataatcttatactaaaactcaaatagtgataaatgctaagtctaggtgacgtatattataggaccctagctagtcaataattatatactaagtctaattacaaatataataatcttatattaaaactcaaataatcttatactaaaactcaaatagtgataaatgctaagtctaggtgacgtatattataggaccctagctagtcaataattatatactaagtctaatgacaaatataataatcttatattaaaactcaaataatcttatatgctaagacaaaaatagccatgtatgctaagtgtaactgtcgtatattagaaccctacacaatcttacatgctaagtctaattacaaatctaataatcttatactaaaactcaaatagtgatatatatgctaagtctaggtgacatatattataggaccctagctagtcaataattatatactaagtctaattacaaatataataatcttatattaaaactccaataatcttatactaaaactcaaatagtcatgtattctaagtgtaactgtcgtatattagaacactacacaatcttatatgctaattaagtctaattacaaatctaataatcttaattgcattacaaatataacaatcatatatatataattatgtcacttgcctgggcgaattccttcgagggctagctctaccactccggcttgagggacaactccgacaacgtcttttctgcaagatacaaaaagatgtattaggataaacgtgatgtaacatatattgcatttgacgttcacgtttcgttcacgatatcgttcacgttcgcgttctcgttaaggtcacgtttcattcacctacgtttgttcgttcacgttcattaacctgcctataattgcatttcacgttcacgttcattggctcgttcacattcgttcgctcgttctcgttcacgttcattcaccttgttctcgttcacgttcgttcgctcgttatcattcacgttcgttcgctcgttcacgttctcggtgtgacggcagcgggacggcggtgtggcggcagcggagcggcggcggcgtgcggcgtcgtggcgtctcatggcacggcgtcgtcgtggcgcggcgtcgtgtcgtgacgaggtcggcgtcggcgtctgaaactcggcggccggcggcaaccgagagggagagagagagatcgagattagagagagagatccagaaggaggcggcggtcggcggctctcacaccgg

SEQ ID NO: 77369 - DNA, 1986 bp, Oryza sativa
ctagtctcatgtgtcgccgtcacgacaggtatttgaccacagatatatgtacatacatgtcgtgtacaagaaaactacggttgcatttcagctgccttatactataacattttttttaaaaaaagattaaaactcagcctctacatccaaagtggatcgatgtatacagtcgaatctgccaatagtacttaactattacttctgggttaacaatcttatgaaacatttttgggtttttcttactgtcagaaaaggtgtctgaaacatgtacatccataatccattgcatgatttcagcaacatggaactccatggtaagtttcttgaattagtaatgcatgttcaacttgacaagacagatgtttctactagcacaagagccctagtatttggcaaagttgagaagttaagtttgcaccaacctgcttcagaagaaaaaggaagtttggaaatacaagtctctgaagacagtgtaacagctggttgtacacatgtaccatatcagaagaatttgagctgaagtgtctgaaactttaagccgccatttcatactgaccaaataagctagtaggacagacgtctccctctgacccatctgctgacctgaacctgaagattgagcaagtaaatcatgtgtggtgcaaccttttcaatactacaaatttaaactgtttggcagaactaaccatccgaatgatgatagaaaaccatgcctttttggcagcaccaattcaacaaaaggatcaatgcaaccgaacatcttttaatttcagtttccttgaggaaacccaaatgtgcaacaacttgttgcatccttgtcattatcatttagccaggagcaaggcaccagctaaaaacagatagaggaaggaaatatatgattattaaaacagagttaggtagcatacgtcaaatggtacaaaattcagtataccatgcctttttttttttacttttgatattttcaatgctgcccatcttcttaactgtgtgacatatttattgttgataataactattaactaataacagtgtaactctcagttgtacacaacatatacaactgcacatttctttatcgtagctgtgaaatatagtttcttactattgaacatatactgttacagaacatatagttttgcacatttgttcaaaaagagctactcattttttaacatctgtttatcattgatcaactctcttcttctatagtgaaatgcaggagctccttgccgttcccttgaaaaaataataatagtagaaggcataaaaataaaatcagagagagcctcagaacagaagggtcattgagaaacagtatatcaacatgtaattctgtatgttttagtgtataacagccagtaaaactgaacacattcacatacatgaactgcatcttcaacaaaatgagaaaattacacaaacaaatacactactagcatatcacacatttcttgctgtcattaattcagacatcatatcagctgaacatgatcggcccctctctctctacctcctcttgttcttgctgccgacgagcaagacgacgtagaagagagcccggaagaagaacccccacgccacggtgaccagcaggcacttccacttgccaatgtcagtgacggcctgctgcgccagcacgtcggcgccggtggtgacgcaggtgttcgccgtcatgttggtgccgagcgtcttgctgatggcatcgagcaccttgagcttgacggccctggacatggcgccgatcggcgtcccgtcgaacatctcgacgccgcgggagaagcaccgcgtcgcgtcgcggaactcgttctggagcaccgcctggtacgggtacttgacgagcgacaggtagtggaaccagatccagtagctcgggatgcggtcgcggttgatgaagaagccggagaagagcaggaagtaggcgaggatggcgacgaccaccgtgtatcccagcatgacgtgcggcaccaccgcggacaggaacgt

SEQ ID NO: 77370 - DNA, 1585 bp, Oryza sativa
atgaaccccgtcaccatgatcgtgccgagccgcatcacgaacagctccggcatgcgcctcgtgttggtgaacgccctcttcatcagcacccacacctccacgtaccacgggttcgcgtacgtcggcaccgacgtcgatgacaatgtccccgagccgctgccggcgacgagcttccccctcgacacgctctccgcgatggcgagctcgagcggcatggtgcatcgctgactgcggtccttgtcgtccttggtgtccaggagagcgccgagcgatgattgccatcttgagctgaacttgacgagcatggcggcgccgtcgggctggtgctcgagctcgcggatggtgtcgagtgcgaactcgacgaggttctcgttgtccgggatggggtagccgaacacggagaagaagggcttgagccccgacggcgagccggcgtagacggtgcggccgcgggagaggaggaggaggcggtcgaggatgttgaggatgcgcgcgctgggctggtggatggtcatgacgatgacgctgccgctctgcgcgatgcggcggagcacctgcaccaccatgaacgcgctcgccgagtccagcccggaggtgggctcgtcgaggaacagcaggatggggtcgtggacgatgtccgtgccgatggagacgcggcggcgctcgccgccggacacgccgcggtgggcctcgtcgccgacgatggtgtccgcggcgcgcgcgaggccgagctggtcgatgagcgcgtcgacgcgggcgcgcttcttgtccggcgagagcgcgcgcgggaggcggaactcggcggcgaacagcagcgtctcccgcacggtgagcatcgggtacagcaggtcgtcctgcatgacgtacgcggagatggcgcggaggcggcgcccatggagcggctcgccgttgagctcgacggcgccgcggaggctctcccgcgcgatgcggccggcgagcgcgtcgaccagcgtggacttgccggacccgctggcccccatgacggcgaacagctcgccgtcccgcgcctcgccggagatgccgtcgagcagcgccttggtgggcgcgtcgggcggcgccggcgcgtccgcggacgccaggcggttgctgtggcggcggcggcggctcgacggcaggcacgacaggaccccgccgccgcccttcctgacgctgtacgagaggtcggtgaaggacagcaggtacggcaccggcgggccggccgccgcggtcgccgcgccgccgccggagtcgacgtcgagcaccgtgtgggcggaggtcgccatgcagaacggatcacttgcagaatggatcacaccgcggtgttagtttgcggtgcggtgcgtgttggtcgcggcctttatataggagcgtgtttggttggctcgatttgggttcagacttgaagactcgtgtcaggctaaacaatcgactgtgcaaatttatttactcatcacgataaagtcagcaatgtgtaatcaagaatgtaaggtatggatcaagtgcgcaatcaattgcttttcttacaactgttctatatacggagaattacggaaattatagtgtgagattttaaatttgtagcgta

SEQ ID NO: 77371 - DNA, 688 bp, Oryza sativa
cagccccactgagtttgtcagcaacgcagaaatcttggagctggctcgggtcagaggccagagcacgaggcaagactgaagaacacactacaagtgctactgctgcaaacactgcagcaaatgcacgagaagccatggcttagttagcttcttcttccctagctagatgagtgtacgttaactctgatgcttttgtgagctagctagctaagtgttttgagctgcttgtaaactacgcaagagtaccaatttatacaggcgtaaaaggcaacccctgaaccctgaagaagtggactacttgcataatatactgctgtagtacatgattatattcactgcattccactactactccaaattaatctgttcattgtgtgtagtttgagtaggaatccacaattaaaccacaatacgagctagctgtgtctgtgttaattattactcttacgtaagacacaacctatttttgcttgattgtcttgttacagtcccactaactgtttgtttatgcagtgtaatcacgtgcataaatatgcataatatatgtatccttggtctgtggaatacctgcacgatatgggtggaaaatttggggaagataacgaaaattttcatacgcagtttcgcccccaacatgcgtcgtgcgtccactagcaagttaaaagatttctgtaaactccactacctg

SEQ ID NO: 77372 - DNA, 573 bp, Oryza sativa
gaagcaaaatggagttaccttttttctcagatgcaaggtttacaaattccactgcaaagcttggatgggaacatgtatcctgtggttttctaacatgtgatttgttttcagtaaaattggtctaaactattttgtatttgttttctgctttccagttggtttccccgtctttaccctcatccattttaaaaattacaaatacaaaaagtttatatatgtttaaatttgtcgacattattttgacatccagaccctatggtgatgcaactaatgtttggttccaaatttcccatagcataaacgttgtactttgtagtcgtaagattcactttgatgttagattgtgagttgtgactagtagatggctgtgttctttcgagggtgttgggaacccttctctcctagcacacaaaatgaagcggcggattaacacataattaattaaatattagcttaaaaaaattgaaatagattaatatgatttttttaaaataaattttctctatttaaaaaaatatattatttattagtttggaaaggaaagcgagagagtagaagctaggaaagtgtccc

SEQ ID NO: 77373 - DNA, 649 bp, Oryza sativa
  unsure (1)..(649): unsure at all n locations
ccgcgggccgcccgaatcctcaaaccccaactccggttcaccgttcacctcccgccagccaaggtantactccttcaccccccccaccctctcctccctcgcttatcttgcgcccgcctttcaaacccacactgttcatgtcttcttgttcttgccacagccaacagcatgtcgagagccgtggcgcgccgatcgttgccgccgttcttgaggctgcgctccgcggtgtgcgacgacggatactggatcggtaggttggaccacaaggattggctttcccccaacgaattgctcaagatcttcgcgaacatcagggatcctagccttattaccagttccttcaagagagcttgtgatagaagggattacaagcccaatgaggcactctatagcatgatgatcgacaggctagcatcctgcaggaggttcagtgatgtggaggagttgctggccagggcaagagctgagaggttcaggttttctgatgagttcttctacaggctgatcaagatgtacggcaatgtggcgaaccatcccgagaaagcaatcgagactctctttgcgatgcccgggtataactgttggccgtgaccaagacttttaactatgttcttcacatgcttgtgtgtaagaggcagtacgaagttgt

SEQ ID NO: 77374 - DNA, 15087 bp, Oryza sativa
aggataagtaacctgaaacatccatacatgaaactgaagtgaacctctagatccccaaggtcatatcttcacttactaatgcttctgtagttgtgctgctactactacaagtttgcagcgtaaaatattccatctcgactttttgttctaccacaagtatgaaattctattgccataagctactaaccaattcttacaactcttccaaaggataacaacacatcgaatgctaaaaactagttcttctgtaacatccaccatggacaaacctgagacaccagccacctgaactggtgagcggcgacaacggcgtgctctttgggcggcttctccttgccaatttcctcatcctccgtgtccacgcacgtggccttcacaacatccttcagcggcggcaccacctccggcatcatccccaccaccatctcccctacatcgccccagccgcccgccgccgccatctcctccaccgcggcggcggcagcgtcagagagcgccacgggaacccagtgcagcgcggggtactccggggaggccgcgcgcgcggcggcgcagaagaggaggaggcccgcggcctccttgctgcgggccccgccgccgccagccggagcctggggatgggacgaggggaggagggaagagaggagggacttggtggaggtggaggagccctccggaggcgcgtagggcgccgcggcgagggagtcccggagcggcgccgcgatgcggaggagggcgtcgcgggggatcgccgcgccggcggcgggaggggccatcggcggcggacgccggactggacagttcgagcaacccacctgcacagtgaaagcccagctaataaatgtttgtgtcgttgtgattgtttcgtgggccggcttgggccagcgttgacgcacaagctggacgaggtcgtctgcggacgcagcgtgtccttgattaggtggggcccacacgtcagtggcccatatttctctgacgtatgtcaaaggagcctcatcctcagtccgcatctgccttatgtttttgctataaatttgttgacaaatttgctcattgactttataggaaaaggtctgtatatactaaattttgtcttagtaagctcttaccatgtgtcacgatgagtatatatagattttctataagtttcatctatttaaatcaaaaggttgagatttataagagttttgcaacgctacagacgcatgacccaatggctcatgtcgtcgaccgtgcatagatggcatatgcatagtagacataggaggcatatgcaaagccgtatatgtcctagtttcttgtttgatggcatgtatggattgaaacaccaccaagtgatgaaaaatagtcttgcatgcatcttttccatgtttcactgcacaatgggcaggagaaaatcccacaaactatattccacatgagccgtgacacgtttttacgataatcacctgtagattataccaaataagttatgatcctaaactatcttacaattagacctatacggccatatctatatgaagagggcaatattatcaaggctagctttgtagtatttagttttaacccctttatatcatatgacgatcaatactttagtacaaccccttaatcccgagatagctagaatagattgatgttgatggcgccactctagttctcgaggaagcccctggtggcagcgctcaaagtctcaaggaaattcccaatggtggcactcacagactcaaggaagcccaccctcaaccgctattaaaagctcgatggcagtggtttggagcttggggcgtcgtgatttcctctccctctcatcttcagtgaggggctctagtgcctgttttcgtagcaaacatgagtttacatcatcaaatgaatcaaaaggatttaaattcttgtaattttacaattgtcacatcaatctttggtgtttatagctgtagctattggatgctatattgttgtcataggggtaggctaaggccctgtttgtttcagcttatgattattataatctagattattaaaccagattactataagttgtattataataaactgacatagaataagctatgagttgtttgtttgtctggattattggaggcatggatcattgggtttgaaaggctaaagtctataatgccctcagctatctgttcggttgatggcataggtgggtaatctttctcaagtatgtaggggtagtgggtttttagccactcaataatctgaaaaaagctcatctagagcagcttattagattataataatctggcttatagattataataatctgctttaataatctacttgtttgtttcagcttactcctaataagctagattataataatcctaagctgaattaaacagggcctaaatctacgaccatgatttttttttcttttgatgcattcattctaaatctaaatgcttatttgtttcaagtggactaacatatcgttagagggatttgtttcaagtgaactaatatattgctagagggaaagggctaaaaggggaggttgtgatgtgaagttatttgttcatagtagtatattaagctacaattttaattatagggacaaactatggtttagaaaagaaagtacaacaattgagattgtctagcaagaatgtcaccaagaagacagtggcaatgtcgaggaggcgagccacgcctatggtgtggagaaggaagacaaaaggttgcataaaggcagggaccggttgcagatttgattattgtttttaagtattctaatgtcgatcctattgtttagaaattaatggtcgaatgtgagtgtacccctcaaaaatggttaaagtctcttttaagaatatagacaagactcaacatcacatgacatccagaaagaagaaaaatattaaaaggatgggatattatttattgacctttgtgatatagggcaaacaaatatttttagataaactacaaatcatatatttagtgttgtggagttatactcttttataaaaaaaaagttttattgatttcaaccgttgtcgaactttttatacgcaactttcattgcatatattttactttttctaaaatataagttccatcaatcgttttagctatcgtcataagtagtagttgttgtacagtacttttgctagaaaacttgttttatttatagctataacctttagagcaatgctacacgtactaaatttttcttactaaacttttactaacaatcatctcaaccgtttgatttaagtagatggaagttacaaaaaatctagatgcactcatagcatgacacatcagtgttagtaagaatttagtaaaaaaaagttagtatgtatagacttttcctaaccttataatgtaccaccaaatgttcttgtgtacaatgacaaatcataacgaaagtctcattaatatataccatttattatgaaaaagttttcatttgtcatcaattctattacctataggaaaggtatgaccatgctgtgttgtacacccagcgaggtaccagcacaaaggaacaggctcaccaccggccacggcggttccggtgggcattctcatctggtgtccgtgggggagagcaaccaacttcgatccgtgctccggaaaccgccgatctccaccgtccacgtaccccggccgaccaaatccaacggcgcggatcgaccgcactggacctcgtccagtgcacggcaaggtcggtttcccgtccactcgttgggttttttcacctcttcctctccagcgacagcagcagcaaacccaagcccgaacccaccacctccgcccatttccgcctcctctcgaaacctcctcctcctcttctcctcttctctcatccaatcgcgagccaccaaaccctaatccccaacacgcacacgcacacgcacacgcgcgcggtcgcgcagcagcgcgccatgggatgagccgcggcggcgcgggagctcggatccggagctagggtttcgggccgcgagtttgcccatggagtgggacagcgagtcggacggcgccggcagcatcggcgccggcgaggaggaggaggaggaggaagaggaggaggagggtggttttgggggaggaggtggtggtgggggcggcggcggagggatgttctcgttcgcgattgaagggatgctgcgcgcttcggggccgtgcgggctcgtcgtcaccgacgcgctcgagcccgactgccccatcatctacgtcaactgcgggttcgaggaggccacgggataccgcgcggaggaggtgctcggcaggaactggttggttcatatcaatctcgcatatgtctcagttattggttcgacttgtttgatttgggcgttcgaattggtggcacttaggatcgaatataatttgcattttatatgatttaatcacgccgtgagcatgatcttttgaattaaatgacaaacggtgcagccctttcgtcatttttagtattcccagcgattacttgtgtccattttgtctataaaaaaaataagaactagtatgttttttttttcactagtatagcttacggatagctgatggcactaatggaccagataaaatagaaattagcacttagcaccatagggtatcatgacctgttgcatcctgatctgggtgaagtttggcttaggatcgattgactttgtagattagacttagtgaactgcatcttgaggcaatactagttttaagaacatgatgcttgatttgtgttgcttggctcagaaattttctttctaatgctaccagtaaatatgacttaattttgttgctagtttcttttatctgactctaggcttgtttaatagcatgctatattttgtgttcaccaacacgctaactgctagacctttgtttcaagaaaagaaataaagaggaaaaaacactaagagcattttaggctgcaaacatgtgcctagttagtgattaggtggtctgaggcagtataaattggctgggtggccctagggaggagggtgcttcttagcacataggtaggctagtcaggcaatttttagaacattgattatgttgttatatccttaaggaagaatagctattgcttgttggtagttggaacttatgctacttataccataaaatgaaaataaattattcaatggaatgatctctatgtaaagaaaatgatggaactgattcagttaacgaagtatctgaaataagacttccctaaaggttgtgaaaagttattttgagattgttagcctgaactgaatgaaaggaggtccataggtctaacacattaacacaaggtagaacaaagaaaagtattaaatggaaatggatattgtggccccaattcctggcttccccttggtcccccatctttgttagcgatcaaaccccaaaaaataggatatccgtggacataggaaatgataaaaccgtgacatgttataatatattgcagcaatgttctttttgcctttttggtcaacaccttggatcttgaagttcatataccagaaacctctaagcttttcccccctgatattacctccaaggagagaggattttttccatgcatatctaaatgctatattaaaaaataagtctactttgatctatggttcttactagaacatgttaatatcaaatttcaactataggtttgattgataagatacataggaaagcaaatcaagtgggtactactttatgtgatggaacaaatataccactgcaacaattgtttgtctaagtttacaaagattgatcatgtaagcgtgtgtagtttttgcatattttgattatctgttgtttttcatcttcactaactttctagtggagtcgaagtgctgtgaagttattttgttattaggcacatggtttgacaacatgcttgtgccaaaaaaaaaatctcccttttttgaagagtattattcagatacctcaccaggattaacttgcttggttcactttacacgtttagggatcaaaatgcaactcccaaggtcaaggagccatgtgatacacccatgcaagtctaggggactactggcctatgatgcacttctattaatcatttatcttatcctacattcgtggtagcagtttagcacttacctctccactattactatcacaattattcaatacaagtatacaacacactggctaaacatttagcatcaagtatcagttgggatgaagtttatggtgtgaagtcaaattcagatgtggttattagccatccaactcatgcacatgttctttcttattaattcagaaacctgcccaagatatttttactctacgccctatgaatatgagtgaaaattttcacattgttcgcatatgaagggtcaaatttttggtggcatcagaaaaaagttttggaaagaacatattctgttgctgaatttttctacatcgttgttcacatcaaaaagatcatgaaaactgagctaacacagcatctagtaccaatgtgcttttgtgagaagggagactgagtggtgcttacaacactttgaatttcctcggagacttgtgctcaaaagtagttggaaatggcactcgccaactgaaagtagcataggatttttgcaagtgtggttcacatttttttcactcatatttcttaaattgttctatgtgttttacttagtacacacttacttgttctttatgtacttttcttgacattcttacacactgatgtttctttcccactttcagccgattcctgcaatgcagaggaccctttgcgcaaaggagacatcccctagttgatgccatggtggtttctgagattcgcaaatgcatagacaatggtaccgaattccgtggtgatttgctaaatttcaggaaagatggctctccattgatgaacaagttacacctgacccctatatatggagatgatgagaccataactcattacatgggcattcagttcttcaccaatgctaatgttgatttgggaccattgcctggctcattgacgaaggaacctgtcagatctacaagatttactccagataactttttccggcccatatccactggaccagggcagagcaacttctgccgggaatattctagcctgttccagttgactgatgaagtactctgccagagtatcctgtcaaggttgtcaccaagagatatagcatctgttagctctgtgtgtaggcggttgtatctcttgacaagaaatgaagatctttggagaatggtttgtcagaatgcatggggcagtgagactactcgagctcttgagactgtccctgcggcaaaaagattaggctggggtcgattggcaagagagctgaccacactggaagctgttgcttggaggaagttgacagttgggggtgccgtggagccatctcgatgtaacttcagtgcctgtgctgtagggaatcgtgttgttctctttggtggggaaggtgttaacatgcaaccaatgaatgacacatttgtgttggatttgaatgctagcaatccagaatggaggcatgtcaatgtaagctcagctcctcctggccgttggggccataccctatcatgcctaaatggatcgctgttagttgtgtttggtggatgtggaagacagggcctgcttaatgacgtgttcacattggatttggatgcaaaacagccgacctggcgcgagattcctggagttgcaccaccagttccacgttcatggcacagctcctgcactttagatgggacgaagttggtggtttctggtggctgtgcagactcaggtgtactactcagtgatacatatcttcttgatgtaacgatggacaaacctgtgtggagggaggtacctgcatcttggacgccaccttcgagattgggccactcaatgtctgtctatggtggcaggaaaattttgatgtttggtggtcttgctaagagtggtccactgcgactccggtcaagtgatgtgttcacaatggacttaagtgaagaggaaccctgctggcggtgcctcaccggtagtggaatgcctggggcaggaaatccagccggagctggtccacctcctcgccttgatcatgttgctgtcagcttacctggggggagagttttgatatttggtggatcagtggcaggtcttcattcagcgtcacagctttatctcttggatccaactgaagaaaagcctacctggaggatactgaatgttcctgggcgacccccacggtttgcctggggccacagcacctgtgttgttggaggaacaaaagcaatagtgcttggaggacaaactggagaagagtggatgttaaccgaaatccatgagctttctttggctagcagcacagtttgaggttcgaagtttattttttatgtttcagcgagcttccttcagaacaatcatgattattcatgtgtggcctgaaacttttcttcactggcaggactggaacactggatgagtatactgaatcttttggcaacgacttgtatttacttggaagaggtggtttgccttgagtagatcaaaacctacatttggggttgcttgctttatgtagtcaaggtgtagtgatatgttctttttcttgttgtttgttttgtcttttaccagaaaatataattcataagctactcttgtgaaatgagtaccaattttatgtattctcagacgcttctgacatgcattatgttagggaaaacagaacaacgttgtatagctgaatcatttgtgatgtactatgcttcttgagcatcttgctgccatctctggcctctgggacacaatttgacgcttatgtgatgtatgcgagaaaaattttgatcgatcctctttattgtaaatcatgtaacatgatgtagctgctttgtcaggtgaactaagctctctatgtttcggcgtgaccatcagacacttccaatgcagctgttgcctgagaactgtgtttaattatcttcgcggtgtcctttgtttttatcctggataatatacttcatgatgatttattgtaacttattgaaagactgcctgtattttccgcatgtgattggttacttggatgtgtacagccatatataatacagtacagcgattggatgaaattgtctagcagaagtatatataaagaatggacactacaaaaaggcactccattatctcgaggactaaacagaatgagttactctgcattttgcattacaatttacaaatgtacatgtacaagaatatttgaaagaccatcacttccacaaactctcgcctacccggcaaagccggtgccataatcaccacaagggatagcggcgaagctcgccagcggcggcggctcctgcctcggggacgccgccggctgaccgatcttcgtctcatcagctgctgctatgccgtcgacggtggcgttgaaccacggaagccgaagcgcctccgccgccgacagccgcgcgtcggggttgcaggtgaggaggccgttcaagacctcgaacccgtcgcgcgacaggcgctcctccgggaacaggtcgcgcagccggtttcagtcccagctccggcaaatcggcaccgcgccgaagagcggcagcgacgggtagctcggccatgtctggcggcacggcgcgccgagcaggcggaagattctcagcagctcgtcggtctcgctgtgcccccggaacagcggcacgccggcgaggagctcgcccatcacgcagccggccgaccaggcgtccacgagctcgccgtagtccggcttcccgaggagcatctccggcgccttgtacccgggcgatccggccttctggtacggcggcttccgcgccgccgtgtccatggccagcccgaggtcgcacagcttcacgacgccgccgtcgccgacgaggatgttcccgggcttgatgtcccggtggacgacgtggcggtcgtggagcctctgcaccccgctcagcagctgccgcatgacgcggcgcacctcctcctccgtgaacggcggcccgccgccgccgccgtggcgctcgcgcaggacgctgctcaggctagggccgacgtgctccatgacgaggccccacatcccggagcgcggctcgagcgcgaggccgtggtagtggacgatggaggggtggtggctgcagcgcgcgaggtagagcgcctcccgcagcagcgcgtcctcgccgacggccttaccacccatgccgcagcggtggcggcggaggaacttgatcgcgacgtccctgcccgtcgcgcggtggcgcgccctgatgacggcgccgaacgcgcccttcctgagccagcacgtgacctcgtaattgtcggtgctctcgatgcagctccgcttgccgccgccgccgccgccggcgtgctcgtcggcgtcggcgatgccactatccgcagcagatcgcttctcgcccatggagaccaagagaagatggtgtcaagcttagccgaggtgagtaaatggaggccaaggctggacgtgggcgagtttaaatagtcacctttcgcgccatgaatccgcgtcgaactcgaactcatgcctccgtttcgcattcggtttctcgaattcgaatccgaatcagcgctcgcctcggctgcgcgccacaaaatacgaatcggactccgtctcgtgtggcgatataaggtggccagcgacgccatgagagcgtgtctccactctcgcattcctcctcctctcaattgatcgcgcgcgcgatcgattcccctcttgtcgagcggcgaccaaaccctagtgcccgatcgccatggcggagcaaggcgttctccggcggtggaagcgcttcttcccggcgttcgcctccatccacgccgccatcgaggccgccgagccgggcatctcccgcagggagttccgcgacgcgacagacaaggtggtggcgatgctctgcaacgcgacggacgacgaggcggtggcggaggagctccgcgtcgtgctcgacgggatgatggtcgaggcgctcctcacgctggagctggttccggcgatgcccaagatgctggcctccaccgacctcgcgcaggacgtcggcgcgctgaggaatcacccgtcggagcgagtccgcagcctcgccatcggcatcgtccgcgggtggagggcctccgtcaaggacgagctcctcaaggccgcagccgccatggagaagctctcccaggcgatggagcccgacgaggccgacgaccatcacgccaagatccttcagccatcgccgcccaagaagacggcaaacacctcacggtcacagccgcctttccccaagaagcagagtgctcgtccggtggtcggcggcagccgtgtcaccacgatggccaagatcgatccgccaccggagaaggcgccggcggcggctgcggctcgaagctcccaccaccgcgagagcgtcgtgccgtgctgtaccgacgagaaggccatgaacgccgcgaagaggaagctccgggaagggtaccaagaagcagaggaggcgaagcggcggcgcacgatccaggtgatccaggcgccggacaggcagcggaagatgcaggcgatcacgcggccgcgaagccgaccgagcttcgtcgccgccgcctccacggcgaagaagagctctggattctcatcgcttcggaggttttagctagggttcttgttctcctccggtgtaacagtgatgtgtccatgatcaactgatcatccccaaagtgtattgcgtcaaaaaaaaaacaaagaaaatccccaaagtgtatgtatgtaattggttatcgagtttatcctgctcgtcctggattactcgcgtgtttaatctatcaaatcaatgatatatttttgtgaaaattgagcaaatttctttatgtgattgtagtatgtgtcaatctgatcgcgatcggcttgaggggcgagagcactgtttctgctcggagtgaagcttcggcttgtttgtcccgaataccaggcttctacatgggcctgaggcttagtagtcgtgggctggaagcccgttataagcatgggccagcgacgcccgtgacaaatgggaatatctgggccggcccatcaagccagctttggtctccgtctcttccgggcccatcacggaagagtcttctcgaaatcgcagccgttcgaccacgatttgacggtcgcgatagatcgccgccgtcgaaacgtagcagcgctagcctttgcgcacaaatgtcgcaacgaaactacgaaagcaacatgtataaaatggaaatgaagccccgacacgattgccatgctcttcaataatacaaagcatcacatcaggatgaaacatgcatcgtacatggcatcgaatcgtgctattattcgcatttagaattgaaaccttgaaggagattggtaggatcaacacgggagattccaagaagattgtaattagctgtcctgctcgtgtcaacacgtcttactgtaagggactcctaaacaaatataaaccacaacacactgcatattatagatcgatcagagattgctggtttggtttgcttttgggtgccttcaacacgcaagtacatcagcaaacgctatcatcacaagcaaagaacaacttttcttcagtaatcagcacagcactctttccagacgcttgcctgatgcgtcgtgagctcaaagctgccagccactgtggctgttcacgggtcaagcagcagaaatcttgtaactgttgtggctaaggccgttttgagcaattgaccagtggcagtggcagtggcagttgcagttttcagttgtacaactgaaaactgtaactgtctactcatcgaaacagaagcaactccaggcaaaccactgggaatgaactcaatcttgttctgggaatgtcctatgaagtctgctacatccaagcagcatttttccagcattttccaaaaacagaagttttcaccaacatcgctatagagatgggtgctggatatatacaaaatgaaactagaatcatgaaacctgttgcgaacgatcaatggagagttctgttgctaatttatatgcacaggaagtttaggctggggggcagggcagcacctagcaacgatagaggtcgaaaagaaatgtaaatgagcagaggtacaatgttctcatgatcgctgcatcacataaagactatgctcctttttaatagctggtcctacaagtacaccatttatcgtccatatcttgtatccctggatccatcaagagaacatcatatatcaactcgtcagaaatgaaacaaggacagcgtcatgctttagagttttaaatttaaagaaaaacatgaactatattatttacatctcatgctgaatttggaaggtagtatcaaattgttttctccacaatgaaatcaaaattttagggtaggtagcctcatgttttcagtattgtactgcacatgcatgtctcaggcactaaaatcctctcctgaaactttactaaccccacctaaacataccaaaagtcttaacacctagcgcataaatatgcaatagatcggttaaaaggagctacctcaaagatgctttcactatgcataatgccatcaagaagaaaacagggaacatgacaaagagtaaaaaatgtaaacggctgtattttctatgcataacatggcagctcaagtaggtactgtaaaagtaagtgcatcaggaacaagaagattccaaaagtgcggtatgtttgtattccatattctctacaacctgaatattttttcattggactagcatgtgttctttgttcttacaaaaatgatagatatagctccaataactaaggaagattaacagtagactgtttctacagacctgtaatggaaactagccattcttccaggtgttgcaatactaggtatggcccctgtgactatgtattcatcatcaatttcatcaaatctgatttctctcaagtcaacagattgtgtgggaacctcgaggttaaagctttcgagatgtgcctgattgctgttcctccttccactgcctcttctttcccttgcccttgctcttcttcgtcttcttgaagatctagagaatcccctgaaaaacataaaagaccaccagtgccttctgacccgcctgaaaacttcatattcttctccagtttcatcatccccatactcaatgacataatctcccagaacaattccattaggaacttgtgcatgaatcgtgctcagcacatcaacaatatcagaagattgctggaagttctcccaatcaacttgcctagcaggatcaatttccgaagggcgtgagtctggatgcttttgttgtgtgtgcttctgaagttcattgaagttgccaacgaatgaacaacaatcctcttcacagcatcttttcttctggttaagatgtagacgagcctcaccgataacaatccatccaatgacatctcctctacacaatgggcagcttgggcggttgttcacattaggagccacaatatggatactatcaagaggagccaccgcaatggttgaaactttcatattggcagggagctcatatgcacctttaaacctctcaagacagtttgagcgggtttgatctgtatcacagacaaatggcctgcaacctttctcataagatgtacatcttagcaggacagcattgtgagggtaatcaagacagattgggcaagtaacatcctctgtccaacttttatcaagctgtatgtcgaaatcaaaagagctgggcctcaccaccttcttcatcatcaggtttcctgaccccatgttagattttctaacaaaactagtagctttaacaagtgctacttttcattaaaacctgcatgacatcaagatgaaaatagattagtttgagactcatcatttctaaacatagtatatttccaatacacaacaaagtttagcatttccatcgatccaacatgagtttaacggtatcacagaatcatgtcaatggatatttggttccaactggttgttttgaactgcacaaactagaatctctcctacatcaacccatatgattgccaaaaggttgaattagtaagccttctcccaacaaattcaactactcagcgttcatatcatcttccctaaatcccccaaaactacaatacccacctggtcaaatccaccaaaaaccagtctcctccaggatgcaacacaagcgaaagc

SEQ ID NO: 77375 - DNA, 1411 bp, Oryza sativa
cagagcatcctctacaaagatatgtggacgactcaggtcatcatcatctaaccccaaagctgcagcaaactgtgccatagaaaccctatactgctgcccctgaatggtccacttcacaaaatcaagccccttcttggtgatgccaaagaaagcagtaaagtagaactgtccaatcacttcctcattccaggaatactgcaaggccaacaaatctaccacgtgcttgcgctcacacaccttgcgtacctcattgaagactatattgttctttgaggacatgtactgccagtctagccacttcatctctaccactagatgagatcttcccatgatcatagagttataccaatcaacctgcaccaaggtcctgaatctgtcatcctgagagtcagctggcagagtatcaggactaaccattctgtcctttccacactggagtagattcttcagatagttcactcttgtgcgtttaggatctggatcaacagcccttgtcttgtacagcctcaaaggattgcttttagaaccaggctcatcctcattgccaccatcatctgactcagatgcagctggagagggagagcggggtgcatcacgaatgacaatgctaccagccctcctggaatggatcggaatctgactcccactgtaaaaaactccaactttttctttgcccaatctccccctaggaccacgaaccggggggctcgagtcagcaggaacatcttgagaaagcttctgtctcttctcacgaggcataatgaccactgcaacaagaatcaacaaggttggagtgcaatggttaaatgaaacagtagcagaatcaaggttattggctggctggacagagaccggaagttccaggccaagaacaccggaacttccggcctgcaaaactgaagaacagaggatttaaccaggccagtgcatgtgacaaaatcctatagatcggcaatctacaaggtagcaggaacaattctatccaaaaggttttctccctaggttcacatatttagagatcggggcaaaaacatgatgaaccaaaggagaagatcaaaagtgctaccttgagagggaaaatcgcaaatcgatcgcgggatgaacctcctagccaccaatgtggttgattctacggagaggaatcaaatttccacggttggaatagaaaatcgccgagaggagcactgtagcggcggctagggtttgggaatcggggaggagaagaagtgacgagagagaaaagaagcttgggctccccctgggtagttatacccccgacccccggaagttccggactgggatgaccagaacatccggcctgacagaacagaggacagtcaggcccaagttcaaaggaatagatgagaattaaatgatttagaaatgaaaacctatggacgggctgcaggaa

SEQ ID NO: 77376 - DNA, 4434 bp, Oryza sativa
atgtttgaccttagcttgttgacaagtttcacaactcagaacatattgctggacatccttcttaagacccttccagctgaatagcccccttattctctgataagttgcatggattcctgagtgaccacccaagccactgtcatgaagagctaacatcactgcttgcttagcctccaggtgattacccagccaaatcttccccttatgcctaataattcctcgttgtaactgaaattccccaactccttcaggattcaaactgagctcagttaacaagtgtttggcttcttcatccttctcatatccttcttgtacaatttccagccattttggtacacaggtggatatagcttggctcttatcttcttcttttcttgacagtgcatctgctgctttattttcttgcccctttttgtatttcagtttgtactgcaaccccattaacttaataaatgctctttgttgcattcctgtgagcaactgctgctcacttaaatggataaggctcttgtgatcagtctgtatagtaaacacattgtgctgaagatactgtctccactttcccacagctagcaatatggccatgcattctttctcataggttgaaaacccctgtgatttaacccccaaagccttactgatataagccaaaggatgcccttcctgcattaatactacaccaatcccctttccactggcatcagtttctataacaaattccttctgaaagtctggtagtttcagaactggtgcctgagtcagagcctgtttgagtaacacaaaagcttgttgctcttcagtaccccagatgtagctgactcctttcttgagcaagttggtgagaggccttgccaaaaccccatagttcttaataaacttatccccttagctgtttgagagtttttggcactggccacttagacacagcttggattttggctggatcagttgccactcctgttactccaatgatgtggcccagatattcaaggtgttgttgagcaaaagagcatttgcttgccttgacatacagcccatgatcttgcaacaactcaaacacttgctgcaagtgttgaacatgttcctgcaatgaattgctgtacaccaagatgtcatcaacaaacaccaacacacattttctgagtaatggtgcaaacaccgtgttcattaatccctggaaagttgcaggggcgtttgtgagcccaaaaggcataactctaaactcatatagcccatggtgggttctaaatgcagtcttatattcatcctcctccaacagcctgatttggtggtaacctgacctgaggtcaagttttgtgaaccactgtgccccagccaactcatccagcagctcatcaactacaggcattgggaatttgttctttacagtcacctcattcaggcccctgtaatccacacaaaacctccatgtcccatccttcttcctgaccaacaacacaggggaggcaaaaggactagtactgggtttaatgatcccttgtttcagcatctgagacacttgtctctctatctcatccttctgtccaggggagtacctataaggtttcaggttgactagttttgtgcctggcatgagtggaattccatggtcaaactgtctatggggtggcaaagttctaggttcctgaaacctgtcctggaacctgttcagaacttcctgaacctctagggaaagtccttgctccaaccctttctcctctagtgcacacaactgcaccaactgagagattgctccagcctttgccatccctttgagttgccttgctgtcacaggcttacattggtaaacaattgttccttgaccccaactagagtgattctcttttcttcataagtgaatctcattttctttctcttccaatccacccacatgggactgaattcctccaaccactccataccaaggatcatgtcataaccacccagtggaagcaccttcagatcagttttgaaagtttttccctgacaccaccactccaaaccattcaccacttgattgcagagcattttacccccatcagctatggttacttgtgatggcacacactcctgggtagacaactgcaaccttgacaccaattgctctgacaagaaattgctggaactaccagaatcaaccaggacaagtatctcttgattctgtaacaagcccgcagtctaatggtccttttcccaactgtaccagagactgcacattcagagagtaccagttcctcatcacttgttccttccacatcatcagccttgttactgtcctcttcttgcgccaggaacacctctagcaattcttccagaacatgcagctgcaccgattttgggcacttgtgtccagggccatacttttccccgcacttgaaacactctcctcgagcccttctagctgcttttagtgaatcaaatctctcttcccacttgggcttttcctccaccttcttgttctcatcagggctagggcccagaattcctttaccaaggaatggggtcttgacagcaggcttgtactgctctttgtatgtagttctgccaacagtcttcactgtgatttctcccagcaagtcctcctgcgttttatcaagtgatagagcagcatcaacagttctaggcttgtgcagcttaatagctgctttaatctcacttttcaacccaccaacaaatttagtaacaaaaaaggtttcatcaaaagccttattataaactaagactttattcatgatctcttcaaatttggaatggtattcctccactccccctaattgcttaaaaccttcttgttcttccaaatgttgctcgtatttatctctaccaaacttgctatgaacttctaccactagttcaggccaactctctatgcaatgcaactcctcataggtttggagccgaagtgctgcagtgccagtgaaatgcaaggtggcaaaggaagcccatgtttcataaggaacatgatacatgctgaagtatttttcacaattagttttccagagcttaggattctctccatcaaacttagggaaatcagtcttaggcaatctagaccccccaaatttcccagagctttgagatccacagttttctctctcagaattttccctcaaatcaaactgcacaggtgagtgatggaacttgtgtttacccttgaccagggttcgctcctgggcaaagcttgccccggtagcatcaccctggtagttctcgtcgtcgccgggccctacgggcgtttgcttcgccattgctggcgtcgcttgtgcacgggtctcaagttgagcgacccgcgcgttgacttgatccacagcttgacgtagatccttcatgcccaaatccaccgtggggatccacttctccatgccttgaagtgatccgaggatggagttgatgctgctggtgagctcggtcaccctcgtcgtcaggaaaccgatttctccctccgccacctccatccgctccgtcagagttggattcgtcttcttcctcaccagcacgcccgcggatcggcggctctgataccaaaaatgtcacgaactcgcaattcggcaccggcgtctcgcctagtacgtggttgcaagcttctgagtttgagagattttggggatttgagaggaagaacagaggaggaagacaaggtaggtaggattagttttatatttcttctcatcgatgccttgactcaattggtcaggtctgtatttatacaccgacacatgggctctcacgggttcagcccaacatgatgaagtggcccaaagactcaatacacccaagagtactgtaacacaccacgacaacataagaacatgacaacaaggtcaatggaggcagctggcggaaaagagaacccggcggcgcctccgcacctgtatctgccatcgcttgcacagctccaactgtgtccaggctcggggtcgaaggggtggcgcggtggagggaggcacagggctgctggatttggccgcgccgtcgcctgccgtggccccatcatccgccaccctgtcgcccgcagccatcccatcgcccgtagccaccccgtggcccgccgctgagcccgtcgcccgctgcagcgccgttcgtagttgcctaaaccgccgtcgcctatcgcccctgtcgaccgccgctgccgtcgcccgtggctgcaactgcctctctgtttctcagatccgaaaaaatgggatggtgatggggttggttacggcacgtgagagcaacacaaggtgtgtgtgtatgtatatatatatacatatatagatacatatatatatatatatatatatatacatatatatatatatacatatatatatatatatatatatatatatatgtatatatgtatatatgtatatatatatgtatatatgtgtagagagacgctcatgtcgagtagtaaacaatttactggtagaagggggcgcagagagaggt

SEQ ID NO: 77377 - DNA, 6698 bp, Oryza sativa
cgccgctcttggccggccgtcacagccgccctgttcctgtggatgagaggaagtgagagagagagagagtagaaagtgtgtgtgagagagagaggagaggatgaatcaagaggataatgttgggggtgaaaaaaaatggtggattttttttaaatgtaaaaatcaatttttattttatatgtggctctttaaaacgaatttaaaggcactaaatcaactcatacgaaaaagttgttaaaaacaaagttgtataacttattgagatctatcaattttattttggtcatttctccatccgagtttgattaaactatataaaatttgaatttaaaaatataagaaattcaaataactttccgggtagtaaatgatttcaaataaaaaaattgtcaacaacaaagttgtataacacatcaacatctacaacttttattttggttatttttctatatgactttgtttgaaccgtttgaatttgaatttcaaaatatgacaacttcaaacaatattttgaaatactaaatgatttcaactgaaaaagtcatcaacaacaaagttatataattcatcaagatctataactttttattttggtcatttcttcatccgacaaagtgatagtaacattattcacaaaatttgcatctatctcatttggttctataaactataagagagatatgtaaactttgtgaacaatattattatcaatttatcggatgaagaaatgaccaaaataaaagttgtatgtcttgatgagctctacaactttcatgttcatgactttttcagctaaaattaattacatcttcaaaatattatttgaagttttgaaattcaaatttttaattgataaaacaaagtcacaataaaaaatggctaaaataatagcagcaagaacacaataacaatagagcatgattttagaaacatttaggaaaaagaatcatccaatttggagttcatatgagtgagataaattagtttcaaattaccaaattttatttttgcatacggcttcttaagtcacccatatggaaaaattgatttttttttcatgcgggtccttaaatggtccacacacaaacaaatgaaaaaattcaattatgaaaaataaccactcaaatgtttaaaaactttcaattgaaatgttcaacctaaaatttaaaatattcaaccaattttcaaaaatttcaatgtgcctacgaaaatttaagtgatacacattaatttatttgtttcatgataacataaatttgtatggaaagtaaacatagcattttctatctcccccttgcccttataaatagagataaaatttgaaaatattgatgttttgtttttgaaaactaatggctacatatcttcctcgttttaagaagcttattttgaggggtcttgatattttgataattattcgttaccgtattcgtttcgattcgtattcgctccgtatctgtattcgataatattcgattccgttttcgtatccgggtttccaattccgatttcgattccaagaaaaaaatatgaaaacgaatatgatagagctagtttcctaccgtattcgatccgttttcatccctagacggaggttaccgactgtgggaaaaaaaaaagggaaacgtgggggcgggggttaccgagggtggagacgggtgggggtagggtggagtggggtgggggggtaagggggttggggtaggttgcgaggggagcattttagctattacgcatcctgggtgcggtttagcgcttatatatatatatatatatgtcggtgacataggaccgggagtatcatgacttagagacttgaggcagacacgatcacccacgtggcctaaccccctcggggggggggggggtcgggcccgagggtgatacggccgcccttctctttgtctccccgagaggtcggaccgctcccgtctcggccccgagggccgaggcgccccgaccccttgtgggttttgcgccgcgtatatggggtaggtgagcatagcggggctcacctaaccgcatttattgcggtttggacgagcgcgttacgccacatgtagcgcagtatggcacgctcgtttatccggtctgtgaccggtcacagatcggtcagattgcgggttaggtggcaacaggcgatctgacacacgcctcgccccgtcccgtcaagatgagagtctctaggcactcgtccctagccggagccagcgtgctagctcctggagatggcacgttggtcctggtcagatatatgccaggctttatcccaaccattataagcaagacgttgtatgaagaagggcgaacatgcagattgctaaactgacacgtggtggacaaaggtgaccggtctgtgactggtctgacactggttatgtcgccggaagacaaccgtgttcccacattgcacctgcttccggcggagtggaggtaggtatgggccgtcccatcagaagggtcactcgggcagcagccgttgcaaatctccgcccatttatgaagagatgacagggtgatccccgaggtcagacgaacgaggacgcgtggccacactcaaaaacaggcagtgtttcagcttccaagagaaggcaagccaagttttactatagataggatgggcccccacccaaaaagagagagagggaaaagtggtgcatgtggtatccccttgagatataaaaggaggaccttgcccacttaagaggggaggggggaaggggggatgatctggagaggagatcccacgagagaaaaaaaaaggagaagagggtttttagaataagagctctctggctctccagctctttgtagcttcttcatacacagatccaccagaacacaggagtagggtattacgcttctcagcggcccgaacctgtatacatcgcccgtgtcttgtgctttttccattctcgcgaactttccacagactaggagcttagaatctcacctagggcccctggccgaaccggcaaaggggggcctgcgcggtctcccggtgaggagccccacgctccgtcaatatatatatatatatatatatatatatatatatatatatatatatatatatatatatatatatatatatatatgtatgtatgtatgtatgtatgtatgtatgtatgtatgtatgtatgtatgtatgtatgtatgtataggaaaatgcggatttgagctcgagctcacatgtacctataaaatctgccgttcgactgcgcagagattcgtgcgtgtgttgatctacgaggggagcgaccgaagttgttagggcgagggtacatatatggttaaggtagaaaaaacgacatattctctacatgccgatatacacttaatcatagtgaaagcccaaaatgccctttgctgctatcactagctttagacagggctaaagcaggctaggacactcaagagagactgagtcagacatggcatagcgaaagtgggttccacctgctcgcctgcttcacgccagctctgcacgcgaggccggttttctacagaaccgttgaaccgggcggttttgatggaacaagccggcttttgcgtttacactttacaccacgatgcctctcatttttctcgggatgtgtggggagtggggacaacctgcggggaggggaatttttttcccatctggttcttttgagcggcgacggcggctgctttaacagcggcggcggtcggctagatgccatggcggggtgagcaggcaagcagcccggcggcaccgcggtaggcgaatagggcggtggccggagagaccgccggcggcaagcgagtagccgagcagggactccgccggcggcgtctctagttcccatggtattgcagtgatgccccggcgttgctcctgttattctttgtgagcttgtagcggtgctcccgtctcctgctcgagtcatcgtccccactgcgtgcacaaggaggcaacgctagatttggtactgtgctactgtgtatgtttggtatttggattcgtatacaatatgctaatctgtctttatagatcaaatttttactgtcacttccgtgcattcttatgaacagatggatgcattcagatttgacaaggtataataagccaataaggtgtattttgttaaatgattgccatttgacctgtagtacagatttagcacttgccagtgacttgtgaacttgagatttgagaaactatgaagtagtacgagactatgaactgtatgagtcacatgttgaatattatatggttatatgattaagctgagttagttatgagcttgttttatttgtgatcaaaatatactggtatttatgaactgcatatgctccggttcgaagtatttttcaccggttcaattcaaccggtccaaaactattgaaccggtggttcaaccgatttttaacggttgaaccaatgaaccgacatcctcaccggttcgattgtcggtccggtcctaataactatgcccccgagcgagcgtgtggtgcgcgcgcagcgtgtctgttgggtcgttcccagacccgtttgggaaccattcccaggcctgttttgtttcgggctaacgtttggcccacgaaacaacaggcgcatccggttttctctcaggagcttcagcatttggaaaaagtacaccgaaggtccctgaacttgtcatcgagttaaaaaaacgtcccaaaccgcaaaaccagatatccggtgtcccttaactaatcaaaaccggtcacaatagatccttcggtggttttaatcccggttttgtcctacgtggctgctaaatcagcgttagatccttcggtggttttaatcccggttttgtcctacgtggctgctaagtcagcgtggctgctaagttagcgtggaacccacgtggaccccacatgtcagggtccacgtcatctctctctctcccttcccctctctctcttttctcctcgctcactcgctggctggcgcgcgcggccgctggggggcgcaaagagggcacccgccgcgtcgttgaagttgggccggagacggcgaggtaggccgcgacggcggcgggggagaccgggtcggcggcgaggcggcggaggaggcgaggggtggggaggggaagggaaggggatggagttgagggcgcggcggacggcggaggtggcgcggtgcccggcttggagcggcggtgtacgtgtcgcctggttgctgtcgccggcggtgcgggggagtgggaccgaccggagccgccatggcgcgcgtgcttccccatcgccggggaccgggtcggtggcgaggcggtgaagaagggaggcggggaggagacgaggactagctaaacctttgccggccgctctccgcgctatcggccgctccgcccaccgctcgcccggtcctccggcaggccagtgcggcggttggagctgccgccgtcgctccgccctcctcctctcccgcctcgccccggcgacctcctcccgcgtggtcgcgtggtcgttggcgagacggaggtgccggagatcgtcaaggcagcccaggacgcggtcagcatgcatgcaatccttatcttctgctgctgcttctgcatcatcgtttcagtttaagtttcagtttcagttagttgtgaggccattcctgtgcaatgtgcgtaaccgtgaccaccgttgtgtctaggcagtgggccaaagttgaggacaagtacgccgtcaccgccatcggcgtcgccgcgctcgtcggcctctggacggccataggcgccatcaaggtatacgacgcgacacatatgcttccatatatatatatatatatatatatatatatatatatatatatatatatatatatatatgatctcttactccttcaagttcagatacgatgcttaatttgattttcttggtaatctgcatatcggattaggccatcgacaggcgacaggcttccacttttgcccggcgtgcttgagctcgttggaatcgggtatacaggcattactgggtaagataaaggccttcagttgcaaatttcgttgtcacatagggagagaggtagtgtaagattgcttctcttacgagctccaattatcatgtttcgtccggaggatggcttcgtcgggacgccttctcccgcgtcgccgccgccgccctcatccgctcccgccgctccttcgatggttcccgcgacgacggtgccggttccaggaggttgtcgccgatggcggcggcggcgactacgacggagacgcacggacgcgctacagccgctgccgccgacggagccgctcctggtcagacgcgctaccgccgctgctgccgacgcgccgacacgctaccgccggtgccgtcgacggagccgacgacttgtctgggtgtgtgtaggagggaggaagagaggaggaagggagaggaggctgacgtggatagtctgacatgtggggtccacgtgggtcctacgctgactcagccgccacgtcggataaaaccagggtcaaaaccaccgaggaatctaaagcgaacggttttgttaattgagggatgtccagtatctggttttacgattgggggatgattttgtatctcgatgacaagttgagggaccttgggtgtactttttcctcggcattttggcctcttctttgtgtaaaacatgtctaacattttggccagttcatcttcacatgccctaatctttttttttcaaagaatttggtgctaatctgaatcaacgatgggct

SEQ ID NO: 77378 - DNA, 2937 bp, Oryza sativa
tatacatgatttattccttattctaaaattgaaataaaaaattaatttgtttattttattattttttatcagaagaagtagactaattttgtattccagtgatcgctcctaaccgttctacgagagataaattaaggttaaattccctagacaaaccgaacttccatgcgccgatcgttaaaatctgtattctaatgatcacttcaaatcatccattgaaagatcaatcaaggccaaattccatggacaaaccgaactcatcttcacatatggtcttctcaaatctcaacgcgaagactattataaagggaaagggactcccatcgttggaaaaaagatgtgaaaaggacgggcatgaatcatgagtgacgcgtggaggacgagagcacggcatatggaggaaactcgtttgcagcttcagcgctgcatacttgtaagttgtaacaatcatctgatgtgaaatgaacaagttgcatttgccgtggaaaattggcttctgctatgcaaaatagagtccatactagtttagatacaagttgtgaaagtcgggcctattgaaattccgatcctacagttaaattttgatatgtagtttgaccattcattttatttttttttaaaaaatacaagtattaactattttttgtaacttatatataaatactttaatcataatctatctatatttacatatttgtattgtttttaaaaacaaatgaccaaacattatgttgaggcctaactctatattaacttgggcacagatggactgggctaggcacgacaaggccatggcattaaatgggccacttttgggctagcccaaatctgaattgcacacggctgtgccggttgcttcaagtttgctgaggagcacctcaacaaagtcaaatatatctccaattttgacgggttgaacttcagttttgtgttctaacatgactaaatatcctggttattgttggaacatgttttggctgtcctattgttctgtcagttttcaattttcaatatgctcttgttgtcattctgaatcccgtaactgctctgactggatggagtagtctctgtttgcttgatcaattttgagcccctgcagaacagcaaagtttcttgcacatgacttttttttgttgcaatgcagcttcaagcttacaaaatgggatatcttatcttctaattgggtcatccacatctcaatttcttagcaactcgattaccaaaaagggtaaaaatatcttcagtacgttgcagcctcgcttggacaatagaagagagtgaaaaatcacagtatagaaacaactcaaacatgtaatagtatatagaaacaagcatgatatgatactcttattccaggagcaacttcaacaacataaagatctgtgtccactttaacagttattacagaacttgacagtaaggttctattattcgattattattgcttctgtgccatgactaacagaagcacagaaagaacacccatggccacaagcacaaaggtgatgctgtaagcctgtactggagctccagggactcttctctcacaaccagagtggaatggcctagtatgggcagttcttgggcagcttgcggatcacattgttcttcattccaatcttggtacgcatgttctccacagtcttgttcattgctcggagagatttcagccttgcagctttctccttcgactgaagagtcaccaaacgcattcccttgtagctgaaaataagagaatcaggacatgagaaataataacaacactgggcttcaagagttctactgatcttatcgatgtagcatagcactgcaaataaccaaatggatgggaataatagaaaagaaagaaagaaaagaagaaaggtttcggacctggaagccagggaaagtggaagaacacgatccgttgcaacaggaatatgtggtttcaggcgatcttcgtaagagaatccccaacaagaacgaagagccctgacataagctgcaagattttgcttagtatcaaaagactcgagatgatgctcagcccaaccgctttccatctcaactaactcattatcctcttcttttatccgcttacaccctgtttggtaaatggcaaatgggttatggaggttggattggtagatggaaatgagtgagtgaacagttaggattaactggaggtgtaaaagaatggatgctaggattgaatcttacaccttggttggtattcccaaaggccaatgttaagccagcactgaaagtcctcatcctctatatcagcaaaactgcaatgacaatatcagaaaccattggccgttagatctacgaagactccacttccactcaccacaaaatgtaaattgtgatctcgaaccttggcctgtagtgcgcttcttcgcccatgagtttcctcatggcctctttggaaaagctggtatctatcattgcagtataaaatcacgcttcacctgtaggtagaacaaccaaaacaacctcattattgaaaaaaaggagttaatttactcaaaaagcaaccccatagatgataaaactcgatccggaaactgatcggaagcaggcccaattcctaaccagctcttctcatatccacatggaaccaggacacccaaatacatccaccagctatggaaaggagatcaggagagcgcctcaaaattactaacacaggagtataactccaaagctaaaaccctgagcttggtaagaactagccagaccgaaacggaggaaacaacccaaaattaaattgatcaaaaactcaatccagaaatcatattctgcgacgacaagaacctaaatcaaaccatgaataacaatctaatctcaaacgggccgccgtcgatcgccaggatcccaggaaaaaagtacttcctccgtttcacaatgtaagtcattctagcattttccacattcatattaatgttaatgaat

SEQ ID NO: 77379 - DNA, 4291 bp, Oryza sativa
tcttcaaaaaaaatatgagagtattagattttttttctaatttttttactaacttttttttttgaattttatgatgaaaggaaagaatagagaggagtataggggggaggggcaagttgatcgctcccagtgatcacccgcccattagattcccccattatcttgacttgtgctttgttattgattaaccaagcatttcattaactcacaaaacatttagctcatttcttgttaactcacaaaactgacgctcatctaaaggcttagtgaatatgtcggttaattgtttgtcggtgctcacaagggataggaagatatcacctttggctttgtgatctctcaagatatcacctccatgcctaaccaatttaaccaatttgcctgcttgactcgttgtagtggtccctgcacaaagcagagacatggaatgtccgtaggcacttgccacgtgcccttagcgttgcccacttgcatagggagagatcaattggggcgacgttgtgtatagtcactgctccacaaccctacctatcggtgtctaggcagagtgggtgaaaagcggtagggctagaagagactcttggagtcaaccgcaccgcctggcagctcacaccgtctgacagtcctgcatatctcacaccttggcgggtggatatatgtcacatcacccttaatgggagtaacttgcaattgttgatgcgaaacacggtggcctaggagttctgcttaactccagtgcaggtccaaggctagcctcgagtgtgtcaagggcgtgccagctgatttgatcctgcaatcagcaagaaagacaaaagcagagttagtcagccgatagccgatcggccgacaagccgatagtgtatcgttggtagtctcagccgatgtagttagaccaaatcggctatggactggatagatgaaggaataaaagaccacatgcctcatcggccataatattgtctattaggtttgataaaaaaaagttcaagataatattaggagaatagccgatggaacagtatttagagcagaatgtatagataatgataaactactagctaatactctagtataaacttatataaacaaatcaatctatataaatatattaaatcatgatcagttagtgtttcagatagcccaggcgatactgatctaacttgatatgattatataggatgatttgtctatataagtggcaaatatacataaaaatagtaaataagcatgtatattaggtaagattggctggaactcccatactatctctaattataattaattccatgttagttcttagggttctaaacaagattagggatgatgcatctcaaagtaagctgagaaacctaaggtctaaacaatcaaggaattaatcacttttcaagatggtagatgccttagctaagctaatctagtaaggcaatttagacgataccggcaggaaccctaaagcgagaaccagccgataggctaaattgagatactaaggctagattaacgaagacatatgataatagatggtcatgataaaagaactagaacatctaaaatgacataatagccccgatagcacaagccattgagacgggttacctcttgttgagaaaactcgccgaaaataagaacaaaaagggtagcgatgtgctgaagttgtattggattgtctctcgtattatagttgtacggggttcatatttataccccaagtacagacttagtccattatggacatgactcaaacctttctaaagataaaatacaaacaagaccatatatggtggcctcttaccaaatctaacgaaaaccgacttaaatatcctaattaatagatacaattgccttaatcgagctctatctttaattggcaatgacaatcattccaatctaggcctataccgagcccaagttaaaccgtacgtatcggctgtatcggccatcgacctcatcaacttgatcaatatgaatctctgtttctaaccgatatggtgtccagccgatgcgtagtctaacttcaaatccaactcaattcaccaccaaatccgcttcgatcttcttccttcttttccaaatttgatgcaaaattccgttgttaatagcaatgcatgaggtgtgatggcacgtctcgctctagctgaaacatctaggcccccattgataattttgttaattaatgacaagcactaattgtggagtaactatttcatttcagtaaaatatttatattaggacaacatgatgtgtacgccaaggatgattaccacggatcaaaattgatggagcaaaaaaatgggataaaggtggcaaacctaactttttattttaatcgattgaggcattgggcgatagaattgtgttaggtttatttctagctttgccgtactatcaagaggggtaataactttggtaaagaagtgatcaaaatgacacattatgtcatttgcatgatggcttggtttgatagttttatttatctatctttctgtctagggctggtcagatcggagtgtcctggcaagtttgaccgagccaagctcggtctgaccgggcggcggatgagtccattgcacggcctcggcttcgcgatccatagccaccagagccgacatcggtgttaccaggtcgagacgggtctgactggagctgctagcgttctaactatccgagccacggtggtctgaccaacaagtgttcggccacgcattaaatgcaatcaacggctagttttttagccattgcccatttgccctaaggctggtctgaccgaccaccccttggtggtctaaccgacaggtatccgagggttggggttttggcccaacggcttgttttggtgggtagggatataaacactccctcaccagccaccaaggttctctcttggcgcattattcactcgcatacaccccttgcattcactctcacaccaatagagcttttagttcattcatgggggttgggtgaaagtaaattgacccaattcaagtgctttgcatcgttgaatgagctagtgtggcacttgatcatctcccagccaggttgttacttgttagtcttggaggtaacagcttggagtagttgcccggtgacctctccgtgaagattgtggaggaggctcggtgatggttgtgagtggtttggtgttcaccatgatgaaccctgagctccactcgagacactcaaggctgttgttggaccgatctttcggtgagttgaagataactatgatttgggagaaacgttgacgactcgactacaaccgtactagacattgttgtgttgcgccttagcgatcgatacacctctccgtgggttgttgatcttgccggtgcagatcaaccttattcctgcgagcaaatagaagaaacaagcaagaacaagataaaagcaatctgaattgcagataggaattgaatacaaatgataggttggggttctgtaacgagcaaaccggcgatctaaccgatcacgggattacccggcaaagtagcaaagctaaacttttatctaaacaaaacccaagaaactctaaaggggtacctaactatttataaaggtgtgaagacaaccaagtggactctagggtcgtgctccacctggttggggcgcaccccacatgggccccacttgggccagggtcccaaacgaagttacaagcccaaaggcccatgacaggtgacacagcaccttgtttttgtgtttgcggctaaactagatggagtctggtgatgaggctggatctgttggaaagagaactccgagagctttccatcaagtactcatgggccaaaaacggaggtcgtatgcagatttggtagccgtttgaagtcagcaatgtagcaggtggccgaatcggattccagcacttggaggacttgaacttgatatcttgttgttcatccatgatgtgagcaacggatgtatccgtagtagccatggtcacatcacaccaccttcagagtgaaggaagaactagggaccctagtgatcgaggcttggatagtccacttcggggccggctcccaccttgctcaccacttgacgaaggggtttggtggcttcgtggtttgagcggtgaagttgggcttgcctcaacggggattaggaaaccgatgagtttccgaacttaatgcattaagtaaatgaaacggttaaaaaatttcttgtctcctgtctcatttacttaatgcatttacttttgtgcagtatattttcatagacatacttgagcccttatcaccgctgaattgcataacttaatctagttgcttagttagtatagttgttcatg

SEQ ID NO: 77380 - DNA, 23399 bp, Oryza sativa
cctcatctaacagctaggattaggattgctaaataaccattttacaggctgaaaaaactgcaaatctttctttatctctcctaaagcaggcagggcgaggcctgggggaaatctcatctaagaatcaggattaggattgctaaataaccattgtgcaggatgaaaaactgcaaatctcttttatctctcctaaagcaggcaggcaggcgaggcctgggggaaatctcatctaagaatcaggattaggattgctaaataaccattttacaggctgaaagactgcaaatctctcctgctaagtcataggtgacgtcatgcatgttaatattattacttcagcacgtcataggtgatgtcatatatgttaatattacttcagcattatcttgttggtgtatttactccatatataccacttatgcttccctagtttcttggattattttgtgacataaaaaaaaacgaatgcaaacatgagacgagtatgcatgttcaaaatcacagaaggtgatgtgtttaccgaagtcataactcttataccggatacagtcttgtttccagtaagcatgatactctcatttgaggtgcaaattaaacaatataaagatctattgtttttgcgaatatcacaagctctctgccatggctagcagatgcacaaaaaacagccattgccacaaagatgatgctggagctccaagggctttgatcctgcaacaggtggcatcgactaatatgggcagttcttggggagattgcggatcacgttgctcttcattccaatcttggttcgcatggtctccacacctgtcttgttcattgcgcggagaactttcagccttacaacttgctcctttgactgaactgtcaccagacccatgctcttgtagctgatgaggagaagcagaaatcgtgaataacagcatcaaactaaggagttgctaagattttattgatgtaacatggcagataaccaaatggaggaaaagtggacaataggttcagacctggaagccagagaaagcgcaagagcacgatctgttgcaacagaaggacgtggtttctggcgatagtagcgaataaattcccgagaaccaagagttctgacacgagttcctttctcactcttgttcgttattacaagctcagccccaccacttcccagttcaatgttatccttgtcatctgcagcaaccaactccttaccctccacatcagcataactgcaacgagaatatcagagaccattggccgttagatctacaatgattccatgcattcaaccaaataaagaaattttgatctccagtgctaaccatagtacctacaactagggctctgttcaacatgattatgatacataacggaggaagaactagtatacccactatctatatcatcccttatggaggaagaattttgatctaccacatgatttttcaattaaatctatagtgctaggattgttctattataaaagtctcactaccagtctgagaatataattcagtcatggaacataagggtcaaaactcaacagacaatagcaaaaactattcagtcatcaacagcagatgctcggggtctctattatttgtaaaacatgtcaaacagtagcatggcacacaaaatgttagtgagtaaaccaaggtacccgaaacccacagtgcaattcatttatgtttaactcaacattcaaacataataatgaaaacaagcaatattgaactattgtaagaggaaactcttaatagaaacctgctgctgtaatcatagaaatcttcaaggtcagcatcttcatcatccccaccatctccatatcgtactttgcagtgtccttttgcatccatatgctttctcacagcctctagactttggaaaggctggcatctgtcattgcagtataggcatataaaatcacgcttcacctgcatacgataatcaaagcaaccttatgattaagattatagtacccaagaaaagtaaaagagaagactttacacaaatgaacaatgcctaccttcagaccaacatatataagaagaccatttggatctttcaagtattcgctatcaggtatgaaaaacccatgctttttgtgcatgtggaccatgcaattctcaatggtgtcatgctcaagatcacacatgaagcagaatgtgggatccaactcttcaaactcatctatctcatcatctgatttggaggaatgctcatctacttgcatttccgaagtcgactctaactcacttgggtccacttcaacccactcttcctcctcatcttcatcttcatcctcttctactgcagatggagccctgcgttgaactcgctcaggacgaggcttgactatggtaattccagcaatggatgcattaggctcctgagaagctttcatgagatgtgatcgtgaattaagatgttgggcatgagcttttgagctcctgtactcctttccacaaagagcacaactgtagagcattggagtgctatcagagttgctcccctctgctaaagcagtttgtctagccaaaaacagagcctcagtcactccaggaactccagccacctgacacagaaataaatgtctcggtcttagtctcacagaagttcaattaataattctctagaagcatgttttccaatcataatgctcaagatagacaaatttctagcaagtatgcttctacaacataatgtcacacatcgacttgcatctatgttgctccctaagaatttacccaacaggaagcatgctttgcaaggataatcataatgagtaaaatagtttgtctaaaacaaaagatgtaaatctacatcaactatcccatataggtttttgtaacaacatgcgggatatttctactgggaacacgacaatgcttttttaaagggcatctcatgcatgaacaaattcaccaaaccacagccactcaatgaaatctctgccagcgccaagaggccaacagagatgctcgtgtaagtgtaacacatatagaaagctctcctctcgagttaatcaaagcattagagcctccagttcaaatttcggccaccataattttaccactaatattgccttaatagccataggaaaatattcatcctgaaattctccaaaatccaggactgaccaatttcaggtggaaaaacaaactatttccaaatttccaaacttttaacaggcgacttcaaaacaagagcaaaattccatcactgaagagttcgcatgggcttttcctacactcaaagtttcaaattcggtccatatacgcgcaacacaccaaagtgcctaactaaagaacgaatcatctcctacatgaacggaaaaaaaaaaccctaaaaacaaaacacgctccctaatcgacctaaaaccccgagaggtcgatacagataggaaggcggccaggccaccccacggtggaaggtaaacgatagtaccttgcgcttgaggttgtagcggtgccactcggagcggtagtggaggcgctgctgctcctcgtcatcgaaccccgcgttgcacgcgttgcaggtcaccgtcggcatctctcccttcccccctcttcttccttccccctcgctcttggcctcgattggctttggctttccttgccggaggcggaggcggtgaagctcttcctctcctagtctccttcgggtttgcctctccgcggcggcgcagtgagttgcgggagaaaaatcgaggagtggcggcggcggcggcgggtttgattgggagaagtagaagagaggagaggagaggtcgaggcgaacacgctctgtgctgacgtcggcgcttcggtgaggcctccaccgcctttgggtttaggcccattggtatcagatccaggcctttctaaatgggccctcaatttggactggtaaggttacggcccagtatcctggttaccgaagagaaaagaaaaaaaatctgaaggttctcctccctcccccaaagtgggaaaatgaaatgaaagggaaaaaaaggagtattaaaaaaaactaacgtaagtttttttttgttaaaaaactttcaaatgcaactatagtatagttgaagtgtaattgcattgtaactgtactataactatattgtaaccatgatataacttatataaaacttacattcaactatggtttagttaacttatataaaaaacttatgaaagttttctagcaaatccgaaggaaagagagtactcacgacaacgcagcatctctaaataattacagcacacaaggatagtgactgaataaaaagtgaacatagaaggccaccatatgatgattttctttcttacggatctgtatggctatatgaaacctatgaaattcccttgattcagaaccaaatcacatcgacagtagtggaaaatgagcattgtttctccccaggtggaaaatatttggattttttttaaggaagggcaaaagctttgacacttttgtaaagtttgggaatatttgattatgtgaacccaaaacagagaaaacatgttgctgttctattattgaaaaacaaaggaaaaatgccgctgcgcaatttgcagcctagaacggttaaaaagagaaaagggaaaaagaaggaaagaagagaaagcctcaacgagtataaatcatagaacactgtcactgctactccattgtagtcagttccatctaaagtttggaaataatgaaccagaaataaacaatcaaacaagtgccttaggtgtctgtcagtctgatatgaatctcaagttctctcaatcttaaagcaactttttttttaaaccgtatcttacagcaactagcaggtatagcaacaagctttgcggcccatagctcaacgggcaccgggcagctagcaggtttcaagcaccgaatccaacaattgaagaataattttgaatcgcatggctacaatatgaccaaatattctgttacaaaggcatgaaaggtaaaaatgttgctaagaattcttatatcctaaaaaaacaacatgtgttatagcaacatacatacttacaggcatgcattatactattcttcgtcgtcactgctttgctcaatcctagccttcttcacttgtatttgcatggcagtttctggtcttctcttagcacgatggacccgagaaggtaatcgaatcgttgacaatggcaccatgactggctcagcatcgggtgtccctgtaactcttacaagacagagtcccctgtgatcggcttgtctcaatacaaatgctcgtttccatttctgatcaattttcacttcaataggcacccagggtggcatggcatatgcaccagagaccagcctccttgggccatgacccatttgagcactcggttccctacacacaagttattttgcatcaaatcatttgatacaattacacttacaaaataattgtacaaatctgccatatcatgttcatgcaaatatggtaggaactaccataaacacttattgttatgcgtgatcctacgaggcaatactaacaacggacttatggacatagtgcaagcacaaacatataagaataaaacaaatgcaaacagccaaacattataatctgtaaaagtgcaaaaacttctggaatgaatgaaaaataaaactaatatcagagcttcaggaaagcaatgcaccatggtaggagacaaggagtcacatcccggcaaaaaggagaagtggtaacgatctaactgcaggagtatttgcgacttcaattttttttaacgcaggattgatataataaaagggtaacaattaataactcctataattatcacctataccttgtaataaaggaaactatgcttcgactgttcagaaaatacagcagatggatcttcacgcattgatcacaaggttgtttgaacagttgttaaattaaaaaataaaacggtccatgaggattctttagtatatcgcatgaacttgttccactcatcacttgggagagaacattcagggatgatattcttgtggagaacttttttttaaccaattgtaactatgtaaaaaaaaattcaatcctacattcttatcgcagttttcatcactgaagccaatgctctagaattcggccatagacgcacgcctattaggcgttaggctgcaggcatccactgcgatcaggcattagatggctaacctgccttgggtgcccttgggcaatatgcttgctaattgcttggaattcactagtcgagttggtcctaggtggtagatgccaacactgtagatgtttagtgtctggcgtgttcatgaaccatgattcaaacaatggagcaacatcacttcttatggtgtcactgcacgatttgtcagatagtatctatttccttgcaaacatatctgttaccacatatttctaatattcaacagcagtctaaagcagcccaccggaaccattaaattgccaaaaaaaaagtcaggggcgggaggccaggaagcaccaaaagccatgcacccaagcagttaggagaatatgaggtaaaaaaataaaaatcaccaccacttttgtaggagggaggatttgaacacgggtgggctagcacaccaaccattaactaacaaatccatactgttgcaaatttcagatcgaataactgcagtatcattaggtgcataaatggtaacatgagtagttcaggttgctcatatatataatcattccaggaatggaagagagcatcaataaagctgctcctatggctgctcgcatataagcagcagacatcgtttcattaatcacagtatcacaatcaccttatgcctcaacggcacaacacagaatttccttaatagggaaaaccaaatttcaaatgtgttgtctgactatgcacagacacttgtaatagcttagacctgacactttaaaacacaaggagtagtggagtaccagcattgccaactaggtacaggaggcaattctgtgctcctccttatgttgatttctactgaatcttaaatcagaattggaacatgggcactacctgttttgatacccctacaactctagtcctaggatgaagtatacaagcactccagcacaggcctcgatttagccatgcaatgcgaatcgcaggctcacagcagcaacacaaagcagaactgcagtgacttttgtggcgttccgcacacaacaagactcgtacctagtgagatcctacaggccctcccaaattgactttcaccacaaaccaaatcccagaaccagataagcatctcgagcaaatcggagattcgcaccacggatccatccaattcttttgaactcaaactgcgcaatccccattgaattgagtacaacatactcacgaagtaccatttcacacaaatcgcaattcatggattaattaacaagaggtcctatcatcatattatgagatgggaggaagagagggatgataccgagacccgccggcgaggaccgaaagagcgccgccgccgacgacgaccgcacggagctgcagcggcgaggcggcgagcctcctcttcgcgcgccggataagctctccttgagcgcggcggcggggcgaactcttgtattccttctcgaaagcggctttccctctttccatgctgcgtttccgccttccagttcaggacgcgcccagaagggtgggaattcgaacccgcctctctgacacggaggccccacctgcgggtgacagctgcaattttccccatcccccacgccacgtcatttttctcacgcggctccgatttttttatttttcccgctcaaacaaactccgcctcgtctcgtctcctccgaaaccgccgcgctccgacgccgccggcgaaatggccgcggccgcgtcctacttctccggcacggcgctcatgccatcgcagcgcagcggggcccccgcgccggagtactccgccgccggcaccggcgccgccgccgctccttccccttccaaggttcgtgatcttccgtttcgtcgtaaccctatctccgtctcgttctcccccgaaccctaacgccgtcgaggtttccttgtcagccgcgcgacccccgcttctccggatgcgtccccgccaccgtgctccacatttcccggtccttcgccgccgcgctcgccgcggacggtgggggcgaccccgtcttctccatcgacggcgtcgagaccaccaacgtaggctactcggcacctccacagcttccctcaatttattttccgtggccccgcgtaatctgtttttttttgggtgccgttgatggttttaggttagggttttggggagggtggtgagcgtggtgagcagggatactgacgtgtgcttcactctcgatgacagcaccgggaagatcccactcgttcggtggtgagttgcaattttgtttcccctttcgcattgaatgctgttgcgatgcagtacatgtgacatttttttttctgggattgtaggatcactgatcagtcggatactcgagacacgtcttacattcagtatgtgatgtgtattagtgtataggctctgagatgtgcttattttagtttcagcgattttatattctgttatttatatttcctgtacatatgaagggagggagtgtatgtgaaggttcaagtgaacctcatgggatttcaagctaagaagcagggtcttgctcgatctatcaggtaaggtacttgaattccttttgtattgatgtggtggtactctgttaattcacctagaaagcttctgctcatttgaatgaagtactactatgttttttaaaagttttacctctgaaattcatagttctactggagttacattaattttcaatagcaattatgcacgctctgaagtttgcatacaatgctggcaatctttgttgtgcacttgcacccaaatgtcttggccgtttgctttgtttgaagatcatgggctcacaaagtattattttgtggataatacttgaactctgttcttacagtaagttttcttgaaatatattatatcatttgaatggagtgctaatcttggatgacttgattagatacatggtggatgcaaatttagaagtgttttgaagaaagtatggggatgtttgagataaaggttttattgtatgtgtagcggctatctttcgttttcttttctttttgtatgtttgtgtgtgtgtttgattcttaacactatcctctttcagagtagttttctctgttcatctaagttcaacctgggtatgtcttttggaacttgttgctgattttttttcagatagtaccatcattagctgttctaatttattagatctttgcataaaatgtgctgatttttccttcgttgcacactacctttttcttctatttcttcacctcaggtgttttggaaccttttctttaacttgttcagttggtggacatgttaaatctgttgcactgttattgattgatgtgtattgtatgtacttccttaattgcactcttttttgtcatgtattgcataaccatgttgctatcgtgtatctgtattctatctctgttataccttttctgaagtgtactgttggatgaactactgatcctacgaacaagctggaaactgaattaatcaatccttgcttcgctgacttaattcagtacatttctaatacaagtgaagtaaatggtctgtagaaatactagctcactattgtagtgttagtttatgagtacttgaggaaactatatatatttgctcatttctctgttatttactaagagtacttctattctattaagcttcaaattgtgattcgtgtatttgcaggcctattaacaatttcaacgaagtggtgctacatttcattgagtgtatgcatgtgcatttggaaagtgttcaatcgaaggtacataaagcaagtaattcaatattatggcaattctattactaatttgacaatgctagaagtcattaatgatcgctacctttccattttgaagatgcaaaggcaactccctccttcagtccaaaccaatgaatacactcatgtgccctcatctggtggagtgagggattaccaagttcatttcactcctcaagtaaaccaaggactaccccctgcagttcaaacaaatacatctacttatgtgcctcttttgggtggagttagagatcatcaagctcattttgctcaagtaaaccaagggcagttttctccggcagttcaagcaaacacatctacccatttgcctttttctggtggagttggagaacatcaaattcattttactcctaaagtaaaccaagggcaatttcctccatcagttcaaacaaacacatctgctcatgtgccttattctggtggatttagagaacatcaagttcattttacacctcctgtaaaccaagggcaatttcctccagcagttcaaacaaacctgtataatcatgcggcttcttctggtggagtgagagaacaagttcatcttactcaagcaaaccaagtatgaaattttacatatcgttttgagaattgcttgcttataaaaaatataacatattaatagtatatgatttagttggtatatctgagaactgagatttggttttatttgataatttgtgtcagtattatggaattgagatttttattgccttttccctagcatagtttttagtgccttccgtttaattcaccaacatgcattctttaaggccctctttcttgttacatgttcactcttacctgatcttgttagatcttttatttcccggcccagttttcagcttactcaagcactggtggactacagcatgacccacaaagaatggttttggaagctctgcagcaaccagatatactgtaagtgtattgtcttaggcactgttaaccgatgatagcttattttggatatttggactgactttttatttccacagtgctctcgaacatggagcacacgttgatgaattggttagaagaactggaatgcccaaagcaaacattatgtactctctctctctctctctctctctctcttatgtatatttttttttcttgtgtgttactagtattattattttttaattgcacatgaatgatgataagctcgaccgtttacaatgcaggggggttgtcaagcatctggctgcagcaggcttcgtctattggaccattgatgacaatcatgtcaagtctatgtgtaatggttgatcaatgcaatcatcctcaagactagtatagcagtgtgagattaagtgccctgcggatactaaaacttcgtggcacatgctgtaagtaactcatatagggtgtgactcagtcagtctttcctttcaataatcaagtagatcaagtagggatattatggcccttttgcactcggaaactgtgattgctgaatggatctgtttattactgcatacaaaggtcactggcttcttcaatatacaatttacacttttcatacttaggtttgctaagcttggttgtctgcatatatacttattatatgttatatcactttcttactatgtcaatgattcttttcatgcttatgggattttaattcttattttaaaataatctgctgctttaaccagatatagacttcggtaaattctgattcctcagcacaagtggctacttaggttttgataaaagaaaaaccttttgcctggtggtttgcggttgtccttgcttatcaaatacattgtttatgtcttgtccaattcattgcaccatgagaatggaataagaaacagtaggaatgatagataggggtttgcttatcaatgtcaggtcaactactatttgtttttactgttcattgtgcaatgcattttgtaagttttagttatctttactctttataggttgtcttctcaaaagtatgcttatcttctttgggcattgtataagagctttagtgtacttttctgaggtgcatttcttaattgctatctagtgatcataaaggtacacgtgctatcctaaagtttgtgcaccaaggattcttaatttatccatctaactaacactagtttgctaatacgtgcactagcactggaaccccctacatcttattcttatcctagatcattcggtattacatttattctgaagattacatacaatagctatgataaattgactataaaacgtgtagaaagaagtcaatatcttgtttgagatggttctaaaacacccttggattaggtacactgttcgattctctgtcgtgacctgttttaccacgaatatgcaaaagattggcgctgtgcatcacttcaactttgtatttcgaaaaaccaaaatacaacgttttacatgagaaaccttggcctgaaaaaagcatctaaggctactactctgaaataaagttgcggttctgctgttttgaataatcacgtgtccatttttcccctgtatttcactcacatcggtaaagaaatatctcaaggctgcacataacatgatgcatttctgtcaggtccatttggtcttgttttccctgtaactctttttagttttcttttgaaatgaaagtagtttcttttctgcattcttatcagcagatttcctttagttgtccatgcataaatatgttacgatgctcaacatactgaaaccattatggagatgaaagcaatatggcactagttcttaaatgcacaggaacgtccttaccagcttattttcttctggtggtgcattatgtggtttctgataatatattaagaaagatataaggatgaaggagtagcaaccaactggacatgtttatctggatctttctattgatagacaactctctttaatattctttaatcatgtcacaaacatttatacattcatcttacaccttactggccagcattatcaatgtgtggtccttaccatgtctagatgccttcctacaatccagcatcgtcaaactataccacgggaaaaatgggctgatgcattataaaaagtgtagtcttgcatttatctttgtgagggaattttaccatgatacattaataaataaattaggttaatgagaacttttttccactaagtgctaatcttaataattctagctatatttcagagaaacttatggtattgttgaacatcgcattcttccattcctgtctaacatttgctggtggactgtcagccactgggtcaacagtttttgtcaggcatttagttgctatagctttgcaagtgattacaacttacaagaaagagatggacaaattgctcatttcaatgtattaggtccatgctgaagttaatcttatgatagctgagattcgttttcctactgatcatgcaaatgttgctggtaattacaaagtatttatattgtcgttttcataggattctttttcctgccttgcatttttttttgttgctggaaaatgggaatgtttgccttgtggttttttcagggcatttcatctccaggttgctcactgaaccttctgtttgtcttagtttaggtaagcactgggaactgtcccactctggtttgatcagttgatcttttgagtatctcatatctgctagccacggtaggtttgactgtgctctaattctgaacccctcacttctcatttcttggaaccaagcccttgtttctttctccaacgagtcagatttggtcagaccttgcacgcttggataagcgttagctaagccatgtgtatgtaggtatttggttctaggatacctaaaagtcttgagggccaattattgagagctgatatattacatgcatcaattctttcatgtaccaccggtttctcctttttgctggattcttttcttgggacttctctcacaggtgtagaaaccacctcaatctgtcagagaactatttcagaccaaatcatttggcacaacactgaagcaagcacaaaggtttcaggttttgagtgtaactgttcatagtgtagtaccattagacttaaggaacacgcacaaactttgcccaaaaacaagcacattattagtaaaccatacgcttggaaaccaatgtattgtattcccacctttaagcttttggaccaaaatctctctttctcaaggatgtttttcttgttaagttctaggcacacgcctagacatgctcaacaacttccagagtctagagaagataaaaacacacctgctgcacttcacaagttcacaattcacctcaacaactgccacaaccattaggattcatatctgaaggagcatccagcagcaggcaatttaggtcaggatggggtccaagagtcgtacaaatggatgcagcaccagcacgtaccctggctttaagggggtacagctcaacctgttccaaactgccatgccacggcattgcactggccttgagaaattggcacagcaaaacaaagcctacttggccacgaacccaactgcccgccttataaattagtgccacgctgtgtcgccttcatacacctgtaacccagctgaggttgcaggtagccttgactggtactctttcttcaaagggggggggggggggggggctctatcatcaaggtttaggtcagcctgtggccgacaaaatctcagtttgcttgctactattccgctgccgaattgatacattcatcaacacacttcccccccgtattttatgcgtgaaagtacactatcttttgatgttcatgtcaagatcaattggactggtactctggtattggtactacttgcttttcatagcctgttggatgatgataagatgaaaatcctttctatttacaagtgggcccagtggagagtaactatcaaaaatttcatcttgtaacaacatcacaagcttactcacaatcttagatactattactaactactaattgctcaaagatgatgagcaagaagatggggatgcagtgttgaactcctcttcatcttcgtcatcttcgtcatccaggtcatcgaatctccatagctcctcgtcgtcgtcgtcctccactgcctcgggcatcgtccaccgttcttgccggatctcgacgccttccagcagctccagcacctgctaccacaaccaatttatggcctacattactagtagtgctgttgcaaattacttgtgttgttacacgtaaaccaagcaacatcatcaaaggagtagtttgtgggttactgctacatggagacatgtgcttggggggcaccctgtcatgaatctctgccctaaattatgactgtttacatggaaatgctaaccatgctgatgaaaaaaatatttgcaagtaggtaaagcaatgtagtgttccatcgcagcaatcctacttgagaaatgggcaagcgttcgttgccttctgatcaaggaacagagtgtgaccaatcatgtttgttacctcggtcatggatggcctccacttcgccgacgagcggatgcacagcgacgccacgaacgccagccgccgcgcctcctcgccgtcgtagtcgccgccgatcctcggatccaccagcgactcgatcctcccctcgttcaggaacggcctcgcctgcaagtgcagggtcacaattcagtgacagtttcagaatttttcagtgatcaaacagtagttatactgatcgcgaatgctgaattacccagctgagcaagctcttgtggctgccatccaccggctttctcccggtcatgatctccaggaggaagacgccgaacgcgaacacgtccgtcttctcgtcgacgatgccatgcgtgtagtactccggtgccaaacacctggaagaaaccatgtcatttcagccaaaattcaccgtcaaacccagcaagaattcgactcgaccatgagcacagaaatctttacccgaatgttccttcgatcggggcgatcgcccggtgcgtccactccgacggcagccacttggcgagcccgaaatcggaaatctgtgataatacgatcagttcatgtcaattgaaacagaggaggtgaggaaaaaatggaaatgtggtggatgagatgcgcctttttttttttgaacggaaccagcacaagattgtgcttattcattaaatatagcatgagaaaaatacagctcctaaaaaaatttggattatttctccatttgtgcgtgtcatccttgcgtagtggccatgctaatctttgttgtatcgttccaattttatcggatgtctccgaagagactgacctgaggctggaagtcgtcggtgagaagcacgttggatgccttgatgtccctgtggatgatcctcctctggcaccccttgtgcaggtactccagccccctcgccgtgccgacggcaatggcgcgccgcaccgcccaccccatcgccggcgccttcttctcgtctgcgatgcagcaatcaaatcaaatcaagaaacgtcaaaacgccattaatggcggcgcgttcgtgctgttgctgttaggtgtcgcgttcgtgtcgctggtaccgtggaggttggcggagacggagccgcggccggagaagtggaagacgaggtagaggtcgcggtcgacgcagcagccgaggagggcgcacacgttggggtggcgcgcgtgccccaccgtgccgagctccgccaggaagtcgcgctcccgccgctcgcacgcccacgcgcccatcagccgcttcaccgccacggcccgcccgtcggggagctcgccgcggtacacctccgacgacccgcccttccccaccaggttgccctcgtggaacgcgttcgtggcgcggtggatctcctcgtaggagaagcaccgccacgccggcttccgcggcgactccggcgccgccgcggcggcggcgggcgtgtatctctccttggcggcggcgtcgccattgccgttcttggcgccgcggtggctgatggagaggagcagcttcttgaagctgccgctgctgcgcaggtacagaggcctcatctctcccctcgacgacacaatgccctgcggtgcggtggcgatcgcggcgtcgccggcgagcgaggtgatcagaggaggcgaagcggaggagggagacgagacggcgagctggtggtggtggcggaggaggaggaggagggaggcattgatgggtactaacgccgaggtgctctcgcgagtgccgcgcgagccgtgagcaaatatgaacgcgacgaggcgtttcgcggggatacgcacgcgctggtcacgcgtggacacggtcctccaaggaccgcctctgcataatgctatagcagattagcagagcaaacattctcctgaatttgacactggattttggtaatctgtgtgagatttgagaaattcttgtactgaaatcttgattctgtccgatgcatatgatcaacagttcatatacaacatgtgctcaacagtgttaaggccttcagggtcgttgataataatagcgaagttggtgatccatgaccatgttgcgcaacatgtttataggttgtaccaacacaaataagagcgtcatgaccttcttgaagcatcatcttcaagatcttgtttttccattgtcatgcgcttctctcagtttggttttcatcgttttgtcagttaccgttattgggttgtcgtgagcgacgagtagatattttctctgtgaggataattggagcccactgtatatcttctgttttagcgcttgtgttgggtgaggcgtttatgaccattataggttagcggcgttcgatcacacatagcagtgatcggtatggtgctagtttttttttctctaggaatgtatttggagctgctagcatgtgatggcgttgtgttcgtcataatcttgtatttttcatcgtgatttgctttgttaagaaaaaaaaaacatctggaccactctgctttccctggtctgacggagtgtgcacatacacaggtcacaggtggtgccgtggaacatgtctagatgggagtgtgacgacggggacaggcggcagcgtggaacggcagttgcttataaacaagggaaggaagcgttttcagcagcaggggaagggaacggaagggtgcacctcctctctctcttctgtccgtcttctctgtccttttttgctagtaccggttccactgtgcaaagggaacctgtctcgtgccatctagtactagtgaacaacacaacactcgccacctatgtgcctacgtgcacagtaacaaaaaaacgtaccgacggtgcgtaaaaaaaatgaccaggcatgtgagctagtagaatcagctagtagtaggagtatagtcacagtagtaataagcatcgtcacagatgtcaaacgtgtccttgtaatctcgcccgtgctgacactgtcgcgaagaaagaaaattttgtgctttgtacatgttagatttaattgggtaattaatccatttaaatcaattaaattaaataaattccaatgctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggttagttgatgacaattagttgctctattcctcttcctattccattggtaacttacatcaattactcttaattgattgttggttgatggttgtgtagtggaggatggttcatggctagttgatgacaattagttgctccattcctcttcctattccatgactcttactcttcatcttccattcctcttataaaatgggaatggatttgatctcccgcgaaaaaaagaagacacactttcatccattttccaaagctgttgttgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggactattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgtttattatcttgttattttggattaaaatatgccgaattatgaccaaatttccaacaatccaaaaacctgataggtcattttcggtagttggctttgctgctgcactgaaaccacatgcctttgatggttcaaactataagagatggaaagcacgtgcactattgtggttgacagcgatgcagtgcttctatgtttcacggggcaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcacttgaggccaagttcggagtttctgacgccggcagtgagctgtatgttatggagcagttctatgactacaagatggtcgatgaccgttctgtagttgaacaagctcatgagattcagatgctggctaaggaacttgagaacaacaactgtgagttgccggacaagtttgtggcaggtggcattattgccaaactaccaccttcttggtcggactttgccacttctctaaagcacaagagacaagagttcagtgttcctgatctcattggctctttgggtgttgaggagaaggcgagggcaaaggacgtccggggcaaaaaggttgagggaggttctagtgccaatatggtacagaagaagaaccctcatgcatcccacaacaacaagaaagtcaagcctgatgtcaaacccaaggctgcaaccaattttaagaagaaaagcaagggaaaggcaaagggagactgctttgtgtgtggcaagtctgggcattgggccaaggactgtcctaagcgcaaagacaggaagtctgccaacatgatcattagcgagggcggaggaacatcggggtacggtaaaatattacctacagttctctctgtttttcattcacctgattggtgggtggacactggtgctaatattcatgtatgtgctgacatttctctattttcttcttatcaggtcgggagaggttcctccttgttgatgggaaacgggtcgcttgcggctgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtatctaaatatgggacttttgttggaaaaggttatgacagcggaggcttgttccgcttttctttgaatgacatgtgtaataatcataatgctgtgaaccatattagcgagaatgatgagtctaatgtgtggcattcgcgactctgtcatgtgaatttcggttgtatgacgcgcttagctaacatgagtttaattccaaaattcactttggtaaaaggttccaagtgccatacttgtgttcaatcgaaacaacctcgcaagcctcacaaggcatctgaggcgaggaatttggcacctctagaacttgttcattccgatttgtgcgaaatgaacggcgtgttgactaaagggggaaagaaatatttcatgacactgatagatgattgcactagattttgctatgtgtatctattgaaaacaaaggatgaggcattgcatttctttaaaatctataaagctgaggtagaaaaccaacttgaaaggaaaatcaaacggttgaggtctgatagaggtggggagtatttttccaatgagtttgcatccttttgcgaagagtttggaattattcatgagatgacgcctccctattcaccccaatcaaatggggtggccgaaagaaagaaccgtactctaactgagatggtgaatgccatgttagacactgcggggctttccaaggaatggtggggtgaggcagttttaactgcgtgtcatgtcctgaataaaattccaatgaagcataaggaagtaacaccattcgaggaatgggaaaggaagaaattaaatctctcatacctacgaacatggggctgtttggccaaggtaaatgtacctatagccaaaaagcggaaacttggaccaaaaactgttgattgtgtgtttcttggttatgctatccacagtgtgggttatagattcttaatagtaaactctggagtacccgacatgcatgttggtataattcttgagtccagagatgctacattctttgagaatgaatttcctatgaaatatacacctatcacttctagtaaagaaactgtcatgccccatgagcactttgcaccgatagaacacaatgatcaaacgcctgaggaaaatcctgaggaggacaacattgtagatactcgcaagagtaagagacaaagggttgcaaaatcctttggagatgactacattgtatacctcgtggatgacaccccaagaaccatagaagaggcatattcatctcctgacgctgactactggaaggaagcagtacgcagtgaaatggactcgattatgtctaatggtacttgggaagtcgttgagcgtccatatgggtgcaagcccgtaggatgcaaatgggttttcaagaaaaagcttaggcctgatggtacaatcgaaaagtacaaggcaaggcttgtggccaagggttatacccaaaaggaaggcgaggacttcttcgacacatactcaccagttgctcgcttgaccacgattcgagtactacttgctctggcagcctctcatggtcttctcgttcatcagatggacgttaagacagctttcctaaacggagagctggaggagtagatctatatggatcaaccagacgggtatgtactagaaggtcaggagggaatggtgtgtaaactattgaaatccttgtatggcctcaagcaagcacctaagcaatggcatgagaagtttgacaccacgcttacatctgcaggctttgttgtgaacgaagctgacaaatgtgtatactatcgctatggtgggggagaaggggtgatcttgtgcttatatgtcgatgacatactgatctttgggaccagccttaatgtgattgaggaggtcaaagactatctgtccaagagttttgaaatgaaagatttgggagaggctgatgttattcttaacatcaaactacaaagaggagatgagggtgggattacacttgtgcaatcccactatgtggacaaggttttgagtcgctttggatatagtgactgcaagccagctcctactccttatgatcccagcgtgctattaaggaaaaaccgaagaatagcaagggatcagctgagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatctaaagggtactatgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctggcagatcagtttaccaaggggctaccacgtaatgtgatagacagtgcatcgagggaaatgggcttgatacccacctaaggttgcataatagtggaaacctgtccattatgatcggagatcccgtgaatttggatggtgaaacaaactattgtgtgactgagagaagagacccttgaaaagggctcattttcatgatgtgcttctcttctttcctgcatggtaggatggcttatgtcttaatgtgatccgagtggcttttccaagcagagatgttgacctgcagaacatcttagaaggaacacacctatatgagttcgactgctagtcacagtctatgagatttgggtgatctctagatactca

SEQ ID NO: 77381 - DNA, 23405 bp, Oryza sativa
cttattacattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgtttattatcttgttattttggattaaaatatgccgaattatgaccaaatttccaacagtacatgactcgtgtcgcttgtcagtgtcctagcttatgctgcgtctcatttcagcatttatgctcttgtcttgggctgtatcagagcctgggccatgagcccacgatgttgagaaggccaaggcccgtttgacgcacactcctcgattggacttgggcatcctaccttttgaatttgggtggatgtgacccctatcatcctaaacaccatcctaatactatgaatctaaaccaatatattatatttatctaaagttctttatattttaggacagtgagtactacgtagtactactaactagtactaaaagcttgttcactttgctaccatttttaacattatcaagttttggcagtgctaaattttagtaaggttacttaaaattttggtaaggttatcaaattttggcaagatttcatatgtggttacttcctccggttccatattaattgacgttttggacaaggttgaggtcaaacttttataactttgaccatcaataactttaaaaatatttagtttaaaggaactagaacaacatatatagatttgtcttttaaagtgctataataaagtaaacatgtatttatttattatatatattataataaaaaaataaggtcaaaatatatcttatagaccgtgtattgttaaaaacgtcaattaaaatgaaaccggaggggtactaaaatttgacaaccaatcgtttttttataactttgctaaaacttaataatgttgaaaatggtagcaaagtaaacaagtcctaataaactgagtcgttttagatctatgcttctcgtagctgctttgcctatccttgcagctgtcaaccgctagccactatctctgctatctttcacattagttgttttacggggtgtttagatccagggtataatattttgacgcgtcacatcgaatattatatatggtattgcatggggtgttttgatactaatgaaaaaactaattacagaatccgtcagtaaaccgcgagacgaatatattaagcctaattaatccgtcattagcaaatgtttaatgtagcatcacattatcaaatcatagagcaattagtcttaaaagatttgtctcgcaaattagtcgcaatctgtacaattagttattttttagcctatatttaatacttcgtataggtgttcaaatgttcgatgtgacagggtgtaaaattttagggtgggatctaaacatgctagtaggctggtaaaattttagcctatatttagtttgtctgttcttttttctccaactgtgatagactggtagttgctttaatttagtttgcctaggttctaaatgacttctccatggtaaagcatgtgaagtctgtatattcaaaagaactaatagtgcttaaaattattactctcctcgttccaaaatataacaatttttaactatcattttagacataaccttatctagattcgtagctgaaagttgttatattttgcgacgaagataataagaaattttttgtcaacgcatgaaaaatgtttgttcactgtgaatatcagatgatcatgctaagcatggcaaccaaagagatgttacctactgttagacattgtcttcgtatctttcttaataaaaaatggtgggacccacctaggagatgggagagagaaggaagaagaggaggggtgagtgacatgcggagcacacgtcggccccaccatttttattaatttgtgtaaaactgacatgtgggtcctatgaggtttattatttttttaaatcgaattgacatgcaagcgctacgtcaattgcacatcaaatgaatatcaagttaaattagctacgtagtcactacgtcagccaaaaccgctgtccaaactgccgagggaccttatctacactggttttgataattgagggacctattatatctggttttttggtggaaggataaaaatcagattcgttcacaagttaaaggatctcatataaacttattccaggtctaaaagagcttgtgaccgatcagccactgcccagtgcccactggaattgcaggagtactaaggcccctgttcttttctccaataaaaactagataaacttttagataaaagtggcattttttcaaacggttaaaaaactttcatataaagttttttaaaaaatataagattaatcaatttttaagtttgtaataattaaaacttaattaatcacatgttattaccacctcgttttacgtgaaacacttaatctttatttttattttcatcttcagaagatttaaacacaatctaaatgagtacattgaatttcttgggcaggaaagtggcaacggctctgcggccactcgccacttcgccagccagtctgccggcgtagcagcatcgccagtcgtcggttctaacgctagcagaatgtttgggccgtaatcggttgcacacgtctcacgaatgggcctagttgtatcatttgggccggtcgacttggcaaacaaccgggctgaatgggcctactctggtgaaacacgatgcgtctaacagcccaaggagaacgaaagccttcagcttcctcctctccccctgactcctggtctgtttctttctcctccccaatccttcgttcccagactcttccctaacaaatcctccatcaaatccccccaaaatccctagcggcctgtttggttggagggagttattaggagggattgggagtttagagggatgaggctattaagagttttgtttggttgggatacatgggaattttggtaggatggggatggggaattgaggaaggaactccctccttttcaatacctgggtagaggcaggtaattgggagggaattactcatttattttttctaagcaaatctcagccatctatttttattaatgacataatctccaactaaactccctatcaatttctatcacctctaccaaacaagatattgggattaaaaatcaaattcccatcttaatctcatcatcaattccctcatgcaaactcccaatccccttctctcgagttaccaaataagccgtagaagttttgtatcaggtgatgaagcaacctgacgctctgccttcctgcagcgaggatccgacagattttcgatggctgatgcggttcgtttctttcttcttagtaagcccgtggttactggttaccatgtgttcatggcttagtttttgcatgattccaatccaggagcattagcttatggtgtgccatggtcgtgcctaggtgccggcagtgaaggcgagcatgctgactgtcactcaaaatgccggtgcagctgtggctagcttcagggaacttgccttgtttcttgttcttgttcatttcgaccgttgtgccaccggaatcaccgaatggtttttgtccttctcaccgtcccattttaccatcttggaatcgttgcatctctcagactctcacagaaaaatggagaagaaatgttggtgctcactcaacatcaacaacttggagacttgtttacattttggaaaatggcatggagtcgctgcgtcctggtacagtatagaggagcccgcttgccagaggaatttggagaagatattttgttcacgcgccggcgaaaggtctatatatatgctgccaaccatgttcttatccttaaccttatgtattatgggaccaaaaaaagctgatatgtgagctctgaagcgaatgttgagcccctcggctgtgaaggtgagatcactaccttgtttttgaagtcctttacttttatactgttgcatatctgtaagattatgtctgtctacttgcgtacaattgttctagttggatgaatcggatccagaattcacttgatagttcattgactaaatttcttgctattacgcatgtaaccagtagagttttacatctaccgttcctatagctatttttcgtggtccttgcagtgatcagctgctagctattttagataatggattagattaaacccggcctctacaagctattatctctgctctcttatatttgtccaactgtggtagacaaagatattggttttagtttctttacgttccaaacgactttgctctttcacactcctggacgtggagaatatatttctaaaattgttaagaaaaaaaattccacgtcataaaaatgttcttccactgtcaatatgaaatgggcatgccaagcatggcatcaaagaaacgtatctactgttgtacattgccttgaatctgttggttacggagtatttttgtagtacccacaagcagggtttgaaattttggtaatttcgtcccccaccggcaagctcacatctcgcccgaaattttcgttttttttcattttttttgtgaatttggtcaaaattttattcaaaatcaatcaaaatttcaaataatttcggcaaaagaattcgaaattttcaaaatttcgcaccccccaacgcaaaaatactaattttgaaattgaaaaccctgcccacaggtacactatggcagaggtgagtatatcgagctttgcaatcaccgttcttgaaaaagctgcgtcttttggcactgactgggctgttagtgagataaagtcagcttggaacgtcaagaaagaactagagaagttggaaacatcactgagatccatatgtgctgttcttagagatgccgaatgcaagcagtctacttcccactcccttcaagagtggttggacaatttgaaggatgcagtctatgacatagacgatgttctggacgatgtttctaccgaagccctagagcaagaagttcggaatagtttcatccatagaacaaggaacatgcttacttatccattcaaattgagtcaaaaaataaaagaagttcgcaaaaaacttgatgagatagcagccaatagagcacagtttggactaactgagcatgtaattgatgtccatacatctgggagcagcaacagggaaacacattctttcataactgaaccagaaattattggaagagatgaagctaaacgtaagattgttgagacgatttgtacagctacagaatcaaatcctttgtctgtgcttcctattgttggtttaggaggcataggaaaaactgcactggcacagctgatttacaacgatgtacaaattaccgagacatttcagaagaagttatgggtatgtgtctctaatgtatttgatcttaagaagatcctggatgacataatgcagtcaggcacaggtaaaagcaacaaacatttaaacctagagatgctacagagtaaggtgcgtgggtttttatgtgaaaagagatatctgctagtattggatgacatgtggaatgacaaagttaatgaatgggacgagctaaaatgcctactatccagtggaggaagtggaagtgtgattatagtcaccacacgcaatatgagtgttgcatcgatagtgaagaccctagaaccatatgatgtggcaaaactaactgatgataagtgcatgcaagtattcatgcattatgcatttagaggtggcgggccacatgaccctaagttattggaaattggaaaatccattgttgagaaatgttgtggtattcccttggcagcaaagacattgggttccctattgtgcactagtcatgatgttggagaatggcggcgcgtcatggaggataaaatttggaatactgaggcaaaagtatatggtctaatccctgcattaaaactgagttatgatgcacttcctccccatctgcgagcatgcttttcttgtttatccattttcccaaaagaccatcagttgttttattctactacagtcatgttatggatggcattggggatgttgaatacaggcaaggaaagcaaacaaatgatatctgctggaagtaagtgctttcatgatctcctaggaagatcgttgttccaagaccaaattattgtttatgatgaaaccattcaaagctgtaaaatgcatgatcttattcatgatctagcacaattcgtttcagaaaatgagcatgctgttatcagttgtgaaaagactgctttctctaaaagggttaagcatctagtgtgagattgcaaggacttctcaggagagcacgaatttcctaagcagttgaaaaaggcatgtaaggtgagaacattttcaagcatatacaattatggtaccgtgagcaaaccttttcttgaggtcctcttctcaacgttcacgcttctgcgtgtattgattttttccgaaactcactttgaagagctgccaagttccatcagaaatttgaagcacctacggtacttagatctacaatggaaccgaaaaatcaaacgcctaccaaattctttatgtaggttggtgaatctgcaaacggttcatcttgctcagtgcgaccaactagagggcctaccaagagacgtgcatcaacttgtcagccttacatatttgagcctcacgtcaaagcagaagtatctactaaaaagtggattttgtggttggcctagcctgacgtttctatatttgcatcactgcgttgagttaacatcactgacagagggattcggcagcctcgctgccctgcgggagctgcgcatcttcaactgtccgaagttggcttctctcccctctgcaatgaagcagctctcctcacttgagaaattggtgcttaataactgcaatgagttggatttgatggaaccaggggaagccttgagcggcctgggcagtcttcgtgcgctcaaccttgtggggcttccgaagctggtgggtttctcagcgagcttccaatctgctgcgtcctctcttcaatatttttgtatcggcgattgccaagggctggagaagctgccagatttcatccaaagtttcacttgtcttaagataattgggattcgtgactgccccgagttgagcaggagatgcacggctgaatccggcgaggattttcatctcatccaccacgttctgcggatttacatcgacaataaaatctgggaaaaggtaagtccgccagctccaaaacgcttattgcgtgttgatctactcaggattttactactgtatgaaagggagttagtttttgtttgtctgcacttttgtgcattgatatgtgattatctcctgaacatgagcttacctctttatccgtctcattttcttgcactagaatcgtacgtgatgcccccctgacgccaggcctgtagagaaccggctggtttcaagactttccgctcaaagaaaattgcattcgaatatttggttggagtggccttccaggctgggcgtccatactctgatactcctcgtgtattgaaggcttgaagcgcatcatgtctgtgtcatttgtgctgcaccctattgtgtacgcatacatgttcgttccatgcatgcatactttgtgtgtaataattgggtacatttgctaattgctacatatttgtgcaactttcatgtgtaacaaacggcacaaacgtactatgtacggatgtttgaactggatactcatgtttgtaactttgtatttctaatatcacatcatttattttgctggtaacaatgtgttttctcctctctgaacgagtgagcttcagaggagttactggtaacaaatgtatactcgtgttttcatgggccaaaagagctggatcgtgtttgacagagctggatgggcctgtttgatgggacggatgcagtcataggcccaaaatgaagatggagagaggaataagtttacttgagatccctcaagttttcgccgaatttgtccctgaaccgaaataggcaggaataactcatctcccaaatcacaataccatgataactttatcactcgacagtacagtggccgatcaactttatcccttggctggtcggttttgtctgatgtgacgagtaagacccacgtaggctcatatgtcatcggccaactcttcttctcctcctctccctctccctctttcctctctcttccccatctctctagggcagtgcgtggcgcctccggaggttttgcgtgttgggtgctgccatgcgcgccgtcggctcgcggacgccgaggacatgtgcgaggactatgtgtccgcgacagcgtcgtcgttcgggaaggcgctcctgtcgtgatctcgtggatgaggcgaagcgagctcaacgctgcctccgtagcccgccacccgctctcgacggttgggagcagcagcaaggcaaccttccatcctcatcccgcttctcctcctcttcctcctcaccgtttcgacacgactagttctctcctgccgccatgcctcgccggctcgtcgccactgagatgctcgacattgtcgcgtctctgtctcgggtgtaggccttagtgtccacggagaccgtgttgctccaccagtccactgtcgtgtccacagaggttgtgagggagcatgaggagggactagctctgtggctccactcccgggccttcttgtcgaggagcaaggatgacaccagagtccagagctacaggtccctcgtgttagtccgcctccgccgtgactcggcatgcaccgtggcgatggtgccggagccggacgggcgaacagggtgaccaggttcaacctgatgccgatgaacgtcatggctttcgaggcattggcgactaggcggtggagatacccgatgacgatagagttgtattgatgttgtacaacaatggttgatgaccctgtctatgattcgtagcaaagcagttggcggtttgatccgattggatttttgatggcagatgccagtttggagtggtcaaattggaccatctactgggcaatatatgttaagtttgatgaccattattgtttagactaggttttggacaacttccactccctcgtttttcacgtgcacactttccaaactactaaaaattttatataggaaagttatttaaaaatatatatattaatctatttaaatttttttagctaatacttaattagtcatgcgctaattcaccactcagttttgcattaagggatgaaggattttcaacctctaccatcgaacgcttgattaaaatagcagcctgtatcgcgggcttgtggcctacaagcccacaaggagatgagctcttcgatcttgtgggctctaacatgtgataattagtcaaaaaaattattgtttttcgtttttcatatcatctaattagtctctactattataaaagttgaagatgtttccctcgaaattttgatacgtcatccgtatttgaattggttttaattttatgtttcggttttaattttaattcgagaaatttaataaaaaatttgtaaggcttgctttttttttctccgtccgaatgtttttcgtcgttgtttttccttcgtggtttttttattttccggttcttgtatggtccggattatttttttgttgccattttcttccgtcgcggttttttttattttccggttttcccgccgctgtttgttgcgttgcgttttttctctcgaaatcagcgaaatcaggcatccatactacgggacctaaattacacggttttatataatttaggggcgaagattttagtattgaagataaaggatatcaaacaaactcgacgtaaagttaagggacagcaagtgaacttattccccatcgatttccacgtgggggtctaacgaaatcacggtccggttcattagcacatcacgaaatctgtgggccattgttgttgtgtagttcggcctaatcagatggagctgacttattagctagcgatggccgggttgctgagctgagtaaaataatcagctttgtgttgaatggcagcgtcacacaccatacatagtggatagctctgatcactctcaggagcacaatctacattacttgcagtattgcatcaccaaggcacgccaatatggacgactcaacaaaacaactcttttgtaccacgatctctatctacagcaggtgtttttccacctcaaatcaaatttctgggtcaacaatgatgcgaactctggtggacaccggagctgaacttgtgatggttatgtctatcgtcttgctcgactggccaatatatgtcgatggcctgtcagtactagcacctccatcagttagctcagttggcttctttggatctgataatagtatgctttgagagttcagaactctagtaacatctgtcattgtgggccgttctgttggatcttcttgagcacaaagaagcgccacctgagtgcatcgcattatcacagggctttcatattcatcacacaatgctgggtctacaagctcatgcaaccttccatctctccacatatgccatgcctgaaatatgttacagttagtcaggtgcccaacacaaatactatttgctagaagaagaccattaaaacaaatactcacgtctcgaatgagattgccaacggtatccccttgtttctccattatgaaattctttcgtccactaatgatttctagaaccacgacgccaaagctaaacacgtctgtcttaagcgaataacggccttccgatgcatactccggagctatgtaaccactggaaatggatagcagaggtaggcatgagaaaactggaacatatatgttgcactgcaccattctttatattttgttcagctcatacctggttcccacgactctccttgtacactcttctgctacatctgaaaccagtgttactgcagatccaaaatcagcaatctttgggttcatgtcatggtctaagaggatattatttggtttcaaatccctatgtacaatcaaacagtgcttgtgcaggtaaagaagcccctcagctagccctttaattatctgaagtcgcttagaccaatttagcaatgcgcccttccttttgtctgtagaatgattgcaaaagaaatgtactttagagaacatagtaattgcttacatactgttctttatcaaatcaacatagttttggaatcagacttttgtgtgtgtgcatgtgtgtgaaaggtgtttcaaatgtgttgttatcagaagcataataactgctttagtatgtgcacatttattaggaattggattaagcccgtctcgcaaaacgtattaaaaagagactgtttaaaacttacggaagataatattgtctaaactgcctttctgcatgaactcatacacaagaatcttttctttttcatgaatgcaccatcccaataacctaattaggttggtatgctgaagccttacaagctgcaattcacttttgaaatcaaatattgctgcatccacaacaaatcttttgatagcaactgtatgtccatcaagtagctggccctgcaatagaattcatgtagcattctattataacaaatcatattttgggtagacaaggagtatctaacattcatcaccttgtaaacagtaccgaatccaccaattccgacatttctgttctctgaaaaaccatctgtagcatccacaagctgaaagaaaccaaacttcctaaatcctggatagttctcttcagtttggatacaaagtctcattattgcctccatgtccattattttctgttcttgcaggtccactgttactggatgagtggtaaatgaccccatgtcaccaacgcaatttggacaaaagttcaataactaaaaatgagaaatgctcgacttctttgtacaataattagtgacttcatgatgtgcaaaagatatattacttatgtgagcaaaagatatattcatggtgtgcgaaagataaaacttgatgagaacaaatgattttcatcatgcactttatctacttcacctagtgtaaaaaatgtagaggttttttactgtccttggggttgtgcagtaccaaatcctaaccgttgatctggcatcatctaacgatcagaaatcgttcatatctcatggtactgcacctccttattaaagcggtatcatgggtggaagggtacttctgtactttcgcgtggggcatctctttctttcgcgtttcgcttccttcacgagagggaaaaatcgtcggggaagagcagcgagagatggcggcgagggcacgggcacattcccggcggcggcctcgatgcgcgacggcagcagcgcggcggccttgatgcgcgatggcagcagctgtgggctcgaggcggcagcggcctcgatgctcggcggcagcggcgagctcgatgcgcggcggcggaggcggcggcaacggcggcctctctcttcctcctttctgctgtgaatattgttgacggccgcggcagcgacggcctctctcttcctcctttttgctgtgaattttgttgttgagtttgctgaaccaaatgtaaatggctaaatggttgattaccagcttactgttgaattgcaagtttcgtattgatgaactaaaaaacaaggttcagaaattggatctgctgtaaataatatcgattcaagtctggtgtactttgagttacgcattgtttttcctcctgattccttcctctattcagattaaagttgcacttatgggacattatttttcctcctcctgtatttctctgttcagattaaatcagcagactcaaattgggtgtctccgagcaaggcagcctcgatgtgcgactgcagtggcgcagcggcctagatgcgcggcggccttgatgcgcggcggcacggcggcctcgatgcgcggcggcacggcagcaggctcaggggctgtttggtttacagggacttattccaagtccctgtcacatcggatgtttggacactaatttagagtattaaacatatactaattacaaaactcattccataatcttggactaattcgcgagacgaatcttttgagtctaattacgccatgattttgacaatgtgatgctacagtaaacttttgataattatggattaattaggctttaaaaaatcgtctcgcggattagctctcatttatgaaattagtttttttattagtctatgtttaatactctaaattagcgtccaaacatccgatgtgacatgagctaaaaagttttaatcccatctaaacaccccctcaatgcgcgacggcctcgatgcaacggtgtctctccattcctcttttttttttgttagcccgatcatacccctactaaatcaacggttagattagattggtacctcgtagtacctcgtacctcatgataactcctaaaggatgggaaagatgctcagaaatatatgatatctttagcatctttacgcttcttctcgctgaaattctgctttttgatagatgaagctaatgttgcacattagctgctattcttgttcaaactgtgcttagtcatttttaactacattgcagtgctatgatgtgatccaaatagccaacacttggccacaagtcatgatgctatgatggatgactaaaattttttcgagggaatgggcaggagctctgccatttcaattatagaaggagaaaaacagaatggtttggttcagcgatggatgactaaaatggagtggggattttctctgttccaacgcattttctaagcatcagcggtacactgttacatttataaaataaagtacactgttactgcgacaaatgcaacaataagattatgttcttgatgatgagaacatttattgcaatgtggttttcaattcataattaacaactgcaggaaactcataaaagtagtcaccttctaatgatttccccctgatttccctaggtttggtggctccttgaacatgtatttcagtgaacgccaatattcttcttggaaacctaagattggtcaaatatactcattatatgctagaatcatgaaaagagggttctcatttcagccctaacaaaatggtagtcataacaactgagttttgaatataaataaatatagaccatatatggggtgtgtttagttcctgaaaaaagttgaaagtttggggaaagttggaagtttggaaaaaaaattgagagtttatgtgtgtaggaaagttttagatgtgatgtgatgtgatgaaaagttggaagtttggggtagttgggggtgaactaaacacggccatggtcaatgattctctggttccagcatgaaaatattcaatatcggcgatagttcgccttcaatgttgacagttttttttccccaaaaaccgtgataaggacatcagctcccggatttgatatggaaagaaacattaagtaatcagttatggggtactgaaacaatatctaaccttgtgtgatgatctgaataacttgggactacactgggcaccccctcggttgcctgctagacaactgcagatatcattcacatgaaattggcttgcacacaaagtggacttttggaactaacagtgcacaagtaaggaaaatcttatgactccagaactaacagttagtacatgtcaagttgtttgactaaaagttgaaatggctatgtaccccaattcaggtacaagtgcacagcagaaacattgacaggaaggatcacttgagcatatcacttcgatcagatgaatcatcataaaaagagatcagcaatttctcctccatctcgatacgccataatcttcagttttaagatgaaccacccaaattatcttattactagaaaaaggatgaaacaagggcttaccgtgacacgacgattattgttgctgctgtcgactagagagatgagagggatgaggcgtatgtacatgtcaatctcgtgctgcgcggcgcggagctcgtcggccatccgagcgccgaggagcaggcggtggaggtagccgcagtcatcctggcacgccctgacgagtgcgtagcaccgccgcagcgcgccttggagccgctcgaggggccgcctggtggcctcccgccgcatcagctcggcgagctctagctcccgcagcaggccgccgacgaggtccacgtgctgccccagccgccggcacgcgtcccggtggcggcgcgccgccagcgccgcctgcaccaccatggagaccagccccagcgcgtccacgccgaccagctgcgccacgctcgacgcctgcccgagcgcgccccacaggccgctcgccatggccgatccccgccgggaaagctgcttcgcccgttgccgccaccgccatggacgggtataggcgtcgcgactcgcgagtgtgaacgtgtcgtggacggcgactttgaccaagcgcgctgctgtaaattgtggtcgttcgtctacatggactcaaaaggcccgtctccgtcgagatggcgtagggggccgaactaaatcacggcccggcccagaaagaccatcgcgaaatttatatgggccttgtctagatcattgtagtgtacagtgtcagggagcattcaggtgtaccgagcacaggtggcaaatcagacgtgatgagatctgcagtgaaaataaatacagagcccagaggttttgcactgcattattactgacatttttttgtactagctttatacaggcgtacagctcgtacctggttcgatcccataactcttcttttgtgctctttttttaacacctaaaagatttcccggcgaaaagaaaaagaaaaaaagagaaacatctgtaagactgaaaccaacgttatagctgatccaaattcgttcatgatctgaaggatgtgattcggtttcaggtcccgatgttgcataaaattttcacaggagaacactatcagatgagtaggagtacatcttcttttcacgtttatgtgtactaacgagtaacgaatgatcttacaaatgcatttcctacttgcagtgggcatgatcacggatgagaggagggatcctagactcctggtccatatggaccacgcacaagaactgagcagagggcagaggccatcacactccgtgctgtttgcattgaatccaattcaattagctcgcgttactcctactcctctgtgcttcgcatgaacacacagctacaacactagtaaagaagaacagtagcaaagtagcaggccagcagcagcggcgtactactcctggtccctgatttcgcgcgttagagaatcctctaacttattttcatctaattttgaaatgtaaatctattgtataaagaatccatatatcaactttagggcactagcaatgcaaccctcaatttgccatgcctaggctgccaaatagactgaggaacctcgaaggacatatgattcacagcacgcgcgggaaggaacgtgaggggcgagagcactcggggaggaacgaggccgaagccactcgttccacaagaccacaagacggctgcaccgcgctctccctaccacacgcgctttcgttgtcgccggaaattggggagccttctttggacacgcgtgcttagttttggtaggcccagttaataacgtgatgtcaaaattccattccgcgccgacgttggatggtgaggtcaaatgccatgccatcacacctaggggcggatagcgagccggctcggctcggctcggtctagctcgttaggataacctaatgagctagaaacctagctcggctcagcttgtttgaaagctcgagctagctcgttaggctcgcgagccaatcaacaagacgaggaccaaggaggagggacctgcgactctacacgtgcgagtgcgacctgcgccttcttgcaggaagtgcggcggcgacagcgttggggaagtgtgatggcggagggccctagcggcttgcggcggcggcggcgcgagcgcctggcgacggcgtcggcgcggtctcgtgcggcggagccagagagagatgcggatgtgcggtctcgagtctctcgacgtctcgtctcgtactctcgtgtggtgcggcactgcggcggatgaggaactgagtgaggagactaggagaggataggattttgcacttttgctgttgtattgggcttgggcctttgctattgtattgggttgagcctttgcgtctgtctgatgaagtactgtctcattaagactcgcgagcggctcgcgagctagctcgagctggctcgttatccctaacgagctaaaatgccagctcagctcgttaggaaaatcaaacgagccgagctgagcctgtcatgagccgagcgagctaacgagccacgagctttctgtccacccctaatcacacaccgcacaatgaaggccgttatgttagagaaaaataaataagaggatctcaatccgactacgcgccattgatggtgcaggagctcgacctggctggctggcactgagccaactggcctagtgacctgggcatggataaggaaggaaaaaaaaacggctcagcttttcatggccggcgaggccaacgggaagacgcaacgaaagcgcgtcgcctctcctcctcccggcgaggaagaaaagctgccgctgctcggcggagatcccgatcctgctaaagccatcgcccaggtggcgtagcaggggcgtcacctacctaggaagtttcatccttcatgtgccacgcaatgacagttttaattcctcatcagatcaagatgattaagtttttcttaattcttttttagctgaaggtgattagtagtagtaagattcaagatggcagcaacggcatgctaggaccatattttagtgctggtcatctgctacaggctggagtaccttaaatccaaaacggatgcaattggtgctgatattttcggaggcagtacagcacagtaccacctaggattagtgtagtactggtactttattttagctgacataggattagtactacccccagtgacatcattaaacgctcataaatcgagcactgtgtgaccaccaaccttgtcatttaagcgcacaccaacataaaccatactcccattctcctactggagtagtaccataataaacataaaacacaacaacccacataagtagagtactaatccaaaatagtactacctccgttcattttaaacgcagtcgtgggttattatgttcagcgttttaacgtccgtcttatttaatttttttatgattaatatttttattgttattgatgataattttaaataaaatactctattcgtctcaaaatataagtaatatctccgtttcaagttataagactttctagcattgcccacattcatatagatgttaatgaatctaggcacacatatatgtctagattcattaacatatacattgtggacaatgctagaaaatcttgtaatatgaaacggaggaagtatttttaaacttcgactaagtcttcgagatggtactattatcaacaatatctataaaaatatgttttaaataaaaagtgttgcatattatgatagttgtttaatgataaatctagtagcatcaatttacatgatttatctttttatttttatgttataatagttaaaatttaaaaatatttgacttgatattattcttaaaatgtttatattttgagacggagaaagtaagacgaacggttaaatattgaaaaaaaaactcacacctgcattttaatctgcacttaaaatggatcggggagtactagcagcaaagccagcaatgcgtttctcctctactgaaactgcaactaactgacacgatgatgatgtaggtgtatctgcctgcccctcgtcgccggcggtccactccacacgacgagtataggagcagctcaccaactccaccaaaatctcgcacgctttcactccctcccctgtggctgttgggcctctgctccctctcccgctgagcagcgggccccacatggcacgcgcgcagcgagcgcacacccaacaagatttgactaattgctcgcccttttttagctagagtggggtggttttgcctttgctgcctcccctcctcgccaatgtcgcgccggaatgattgttgcagcgcagcaacacaggctagcaagcagctctagtcatggcggccatcatcaccaactcctctctactctagtctctggcctctttcctctggatcctggcattttgcattgtcgtttgccgtgttagtttagtgagcagattgtactttgggggtggttaaagaatccgggggtatttgtggtgtggtggatgctgtggtgcgtccgcgcggaggacgcattggccgccgctgcagccgtggccgtggcgtccgacaagatgcgctccgtgaccctgtcagtctcctgctgcttaatttacctgcttctcatggatgtttgctgttggcccgtctcctcaaggtttggttctttcctcgctgtgcgcgcgtgtgtgtgtgtgtgcaggggcggttcgatccagagggtgatgcggaggattggcggcggcggtggtggccggagatcggccgggtcgaggggcgcgccgcagcgggcggaatgcctgggggcggggagcggcgacgcgtcggcgagctgctccggggttggtttttgtctttgatcaaattaaaacccacttctttcttgttgccaagcatttgtgcaatggaagtgcaatttcttggttcctcctgcgaagattgtttgttctgaaaacccgaaaatgtggtgtttttgggtgcatcctgggcactgggcagcttcagacaagctagctgtgttcgcgtgccaaatttgaggggcccagatgagatgaagtgtcactttcccctctctgttcttcgcatttctagtgtaatagatgcagaggttttgactgcttgtttgctgcattctgaactaaatttcttttggatggattctgtcccggcaggtgtcctagactggggattttgtttgtttcctgtttttttggacagtttcaggtgatatgtgaacctgattgctctcttatctttcctctgtaggatgatagtagcaatggcactggcaagagggatggaagcagaagggtaaggatgcggcggtacagatcggagctcgagcaagaagtgagtgcttttcttggtgtaattctgctcgtgtttgagttctgacgacttttgttcctgttgttcaatgaaagttggtactgatggggttagctagtataggctgtggcattatccaatgcttcattgaaaatttattcatagagtggtcctcaaatgaagtctaatatttgctacctaatgtttgctaaaaatttagttactctgacggaactatatttgcatttcaactgagtaaggactaagagctaatattttcagatgttatacatgtttcaggtaaagaaactgcagaggcaactggaagaagagattgacttgcagttggcattaacagatgccatcacaaataatgctacactgatacttgagccctctgcaaagcttccaaacaaggtacggattgcattttagtggatattttgcatgtgtatctaggtagccactctttaatatattttctacttcaatatttcacgtgcaggcacaggagctaataattagcatagcctccttggagaatactgtctcaaaacttgaaaaagacctaaatgacttatgttaccaactgtgtcatttaaggaacaatacgcgacttgcagaaaataattccagatacttagaaactctagctgaagaaaataattccagaggtctactgtctacatcattacagtaccaaccaccgtcaacttgtaaatgtacaggggaggaagtaagtctttattatagaaatggtctcattttatagtgcttcttttggcattcaaataccaaccgttttttttcccttttctgaacttttgaaggacatttcaacactaagagatataaagctcggagaatctgaatcaatgcaagaaaatttattccctgggcttgaggaccaacagaacattcaaaaagagagtgaagggagagagatagtatctcaagatgggcttctcgaagagcatcaagatgttccttcaaatagattgttggaaaaacactggaacgaagaggtttatatttatcagtattaggcaaacatgaatttatgctttatcaaaatattttaagttatcaaaaagtaaattttagcttgtttcttggcagatgcaagagtcctatcctatggaaaatggaggcagagaatatcagataatagatgcgttatcatttgaccaatctcatcagaggaaaagcagcatcaatggtaatgtgtggaatggcaatccaaataagctctctgaagaaatggtgcgctgtatgagagatatcttccttcgtttatctgactcatcatccgagatatcaccaaaagggtcttctgttaattcaatttcatcaacagaacgtctatctggctgtacattgacatctgtatcagattcatccttgatggcatcagtgatgcaaagcccttcagttgattcaaaccatgacagtattgatgaagttagatacttcgatccctacaacgttaatggcaaggaagttcgaagagacattgggaactattgttcagtagctgaggtgtcttggatgtatgttggcaaggaacagcttgcatatgcatctgaagctctaaaaaatttcaggtttccttattaaactctatctgtagctatcaacactaatggatttcatttcatgtctaaataaatagcctagaccaatttacagaagcaaaagtataacaataattaagcatgcgagaaaaatgctacagcggaagattcagttataacaaaaaattcttcagtgtttgtttctaccttgtagtgcaaagtagcactgcttggtattacgtttatgaataaatgatggacattatattatacatgactttgatacgattgctattaattgtttaagttactctcgtctgcaggaatctcgtggagcaactatcaaaggttgaccctacatgtatgacctgtgctgagcggttagcattttggattaacctgtacaatacgttgataatgcatgtaagtatctgttcaaataaaaatgcatgcaagtattatccgctagatttcatggaaatatgatgttataattagttattagcaaaacaatgtgcctttttttttatgaagtgacaattttgaaggcagtgttgtgtagtatatgccaccgtggtattctgttgtaatttcagtttcttagtgtatgctaccgtggtgatttctcattgaaatagcagttcctgttctttgtttgcactgttctttattttgggccatgcagtacacattctcatgtgttgtgcatattctattggagtttaccaggcatatttggcctatggggttccagaaaacgatatcaagctcttctcactaatgcaaaaggtttgtcatctttggctcttatttaaagataccattggctttataatcatggttctttaataagatgttaaccaacttggtattgcaggcctgttacattgttggtgggcagtccttcagcgcagcagaaatagagtttgtgattctgaagatgaagactccagtacaccggccacaacttgtatatgcactctgctcttcattgtcatctcctttcttccttttcggcatgcaagtcgcagtgaagcttattgttttctcgtttttcagtcgttgatgttggcccttcacaagttcagagttaccgaggagcacaagaaatattcgatcgatgatgcagagccccttgtgttgtttggccttagctgtggaatgttctcatcacctgctgtaagtatatttaccttttatcttggtttgtcatctcaacactatttaccttttatcttggtttgtcatctcaacactatttaccttttatcttggtttgtcatctcaacatgtatacacggacggtcttttaaagaagctaaaagtcaccagtatgtttcaggattaccttataatgttttacgccactgaatatattcactcttaagcctgaaacacttctaaatcatcttttatgttccagtatttataacaaaaaaaaactgtcattttcatgcctatcctcatttccaaaatgaaatgtgcgtttgctgtcaaacaggtcaggattttctcagccgggaatgttcggcaggagcttcaggaatcaatgagagactacatccgagcatcggttggtatcaacgacagcgggaagctcatcgtcccaaagctgcttcagagctatgccaagggcaccgtggaggactctctgctcgccgactggatctgccgtcacctcacaccaaaccaggtcgcagctgtccaagacacttcgtcgtcgcggaaacagcggcttcttggtgtgcgcagcttcagcgtcgttccatttgactcaaaattccggtatctgttcttgcctgacaacagtagctcccagcactgaac

SEQ ID NO: 77382 - DNA, 1705 bp, Oryza sativa
tcccactccatcatcaacccagcggtggcatcctcaagaggtgtggctcctccgccgtcggactcggaagcagtcgaactctcttgcctcttcctccccgtcgtcaatccggcagcagtgggggcggccttgagaggagaggatccacaaccaccagactcaggagtggctggcctctcttgcctttccttctttatcgtcgatttggcggcaatagcagtagaagggctagatccaccgtcgcgggactcgggagcggcaacgggggctcaggctgggcgtgatgaggacatcactagctcggatatgaccatggttatcttatgtattcatcaagcaaaggtgcatgctttctaggtgggatttacgtgttatatattggaacaaacattattgtattatgagttccgtgtgttctcatttgtagaggtgcttgcttggtgaaagggaaagataccgagaacaaggaatacatggatgatctaagaagttgattgaggaagaaaccaaaaccttcctcaagtctactccaacattaccatgttatttttggttcataaaaggcaagagatgaagttctgcacgttttggattcaaattcgggcctcctgacaatattaactttaaacaaacctagccactgatccagaaggaccctaggggtccatgagttctttttggaaagattatagagtctgctttcagatggttttagtcccacatcaaaattcctattgagctatagggaatatgcaaaacaagtcatgtacctcatacaatcttagtctgatttgggcgttgggacttgtacttgtcgtgggctaagcccaaggggtggaaaaaccctaggatgtctctaatcatatttattccatagccgtcataatttagagtcgggttttgcttgaattatttctggtactatagtttcgatgttcattggtttgtggaacccaaatttcgagttcttaatcattcatctgcatttctattgcaatattttttgttcttgcttgtgtctttgattcacacaccgtgattagccttctcgatgaagtcaattgggtttcggcatggttgataaccagaggaggcgtggtgctaaaattgcatggttcagatcgtattgattggaagccaaatcgtgtgtgtcaagtttccgccaaattaagagttatcaatacctatcagaagattgagacctaattagttaacgggaatccactgccagcgcccacaggagcgacagatccggcccagtcccattggggacaccgggaaaggtggtggcaattttgactgcgacgatgacggccaacaacacgttattgggcagcaaagactagtccctccactccgacgagggaggcagaggagcttgcttgagtctatggcaatattcatggtgacgacgacggcaagagtacagcggcggcatggttggattgggtaggctttctggattttggtttttttgaaattcttattttagttttgccatttttttccatgcagttggcataaggagccacattttcacatgtggttcagctggccgcctggaaaattactctctttcgcagactcctactggtaggcgtgcactttgtcacaccctgaagttcttctcccaagcctaaatcatatttataaatgacctcgagaatttatctgtgtaacagcaaaagagaaaccctaatttaat

SEQ ID NO: 77383 - DNA, 1262 bp, Oryza sativa
ccagctcttccaatccaatctaacctcgggcacacgaaccacatgcatacgagatcaggagatcgccagcccccaccaaaattacacctcatcatcagcacactcccgagactaaacccccgagctccgtaacatccacaccgaacgaacaaactcccccaaaatcaactactcccgctacacccgagaacccaaatcaaaccccacacacaaacacatgaagccatcgatcgccagaatccgagaaaaaaaaaagtcaaaatcgaaccaaaaaaatctggcgagaaggggatgaagacgaggaggaggagggggagaggagacgtaccgcggctgccgctgcggcgagggtaggtggcgcggtggtggtgggagaggagacgagaagagagggaaggagactggaggggaggagggttgaaaagggagtcgagacgcgaggctgcgagggggggaagagaagatgctgccgccgctgctgatgctgttgctgctgcagcctccctatctatctctctctcgcttcatttcggctgtttttgtatataataaaaatatttattatttatttatttgggtcagcatactggtgctttttaaatttgtatttgagcggtttttttggattatcttgtggcgaggagaaaaaacatgcggactgtgcagggtgaatgattaggcaaggtcaaaagtcaaaaccatgtttggatttgtaggagtatgttctactactactatctccgtcccaaaataagcacagtcataagtttccgcgcacaattttagtcgttcgtcttatttttttttataattagcatttttattgctataagatgataaaacataaatagtactttactcgtgacttatgtttttaattttttaaaaaaaaattcaaataagacgaacggttaaagtttgacgcggaaaatcatggttgcacttattttgagacggagagagtaccacgggagtatgaatgcagtacgggttgaaatgttgaataggttgacgggtttgctcgtcacgttttaaccatctttgaaatgaatttgcatgattttctttcaaggtagttcaattcatatgaaaattctctagaattcttaaatcgagataatacagtatgagagtttttttttctacactacatgaaagacacatatgcatacacacctaaaaaaagagcatatagatcaatgaatatgttagctgtgtactcacttaaagaaatgaacaccaacgatagctccgtaatctta

SEQ ID NO: 77384 - DNA, 954 bp, Oryza sativa
cttttaaaaatccggcggatccggatgcggatgcggttagtatgaggcggatgcggatatggtatctctaaaatccgacggatgcggattatccgatatttttgtcggattatctgataagccgtttgtcggataatccgaaattatcaacatatataaccactctatctattgcatataatataagttggtacatccaattccctaattcatcaattaacatagattttttagtctaaggcttttatcgtctcatgtcacactcacgtaactatatttttcatactatggacatcatgtattcatattgtttagcgcttaatcatgtaattattacgataggtcatttactgattattgtattatttttccttggattgctaactcgatgttgcattgattgcatatacacgtaacatccgataaatttaatccgcttccgaaccgattccgcaccgactccgcaccatttccgacatccgaaacaatccgctctgtatccgcatccgtacactatccacacccgttctgaatccgcttaaaaaatatggtttaggatatggtataaccactatccgtccgaatccgcttcgttttcatccctagtttcactcgtgttcctgctaatttattactatatgaaattttataggtaaatcaattttaaagaatctgtgcgattgattttattattatttttacatttaaacctttaaatatattagatatattgggctcattttttatcatcgctaaaaatacagaaaagaagatgaattactctcactgtatatgctttatttgctacatgcaaacattctaatttatcatgtaattttctgaagacgttaaatatgcaattgaaaagaagccaagggattattttgtgaaattgtactgtttggacagggtatggacgataagtagcagttttttttttctcacacgcacttt

SEQ ID NO: 77385 - DNA, 639 bp, Oryza sativa
tatataaaagctgctatggaatagagagcattctcatgagccttgaaatttgtggggattgttagatttaattgggtaattaatccatttaaatcaattaaattaaataaattccaatgctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggttagttgatgacaattagttgctctattcctcttcctattccattggtaacttacatcaattactcttaattgattgttggttgatggttgtgtagtggaggatggttcatggctagttgatgacaattagttgctccattcctcttcctattccatgactcttactcttcatcttccattcctcttataaaatgggaatggatttgatctcccgcgaaaaaaagaagacacactttcatccattttccaaagctgttgttgctacggtaatcccatcccgacgagtgtgtgcacacgcgttgggagagtaggcctccgaaaccacgcgttgctgcgacgtttgcacagacgggcgggc

SEQ ID NO: 77386 - DNA, 926 bp, Oryza sativa
tgttgagtagaggcaacacaaacagaatcgagagattttcaattttagtactatgttcatagtagtatttcgtaaagtacattctcgtaacatacagctcactctgtaagtagtcgtctgtaccagtaattggagacggtcatgtttgcatatgcatgttattcaacattgatacgaataactagctagctagagtgaccatgtcgatcatcaacacaaggttgctcgacatgatcaagggtgcgagatgagatcgagccagggtttgaaatttcggaagtaagatttctgccgcaggtgggcgaaagaactgaaatttccaaaatttcggatttttttcatacgatttttttttgaaattttgactgattttaaataaattagaataaattttgaccaaaattcataaaaagttataaaaaaccgaaaatttcggacgagatgtgagtatttcggtggggggcaaaatttccgaaatttcaaattctggatcgagctcgatcgctagttagctatactaagaataagatcaggtacggttggagcctgcagcaggacggccggtgacgacgacgtccttcgcagtcgacgacgacttggcctttggctttgcgacgccgccgtagcacgacacgcggacgctgtcgacgtcgccgtcgtcgctgttgtgctggtcgacgttccggcggccgttctgcctgggcggcgtttggtcgtcgtcgtcgaacaagaagttagctcgccgagacttctccatcacgtcctgcatatacatcataaccattaattaattactttctctttaagatgatataattaatccgccctctacatccaatacttcagatgtatcgggcggccccagcagtatcgatcatgcatgatcatatatatatatatatatatatatacacgtatatatatat

SEQ ID NO: 77387 - DNA, 8528 bp, Oryza sativa
ccttttcatttttacgcgtggaattgaagcttgatcgaatgaaggaagggatcgaaacagagcaaaagtccaacatgatcgacatatgctttttgatgaaatttccccaaaaagcaggttgtcgtgtggcataatatgcattatattcaagctaagtaaagcgcaagtgcatatattccttggcgtattccactctagctataactcaatcttttcctctcttttcgcgatgatcaaaattcagcgcgtctgatggtgttggcagaaacgaatacagccgcacgatcgatttacgggtacaattaattgtcccccttgcaagtggagcaaacgcctgaaatgaatcgactattggtggtgctaagcttctttcaaaaacactattggtggtagcggttgcactactagagaaatgatctttgctgggtcaacccaaaaccacaatagtcccggttacaaaaagaaccgaaactaaaaatgatttttagtcccgattgaaaaccccacagccattttatcatctttagtcccagttggcaatcgggactaaagatctcccggttcatcctttgtcagtggcctgttagggggccgagaatctttagtcccgttcgtaaagatgatctttaatcccggatggtaatcctaaccaggactaaagatcaatagactaaaatttaatacgtagtatattatccctctcacttatcctctcctccacaatcgcaccactcacagatcccttcctcttccccttcctcgtacttatcctcttcacagatccctctcctcatccccttcctcctcccctcccctctcctccccctcctcccttcccatccagcggttggcggggccgcagcggcggcgaccggcggggccgcacccggcggcggcaggcaggcggccagcggcgccgtgcacagctacgggcaggcggccggcgatgccgcgcgccctctcgtatgccggccagcatcctctcttttttttggataatttgtgattaattgagatgtataattttgtgattcattgcatggatctgagatgtataatctgtgatgtatttaatttgtgtgttattttttaggatttttgatgtatctgatttgtgcgtatttttttaggatttgtgatgtatttgatttgtgtgtatatgtaacttaagatttgggatgttactttgaatcgggggatttggggattgatttggggatatacatggcactagattcgggagaaaatatagggattaactttagccaaagaaacaataaaaatgaaaaaaaaaagaaaaggggaccatctgactgccgctatccatcttttgtcctgagtatttgaaccgggactaaagatcactatctttagtcccagatttttactctcggttgaaaaaccggaactatagggggttatcaactgggagtactatagggggttatcaactgggagtaaaaagggtttctccaccagtgtcggtttcgcggccacaatagcggtatcgatcgggaccacgacgaggagatggtgcaaaatggaggccaggctggaatactgcggccacgacagtgacctcataaatgaaatagcgatagttagaaccaccacgaaaatcgacaccatcgaatttaggaaaggtcacgtttttttagtggtattaatagcggccgctgtttttgcacaaaagtctggtgccgttgtgaatgtaaatttgtgaggcatgcggttttgactgcgctatccaaacacgagtcacgcacacatatatcttttacgcacgctagctttatgaaatattttagaattttgtaagtagtaacgtgcgcacaatttttcaaagtcgtaacatatataatgtatacaattttaaattcataaaataaaaactgattagggtgtcatacacattagcttgctgttttgtcgtatattactaataggcgagaccaaattcgggttacacttatatgtgtgtgtatatgttgtttcctccactgtagcttcctgtccgctaaaaaaacatatttctaaacttcaagaaaggtcttaaaaatgcattactcacgccactttgtgtgactaacttttcacttgaaaagtagaaagaatatattgagcgtgcatcactaagatttcaaaagctatagctctccctcaattgacatacagctcaaagtttttttctgagcatatattccttgacgacattatatctccttttgcgttcaattcaactgccaatgccgtactccggagaatcgaaggtactactccacttgtcaaaaccacctcacgattaccgagccatgtcgatccacaggtggatatatatatatatatatatatatatatatatatatatatatatatatatatatatgtgggtgcaattaatttccttgattggagcggtatatatatatatatatatatatgtgtgtgtgtgtgtgtgtgtgtgtgttagatgataaaacatgattaatactttatgcgtgacttatctttttttttttcatattttcttcaaataagacggacggtcaaacattggacacggaaacccagggttgtctttttttggacggagggagtactcaatactactggccacaaattaagatgatgggtgtggaagaatttatttttaaggtgattttcaaatcaccactgcaagaacagtttcataagtactccccgtcccacaatataagtatttttaaacttcgacatagtttttgatatgttattttgaccaacaatatctatgaagttaagatgctttaaacaaaaatagttgtatattatgatagtttgtttaattataaatatagtaatatcaattttacatgatcgatcaattctattttttggatattaataatcaaagttaaaaatatttgacttagcactgttctaaaaatgtttatattttaagtattttgggactgggggagtaaatatcaagattgttaatttggagcggtacgatacggcgcccactcgttgcataccctttttgctggcgaaattgtacgtactggccattccggccttgagacatttctaaaatcataatgaatacttgtgtaacgtggtcgagacatttttgaaggaggtttgtagccaaaggtgtttttagaaatatgtgcagcatggttagagactttttcttctctaattaattaagggcattctcttgagatgtttttaatttgccccatctaaagtcatttttaataggttagtttttattaaatatctaaatataaaagatgatgtgtcactggtggagaaaccctttgtagtcccggttcgtaacccccctttagtcccggtttccaaaccgggagtaccaatccgggactaaagatcgctatctttagtcccgggtgaaataaccgggagtaaagatcgatctttagtcccggttggtaacaccaaccgggactaaagatcgagctgatctttttttttttttgcatggccctgttgctgcatggtatatatatatatatatatatatatataaaccatgcatatatatgtttcaatacatatatatgcatacatatatatatgtatatatatatatatattatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgtgataaattccttatgtgtggtcaggttatccctcatacgaataaactatatgaatgtatgaaattgattagtaattaaacaagaaatcgctacgtaatgaaattttgaatttatttgtacgtacatcgagctctcttgtggtgatgatttggtttgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaagtcgaagagtaaaagcacccagtggaatctgcaatgtgcgtgggatgcattacatatgaaacacttagcaagttcgtacgggaatgaaatttggcatgtaggaagacagtaaaattaaactaactctgtgttgtatggcaacagtatgaacgtcttgtaatgctgcgccttcaggagatggatgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatagtctacttatatacaaggacctaattaattaaaggagacgtatagtaagaaatctaactgaacgatatacttacaaaatccagcaactcataatagagacgtcgagggcgtccaactggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacaggtgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctgggggggcccttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcctgaggaggagatggcagagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgttgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctgaagtctgcagggcgagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccagttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcatgttatcccgcacaacccaaccgctgtgacgtacatagttcttggcggcttcggccggggcactaggacgtccatcttcttgcacttccgttatgatgtgccgactctcaagcttcttcgctgcacctcgttgcccgcgtgccctcttctgtccaacggagggttgactaccactagcctcctcctcctggttcccctccacatccctttccatgtgcccctgctggttcccctccgcatccctctccacgtttccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactacaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatctatgctaagtgtttcgtgcgtatatgctaagtctaattaagactacaatagtcaattgctacttgtcgcaccaattccgtagtcaataattatacatactaagtcaaattacaaataaagtaatcttatattaaaactcaaataatattagaacactacacaatcttatatgataagtccaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaagatgtattaggataaatacgaagtaacatatatatatatattgcatttcacgttaacgttcgtcctcgttcgttcgc

SEQ ID NO: 77388 - DNA, 1745 bp, Oryza sativa
  unsure (1)..(1745): unsure at all n locations
tttcacaccctacggaaagcaaatatctcgcacgaaatttttgagtcaaaaattgataaaatttcaaacattcttttgcaaaaaagtatgaaaatcatgaaatttttggtatctcagaaattcagataaaaaatgaaaatgggcaaccccatatatgtgtcatgtttacaggaggcagtgcaaaccttgttctattgtttaaaagatatgacaaataaggacggagccttgggttggtctttgttcttgatcgtgtgccttcttcggtcctatagtcttctcagagattatattttctatagtactagtggaaataggtttagcatatcttcggtcctatagtcttataagagattctggtatatctttaatactttattcttattgtaagactatatagttgaattaatagaattatcttctaaagtgttcataatttatatattgctttagtagttatataccttattaataagatatacttcatttatatatttcacttgattagattagtcgatctatgctacggcaacgatcccatgaccttgatgagttgctctaactctaacttgtccatccgaatggtggaagtcctgaggagttagtatcactatttactagcataagcatagtgcttaggttagataaataccgtttgatgtgggtatgtccgacagaaagtgaggtaggcagcaggtggtgatagccttgtccgtcccttgtattcatccacgtccgggtatgatataagagtgcgtaaatgctaggcaaaatttgctacaggacattcaaaaaatatgtaattagctaagagacaccataaaatcgtgaaacggctgaaagacactccaaaaatcatgtaatttgccattggacactttcactattattttattattttcggaacaaatggagggacaaacaattaaaaaggaccaaattgcccttgaggccaaacttaggttcaagggtggtggcgatggccttgaccggtggcgagcgtcagtggaaggcggtggaagaagagcatcttgcagcaagtgccaaagggggtcgagatggcgtccaggtgagctaccatgctccgcgcggcgaagaagaggaagaacaccaccttggggagcgagaacgcccatcacaacgtgtggtaggagcgcgcgtcggggcggaagaacaacgccgagtgtagtagcagcagccacgagatccacggcgcgaagagatagttcatggcgatgtgttgcctgaactcgatcggcgcgcacggcggngaatcggaggaggcacagcgccgnctagagcgcgcacagtggcaccagcttgagcagcgccagcgacaagagcagcacaaacgccgtgaacggcagcgacctcgcactaccaggcctagcgcccgctggtccgtcgacaagtcgctcagcgtctgccacaacagctcctaccccgacagcgccaggggtccacgtaccatgcggagttgcgggacagtgcaaggacatcgggacacgatgctctaccatgcggcgctgccggcgcacgtagtgaccaaggggtccacgtacacgagcactatcatcacactaaacgagcagcaggaataaataaaaagacagtgaaaaaaagaaaagggcaaaattgacatttcacatagcttctctctcctcagctaggtgtatatattattttattgctcatagtgtccatcaacaaattacacattttttatgtgtctttcagccgtttca

SEQ ID NO: 77389 - DNA, 2893 bp, Oryza sativa
cagcgcgactcaccggtgtgcgaggagataggcgctccggtgggattccagcaacgtgagtcggcggccgggaaagctcttgcggcggcgaagctaacggcggcggcggcttggcgcggcggcggccctagcggcgacggtatgtggccggagatgagcggcagcggcaaagctcggcgaacgcggcgcggcggtggtaggaggcacgggaaagggtggcgagagtgggaaacgagagagggggctcgggggagcgatttataggtgtgagagggagcggacgaggccgggaaaccaccctactgcgccggcgacgtgggaagatgggaagggagagagagaggggattcaaatttgaatcccagtcggtgtggggcgcgcgcgcgtgcgggggaggtggaggagtgggcggcgacgtgggcacgagcgcgggagaggcgcgggatgggcgtggaggagcggcgtgggcggcagcggcggttgctgccgaggcacgggcggcgagaggttagggacgacccgactggtgggccccacctgtcggcgccccaagggaggagaggaggcggcttgggccggcccagcaagagggaggggcgcaggagagagatgggccaacggcccatcaagagaaaaaggaggaagaaaaaaaagaaaaaggatttttcctgggatttatattgcaccttggtgattttaaattggttaaaattatttccaaggctctgaaaattccactaaaaatcttgttaatgcattagggcatggggaactcaagaaaaattccaccacgccatttctgattattaattgcatttattaattagggattagctctaggttcattaaacaatttcttcgggcaatttattaaacaatttttaaagcaaggaaaaggggaaacttcagggcgtgacataggataaggcgccgtggtgggccgagggggaagatgaggatggcgatgaatcagagggggaggcggtggcggagtgcggcagcgcgagcgtcaggttaggggcggcaccgatctgggcgacggacgggacgggggcgcgggcgcgctccatggcaatgtgcagagggaaggtgtgggaagaggcagcgattgatttgctcgcatgcgtgattttcggccggtcaccccgcgtgcgcgcaatctctctcccacagtgtgaccccgcgtgcgccggtaccgttggatctagaagcgttggatgatttggaccgttagatttgatgaatgagtaatgtaggtgtaagagtgagttggtgaattatagggtagatagactatagttcgatttttatattttcctcaattttctactattaatgtaggattttctagacaatgagagtactaaacgtggaggcttctttttctattaatttattaagttaatagatttctagtatttattaaagtaccatgtggtaagttaggagcgtttgtaggagtgtcatatggcggtttaggattatttgtaggaagtttaatggatttctagtatataatagatagatagactagttttcacgagccgagctaagccgaatcggctcgttagccccccttacatgcgcgaggttgatccgacagctaatggcagtggactgagatctattatattattaaaacagccttgaaaggaggcaccacgttcgctgtggaggctaaaaattcccacattaatcatagaaaaagaaaagaagaatccaaatagaaatacaaatataaaaatagctaacattcggaattaaaaatatgcattattgaaagaggagtccatatagcaacccaatacatgattaattaaaactcggaataaaaataaaataaattttgaaattagaaaaagaaaaaaaaacaagagttcgagaaggaatacaatttaaaaatatcttaaattcagaattaaaaaagtccatacaggaatccaatacaagattaattaaatttccgaataaaaaaataaaaaacaccgaaattagaagaaagaaaagaaaagaagagttcaagtaggaatactgtcagggttattgataccacatacctaatagtagttgactaaatctcggcaggacccaccacataccatgtcttatacggaaaaaaccttcggatataggaggagttccgtataaggaaggatgaatagagttctacatgaaaacgacaaggactactcggattgtatctatattggtttccctagttctacttagacaaagggacacctatgggtataaatacaaggtcccctaggaggagaggggacacagaacaatagatcaagacacaagatcaacatacaagccaacatgcgccaagacaagacgccggatatcgacttcagagataagcatagctagtcccctacggtgtctacggatactatcaggagagacataacgatgtctttgatctcgccggatgcagattcgaggaggaaggctactctgttgtcgactacgagtcagcacttcagaccgccaagtcgacaacagttatataggctaccccaaatattgtactggtgcgattttggtgaataagagcaacgaccggcttcggccaacaggagtagggttattacctgacaattcaggggcccgaacctatataaaaatcctcgtccccatctcttttacctaagtctcgcatatatcctggtaccaacgatccccatactatgcaaataccgtagtcgtgacatcaaacgtcgacaaatacaatttaaaattaacttaaatttggaattaaatataagcaatattgataagagtaaatataagaacccaatagtagattaattaaaaaatccgaaatttgacgggccgtagaggagtatagttgcatcgtttgacgggacttctaaaaattaataat

SEQ ID NO: 77390 - DNA, 3793 bp, Oryza sativa
aaaaattaagaataaactctaaaaactataaggtccaatttttaaaggtttggaacttctaaaaaatataaaaaaaccaacgataattatgtttgatttttaaaatagcaatggcaataaagagaagatgcagtggacggttgtagaggagtataatggcagcatttaatgggacttctaaaaattatacaaaagaaccctaataggacgataaactctaaaaactataagtttttaagatctaatttttaaaggttctaagaagaatgaatagaaacggtggtagatcaagcaagctaataaagaataatatgacagaagtaagtggtagcaacttatgtgacttttaagaactataaaattacaaacacgaggatgataagatttggtctttcaaaatctcaagatatcgagataaatttttaataaatcttaagtaaaatcatattaaaaaatatataattttatatgggtgctagccgcgcaattgcgcgggcagtttaaaaaactctgtcacgtataaccagccccagacgcaaccacggtggttgcatccaagcgaaggatttcataattaagtcattaatggccaatttggctctaatgggacttgttaattaattttctcctgattcttgccagctaaacccaccatcctacaccttacccatgagagggatgggatggcatctcaatctatgggcgccgggcggttgatgaggcagacaaaactgatcaattttcttttgttgcattgtgaatgagcccaagctagtagaaaaggagtcatccggacctcgtctgaagtccgggctcctgcaggcagcattatacccatcaatacacaaacccaatcaaccccagcaactttccgggccatcggacgagctggtccatggaggcggccgtcggcgtggcgagctggctcctcggtaaggtgttgacgcaattgtccagtgacttggtggcggcgtacgttgccagcaccgagctaggccttaacgtggaggagatcaaaagggacctcaagtacacacaagggctattgcacatggcccaggggaggaaggacatcagggacaacattggcttacagggccttctgcaggatctaagcaagaaagccgacgaggccgaggatgcattggacgagatccactacttcatcatccaggatcagattgatggcacccatgaggtcataccggaggcagatggtggcctccgaggtcatgccctccacggccgccatgctcttcgtcatactgccggtaactggttttcatgctttttttgttcttctgcacgagcacgacatgatgccgacgactcgcaagatacagccaactcccatggtgacgtcattgaccaggttggcaacttgccattcaatcgagtagacatgtccaataaaatcaagtcagtggtaaagggcatacatgacttgtgtacgtgtatatctagattgctccaaattaaccaaactgcaggagaatgggatacatccctggagcggcctcccactagctcaacgattacgcaggataaattgtttgggagggaaataatctttagacaaactcttcatgacttgactaactgcaatattccgagtggaacactatcggttttgcccatagttggccctggaggaattggaaaaacaactttcgcccaacacctctacaatgacaaaagaacagatgcctacttccctatcaaggtctgggtttgtgtgtctactaatttcgatgtgcttaggctcactcaggagatcctaaagtgcatacctcacgataaaagcgcgggaagcgaagcggtgcataactcttccaatttggatcagctccaaaaagctattgcagaaagattgaaatcacaaatgtttttacttgtcttggatgatatgtggaaatgcggtagtgaggcagagtggaaaaatctagtagctccattcacaaaaggggaagccaaaggcagcgttattcttgtcacaactcgatttccatctatagcacaaatgttgaaaacaaccgagacaatacaactgcagggtctcgaggatagtgaattcttcacattctttgaagagtgtatatttggtcaagacaaacctgagtgttacaaacgcgacttgattggtattgcgaaagaaatttcaaagaaattgagaggttccccactagcagcaaaaactgttgatcgtttattgaagaacaacctttcccatgaatgttggacagaagttctggaaatggatgagtggaaaaatctgcaaagtaacgttgacattatgccagcactaaaaattagctacgactaccttccttactatctaaaaaagtgtttttcgtattgcgccctttaccctgaggaccaccggtttaataatttagaaattacttgtttttgggaagcaataggcattatagattctggatatcaaaacgatagagctgaagcaataggattgaagtatttggatgagctaataggtaatggtttcctcatgaaggtaactgatcgcaatagtcagtattatgtaatgcatgatttgctacatgagctagcacaaaatgtttcgtcacaagagtgcataaatatagaggagttttacggtacaatatacttgcaatatatacttgcagtataaataatctaacggtgtggattcatccaatcttctttttacagtataaactagcatggtggcccgtacagattgtgcggctagtatcattatattttctctcatataatagcacatatgttttctcattatattattcaaatatattaaaatgacaacataattttaaattttgcaataactttacgaaatcactaatgtgtaatattcatattgtattttacatacgtgttagttattaattatttttaatattaaattttagttatctgtaaattatatatattcttcctatatggactttagactcgtcttttaatatttattgttttaatttctaaattttcattatttctaattgtatttctacgtggactctaaacttaattttaaatttcagttacttctaaattgtattcctatattgactttaaactcttcttcccatgtttttcttaatttcgaattttagttatttgtaaattatatttttatacggactctaagcactacttttaattttattatgtttattccgaattttagtatggactttatactctacttctaatattccttatttttttaattccgaatttctattttttttcttaattgtatttatatatggactctactctacttctaatattccttatttttaattccgaatttctattattttctaattgtatttctatatggactttatactctacttctaatattccttattttttaattccgaatttctttttttttcttaattgtatttctatatggacactatactctacttctaatattccttatttttaattacgaatttttattatttcctaattatatttttatatggactctatactcatcttctaatattccttatttttaattccgaatttcagctattttctaattatatttctatatgaactctagtctcctcttctaatattctttattttttaattccgaatttcagctatttctaaattgtatttttatatggactctgctttttctttttctccaattaatgtgagaatttctaggccatgagagcgaacgtagaggctcatttttctatttctttaataatataatagattgtgaagggtatatttgtctttctatattttt

SEQ ID NO: 77391 - DNA, 716 bp, Oryza sativa
tgtgtactagttgaactaagcatggctaagcattttcctaaaccaacatctagtcattttgatacccaagttatcaatggcataaggtaaacaataaatggctgagtaataggacccatcccacatgacattgtaaaaggatgcaacatttaatagaaatgcgggatatttgtaaattgggtacaatatgatcaattgtaatgcatgacttgccttgctctcgcactgatgagacctcagcaacgtcttcgagaaaccgcggatcgacgaaacggccagtctacgcgacaaacaaagcacacaagcaaaacatgctataagactactgaaacaggaaacaaaaccatttttaatggattctagggatttttataaatttactgagacttgaatggatttaaacagagctcggatgaattagttatgattttcagaagataaactgtgtttttactataaaaagaaaagccttattggtttattgcgcaatatatattcccagatgatgtcagcaggggggcgccgacatgcgggcctcactggcagcggctcaaagggggtggtccaccgtggaccaggtccacggggccggggtggtggtgtatcacgtggcgtcgacgtggcaccacgtggctggccacgcgggccatgggatggacggccacgatcgggcgagggccgatcgggcggttggggacgggcggcaccgaggccag

SEQ ID NO: 77392 - DNA, 6330 bp, Oryza sativa
tatttgtacttacatccaaacaaaacaaaattgtaaatgtatcgaacccttttctcctatttcctcaaaaaattgaccattgagtagggaaacactgcatttaaagcagtttttttagggaggggggggggtgggctggctaaaagggtggttaaaagaattcgttgttggttggacaccggataaatttagtctttttgacaacaaaccgagtgaaatggaggaggaagcaataagcaaactgatctttgtgaggagtgattttagaaaataaagacccaactacaattctaagacataatagcaggtgtggaaacaatatgcatattactcatttactcccctggatcaaattaaagagctaccttagtctgtgctgaggagtgaagtttgtactatagtcgttaatccccttaactcgaactgtacgtttgtacttagttttagataacgacgtgcgttcgtacctgaatctgaatgagaggggtgaagtgtcgtccgggcgtaggaattcattggccgggtggatcggcaccaaatttgaagactttcttcagatctgcacagctagcttatatctatatttattaaggagacagcttatgcatacagatagatttatttatgaatgcaaagaatatacataatagcatatagcatgaatgattgattgattaattaattcgtaagcaatcatatgacagaacaagaagaatttttggcagccaggatatatatatatatatatatatatatatatatatatatgtgtgtgtgtgtctagattcattagcatctatatgaacatggacaatgttaaaaaatcttacattgtgaaacggggggagtatatatctagcattctagctagctagatgatgtgaagaattgaggcttttgtcttctcgctcacatggaactttagctagctatcgaaattgaagaatcatatggatgcagatgcagaaacaaagtagccagaggaagagagatctgcagttagctagcgcacgaatgatcgatggatagatcggtgacatgtagtagtacgcacgatacgagtgaatgaacaatctgtgagtgagttagggcatgtttggctcagctaggagctggagcttagccaaacagtttcagtttcaactgaaatatataagggcagagctgggtggagcactctcacaaaatgaactagagatgtgaagctgggtttaggctgcttcacaactccactccaaacccaactactgaagctaaatttaggagttggaactctatcaaacaggctcttagagtatatagatgagtaatctttgataaagaaagtggtacttgctatacatgcatactcccttcatcccaaaataattttatttctatcctcttacctccactcgattagtaagtcgataagctttattgtttcaataccttttaactatattttaaagataatgggataaaatccggcctttgctaaaaaagctacggccaattattacacatattcgtctctaagagatttaacaaaccataaactcaaacaaataagcaccaacacaagataaagaaaccccacaattattgtatcctactcgcacattaatattactttcccattaacatgttataatttagtttttttctctctaatttgttttgcacacacaagttctaaagataaagttattttaggtctgttgtttttgttcatgttgattgtctgtcctgtgatatgcgttttgattcacagaggggctcagtcataatattggacccaatgcaaatggacattgccgctgatcttttatgttgaacggttgaatggtttaatagctgatgtcatggttatggagggggtacaaatgattaaattactattataaaatagaaaaaatgatttaaaaaattctctgagaaattcatatatagaaaaaaaattaaaagttataaagacgtgaaagcgtgaacatttgtccattcatccgttaaggagcaatataccgaattacatagaattatttcaactcctagctactccgattatctgacatatataggcatgtccttttgtcttaattaatggaatggaatataagaatacatacacttgttaggctcctaaacggtataaattttgcaaaatctctctacaaacaattttttgaaacacaatttaaaatctacttaaatttatgatagttataattaattttattagtccgtattctcgaaacatttgtctatttagctaagtagtattcagcagtccgttctattccatttaggccaaaataacacccaggcaggagggcatgcacacctaattaattaatcagataatatagtagctagccagggagtagtttgattaattaatctcctgtcacatcttgctacgctgatggttaaccaaattgctaaatcccctataaatatatataattttatactacgaatctgcccatttacactcaataaattatatgggcgacgatcatatccattaataatcaagtagaaaagcagatcgcaaataaaggcgacctaaatgctaaacgtgacaaattgtcgcaagtatctttcacgtacagttttttttaaatgtctcattattttctaatatgcccttgttaattaattccttggtattatatatttttttgatgaggaaattccttggtattattgcactcaagaaatcagatactcaaaattaacaagagaagcaaagcttataacttataagttacatatttataacggcggtaaaaaaaatattaatcgtgccgacagataattactcgcggttaaaaagaaatcagaaattaaagcggaggtactttgccacgtccgcaagtaaagcaaaaggcaagcaagcagctgatcagaacttcatggatgctcatgagaatcagatcgataaatagaataaaaaagagagagaaaagagacaaaagaaaattaaaaagaaaagcgtaggctatcagtgatcagtcagaaggtgccatgaccaaattttgtcacttcctcctttccagctcccacgctcttcctccatacgaattcattaccgccactgaattaatcaatcaattaagtagtagtatttacataatggagtatttgtgtaatatacttccttcgtcccctaatataaagtattttgacattttacttgtactatttgaccattcgtcttattaaaaaaaaattagaattattattttttacttgctttactatccaaagctttaagcacaacttttcgttttttatatttgcacaactttttgaataaaaagagtgatcaaacagtacaagcaaaatattaaaatcccttatattaagagacggagggagtaatctagaggagaacttatgtaatattaccatcattttttagaaaaactttggcaatacacattcggttagacatagatgttatgtttttttaaaaaaagatatttttaatttagactattcgttatttctaaatttttttataaaaatagacaaacataatgtgcttttaaaagtactctttttctataacatatttagggtgcgttcggcactgcctttttttatcttcttctatttctcgttttatacgtgcatatttttcaaatggttaaaaagtgtattttgttaaaataattatagaaaaattgcttgaaaaattatattaatctattttttaagttttgttagtcaatacttaattaattatacaccacaccaatgagttacctcgtatttcataggtggagaagttcccaactcttctcgtggagacgtggacacagccttggggatactcttttcagtttaagtagttgaataaataaacgttggtaaaaattcgaggaaataaaaatcaaatgtgacatatattaagaaacagtggtaataaaatattttatctaatgatttgagtggatctgccgttacatggtgcggcgcccaacgtgtagatcacaatgcaagtagatttagtgggttttatttggtcaaatttggtttatctgcctcactctagcatgcatgcatacgagtgatgattcctctaaaatacgtactttacatgattaccgcgaattgagagctacgtgttaaccacaaggaccaagagatcgatcgaccaattagcttagcttggctagcagatactctcgtgcgccataacattagtccattaattagaaagttaatgatcctattagggtaaatttggaaaataccactgcaaagatacgtgagttgcaaaataccatcgtacgtgagaatgacatgtggggcctggacccacatgtcaatgacacatacgatggtatttttcaactccgtgatttttgtaatggtactagccaaattggcccattgtattatggatcacactttgttaattaacacacattccccatatgcatgtgtatgtatgcatgtatgcatcgatcgatgtggggcccgaggacagggacagcacggctaccgggcccacccgcagcttcgattctccctctgtcctcaaaggcatgatgcgatgtgccatcggttcatatctctcttttttggtcactaataaccctcctcctaatcaccttgtcaccgacatcgatcaccttgatcgatgagaaataagcacccctgcaactaatcaatttatatttttgatgactcaactaatcaaattgaaacttacacgccacaaaaatataatcaattggagcttgaaagtagaatgcacgatttgggaaatattctgcaacttcaattcattgatcatgaattgtgagaacttgttgcgacctgcaaattttgttgtatgggggaaataagatgatctggttgaactttggcattaatttgatgttcgcatgcgtacctgtatgggataaatttgacagatgtaattatagtacaatcgtagtgtaattacactgtaacttatatgtaattgcactgtaacttgcatgtaactacagtgtaacttgtatataagtttcacgtaatttgaagaaaaaaaatcacagcacacacatatgtgtaaggatttgttcccacaaccttaataacatattacagagagatttttaaaagttacatacaagttacactatagttacagtgtaattacatgcaagtttcagtgtaattacactacgattatactgtaattacatctgtcaaatttttgggagaaaatttatcgacaaatatatagcaaaatcgtacctgcattgctttttgtttagactctattggattttcgcatgggcgtatatacctgttctgtaatttatcataaaattctttactagttaccaacttactattgacaagcgattgatttctactataggaattatcatcaataaacatgagttataccgaatagtattgctgtattgcacgttgaacagacaatctttccttcgcctcaagtgcacttagcttcacactgtacacgtcataaaagccctgagcttaggcagttcttcagacatttaagaagtaaaacagacataattttatatggtttagcgaaatgcaattgatgaaggctaacagctatagctaaaaaaaacacatgttggcgggtacagtactcctcggtttttaatatttaacgtagttaattttttaagcacgtgtttaatcatttatcttatttaaaatgtatatgtaaatatggaaaatataagtcatatacttataacgataaaacaaacaaaaaatgataattatgtattgttttaacaagataaatgattaaacgcgtgttaaaaatgaactgcatcggacatttaaaaattagatagggtatttcgtaaaacttatgtttatcgaaaaaacattgtattatactaaatctgcactatatatcgtgcgatggaggaaatataataaattgtcgtgttgcaagtcaatgcattgaatcacatatcaatacagtatactagtactccactctgtattaccttgatgatgatgatgaagaacgttactctaattagtaaaactaccgtccacgtcaccacccaaccccaacgtacccagcgcccaaagtcagactcagacagcccagaccagacatggcgccgcgcgcatgcagaaccgtgactctctgcccacctggccccacctgtcatctcccccacaccgacgctccccccctctcccgcttccgctccgttaaactctcctggccccacctgtcaggcggacttatattagtactactagtaccagtcctctcctcctgacagctaagcaccaaaccatcacttcactcccctgagctcaccttgatcaccctcctcgcca

SEQ ID NO: 77393 - DNA, 852 bp, Oryza sativa
ctcgttaagatcgcgaacccgttaaccacggggaggagctcgacggtggagggggagaactcacctccgtagctccgctggcacttgaacggttcactgttggaccatgaggaaacgagcttgagcttgccagcggcgtcgggcgcttgaggtggccgacggcggcgggcgctgggggagaggcggagaccagcggcggcgggagctggatttcccagcggcggaggacgctgggggagaggtggagactggtggcggcgggcgctgggggagagtcggagaccggtggcgtcggccgctgggggagaggcggagcagcatcgtgtctcgggtggccaggtggggaattgaggagtgagtctcgagaggactagggtttgcagttgcacagtatctacttgtggcttaggcctttttattgtattgggcttttgggttgtctgatggagtcctggctcgttaagacttgcgagcagctcgcgagccagctagctggctcgttatatctaacgagctaaaatgccagctcggctcgttaggaaattcaaacgagccgagccgagccagtcacaagcggagcgaactaacgagccacgagcttcctgtccacccacgatgcgatctgcgccaaaccccccgcaaggccgcaaccccgtcccctcgcatcgcgttccatctctcgccaaatcgtcgtcgcctcgccctcacggtcgcgcttgaagtctgcaatggccgccggaccaggtcaccatcacctcgccctcaccgtcgcaccgctgccaccgcatcccccggttcaactccactgagatcgacttctccctcgtctgcgccgccaccaacccgtcgagg

SEQ ID NO: 77394 - DNA, 608 bp, Oryza sativa
agagtgaatggtccaacagttatgttatattgtccatttgcaagttaaatgtttttttaaaaaaaagagatatagcgggttgattctgaagtattatcgtactattcaagagtagagaaagtagtaatcgtatccaaaatacatacaaagaaccatcatacataattttagcattcagagaaatagagatgcacgcgcaacgcgcgggctatcttcctagttgtcctaatttctcttcgttgctgcggccatcctcggagtgctctgtctctcatatacaagacataaaccccacatggtttcccaacttgtgtgatcttgacattcggagttgccccaagttgtccctgccccccatgcctcatacttccacgctgacacgtgttagtgtgagaaaaggtgatgaaacactcttgtattttcgggaagaagagctgacagcataccattatgatggtgctttggcactccacaacctgggtaaagtaaaagctatggaaattgtagatatgctgcattttccattggctgacctccaaaatctaaactgcctaacacgacattctttcgaggattgcgataacattgacaatactgttgttctccat

SEQ ID NO: 77395 - DNA, 521 bp, Oryza sativa
attaagagcggcgggctgggcggccgctcgcgtgccacgtcggataggtacagtgcgcgggtagaagttttgcgaaaaaatccttctattttttgtaattatatatatgtccttataaacagtacttgaaggggaaaaatcgcggaaagggactgctctgtaaaataaggaaagaatagggtttttttttcaaaaatgacgcccactaatctaaccccccagaccttatccgccgccgcccgcaccctctccctctgcccgctccctctccctctccgcggccgccgcctcggccacctggatttttcacattttgatccttttaaaaaacttatttcgcaaatagacccctgaaaaaacttatcccagaaatggtcttttttggggcgccagagtggctggcgccgtcatccaacgggacagcgccagcctctctggcgccgtcttcctgccaccgtggcgcacgcgaaccgacgtggcaggaggagcatgctagcgccgccgcctccattcctatttct

SEQ ID NO: 77396 - DNA, 1150 bp, Oryza sativa
ttacaggcaagatgttgtgtgaagaagggcgagcatgtagattgctaagctgacacgtggtggacaagaatgaccgtcgtgactggtctgataccggtcatgttgtcagcagccagccccgattccacgtcgcacctgctcccggcgaaagtggaggtagttgtgggccgtctcatcagaaggtgactcggacggcaactatacaaatctccgtccatttatgaaaagggggggggtaagtccccacaaaaaagagagaaatggtgcatgtggtgtccccttaagatataaaaggaggaccttgcccactgagaggggggactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccatcaccatataatctttgtaatccatgatatcgtgtgtctttagtcaatatttgacaaatgcttagcccatgctaatttagattcatgcatattcatatttatcaaaatgctttatgcttgggcaattaccttagggaaggtaattgacatacggcatgtggagacatgagcgccacattgctatgataatgatgagatgatttgtgaaagaaaattaaactaaacaaatgttttcgactgaggcggctggaggacttgggtggtgtccggtaaaggctagtgccgtccctggtcagttaaggaccgagccatgaagttaagcatgaatcgaccccagtacatccgtatttctcgaatgggtatagacctagcggagtagatagccgagcggaggcagtatccctgcatacccgaaacaagcagatgtggacgaacaagcagtctactggcggatacccgaaacggatggccaaatggcggatacccgatacggatggccagagactgacttgtcaagactacaagactacaaggagataaccaaaagaggacagcatggattggg

SEQ ID NO: 77397 - DNA, 2463 bp, Oryza sativa
  unsure (1)..(2463): unsure at all n locations
ttgtccaaaaattttaaattgtactataccttttatgatttcctatacttttgggatttcggtatttattcgttttcaccatgtattggtttaacataattattatataacttgtaggcttggacatttattaattagaatatactaatatcaccttattaatacaatggcacattggtcgagttaatttggataacaatgtatttacacatggataggtttaatctatttatttcacaaaagtaaattgagacttggtaccatattgatttaaatgtttaattagacattcacattaacatattatatatataaagctcaatttatttgcattaccatttactttatgtgagtgaattctattccatgagagactcaatgaacattataaatattaatgtaaatattctagtggaacgctccttttatatatagaatcatcgtagtggcgattatttcatgtgtagcatttaatatttgacttataaattgatttagtaattaaccttctctttgtattgctttgttgtgttgtgcataaatatttgtagggttcataataaatatcataactttataatttttacgtagttatatagctttagcttaattttcatttgtgatattttatagtttggcaagcaataacaaccataacatccaccatgatgcacaacaaaagaaccaataacatcggcatgatgcaatttatttaaaagtttttgaaagtactttaatttcaggtttcgttttatttgtcgaattttcagggtgttacaaggcggtccaagtcatcatccggaggcagcggtggctgcgcccttccgcggtgggacccacaagtggtgaggctggccatggcgccgtcgccgcgcctctcccctcccctctaccccttcccctcctgtcgcgaggcgctcaaagcggcggagcttggcggccacctgtctgtcacactcggattttcccttcccttaagtttcaaatcactaataaatggcttcaagaatttggtttaattaaccaaaagaaaaccccagttagcaatgcatttaataatcggaattgttaggaagaatttttttcgaattctctttgctctgaaaatcactaacagaacttaaaggataaacatcttcctcatttgcctttggtcgtgaattatgcccaattcactctcttctcagtccgcggtttcgttttgcatgacgaaccgtatctgttcgcgggaccgttttctttccttttctaaaacggcaccgcattgtttttccttgttgggaaagtctcccctctctgccaacattgttgaagaaaagcgaagagaagaagaaaagagaagagaagataggagagaagaaggaagagacttacatgtgggtcccacaattttttatttttttattttgctgagtaggatgccacgtcagcaaaccagatatccatactgccatgggaccgaaattgcatggttttgtaaagtttaagggtgaacatttctggttttggggtttagggatgtcatacaaactcaacgtaaagttaagggaaggatggtgaacttattccaatttgttgagacggctgagcagctacgcttatggcccagcttcaggccgaaactctaccccaggccagcccaacaggaaggattcatgtagccattagctagcccatcaccgactggaggtttttttttttaacacattatagatttggtttcgactatttgatatctggttcattttatcataggcattgtcatgaagtgctaacacaatcaaaatgacaacgaatgtatggctcattttatcataggcattggtgtaaaactggatgtcccatttcgaatttgatttctcagcttcattgtagttagacattattaggcatgtaaaaaaaattgtgactgaaatctagcctttgccaaatgttctgttttgtcttttgatgttcaacatggccatatgtaatagagaagtgaagccataaaatatgtntgtttaggaggcaaggcataaaagattgtattaatcagatgacctatattgccctcgaaaactgcatgccaacccaggaaaactgtagcctatattctgatgattcttgatctgaattgtgcatatacaaatttgtggatctgtagctatgtcatcatggattgatgctttctgactatctgttcaagctagaattctggttatcaatctttctacgtttttcattgaagatgtgtattggttcatgcatatacataaaaaaatctgcacgatatgcatgtctcaggtggttaatattcctgtttactaaaacccatttcataacgtaccgttctcttgcattaatcatgaactggagaaaccttttccgctcgaacaattatcactcaaacaattttttttttatgctgtgaacctccaaaaactagatatgtgagcaagtcatgtttgattcgtttaaaaa

SEQ ID NO: 77398 - DNA, 595 bp, Oryza sativa
caggaagacgcagccggcatggtaccaattcccgccaggccgaagcagctccctcgcagtggcagctgccccagcatcgggccgagcaagctctcgctgtcgtcgtgagccccagccaaggtggtggtcgcggcgccgctggacgagctcacggcgttctgcgggggctttaataggacgagtgttgcagcatgaggatgtccagcattagtgtgaccgacatggatgtggacaaccccgttgagctccgcctttgtcccattgagcaccgcttgcctgcgcgccgacgacgcccaaccgagccggcaccacctcccgtcctactctagcaccacctccgccgcgttgagccagccccgacccttgcgcacgaccgcgtagcgcttccccagccgaggtgccgcaccggactgcgcctcgccgtgctgccgctctcggttgaagaaagaggagagaaagagagagaagataaggaagaataaagaataaagaaaaaaaatgaaaggtaaaaccgtacttacatgggtgtttctctctcaaattccatcagatataataaaataatccgacgggtgtccaagcagctaattactgg

SEQ ID NO: 77399 - DNA, 2338 bp, Oryza sativa
  unsure (1)..(2338): unsure at all n locations
aggtttgatgcagtcagtaatcagacatgtggatttgtctcaggagtgaagtttgaactgtaggattggaatgtggaatgtggcaaccaagtgcatgtccagttcgttttttatgggcctgttcactataagctaattttcaaccttaccgaagttcggaaagctaccataaaagtggctacatttagtatgctaccaaaattttggcaactttagtaaaattttggcattgccaaaatttggtaaggtttttttnggcatcaaagtgaacaggccctatattttgcctacatgcttgttcagtgtttactggaattacccaatgacgattgttaattccttcttgacaatctggcaaacatcactcttgtgctgtgttctagtacgtaaataagtgaaaggtgaaactgttgcatttttcagctattttctgattctgatcagcatagccacgttattttgtcattcaaaatagtgataactcacaccctcaagtagccttttttacttatttacccttgtgttctttttttacttatttacccttgtgttctgttggaagtgtctatagttctcagtattccttcacttgttttgaatttcttttctgttcaaattaaacatttaaactagcctacctctagacttaccccagtagaatttctgagtcccatcgaaatcttcctttatcttctctccaactcatctattcttttcctataaaccatcgaagacaacccgatctaaactacaatcccaaggaacactataatcatcgtgcatgctcgctcattcatgaatcttgcgtttaaaataggcgcgaaactttaaccaagtctagtagtttcgaccaatgttttaagagcaagtttaatagtatagctaattactagctccaaatcatctatagccaatataatagctaattcatacaatagttgtttactataatattaatacatggttacacctgtcatacacacattatatctttactataatattaatacatggttacatctgtcatacacacattatatcttagagttcgtgctgcagctggctacagatatgtaacccgctacttttctctctcttcttttatctttttaaaatatgtttatagttgacttatctgctattgtacctgtttaaaaaagaatcctttagtttagtctccttgttccactatcaacttataaagaataaaagctaagcacggtagttaaaagttcgacgtgaaggcatttactgaccgccaggtgctccgccgtcgtgtcgcacaggcagcgccggcgacccagattcccaaaacctcgtcacctttctccgccgcttaccaagaacaagaacaactccctctataaatcgtccacacgttaaactgtccgtggatctcgccgtcgccggcgacatggcctcgtcgcagcaggcggtgcgcgagacggggaggggcagggcgtcgtcgtcgtcggccggcgggaggaaggtgaccttcggttaccacctcgtggagggcaagacgccgcacggcatggaggacctccacgtcgccgagttccgccgcctggacgacggcaacgaggtcggccggcctcttcgccgtgttcgacggccactccggcgccgcgacgtcgccacctacctccgcgagcgcctcttcgacgacatcctccgcgagcccgggttctggaccgacaccgcgccgaccggaaggtgctggtcaggacggcggcgacggcgggtcgacggcggtgacggccatcctgatcaacggcgagacgctggcggtggcgaacgtgggggactcccgcgccgtggcgttcgacgtccgcgcggggcgggcgcagcagctatccgtggaccacgagccgctccgggagcgcgacgccatcgagcactgcggcgggttcgtgacggagatccacggcgacgtgccgcgcgtcgacgcgcagctggcgacgtcgcgcgcgttcggcgaccggcagatcaaggagcacatcagctccgacccgaacgtgaccatcgaggacgtcggcgggcgacgccggcgatggtggcacggagctcgtcgtcctcgccagcgacggggtgtggaaggtgatgtcgaaccaggaggcggtggaggggcacggcggacgcctggaaggcggcggcggagctcgtcggcgaggcgctcgaccggggcagcgaggacgacatcgcctgcgtcgtcgtgcgcctccactgatcggagcatcgtgttcgtggcatgtgtacgacgtgtctcggaaatgctactgtgcgagcgatcgcccttgctcgcccagggcgatcaaattcgcccccccccctccat

SEQ ID NO: 77400 - DNA, 2282 bp, Oryza sativa
tttacaaaccaaaagtttatatattcgattcaaatttgaatttgaattcaaatatttttatatatagtatttctatatatctaaagtttatagacctaaagtttataagttaaaagtttatatacccgtttcaaatttgaatttgaattatatctgattcaatttgaattcaaatattttctatatatagtatttctatacatctaaagtttatacacctaaagtttatacacctaaagtttataaatcaaaagtttgcatacccgattcaaatttgaatttgaattcaaatattagtttatagacctaaagttttataagtcaaaagtttacaaacccgtttcaaatttgaatttaaatttaaatatttttatatatagtattttctatacataattttttttcaactttgtttttttatttttttaaaaaaattatgatgtagtaggaagagaagaaggggaggaggaaggaaaagagtagtgtatagaggggagggggcgatcacccgcccattagcacccccgacgtgtcttgtcagatcgtgatttgctctgacgcgccaaatgctaaaaagctcagaaatatttcaattttcatgcgagatttcagaatttttcttacagcgattggcagaatagagaaacaacatactggaaaattgaagtcaaaactcaaagtcgctctgaattcttatgttttgacttcaattcagaatgtttcttacagcgattggcagaatacgcaatctgtatccatggagcctccatggaacataggaattttcatgttcacagttcacacgtccattactttgaaattcctccattcaaagaggtctgactcgacgaggacttgtaatattgtggtatgatgtttgagatagatttcagctcaagatgtttgagatagatttcagctcaagtaaaacgagaaaatgattagttcggttcattaagttttaaattttacaaaaaaaatatataattaatattctaaaagaattttttaaaagaatatcatttaatattcttaaatatgctgaaagatatgtacttaataatgcaatagcaaggggagtggttggagtggtttaaacacgtttaaaatttcttgttataatgtatttggagtgaattctctctcaaaatcttttttttctataacggattataaacgtgctaacaaaaataggaataaggatgtaatctgcatctgaaacgaacgggcctcgattctaagccaggccgaaacaaagaccgggttgacatgggcttccctcaaggcccaacagaacaaaggaggcccgttcaggcccggcccacgccagcagcgagaaccttccccaaaaaccgtagaaccataacccgcagaaggcaaagccagaagagacgacgcagcagacgccgccgccgtcgttcacgagacccatttcgccacccacccgtgctctccctcctctcctcgtgctcgtggtgggtagggggactaggatactgctagggttttgcgagccatggcgtggaccgccgccgcagccaccgtcaccagggccgccgcaacgccggccgcggagctccgcctgccgctcgccgccggcctcggccgcgcctccttcgccgtcaccggccgtctccgccgcgctgtctccgcgtccctctccaccgccgcggccgccggtacgcatcttcttcttctcgaggtagcattccgttcgcctactgggactggggagggagtcctgctttgttctggccaagaagagggcgtagtagttggggattttgtttgtggccttgtgggggtgttctctctttcatttcaactatatccctgtaaaaatgctcaaaatatcgcatttctagattgttatataatcgattagaggcagccttcagatttttgacaaggcaagcttttggattggattcgtttgttttgttcacataacaaaaaatattgccaaaatgcagggttttctcttatttgtggatgtagatttgagtcgctaataattactagtatactggttaatctctattgagagggcagaaattcagtgtggtttaacgtctacatctgatgtactaaaagcgagcgtgattggctagcgcattgggagtgcgagcttagtcagttaaccacaaaaagtttacatattcatgattcgtgaaccactggtttggctgggctgatagtgcgcctgatggcagcaatagataactagtgtattgcttaaacaaatcacacaaaatagtgtccatttgcagggctgcaggaat

SEQ ID NO: 77401 - DNA, 635 bp, Oryza sativa
aattgaaacaatttgactttgaccaaagtcaaaaatatcttataacgtaaaatgatggagtatttctttttcttttatataaaatccaccgtttagcggttaagaaaacgtgataatagaaaaatgagaaggttgtagtatggagcgaaagtttagaactaaatcaattgggtcgcatgaacgattaattggaactgtcaactagcgtttgtattacgtccgtccgtgcatctacctaatacgagtatagtgcaatcccacttccactatacgcggaccatttcaattcgattgactttgtctcttaggttgctcgatcatttgcgagaaatttgataatatgtcatccattccaatgccgtgtacttttgcccttcgccacgtacacatgtcagatcttaggtcccgcccaacgccgttgccgctacgcccttccagttgatctatccactcaagatcgatccaagccaagcttgcccgcccctatctatgtgcctcgccgcctcggccacacctttgctgctgtcgtcaagaggaggagctggtaattaaactagcacctgttttcttttcaattaagtaataatataattttcaaatagtaattaagcttatttacacctgcttgcctgctt

SEQ ID NO: 77402 - DNA, 1334 bp, Oryza sativa
tgaggtttgttaccttcatttacagaattcaattgatgaatcattccattatattagttatttcgcttaatcctgtaatattatagggtacttaagtctactgaaccattgattgtttattgctgtcatatatgaaccttaaaaaagaacatctggattcacatgtcttaaccatgagaggctttagatccccttatattctttctcttcccttcttctccgtgcttcatgcatgtttggtttcatctctagcccaccccaacttgcttgctcacaaggttttgttattgttgttgccatataagcacctccataaaccgcaaaacagtttattttgttgtgcattgttagttggatgataactgatgcctttcttcttttttttctaatgtgatggatccatctagtggatgtgtcataccttcttggacaaacatgatgaattggagcccatctttgtaaaggatagcccccgttgcttcctccgatatttcaagaactgtgggtgctatggcatgtcatggaatctcaccatcaccgcacaaaccttaacctgcatggttagtttcaatgccctgagatgtgcaaaagttgtattggagggcagggcacctgagctctttgggatgcatgccaatcccaactgcgtaaccaaatacggatacttcccgcttcacgaagctgctgaaaggttctctgttgagatgatcaagctactcttacgctttggtgcatcagccaatgtacgcacagttggcgacgatgtcattgaggacctactcccgctccatattgcgattgagaatacttgcctgcataagtatcttgaggacaatctttcgcccagccagaatcatttggattatatctacaagcttatccacctgctatgtttacctgaaatggtttgtttcacttccctccctatgcaagtactacttttgcagcatgacataaatagtaactgtggtcataccatagatcccagacagctgttattacgaattagtgatattaaggactgaacatccttttgtctccacttgttagaggaagtaaagtttcccttttttaatcttgtcttcatgtgttagtgcatgttcatatggttaaaggcaaggagtcttcaataaaatatacaaaacatgttgctactaagcaattttattttctttgccttggagattgtccgtaatccttaactactttgataggaggaaatgaagccatatacagaataggaggaaatgaagccatatatagaaagttaatcaacactacttgcttgcgcgtacaaatgctaaatgtcactttgtttttgttccttgttttac

SEQ ID NO: 77403 - DNA, 6388 bp, Oryza sativa
cacctaacccatacacgcggagtagaaaccgcgaggggtcggggcgcctcggccctctggggcgaggcaggagtggtccgacccccccccctcggggagaccaagaggtgggcgcactcatcaccctcgggcccgacgtcccccgagggtgccaggccacgtgggtgattgtgtctgcctcaagcctctagtcatgatactcccggtcccatgtcaccgacagtagcccccggcgttatgccagggcaatcgcccttttcaaggggagcggtcgggcgtgacgccactcctaaagcctggtgacaagtgggaccggtctctacaaataggcagaaacccaacggtcacaaactgcgcacatcggcaatggtaactcggctgtcagcaatgagcggtctcttcaagactgccacattactcgagtagcacacgaatctggacgagccgattcgctttgccaggagatatgtgatggcgcttcggtcggcgagcgcaatcaacgcgcgcacgatatgatctatcttgactgccacaaccgcatatccacctcacgcgccgcaagcgggcgaatgggattagtggaagcgtgggcgcgagagacgagggggcgcaatagtgggcgcgagaaacgaggagccgggcacagcgttggcaagggtataaaggcactgaggaagggatttgtttctttcctttcgccatcattccccttgtcttcgccgcttgcgccctaactccttcttccctgcgcccttctttcgccacacgcgctcgctctccatcttctcttcgtccggcgccatggcacggggctccgcactgcttgatggtagcgtgctgccgccttcccgcatggtgagcgagaagcaggctgggttgccgcgccgcttcatgccggaatctgccaccggccgtgagatagtcatgctgggcgagggacgcccagcgccagactacccgggacggtccgtcttctttctcccctttgcaatggcagggctggttccgccattttcttctttcttcatggatgtcctggagttctacgatctccagatggcgcaccttacccccaacgcagtgatgacattagccatctttgcgcacctgtgcgagatgttcattggggtgcgcccatctcttcggctgttctggtggttcttcaccgtgcagtcggtatcgccaccgtcggtggtcggcggctgctacttcctgccgcgggggccggtgttgaaccgctacatcccctgcgtcctccgcaagaagtgggatgactggaagagcgactggttttacacccccccccccccgccgacgaagcgcgcctccgacttccgagtcagcccccggcgcaggcctccagctggcgggcgccggtagatctgggggatggctatgacgccgtcctcgaccgcctggcgggcctgcgatcccaggggctcacaggggccatggtgtacggcgactacctccgtcgtcggattgcgccgctccagcggcgcgctcggggcgcctgggagtacaccgggtccgaagactacatgcggacccaccagggagtcagatgggattgggctcctgaggacttcaagatattggtccaacgggtgctgaatctcaactccgtggaggcgtccctcattccccacggaatcctccccctctgcagcgatccagaccgcgcctccatcttgaccattatgacggcggtcggggcctcagaggagcaggctcctaagggccatgacggcgcaggcgggagccgccgaggggaacaatctaccccaggagggggtcgtgcttctgggccccgcgtcgggggctcggggagcaaccgccctaccgacgcccgggggaagaggaagctgggaggaacacctcccccatctcctccccgagggggcggggtggtgcgtgccagcagcaggcgccccggagggggccgcgccaacatcgcagcccgagggggagcgcaagaagaagcggatccgcaagatgggggagacagaaccatcccggggaaacctgatttctcctccaaggtggtcatttaaccgaccccctcgcaggttcgtcccacgctcattgcgaccgtctttcttctatcccaaaagcaagttttctcttacccatcttgtttgtcttctggtttttccttccgcttcagtgatgtcccgtcgcgttcctcccaccatcccaagtccggccagtccgaggccgaagatccggcggtcgcagaggcacggaggcgggaatctgaccggcgagaggccacagatcgcctacgggaagctgaagaggccgcccgggaggccgcccgggctcgccaggctgaggataccgctcgggaggaggccgcccgggctcgccaagccgaagaagccgcccgggaggaggccgcccgggctcgccaggctgaggcgatggcgacttccgaggcagctcgcgacgaggccgcgggcgcgtcgcttgggcccacctcctcgggcgacgctcaggcgacagcttctggggtggctcgcggcgaggccgcgggcgcatcgcttgggcccactccttcgggcgacgcccaggaccaaacaggtccgggggacatccccgagtccggcacgtccattggcgagccgagccgcgcggcatcttctccaaggcagctcttccccacgccttccgtcgccccgctgagcgcagagccccttctgcaggccttagccgccgcaaacaccgcggtgctggatgggttaagttcccaggtggaggccctgcaggcggagcgtgcggagctcgacgccgcatgggcgcgtgtcgaggaggggcggcgctcggtggaggccatggtggaagcgggccgcaaggcacaccgccggcacgtctcagatcttgaagcccgtaagacggcgctggcggagatcgctcgagaggtggaggaggagcggggggctgccctcatcgccaccactgtgatgaacgaggcgcaggactccctccgccttcaatacgggagctgggaggcggagctaaagaaaaagctcgacgccgcccagggggtccttgatgccgccgctgcccgagagcagcgagcaacggagaccgaagcggcgctccggcggcgtgaagaggccctcgaggcgcgcgccatggcgctggaagagcgcgcctgcgtcgcggagaaggacctggcggaccgcgaggccgccgtcgccactcgggaggcaacgctggcggcgcacgagtctgcctgcgccgaagaggagtccgcactccgcctccgcgaggacgcgcttaccgagcgggagcgagctctcgaagaggccgaggccgcggcgcaacggttggcggacagcctgtccctccgtgaggcagcgctgacggagcaggcacgccgcaatctagaatgtgtccgcgccgagagggccgcactggaccagcgggccgctgacctcgaggcgcgggagaaggagctggactcgagggcacgcagtggcggggcggctgcgggcgaaagtgacttagccacccgcctcgcagctaccgaactcaccatcgccgacatgcagcgtgcgctagactcatccgccggggaagccgaggccctccgcttggcgggcgagatagggcccggcatgctttgggatgcagtctcccgtctggatcgcgccggtcggcaggcgggcctctggaaaggccaggcaatgaagtactccaccaaccagggaggcctcgctcagcacctctcgaagatggccggggctctccagcagctccccgaggagctcgagaagaccatcaagtcatcctcgagggacctcgcccaaggagcggtggagctcgtcctggcgagctaccaggccagggaccccaacttctctccgtggatggcgctggatgagttcccacctgggactgaagacagcgcgcgcgcgcaggtccgggatgccgccgaccacatcgtccacagcttcgagggctcggcccctcggctcgcgttcgcccccaactccgacgaggagggcgacgccagcggtgcagacgacagtgatgacgaggccggcgacccgggcgcatcggattgagcccccaggcccccgccaatctccagttttttttttctttttctttcttctaaggccttcaggcctcttttttgtatagatcaacttaatctgcaatcaaaaaatgatgaagaatttttgtgttaattttactttgctatacaaatgagatgaggatgatctgtgccgtggttcttttgtgtcttagcttgatttaagggctcgtgcccaagtcccaatcctcgaaaagcgcgggtcggggctagtgcctggggagatccacatgtcgagactggccaggccgggaacgtggtgaccgagggttatgggtgacccgattgtgggtttttgccgattcccccccggagttcaccacgccccagggcacggctcggttctgggccccgtttggcgattttagctgaccgaaccgagcccccgagggcaaggttgagcatgagtgaccttatttcaagtcaaaattcttcaaaatggaaaaaatggcacagatacagccctcaggaaattgaaactgcttttattgaaatactgagataaaagaaatgagaatgtgcatgtgtggcagcccccggccaaccctgcacacccgagggggggtgcggggttggcccgagcccgaaacctgacacccgacccccccctcaggggtagaagcgacgaaggtgctcgatgttccatgggttaggcaactcagtgccgtcgcccgtggccagccgtatggagcccggccgggggacgccgatcactcgatacggaccctcccacattggtgagagcttgctcaatccagcacgcgtttggacgcggcgtaagacgaggtcgtcgacgcagagtgatcgggcccggacgtggcgctgatggtagcgccgcaggctctgctggtaacgcgcggctcggagggccgcgcgccgccttcgttcttccaagtagtcgaggtcatctctgcgaagctgatcttgatcagcctcgcaatacatggtggcccgaggagacctcagggtgagctcggatgggagaaccgcttccgcgccgtagacgaggaagaaaggcgtttccccggttgctcggcttggtgtggttcggttcgcccagagcaccgctggcaactcctcgatccatgaatcgccgtgcttcttgagaatattgaaggtcttggttttaaggcctttgaggatttctgcattggcgcgctccacttgaccattgcttctggggtgggcaggtgaggcgaagcagagcctaatgcccatgtcttcgcagtagtcgccgaagagttcactagtgaattgggtgccgttatccgtaataatacggttaggcactccaaaccgggccgtgatgcccttaatgaatttaagtgcggagtgcttatcgatcttgatgaccggataagcctcgggccacttagtgaacttgtcgatcgcgacatacagatactcaaacccgcccggggcccgcctaaacggtcccaggatatcgagcccccagacagcaaatggccacgaaagtggtatggtctgcagggcctgggccggctgatggatttgcttggcgtggaactgacacgctctgcatcgccggaccaggtcgaccgcgtcattgagagctgtcggccaatagaatccttgacgaaaggccttaccaaccaaggtgcgcgaggcggaatgggctccgcactcgccttcatggatatcggcaagaagttcaatgccttgttcctgaggaatgcacttcaggaggattccgttagccgcgcgccgatagaggatcccttctaccagcacgtagcgtttggaaatgcgttggacgcgttcactcccttcgcggtcctcaggtagagtcttatctgtgaggtatgcttggatctcagagatccaagcaatcaatctaagggagctaggagcgctcccctcgggtcccgaggcctgggctccgacgggcctcgggggccgatcaggcgcgtccgtctcccctaaggggtcgggtcgcgccgacggctgggcaagcctttcttcaaagacgcccggtggggtctgggctcgcgaggacgcgagtcgtgagagttcgtcggctatcatattatcccgtctgggcacgtgccgaagctctatcccgtcaaaatggcgctccatgcgccgtacttggcgtacgtaggcgtccatctgcgggtcagagcaccggtactccttgcagacttggttaacaaccagctgagagtcgcctaacaccaagaggcggcggatccccagtccagttgccactctgagtccggcaaggagtccctcgtactctgccatattattggtcgctcgaaa

SEQ ID NO: 77404 - DNA, 542 bp, Oryza sativa
agagtcaattgcctaaattgatactaccttcttggaggtacctacgacttcattgtacaaacagatctagaactagaacgatacatttacaggggtgtagctggaagcctggaaattggactgttgaacataaataatgcagttacttgcgtcctcgcctccttggtctcctcaggactcaggagccatcaatcagaagtctcaactgcagacaagtaaaaatgaagatgtaataatcctggtgcccaatacaataaaagaagtaacatatttttaacttaaccaattcgtcaagtatcaggccacaagcataacaaccgcaattggctaaagttaataccattgtgcaacctgcaccaacgaagaaaattgcacctaaaacactaccatttcggggggtgaattactgtggatcggatactccgattgttgtactccagtagtctagtgaagaaaagaaatatacagtgtgctatttttcttcatttttttagctgtacgggttttaaaaaaaatcacactaagttgattgcaaatggaga

SEQ ID NO: 77405 - DNA, 765 bp, Oryza sativa
ttttttttttgaggttcatccgcacattttattactggggagattcagtacgatcacgaatcaccagagtacgtacaaaatacgggagggggtcaacccagaccacagactgatccgggtcccaactcacaccaatcttggctagattatgagcaacattattacaggatcgaggggcaaaggaaaccttcgaattagcaaaatgaagttgcagcagcatcttgatttcagcgaaaattgtagccccaacagcttggctatgggaggatgacgttactgctgagaccagaatagctgagtcagactcgatctccacctcagtcacaccttgcaccgagatggccaggagggcagataagcatgcccttgcttccgccgaaacaacatcatgaacgaattccagccgtccagctcctgccagtaatgcatgcccttcttcatcccgcagcacaaacccccaaccacccgtcttgcgatttgcttggtatgcagcatcaacattgagtttaatcttccctgcggggggcggtgcccagtgtttcatcacagcagcagtaacacgcgtatcaagcgtgtttgggtcagccatttcctaaaccatcgcgttttcactctgtgcacaactttctctggcagtagcccacgttccccggcgttgattttgtttcgggcaaaccaccagttccacagaagcagtatcacctccatcctacattcttcttctagtaataacacatgatgaaccacttctttagctgatttcag

SEQ ID NO: 77406 - DNA, 1277 bp, Oryza sativa
acaaacccggtggcggtggaggacgagggagctcgcccgagggttgtagtcctcgcctgcttcgcgcaccatcgtcatcgtcgtcgtcaccttctgtgttggggatgttcaccggagggaagaggggaccatcactgttgtcgtcgctcgctcgatggagacgcgaagacgaagagaaagacgtatgggataaggtagagagaggaagaagagaggtaggctgcacataggcctcgcgcacgacttcctccgtcagcatgtgtgcgctaggtgcccatgttgctataaaagttgcgaactgagctcaggcctcctttctcgcgcgtatgcacccgcagcgcacattttggcccatctagcccataatgctgccatctaaaggagaaaagacagtcaacaagaccactgctttttctctcatctccctgcctcttttcccattgaaatccgtcaaatccagatacggaaggggaaggggaaagaagatgaatatggaccaaggtaaaataaaggggcaatttggtactaaaaattttacaactgcatcaataggttaaatagtggcatatctcaaatacatgtaaaattgtaatgacatgtttaaaaatagctgaatagtaccatccgtttcataatgtaagactttctagcattgcccacattcatatagatgttaatgaatctagacatatatatgaatgtggactatgctagaaaatcttacattgtgaaacagatgaagtaatggtatattttacaacttacgatttttttttttgaggttcatccgcacattcttattactggggagattcagtacgatcacgaatcaccagagtacgtacaaaatacgggagggggtcaacccagaccacagactgatccgggtcccaactcacaccaatcttggctagattatgagcaacattattacaggatcgaggggcaaaggaaaccttcgaattagcaaaatgaagttgcagcagcatcttgatttcagcgaaaattgtagccccaacagcttggctatgggaggatgacgttactgctgagaccagaatagctgagtcagactcgatctccacctcagtcacaccttgcaccgagatggccaggagggcagataagcatgcccttgctttcgccgaaacaacatcatgaacgaattccagccgtccagctcctgccagtaatgcatgcccttcttcatcccgcagcacaaacccccaaccacccgtcttgcgatttgcttggtatgcagcatcacattgagttta

SEQ ID NO: 77407 - DNA, 1045 bp, Oryza sativa
tactgcatggatccgcgctgcgagagagcgcgggagatgcaggcgcgcatcctcagcttcctccgcaagtgaagctcctccacgacgcgaaggcttcgccatgatggaataattctggcgctttgtgatgccgccattgttgagctcgagggctcctgtagcttgtcgctcgtcagttcaggcatcttttgtgccaattgacgatcttattcttcaagagttggaaatcatcgaacaaattggaaatttctattcgaatcatcaatcagttatcatataagaataagttgcattttgcaccagcacaacgcacatatttagcaaataattttcactttacactgggttgtattaaaataagttccatttaacatcatggtatatcaacaaacaataggatgcaacatagtgcaaagtgaaatcttgatgtaaaatggatgtactacacttgttacaaagcaaaacaagatacactctacctagtgcaaagtgtaatttacccatcaattaatcaatcacaaccttgcacaaattatagctgaagtttagggtcaattatttgcaaatgattcccttccaattgatttggagggaatatgattgcttgccactctgtggaggtgcatttgatcatttctcatcctgctcactgtaacaaattattcactagaggttattaatgtcatggtttattccaaataacacccttaccctctttgtgccgtcatggaatacgagacagcatttctgcatttgtagggacaaaaatgtctataacgccaaacgatcatatttcgaatcaaattagtataaattccacaggtattacaaattacttcgtggcaaataatggtagaagccaccacaacaatatggcaaaagaaaaggaaaaagaaaaatttccccatcttatttagattagactaaacacgctccaaatctgactccgccgccggcgatcttcatttcttgatgaattcgacgttgcgctccagcagctcgacggcctggtcggagcccgccatgccgacgaagtggaacgcgt

SEQ ID NO: 77408 - DNA, 2523 bp, Oryza sativa
acgacggggagtttctcggtggacacggcggccccgggcgggaggtacacgcgcgccctggcggcgccggcgtgaatgtcgcgggagacgacgcgggtgacggggtcggtgccggcggggacggtggggtccccgccgaggcggaagacgcgcccgctcttgtactggcagaggtagggctggaagtcgaaggcgacctcggagtcgggatccatggcggatggggagcggttggtggccggatcgggagacggaaatgagttggccacctgcaacaaatcgagctggaaacttaaaaagaagtctagttcacttcaagaagttcaacgcgggggagagagagatagtgggagcgtggttggtgagggtagagacttgcggcgagtggcaacgccgctttctcaactttttatttccccatttggtgatcggtgaacaacttttataattattttccccatagtatgacccgctcaaaaactaattactgctccctccctttcatattataaatcattttgattttttttcataattaatttttttaaaaatttatagaaaaataattaatttttttaaaaatttatagaaaaaactagtactccctcaatactcataaaggaagtcgtttaggacaatgtttaaatcaaaccttaggaatataaatcataaataactctcaagttgttaagtttgaaaatataaaaattatatgtatagatttttcttgaaaaatactttcataaaaatatacatatatcacttttcaatatatttttatagaaataagaaatcaaagttgtattttagagaccgtgtcactatcctaaacgatttcctttacgagtatgaagggagtatcatttacaataccaaattagtttcattaaatatactagtaatatgtttgtgttgaaaatattactatatttttctataaacttgatcaagtttgattagaagaaaaactaaagtggcttacaatataaaacaaaggaagtactagtattaataaagactatttcttctcgtgtttatttagatgatgtgagaaccgattacgatcgacttctgttcagtgaggtcgccgcaactcttaagagctgaacaaatacaaaggcattcaccgaataaatcggtgcaagttggtgacagttcttgaagatgggtgggcgatggcactagttgcaggcttgcagctatccttggacttttttttttgcatgaagttcacagccagccctgtctggatccccgaccgactatccagcatggtacacaaagacaacagtattttgacggtaaggagattgattaactgataaaaacggttggtgaacttggcatcatccatttggtcagactgccaacgacccaaaagccaacagagcaaaaaggaacggctagaagttgaaacttaggctgtgtttagttccacgtcaaaattagaagtttaaagaaattggaacgatgtgatagaaaagttggaagtttgtgtgtataagaaaacttgatgtgacggaaaagttagaagtttaaagaaaaaagttgggaactaaacaatgccttagtggttttggtggttgggggcttaagggaagacagccacaacaccgccagttaactgaggcgggttaaagggctcaaaccagagattttataggattttcataggaatttatccaaactcccctaaaaatccttataaattcctcacttccaaaggatatattagttccaggctacccccttagagaccaccatatggaaatccttgtactaccaatgagtaatttaagcacacgtagcaactgaagagcgtgaaaactcaattcaagagatgtaaagtatggaaaaaaaaaacccgctacctgatatgattttcaaattcatacacagtattgatctcaaaatgttctccagatcatttgactcagaggttgatactttcccagtttccatacatagtgtaacatagacaatgttattgtcatgggcttgttagcatgctacttactgcgttttgcagggaggcaagtgaatcaactgcagtctttgtgaaccaactgattccaaccttcactcgatgttcatctgtgggcatcctaaggcagtatacaatcttcctagctgcagaaccaagttgaatgttattcttaaacgtaaaattatgcaaaaacaggaaaagaacatgccggtgaggattcataccagcatgccctaaaggtccttccaaggtcaggccctcaataaagcttgctgttatcgcagcatcacttctaccaagtgtcatcatctcaccaagattttgaaacctgaaaagttacacaggatatttagctcttctatgaagttcaactattcctacagacatgacagaacattagcattaaaaaagaaatgaaaatccttagtaatcctgaatacgtcaacatagacagttcagctagatttaaacctgaatggcagaagaggtcggtcattgattgctgcccagagattccatccagcaaaatctgcttg

SEQ ID NO: 77409 - DNA, 8753 bp, Oryza sativa
gcaacgcgccgacaacctggcagtggccacggagccgcaggccccggaggcctctgcgtcccgtgtctccaagaagcgcctcacctcggctgatgaggtgcccgtcaaggagatcccccttggcgatgatccgtccaagaccgccaaaattggcagaaacctagacgccaaataggaaggtgcgctcgtctccttcctgcgggcaaattctgacgtcttcgcatggaagccgtcggatatgcccggggtccccagggaggtgatcgagcaccgccttgccgtacggccggatgcgcgacccgtccggcaaaaagtgcggcgtcaagccccagagcgacaggccttcatccgagaggaagtggcgcggcttctggaggctgacttcatccgcgaggttatccatccggagtggctggcgaacccggtggtcgtcccgaaggccaacggcaagctccggatgtgcatcgactacacgaacctcaacaaggcatgccctaaagatcccttccctctaccacgcatagatcagatagtcgacccactgcggggtgcgaccttttgtgttttctagatgcctactctgggtagcaccagattcgcatggctagggaagatgaggaaaaaactgtcttcattactcctgtgggcaccttttgttatacacctatgccttttgggttaaaaaatgcaggccctacttttcagcgcatgactcgtattactttgagtaatcaaatagggcgcaatgtagaggcgtatgtcgatgacctggtggtaaagacgcgccaccaggacacattgctgcaggatttggctgagactttcgatagtcttaggtccacacgcgtgaaactgaaccccgataagtgtgtgttcggtgtgccggcgggcaaacttctcggttttctagtctcctcccgaggcatagaagcaaatcccgagaaaatacgcgcgatagagaggatgcgcccccccagcaaacttagggatgtgcagtgtgtcactggatgcatggccgccctaagtcgattcatatcaaggctgggagagagggcgctacccctattcaagctcctcaagcgctctgggccgtttgtgtagacggaggaagctgagcaagctctcaaccagttgaaagcttacctcaccttccccccccccatcttggtagccccggggccgaaggaaccgttgctactctacttggccacgaccccccatgtggtgagtgccgccctagtagtcgagcgcgaagagggcgaaccggaggcctctttaactcgagatgacccttcgtctcccgaaggcccggagcccgaagcccccagcccccgggaggaccccgaagcccccgtgggaggaagggaggctttggcaagtggtcccgaggcctatgatcccgacatgactcgagacccccccccccccggggccctcgagcaagggcaacccagatcacggcccctgacggtacgaaccggccccaccgaaaggtgcagcggcccgtctactttgtcagcgaggcgcttcgagatgcgaaaacctgatacccacaggccagaaaatgctttatgcagttttaatggcctcatggaaattgcgccactatttccaagcgcatcgggtttccgtagtgacatactaccctctcggtcaaatcttgcacaaccgagagggcactggacgggtggtgaagtgggccatcgagctggcagagttcgatctgtacttcgaaccacggaacgcaatcaaaagccaggtcctagctgactttatcgcggagtggaccccagtggacgaacctgttccacccaaggtcccctccctccccggagatgaagaggacccaaacgccgatattcgtggtgggcactaggttatgcattttgacggctccctcaaccttcaaggtgcgggcgccggagtcacgctgacttcgccaagcggggacgtcctcaaatacgtcgttcggctcgacttccgagccacgaacaacatggcggaatatgaaggactcctcgcgggattgagggtggcggccggaatgggcatccgccgtctcctggtcctgggtgactcccagctggtcgtgaaacaagtatccaaagagtaccggtgcaccgacccacaaatggacgcatatgtccgtgaagtgcagcgcatggaacttcacttcgacggactcgagctccggcacgtgccccgacgtgacaacacagtcgctgatgagttgtcgcgtatcgcgtcggcacaagccccactccccccgggaatattcgaagaaagactcgcgcagccatcggcgcaaccagacccctcgagggaccccgatgacacgccctccgccccgacccttggcgacccgtggccctcgaggcccgagggggtcaaccccgcccccccccccccccgtcaggtcgtttggatgaccgacatccgcgcgtatctcgacggcaatactcttcctgaggatcgcgcagaagctgagaagctcgcgcatatctccaagcggtacgtcctcgtagaagggaccctctaccggcgtgccgccaacgggatactcttgaagtgtgtttctcgagagcaaggcatcgagctcatagccgacacccattagggtgagtgcggggcccattcggcctcacgaactttggtcggtaaagccttccgacaaggtttttactggccgactgtattgcaagatgcccaagaatgggtccggcggtgcaaggcatgccaattccacgccaagcaaatccaccagccggcccaagccttacaggtcatcccactctcttggccttttgcggtctgggggctagacatccttggaccattcaaggcggctcgagggggtatcagcacctgtacgtcgccatcgacaagttcaccaagtggcccgaagcttacccggtcgtcaagatcgacaagcattccgccctcaagttcatcaggggcatcacatcacgattcggagtgcccaaccgcatcattacagataacggcacccagttcaccagtgagctgttcggcgactattgcgacgacatgggcatcaaattgtgctttgcctcacccgcccaccccaagagcaacggccaagtcgagcgagccaatgccgaaatcctcaaaggccttaaggccaagacgtacaacatcctgaagaaacacggggattcatggctcgaggagttgcccgctgtgttgtgggcaaatcggaccactccaagccgtgccacaggggaaacaccatttttcctggtctatggcgccgaagcggtcctaccctcggagatttccctaagatcgcctcgcgtcgcgctgtacaatgaggccaaccaggatgatcttcgccgcgacgatctcgattatcttgaagaacggagaaggcgtgcagccctgcgtgccgcgcgctaccaacaaagcctgcggcgctaccatcaacgccacgtccgggcccggtcactgcaagttggcgatctcgtcctacgccgcgtccaatcgcgtctggggctgagcaagctctcgccaatgtgggaggggccatacaaagtgatcggcgttctccggccaggctccgttcgactaaccacggaggatggcacggagttgcctaacccctggaatatcgaacacctccgtcgcttctatccatagcgtcgagattttttgctttccaggagctcggcccaaccctcgcacaacccctcggtttgtacgggcttggccgggggctaccactgtgtatcctcttccctttacaagcaatgaatttttctactcactgtgaagcccattatgcacccttttttctctctctttcctctggcttgtcctggttcaaaggatagttcgcggttactctgaaccctaagtgccgtggggcgacctgaaaaccgccgaaagggagcacaaacgcgggccgcgccccgggttgcaccgaaccccgggggctcggaagggcctacacacggccgtccccgacccccgatcgtcgtagccccggtctagccagtcccgctgggcggctccctcagggcgacggttttgcctttcaccacttaggtaccacggaccgagcgctggtttgccttttcgctagaacaagcccgggggggaggatggggtaaaagcggcatttcgatcacaggcagattaattatatactttcgctcttgttttttcttctttctatgccgcaggcattcaatggaaaaaagcaaaggaacaaaaaatgcgaaaaggaagttttaattgcagaacaagacaggaacggcacgatggcctaaatacaagaagtgtccgctacaggcacacaacaaagggaaattggaagcgcaggtaatcacggagtgcccgggcccccgaggctggcgccgctaacgacgttgtcccagtcctcgccgccgaagtcgtcatcatcgtccccgctgccgctctcctcgtctgaggcaagcccgaaggtgaaccgaggggccgacccctcgaagttagagacgatcgcgtcggccgcctcccggacttgctcccgagcccttgcctcggtccccgggggaaaatcctcgagtgcgcgccatgggacaaagtcggggtcacgaacttggtggctcacgagaaccagttccaccgcggcccgcgccaaggaagccgacgacgatttcacggtctcgctaacctcctcctccagcctctccagatccgcagccagcccgtccagccggagtgcgagtgccggcagtgtgggcggaagcttactatcccggcgcacggaaatgctgactcggcgccccgcgcgctccagtcggtcgacggcgtcggagagctgcccgggtccgatctcgttggtgaggcggagggccgcaatctccccggcttgatcttgcaccaagcgttctagatcggcgagagtgctctgagccgtggcaagctggctccccaactccgcgccgccgggctgcccgcccgccgccaggtccttctcacgggcctccagctcagaagccctcgccgcaatcgccgcgcgcttggcgcgagcactctccagatgccgagcctcacgcccagcaacggcctcctcgcgtttcgcgagctgctcgcccagctggcgcgaggccacctcacggcggttcacctcagcttcgcgctcggcgagtgcgacgtcccgttcccggcacgcctcttcccggagccgtagctcctccgcgcggcggtccgctgaagctttcacggcgagggtgatccggtcacgctcagctgcgacctcttcacgaaggcgaagggaggcctccacctccgccgctgttctctcgtgggcggccaaggtggactcccgctgatcgagcagacgcgctcgctcctccagcacctgagtccgcctttccagctcctgagctcgctgcgcctgctcctggtcgcgcgcgttttgctcacgctggctctgattgaggacctcgattcgttgacgaatcgtggtctcgaactcctgcgcggagcgggcacgctcatccaaggccctgcgttcggcctcgagcgccgctgtctgagcccgcagcgaggcattggcctccgatacccgccgctcttgggcaacagctgcgtcgaggataccgcgggcgtccttgatcctcttcgccaaatcctcggcatgggcctcgtactggaggcggatgtcacccagtgcttcgtccaggacgctcaaggcaaccagcgccgcctgccgctcttcctccacctctcgcatgatggagtccagcgactcctcacgcgcctggattttggctagttgggcttggcgcattttgtgtcccaccctcaccatgtcgtccatggcgtggcgcccctcgtcaactcgcgcgcggtccgcggcgagctgtgcccattcagcctccagggccgctcgctcttctgccagggcttgaacttgggcttgagcccctcccggacggtggaatcggcggcggcgagcacctgcaggagcggctccatacttgccggagtcggagaagaaaaagtcgcggcccgcccctgtgatgatggagtgctgctggatccccacgagactgggggctgctctcgcccccccccttctgcgcgaccagccccgagggcgtcccaagtgcaagggggagcggccgtccctctcgccccccgcctcgggtcctcgggtagattcggcctcggcctcaggctcgggcccgcccccaattttggcctcggcctcaggctcgggcccgcccccgatttcggcctcgacctcgggctcagggccgccctgtccctcggcatccgagccgcgacctccctcgccccccgatcccgggtggcgctccgcatgaaccctggtctcggagtcgcccccaggagggacgtcatcatcgctatcgcccacggcgggacgagtcccggctagggttcgctcgggtccggacccggtatgcggcccgtgggccccgccgaggggctgtgaaggccccgcggccttggatcggccaagcccgggccgctccgatcgttcggatttggtcgcccgcgaagggtcggaccccgagaccccctaggaaggaatctcgctacaagggaactcagatcgcgttaacaaagaaaaagaaaaggagggaacaagagatcgagctggataaaagcaccgaggtgggtgccggcgatcgtacctgcggggagggcggttgaaagtccacttcggaggctcaatgaagctcccccgacacggctccgtttgtcctatcttccggagccgtttctttttccgtccggcctcaggcccggcagggcgcttgtggcccgctggcggacgatccgccacgcgctcggcgccccctccacgcgggggagagggcggtcgagattcggacatcttccgcttctctttcaggtcgctggccgagtcgtccccgggtccgcggtttgggccgggagacctggagctcccacctccgccgggtccgcttgtccgactcccgcctgcggtcgcgccaccgccaccaacaccggcagtgctaccaccggtgccgccccggcaggaccggctcctgccggcgccaacaaccgacatcatggccaggatgctctcccggtcgcggtcgcagcagaggggaaggatcccgtctggaatcagagtttgctcggcggagtccaagcccagtactcgccgaatcaccatcttcgcgtcctcctccccccaatcccagcgctcacccacatgcgtgcgcatggggtcgttgggaccagtgtactcccacgcgccatgggatcgatcctggagaggtgcaatgcggcggcggaaatagtcaccaaagaccatcgcccctgtgaggcccaggcttcgcaggcccctaaggtgatcccacaccgcgtcgtactcttcgcccagttccgaaactgccagccatgcggcggatctttcgggaggaccgacgggaagccgaagtcgtggatggtccggcaatgcggtgtagaaccagtccttcttccagtcctcccatttcttgcgaagatgactctcgatgtattgccccgctgtgcctggccggggttggaagtaacatccccccaccaccgcaccttgcagcagctgcgggatgaagaaagactggaacagccgcatcgtcggccgcaccccgatgaacatctcacacagatgcgcgaagatggccagcgtcatcacgacgttgggtgcgagatgcaaggcatggatttcatagaaatccaaaacctcatggaagaatccagagaacggcggaatcaaccccgccatagcaaaggacaagagatgcacggatcgctccggataccgcggccgcggccgcaactcccccgccctcacgacggcgccttccggcatgatcttgcgggggaggctaaggtgtctatccgccgtaatgcgtgatgccgggagcaccgtgtcgccaacgtcttgagccatgatggccggcggagaagcggcggagggcttggcgcgcagaatagtgtgaagtggcgagaatgttagggcttaaggagcaagaagacgagtgggcagttggcgaaaggaaggaggcaaagtcctcgcctccatatccttttatcctcgcctcacccacgctcacctcctcgtttcacgccctcacggttgcccccacgattctcgcgcccgcggttgtctcttcgtttcccgtgtccactcatcacgtcgcccattgaatctgcgccctgcatttagtgcgcctatcagcggcacactcgaagtagggcgcacaacggtcacgggcacaacctgagcgaaccgtcgccactaccgccgcatgagtagcgggcaagggaatcgaggcgtggcctaaccgaccccctgattttcgcgccttaaacatcaccatcatcagcacggtcagtggtggcaaaccgctgccgtggttaatacgccaacctggccattcggcgacatttccttagattccctaccggacccacaaccccagcttgggaagtcgtgaggcaccacgtcagaaccgacctcaggaggtcagtgtccgatatggtgccgagggctactgacggagatatgggcccgggggtatgtgaagtgggggaaagttacctttccatccagccgcgtggctctacagcctggccctactcccgcgcctcgcgagtcacagaagcggccgggggggcctcagggtgccacgtcgtgcccctcgggctctcccgctgcctcgccctgaggccctcgcctagctgccatgtggcgggaggaggga

SEQ ID NO: 77410 - DNA, 1790 bp, Oryza sativa
atatatataatttttagaaatcccgtcaaacactgccactatactactctacgactcgtccgccgcatactctttactgtcattgggattgaaaaaaatccaacataactatcattgaaattcattttttactttctatgagacccaccaaccatcgacggctctgtcattgtactccaatacgacacacctgttgtctctcatttttattgtaattgagatttttaaaatcaaatatgattatcattatttttttttactttctagaagttccgccaaccgccttaactgattgcttcatgagctgcccgtcgtcctttccttttaatcgacattaggattttctatttggtgttttattaatagtttttagatgtccatcaaccgccaccactctactcctatatagatgtgttacttgattaatctcgtcatgtgttttagatggtcttttctttcaatagtctttattttttatcactaattttagttattcataaattgtattccgagttgaaatattatctttcttttttaatttcagaatttattttatttttcatattgtgtttttttatatttttatttttattttcaatttcagttgtttcaaaattgtatttctacttgaactctcttcttaatttgcctaatttcagattttattttattttttattccaaactttaattaatctactattatgttcttatatatactgttatttcaatattacttatatttaattccgaatttcagttaattctaaattatatttctactagaactcttcttttcttttctttttttctaattttgattttttattttttattctgaattttaattaatctcgtattggattcttgtatgaactcttctttcaatatttcttattttcaattctgaattttatttatttttaaattgtattcctactttaactcttcttcttttttttgctaatttcggattttattttatttttattcggaattttgattaatctcgtattagattcctacgtggactcttctttcaatattgcttatttttaattccgaatttcagctatagttttagattgtatttctacttggactcttcttttctttttctctgattaatgtgtgaatttctagtctccacagcgaacatggtgcctcctttcaaggctgttttaataatataatagaagatagattgagggttcgcaaaatattcccaagatcgttaggtctcgtgctttcaacataaagaattggcagcttgaacatgtcagtttttcacttagatgcccgtagtcttacaatataggaaaaaatacaaattacccccctccctcccacccctcccgaattgtcgcggtcgtccgaattacctccctgaaccacaaaaccggacattcttcactcccaactatgcaaaccggacgaattacccccctcaacctaatccgtggtggttttggtctacgtggcatacgcgtggtggtccagtcagcattttatttattaagaaaatgtgggacccacctatcatacactactctctcttttccctctcactctctctctctcacttctctctctcactcttcctctctctcaccgtctcccgggtcaacagcgacgagggacacggagcggcggcggcggtgagtgacgcagagtggcggcggcggggatgaggagctgggcgcggcttcccccctccctctcggatggagctcggagcaggatgcgatccgaccgcctcgccatcgtcgccttctctggcatgccgcgcgg

SEQ ID NO: 77411 - DNA, 3179 bp, Oryza sativa
  unsure (1)..(3179): unsure at all n locations
ccaccgggatgaggcaacagtcgacggctgatgagcatggtgtggagcgcaatgtggctggcgctccagcccatgagcttaatgaggccgacgccgtttgccgcgctctcggcctccacgtgccagacagtgatggcctcctgcgtcaccttcaccgctgtgtggaacccgaacaaccggttgataacgccaacgtgttttccaccgtcttggggatccccgccaccaccacggcaagccgctgctgctggacctcatggtggatcgtcaccgcaccgcgcatgatgttgtccgcgccgacgtcatacacttggttgaacctgtgccactcgatggcgtccacgatcctggtgaggtcgaacccgccgcgcgacgtgccgagcaccatcccgcaggccttgttctagtgctccaccgtcgccggatcgagcgggacaaactcctcgaaaatgaccgtaggcggcagcaacagcgctgtcgccgctggggtgggacagaggaggagcagaggcggcggagggggaggaggatggaggtagtggcgcgcgagggaggagcctggaagggaaggtagcggtggcgcgcaaggtcgccgagggtgccacctgctacccgcctcgctcgtctgcaggaagggaagatgaagagggggagagagaagagagagaggggagagggaagaagggaggtgaggtgacatgtggggcataggttttattatttttccaatatcgaattgccacgtaagtgccacgttaaatgccacgtgggacaaagacgaagtcaaaccagccacattgccatcacatcagctaaaaccaccttccaaaccgtcgagggacctcgtttacactgattttgatagctcggggaccgccggaccagttgtatctggtttttggtttttgggttcaaggacgtgtaaagttaagggaccctcaaatgaacttaatccatcacaccataacccataaatagattaggcctgtctaagacgatagacagattaggtccatctaaggccagaaatgattgaaatggcatggctaaattatggcgtaaagaattaaatggcccaatttcattcacgttaaacgtggcgcaaatttgtttggctaatgttgaacgtagtggaagagtacttgatatacttccaaaatgtggcgactggttggtttgtaatcgtgatagagaatggaaaatgaatgttaggaaaatgtgcaacaaatcattttctgggaaaagatgtccagcttacctagttgttgagtaaacgagtgaacggatgaatttagggatggcaattttgcccatgggtttggttatccgcgaatacccgacccattgggcacgggcgtgggtgtgattttttatccgtgggtacgcccgcccaagactcgtagacatcgtgggcaacagccgggtttcattttttacctgtgggtaacccatgcccaacccgatacatatgtattagctaattttgatttatctcttaattcttatacccctttctcttattcatttgtgatactaactaataataagttgtgatgtaattcaaattattgttgataactgataatttggtaaattattgattttatttttctttattaaattatatatctttcgagttattattcacaaagttttacccgctaaccctagtgggtagggtttgggcgggcgacgatgggcatagggtcgggcatggtttnactcnacccatgnccgacccaacccgttgccatccctagatgaattgatgcacaccctttaaaacactattcaaatcaaattggactattggagtagtggagtgccaaaatttgtcaccaccatcacccagcgcatcaacacagctgtaacataagtaccgggcaggcaaacacaatgatttcaacttgaatcatttgtactctttttctactttttctactttttcttcttcgaaaaagagttcgccaccaaccgtccatccaaaaaatacaccagctatctcacatgaactctagctaaccgtctagactaatctaaagactacaaaagccaagaagaattttgataattggtatatgagttcgtggaactgtaccaaatttgatgtggcgttgcacatccgaacggagttcctgtctcctgcaggcagtagatactagatagcctgtaggcagctcatacagtgatgacacctgacatccatggcacaacaacgggagcagatggatgagcatccctgtacgactcagaatacctgtctttgaagttcaatttagggtgatcagcctgcaagcatgcaaacaatgaattcaaagttacttcgctattctttggcagtatgaggcccaatctttaggatcaacatcaaatgcaggttcatctgaaaggaattgtcagtgaaataatccacagaaatattacagttaaatacagtactttaagataatcggattgcatttctataacctttattggcaaagatatgataaaattgcataaaaaatagtacaatattccccgcaaaaaaaaatagtacaacgcattaaaacttccatgttgcaaaacaagattctcctacaaccgcaagtaactaaatgttgaatagcatcatgaattcagtattggagaattcaacataccaaccttgccactttaagtattgaattcgctactaaattaaaggcagcaaaagtactgtgccatactttaccttgtgatctaaaagttacaacttatgcaccagcctgtccagccatgttccaatattcaggaactggaaactgcttagcttaccaaattttgctaatgtgagattttgctgttaccaaattgatttggtttgtttggcaaacaaaacaagcatgtcctccaagccaccacaaccaagttacaagcagggccatgccctaagatatgcatgataacttctaatatatccaccaattagattcaatgtatgcagtcatttttaaatatagaggacaaaatagttatatggaaagaacataacaggaactgatgagtccctctatttttaggtataattttcagaatcattatctccaaagcagaataggaagtacccaactaccccgtcatcaaatataaaagaagacaacatgatgatacctgtttcaaccagcactcttgatgtttgtgttcatatttatctggcg

SEQ ID NO: 77412 - DNA, 760 bp, Oryza sativa
ttaaaaacaaacactaaaaaaaattatgttgaaaatatcagtgacagtcacatatctgggcgaactcctcctgcggctttctttctctgggcctaattctctaggctgcgtacgtgagttaggacactcgtgggctccgttacggcccaacttaaccacgtgaaaactcctcccacaaaacagaaaaaaaaaagagtaagaacaggaatgtgaatgcgacgactgcctgctgtcaactgaccacctggcagtgcaacgggtggcgcacagccgagcatgctccaagcggctattaattccgtgtttaaatcttttaatccgcgtgtttaaagctttaaattcgacagctggtgagttgttaataaagccttctgccatagcgatagaactctccaggctccatctcagtagctgacgtcaccaccccagcgtccacacgcgcaccgcatggcttctaccgacgccgacgccgacgcggtcgccgtggagctcctcccgttcatccgcgtctacgtgagcggccgcgtggagcgcctgctcggcaccgacacggtcgcggcgtccctcgacgagcccacgggcgtggcttccaaggacgtcaccgttgacccggcgaccaacctctccgtgcgcctctacctcccgccggcggtcgccgccggcgagaggctgccgatcctcgtgtacttccacggcggcggcttcatggtcgagtcggccacgtccccgacgtaccaccgctacctcaacgcgctcgcct

SEQ ID NO: 77413 - DNA, 1576 bp, Oryza sativa
gaagcccattaaggcccatcgcaaaaaccagaagcccattaaagcatcagctaatcttcccggagaggcagagacggctccacggcctccgctcgctgtcttcccggagacgcctcctcctcctcgcttctcttcccctctatcgtcgggagctgcgaccggaggcgcgccacgtgtccctctcccctccccgccgatgagctgccgcgcggcgccgtgggggcgcccgtcgctccccggcggccggccctcccccggctcggcgcggcaacgcggtccattcggtgagattcacgagcttagctcgtcgcgcctactacttctctgtactttacgctgctgtggactgcggggatgtgttgtgatgctgggttagggtttacgtcggatgcttcaaatcttacagtagatggagcagttcccgcgcgcggatgtaccatttttagaacagaagttcaaaacattgggttttgatgtttctgaactactcacaagtgatttcccaaatatgaactcaaattgatttttgagccccagagtagttacataagttgcgggagcattcgtaggacagcaccatttgttggtcaaatgtatcgcagtttccagtgatttcatattccaatttgaaagggggtgattaggttaatgtatccgtcaatctaatgggttagcactttgttcctgacaggaggtttgaatgtatggaggaattcaatcctcaacaattcatggaggcttggtggtacgccaatgaagtttggactaccatctagattgttcagactcatggcttcaagtagctcaggagatggtggtttttcacggccttcatcaactgatgaagggccaatgccaatatactcttggccggataagcaggtgattctttactgtagatatccgtagttgagaaccccctgttatttggtggttttccttttcattttctttgcgagttggttttgttttatatgtttagttgttcgccaaattctctatttcatgatgaagcataattcagtatatggaaatcccaaggggacatacttcggtacacttgattcagagcttatgacatgcattaaaatacagtgtgtagatactcacggaatatagttcaatttattataactataaatcaattggcctatactgatggtgtcttaagtgcatgttttttgactcatgagttaatttttttcatatttttgttttgtctatgcatgccaggctgtgaggataaatgtttgaggaaaagttagatttacagcgtgcttatgctataaccactatatttgtataattgtattactgaatatgccctcttccttattttcagcgtccacgagtgtgcatcttgggtggtggatttggtggcctgtacactgctcttagattagaatctcttgtatggcccaatgataagaagcctcaggtaaaatgatcatgctcttatgctggaaattccatttagatttgcagagtgctatacctgtttttatatatcttgatacataacggtcatagtggtgttcgcaatttgacaattttatcagtgactcatgtgcactcg

SEQ ID NO: 77414 - DNA, 2363 bp, Oryza sativa
gcacataagttccttttttgaatagctgaatgaattaaatattgtaatgttaaaatgaatttaaaataatattgtaagaaattcatatatagaaaatttttagtaccgattacagctcgaaaaatatgcacattcatccgatccatctttaattaatcggaaaagttatcgtgcaagtattttgtgcttgccagggctctaaggagcagataaagaaaagttttggcgatagtgatatgttaatatgatactgtcaactataaacaatggtttagacagcgtggttttcatggactaattcgcttcttttataaaagctttgattggtgatgacacgggtgggaaatcgattaaaaatcagcaaagaaacggattgccactttctcatgctcctctgactcgcatgctcctagtgatcccaaatgccatgcctacttgattgcatagatgttttattatgcttgaagcatactggagtctggatgcacctttactttaagaaaaatcaatggctgaattattatatatacagttgctcaaaaggtattagaagagtttgtgagtgatcaataactggtatctttaattttcaagtggatttaattacgcctagcaaagagctgatcattttagactttatcgacattaaccacatcacaagttgcatctccttttattggggtgaaaatgaaacagtagtagtagatatcactgtgcagttgaaacggtaataggtcagctctttggctatcctctcgggtcaactggaaaatttctgaattttgacaaaatctcgaatgcgaacatcacaaaattcagtggcaagcatcgattcattgacatgcaaagattgaaaagttcagagtgtgaagactctgaagttcttgagcttgttgtgctaaataaaaatgtccactctaccttgtgtcgtaatttccagcttttctgtaatcctctgatgcatccttttttttattcagactacgagatcacaaaaaacttctgctagaaggcatctgggaaatgttatttaagtttgtggtttgaaaaagcaattgtttgtatttcagtgaacttcttggaaacgtttttttgcttgtttagactgaactctgaatatactacgtggcaaatattagagccaattgcatgctgatcaatttaatctgaggaaaaaaaaaagaagtatgcatgttgactaaacatttttatgttctagctgtcttacaagaacaggtattccttgtcctagaacgccactaacacggggtaaattcattgacgggtaagcttgtactgaaaacgctgacaaaatagaacgttctttaggcagttttgcagtaccatgccgctgacgaacgaagacctcttcaagagaatttcccttccgtggtttgatgcactctaaatataaactacaactctttctgaatttttctcattcactgtttcaaacaaattattaacctgaaaaaaatatcgtgaaaatttagaaagagttaattttcacgatattttttcagctggtggtgagcaagttgcttcaccatagcggtgagcaaaaagaacacgaacttgtcaagatcatgtctgtcccttcgccgtttgtcaggcaaggaaaatctgtagctactgatcatcctcaacagatgtctgctctcctaaacaccgaaaaaacgaatccaaattgctgcagaattaaattcgccggcgccgtgtctggcctttaatttgcttccttgcacgtagcagacgatttcgctcgagtcggcaaaggaaagttcttcgcgcgcctaactgaaaccaaccccatcgtcgtgaattcacgatcgcgtagtgcgtgtcgtgagcgtgtgaaacggcttagttttttcagctcggaaacggaccaatcgcctttgacgtgtcgttgtctgtctcgatctctctcttgtttggtgtttctgaacttgtgctccctgcattgacaagtctattttgactggaaagacgctaaccgctcgaggaagcatcaagcatggctgcatgggttgtgactagaatactagtatgaggagcataaaatatttatcatcggttttgcgaatatttgacgtgtgaagaaatcaacgacaattgcacatgcacacatacaaatcatgtcaaatactcgaccgattttgggggccttcatatcttcttacatgatttgtgctccatgacctctttcttctattatctaaaaaaaatgacctctttctctactccggtggtgaattaccatctgattaggttttgggtttaagtaggagagggttgtgaattgggttgatgggaggtgtttctcggcttaaagggatggcgaggaaatggtggcgtcacct

SEQ ID NO: 77415 - DNA, 939 bp, Oryza sativa
ttatattatagtacatgataaattataagccaaccgtaccaagtttgaccatgccttatattaggatgaagggattaggcttgccgatcaatgagtgaaaagcaatagttagatcaacttgggtttactagactaatctttgtgtcatgcaagccaataccgctgccacgtaatcattttcatggcaaaaccacctaaaaaactactctggggggttatttgaaccctttttcatactttaaggggtagaatatccggtttcgtactttagggggtgaagtaggcttattccttctggtaatggagcatgggaaataccctataagggaaaaatgatgggctataacatatcactgatatctacaacttacaagaaaggctcaggtcattttgtagctcatgctaactatgacaaattagtaattatgtgcacaaaatggtttatgtgattttttatattaacattttggctatcggagtttttcggtactaaaaggctgaaaattggttatgtttcattttctcattttattttgtgtgttttctctacataggtgctagggcctaatgcgttgtgctggctctgcccaatatcaaggaatacaggcaatggtattcgtttccgtacatcatatgatataccactatctacaccaccaatttgacatcaggtagcattacattcatgttagatttctggtaatttgctaaaaaaacttggttgcctatccaagtgtgaaatgtgctattctcgcaatagcatttgataacccttcataaaggaatagcgtttgtcaatgtcttgaaactcttgcatcaagagtttgtacttgatgtgatcaaatgtgtaaatgacactcccgtgtaagatacaggaagaggagctggatattcctccaggctccaaggatctatatggattttggagctagaaatgtt

SEQ ID NO: 77416 - DNA, 681 bp, Oryza sativa
gctagcagaattggacagttcggcctcaaaatttgatacctttgggtttagatttcggacattgccgattaggaagatcccctgagctgatattccgtgcgtgggctttagatcttcagagtgggatggcaattttgagctcaacgttgaggtctttggggaggaagagagtaacagcatgtaggtgtgcatccgaggatatggggctatggagggggtgaggtgagcgcgttttgcattcgatcttcacatactgttatgatccatatttgaacttacggggtgtacttctgctaagaatgcacatattgcgagatgagggcctttgtattatggattatatagtcttggatctaagtacgaatcttaggtctagtcttgcatgccgagtgcttggttggtgaattggaaggtttgcattatgtatttaatgtgtgcaatagatttcgaaaattaatgttttgggatctattgcacacattaaatacataatgatggttgatgaggaagctggatagttaccaattatcattaattattttctgagcttatggtagctcagctgatagtattatttatttcctatttggcattgtgtaagggctttacatcatttggggcgtttaaacaataggtgcctgcataaagataatgtattgcattcaatctgctttgcttttg

SEQ ID NO: 77417 - DNA, 699 bp, Oryza sativa
gttactgatcttgaatgacctcgtgtgtacagccaacaggaagcaaaccgaacaggcgagtccggacttgacgctggagttcggcggtggcgctgaagcaggagaacgcgttcgtgacggtgcagcagcggacgctgtgcctggcgatcgtggcgacaacggagcagcagccggtgtccatcctcgggaacctttgtcgccgccgactgcgcggggagcggcggccggcggaggagacgagcggcgggcaggcgcgctgcgggagcgggacggggagagcgaggacgccgccgccgtcgtcgtccatggccgcagatctcgcgcccgcgctgtcagcggcgtcgccggcgggagtatgtgattgcggggcagcggcgggcggagcaggcgatggcgggcggagcgggcacgacgacgaagacagcttcttcccgcgtcggcgccgccggccgcctctcccttctcaagcgtcgcagccgccgccgcctcccttatcccgtatcgtcgtcgccgccgcctcccgggcttctccgatggtccgacctccgaggtcgcacgcgccgccgctggacctcctccccaacgccagccgccctgcagagaggagagaaatgagagagatcaggaagggagagaagaggggaggagagagaagacctggcactctgacatgtggggctcacgtagatcccaagctga

SEQ ID NO: 77418 - DNA, 637 bp, Oryza sativa
taagaaaaatgtgattgcattgccattaaaatacagtatgaacctagactatctgccatcggattgacagattgaacaaacatcattagaaatcttggttttatgaaaattataaaagccacagtaacagctgccacaactttgcaagattaacagccatcctcatgttgttgttgttgttgttgttgttgttgttgttgttgttgttgttgttgttgttgttgatgtagtccatgctgctcatctgctatcaccatagttagctgctgcgcctgcggcttctcagccgcaatagactgcataatcgaccgccgcaacacccgcctccgccatcgtcgtttttatttgtagctacctccataattgaccgcctcagcgcctacctaggcccaagctgcagtcgcctgctgctgctactgcccaagccgctgcaaacccgaccgctgttgcgcgtgcctccgcagtccgtcacccaagccgccaccgccgcctgctcgatttgctaccggctaaaatacatatcctgtaactcttccatcgccatcttgtaccttattatgaccgatctatccgataatttgctctcgatttaaaagaacaggtaataaggggatttgggatctaggtttcctcaaag

SEQ ID NO: 77419 - DNA, 1258 bp, Oryza sativa
agggatttgatttgggaaggatttggattcgggattgaacttgacgatagatcggggatttgagatctgagatggcacagacactagacaacaagcaaagaacagatttcgcaattaggtttttttttaagagatagttttcccgctaggcgccacgatggaacgggcgctacattccgtctcccctctcctcctagagggtcttgtatttatacccataggtgtccccttgtccaagctagtagaactaaggaaaccatatggatacaatccgagtagtccttgtcgtttccatgtagaactctattcatccttccttatgcggaactcctcctatatccgaaggttgtttccgtagaagacatggtatgtggtgggtcctgccgagatttagtcaactactattaggtatatggtatccataactctgacacacatgttgaagaaagatgatactcgaatggaaaatcttgattgcctttttccctatatctcactacttttatgcaattcatattcaaaagtaatgggtatggatttccacgatgctactaacaaaataacaaataatatatcacattttgcttctgaataaagcatgtcgtttcagatgagctattatatattcgtattctttggttaagaactatataacttatttttattctacatatattaactagtagaatttcccgggcaattttttatgtagctatagattttatattcaaaatacaactggatttgacatgcaaatattgcttatattttcacaaatacagtagtagtatccaactatattgattagccgttataatctagatctatcattatcaaatagtgcatatttttcttcttttccttctactaagcgttaatttctggacctagagtaaaagtgtggtggttacttttcttcctatcttaataatatacgatagatacaacaatatagcgttgtcatgtgataaacattagagccgtaactagggcttgaaattagttgaatgggttataccataaggaacctaccaaccaatgactggtttttgttcaatttgttttactagtagtatttaattttataagtaacgaaaaaaatcaaattaaaccgtagctagttaacgtatatttagagttaaatttgttaatttcgttgcaagatatagaagttgaatttttacttgcatgtttgtggagtgatatatcacatgttaatacatcatctcaaattttttcaaatttttcataaccattt

SEQ ID NO: 77420 - DNA, 4204 bp, Oryza sativa
  unsure (1)..(4204): unsure at all n locations
cttacattgcatttctgatcaataagcgagaaaacagatttggctgcgcacacatgagttgaaatttgcaactaattcgctacttttgcttggacgtgtgcaggggtatggttcatgcattgccacttggaggtgcacgtcagctggggcctgaagatggcatgggtggtgcaggacgggagcctacccaaccagaagatcctccctccgccgtccgatctccccaaatgctaaccgatcgacaccggccgaccagagacagagattgcgtcttgctcatcagcttccctgtaggatactcggatactcctctgcttttgctagcttgcttctgttgattgctcgcggttggtgctatggaatgcttttcttgtagtggtgtgcctttccgaagttgtgtcgtcatctggttagctgatgtacgaatgatcatgggcaagtttcttgatcagacgcaaggcctttaattttgggcttctcattattatttgtcaccttttgtaacatatgagggagctggatcataaatccacgttcatcccaatatttgtaccatcatttgatgtacggcaaaaggatttttttatgtactatttcatattaatcaatgtttgttatattgttttggagtaactcatttacctcggtgattttggtgtaactagtattgactaggggattagcttgctatgacaggaatagattgtggttgcttgagaatgttttttttaatcaaagtttcacttttttttaaagaaaataccgcaataaaattgccaattcactttactgataaggaatatattgtggttgtgtggcaagtctgtttttggcagctccagcaacacaggagtgaaatcaaatcaaaggtttaaataataaaaggcctacaaagtgtatccaagtccccaagtctaccttgttaaattttctaagaaaaaataataacactcgttaactgttatgcaggacccaataaaaagcagccaatcaaaatatttaggtagtaacctgacccacacaatgcttaggttacaaaacatttcatatcaatgaaaataacgggcggtatcgttatcacctttttccaagaaaaaaaatatttgatttgggacagagacttgaaaaattaggaggcgacttctttctcacattttttttttgaagagattacaacgagactcctatgcagtcaccaacgcaaaccaccaaacacacgtgtgtgcggcttccaccgtatgctaggaatttttcagtcatcaaatatctcctggagtgtggcagaatctttactcaacccactaaacatgcacatccatatactgttaaaattaaagtacactggttccaagccttgaacataacccgtttagagttaatcattgaggttaattactgcttgattatagaataaattgtactgtcatgaaatttgngaataataaattaatgacaatctagctgctctttacactttgacatcaatctgcacctctgtttgatcttattgacatgtggatacataactcacattgtcgatgtttgatgtcgcgattccggtatttgcatagtatggggatcgttggtactaggatagatctcagactaaggtaaaaaagatagatacaaggatttttatacaggttcgggcccctgaattgtcagataataaccttacatcctgttggccgaagccggtttggttttattttatcaaccttattcgacccattccatttttgggggtaacctatctaactgttatcgacttggcggtctgaaggtctgactcgtattcaacaacagggtagccttcctcctcaagttcgtgcccggcgagatcaaagacaacgttaaatccttacagccggtctctataggtaccggatagggttgatccaggcatatctctgatgtcaatatccggcagcttgtcttggcatatgtgggcttgtatgtagatcttttgtcttgatctattgttctgtgacacgccccgaactagtcccgagcggaactagcccgtgacgctccaaattaacctgttagtcgataccagtcccaaaacacagtgctggtatcacaggaaggcagaatatcacagcaacagaggtctctttattatagagtaggagtacagtcatgttgggctgcggacagatcccgagctcacaactgcattacaaaagggaagcggaagccaagacttcgaccaaacatcacaggcgcgacttgggaactaggccgaaaccctaaaactcatcgtagccggcttgctcctggaagaactcctcgtcagcgggatccgtttcatcttcttcagcaactggggggattatttatgtagagcaagggtgagtatgggagtactcagcaagccatgggaaataagtgtttaatgcaggcttcaaggaaaggctgttgtttttgcaattgattttatttaaactcttttctgaaacaactaagtgagtgcttctcaaacgacacggatgagacagtgcgtctcgtccggtcggagtatgtgcaatgtatcagtcttttgaattgatcaagattggcacccggccaacagctttcaaacggccacccgggcctggctgatcccatcagccgcagattttccaaacatcaatcccaaaccacatcagcaaatttcacaaagcagtagtaaaacaaaactacgctaggaatcacctcacatccgcccatgaccgtgggcacggctgttcgaacagtttaataacctctgcagagggggtacactttacccacacgacattactaacccggatcatccagcccgtgcagaacggccacgactagagaccttaaggctttcatgacaaggcatttcgaaagccgacacaggttcaccatatgccaacgagaggggtcccagaccaacaccagatcaggtcccataccatattgtgccaggaaacccgggggtcctccccgacaccaccccgttgaatccacatgtctcttggcatcatggctcccccgattagctagttactcagccaggggtgtcccattccacccatgtggtcgtacttgtcttatgttcggatgaaattccaaggaaacggtccttaagtgcaagagcgggaaactgtacacccggtacattccccgggtccgcaatttggaaattcatttagttcgcaagcaccgacccaggtgtcgggtttttccgagtcttttgtaaaacccaagttttacccaggatgtttcttagaatttaagtttgaggcgaccgtcgatactcgtacagagtgcacgattaccgaggcgcaactaaggggttaagggggacatggtataacaattaacaatggaaggatcagatgcaacaagttaggtacgtccgccaatctgccttgcagacgggacaagcagattaagtgcaatcctatcaatacataatatttttcaagcaacataattaagttcaaatataggctcaagatgttcaaaggtggcttgccttgctcgagatcttgagcttgatcctcgaaatcctcgcactgcgggtcttcgggctccgaaactacacgcgaaacgggacaactcagcaaacggcgaaaataaagccctattattgacctctaagcgtgccattagatagatctcgagatttgagaaattttggaagttgaacggagtcaaacggacttacggttgggaagatattgaatttctaagattattggatttttagtctaaaggaaaaggatttatttaaatcctttttgaaaaagaaaagaaaggaaaggaaggagggagggaaattagactttcctcgggcggctagggcgcggcccgagagaaaggggcggctcgaccgagcttaatgggccggccggcccaagaaggcggcccaaagcgcgcgcgggggcggggaggggagagagagagagccggtgggccgggtccatcccgcgtggtctcgggtgggacccgcttgtcggcgactcggctcaccgtgagcgaggtgcacgcggggcgtgctagggtttagggagggagccgcgacgcatgcgcgcggttcgcggaggacgcggtgcggcgggcccacgcgcagcctcatggctcaccgcggaccatgcgcacggggggggggaacggagggagcggctggccgggtcagccgatccggtcgtgccgaggtggctccgacgtggcgcctacgtggctg

SEQ ID NO: 77421 - DNA, 1372 bp, Oryza sativa
tatagttgtgtatagcttcggagtgtggctaaagtcaactactcttctgtttgcatgtcaccttgaccacctattatctttttctcatgtcttaattacacgcagaatgccgaatatgcaatataataattagatcatgctgcaatgcgaatatgcacttgttaatttgtgtgttttggttatctttgtcacgttttcttgttgacttgggtgcacgaatcaatttagctcagctctactttgaaaataggggattttatagccagctgaagtgcgatttactcagaaataaagaacttgtgtggatggtaagaactttcacatttaatttctagtacttgtgtacttatgttgaacttctttccataatctaaagaaccgctgtcaaggttgtcattattttaaggcgtgaagattggtggttcggctgagattaatttttggcggcacccgaaatgatataatacattagcgcatgtatcaagcgttaactattactccctccgtttctaaacatttcatgtcgtcgacttttttaaatatgtttgactgtttattttattaaaaaaatttaagtaattattaatttttttcctatcatttgattcattgttaaatatacttatatgtatacatatagttttacatatttcacaaaagtttttgaataagacgaacggtcaaatatgtgctaaaaaatcaacggtgtcaaacatttagaaacagagggagtataaatttaaaaatagctttatttgatttcttaaaaaaaacttttacatacaaaatttttacacaaaacacttggagaataaggaagtagccattcggaacagttaattgttacaatacatagtaatagtctgctaatatattgttctatgagtgattttccaggtgttgattaggtaccagaagttaaccatatttcttgtacaatataataatgtcttacttccttaatgaccgtaaaatttcttttgtcatgtactttagccttttttttatgatacataaaagttttgcgcatctttatattgagcattgggagaataccaattcaaaatataagagcaatattgatatggtctccgaattatcctttttaatagagggagtatggtctccctattccgtttgcttgtaatgtaaactcaagaattcctttaaccggtcgatcgggagagatcatcgaggttagttcgagttttctgcacctactattagaaatgtgttaaatcaggggtagttgaattttcgctttaaaactaaaggtcagaggcggcaccaagtggatcagttgcaaatcacatacttttttcgtcaaggcccctaccatattatccttacatgccaagggatgagatcacga

SEQ ID NO: 77422 - DNA, 1269 bp, Oryza sativa
  unsure (1)..(1269): unsure at all n locations
aattggttacaatgcaagaatcgaccttttgagattcaaaacatagcactgatatcgggatgtagattttaaaggatgtactcttgttttagcgccatatcgtctagaaaatcatcaaaaacatttagagagaatgacaaaatatataaatatgtggtatattatgtattccactaacatatgtaagtttaaatatgacttgcataaatataatacaaacacatcgttaattttttttacatgtacaagttaaatttaaatttggatgtttctgaagtgatatatcttcattgatctatactgttaatttgtactacctccatcccaaaatagctaaaaatacgtatattttgagatagatggagtatattgttaaaaggactttttaatgactttttcgatgacatgtaaaaaacgaggggacgttctcgagtgccaaatagactttccacttgtccaagtaatgaaccagtgaattaagtcttgcactaaacatgttggaaatgaaattcttngggggcatacattgtcagttgtcaaaactgttgaatcaatgtgatggttacttattcagaaanaaaacgaacggttccacatgaatgtactctttgtactttctagctgatttggttccacataaatccattcgatcaagtgccaataagtcaaacctgatctaatatgcaaataacttcgagcatgtattaggtgtactccatacatataaaatcatgacaacttaaaccaaaattcatataggagctgacatgtcagaagttattggccctatattttgataaggtacttcgttctctattcttctagataccatactatcttatgggtacattcaaggttaggttgtgcagcttaatcgaattaaacatcacacgacacacgtaccatacacgcagtgcagggagtacttcccctgttacatcgagattagctccttttgaaaagcacttcgatcgacggacaattattttgtcaatcaccatcagcaacctacatatatagtggtagtagtatagcaagctaggcatgcagtttaatttcgtcaatgtccattctgatataccttcaaagttcaccataatcatatcgctaagcggtaacatcacttcctgatatgctcgtcccttgttttcacctacagtacaatgaacctaggctttttattttttatgtatatataatatatgctcaacaatggctaagttgcgatgatcacttgacatggatcccaagatatatatctatccagta

SEQ ID NO: 77423 - DNA, 1794 bp, Oryza sativa
ctaatttcataactcgcatggaaaccacgagacgaatcttttgagcctaattaatacgtcattagcacgtctgtgttattgtagcacttatggctaatcatggactaattaggctcaaaagattcgtctcgagattttcgtgccaactgtgcaattagtttttttatctatatttaatgttccatttgagtgtccaaagattcgatatgatgtttttgggaaaaaaattttggaaactaaaccaggctatctctcaccaaacaaccaaccttgcagaaagtgagacgacgatcgagcgaacagaatatgaattccctttccactcatcgctttctcaggggcggatccaatgtgggtgtagagcggactcaaatcccccctacacctatcggacccatggatacccccctgagtccccccttcaattttttcgtcctgattgataagataggaggtgctaaatgtattttaatagtattttagcatagtttaatactgagattatatgtttatattgatgtactcggtatgttgaggggctgtttggtttggtgccacacaatgttatggatccgcccctgcgctttctccttataatttcttgacgacgcgttgagcttcggttgatcccgacgcctgcaacagtgccacggccgcacggcgtcgtcgtcgtcaagcgcgagtatgatcttgtccggcacagcgctacagccacgatcgaatttactttcgaatttcgaaagatctcgttgtgtatacctatggcaccaatcgatcttgctcgctgccactgccacttgctgcacgcactgaaagggagacgtagagctgttcctctgaaaatgaccgataaatccacgaaacgattcggtttcacccgtaacttgacatgatatttgggcgaagcaactgttaaactgtcatttgctcattttttttcaggcagtttggtcgagcctatactcggggcctatttagttcccaaatttttttttcaaaaacatcacattgaatctttggacacatgcatgaagcattaaatatagataaaaagaaaaactaattgcacagttatgggaaaaatcgcgagacgaatcttttaagcctaattagtccgtgattagccataagtgctacagtaatccacatgtgctaatgacggcttaattagtctcaaaagattcatctcgcggtttccaagcgagttctgaaattagttttttcattcgtgtctgagaatcccttccgacatccggtcaaacgttcgttgtgacacctaaaaattttcttttccccaactaaacacatcctcatttactctgttacagttgaagttgaaccacattgctcccctcgccacaagggtgtcaatccaaacgtcatctcggtcaattctgggatagcagcatggtcgaggacacgaggtagtataggaaatactactccactatgcactgaaaaagtcgtcctgcaatttctcgtaaaaaaaaaagttgtcatgcaattggggtagacccagccggggcaggacatggtctctttcgctaataaaaactccgccatcggctcatccatcacacagcgatggacacataaatatatactctctcggttcctaattaaatacttcatacaattttgactagttaaaaacatactctctttatattttattgtataacgccattgactttttaaccaacgtttagtcattcgtgttattcaaaatttttgtgcaaatataaaaatatttatgttatacttaaagaacatttgatgataaatcaagtcaaa

SEQ ID NO: 77424 - DNA, 767 bp, Oryza sativa
caaattaagaagcgattatatcccataaccaaataaacctggttgttcattagttttctcaaaatctcggtatatggcgatgattagttttcttgagactcgttagtttactcctatatactccatgcgagctgcgtcacatgcatgcagatgcaagtggagcgagcccccataatccttctagaaggtcttggtcattggacctgagccaaagaccaacaacactgacaggtgggaatcttttcggatcaacatgaggatgttagtactatattttggaggggcttcaggcttttcttttgtttttaaggtttttttaattcatggggcaatcttcttttggtgtttatatatagcaagttgatctttttatgtgtgatcatggacaatcggacataaacaatcgtgtcattcatcatcacgtacagtatgcattaatcgtacgtatagtactagtacagtagcagttacgattgcttcatctgtaaacaaaggtgtgctaggtgcattatggctgaagaaagcttgttacaactactaataacgaaatgacagcatggacatgctcaattagcaacctactacacgtacgttacacgacgtagcatcaagcaccactcatatatgtactaatacacccatgcgtgtcgtttcatcgtgacaccacactctctggcagtgtaaatccgcgagaagctcacaaaattctcacgcactgaatttaattaaatacataaacatcagcatggaaacgttctattttaaat

SEQ ID NO: 77425 - DNA, 1690 bp, Oryza sativa
actaatataatttttagaacaactttcctatagaaaatatttgcaaaacacatatcatttaaccgttcgagaaatgtgtctgtgaaaaacgagtgagtagaagatcccaacctacagagccaaatagtctaacagatgattggtagggtaagaattgttaacctttttaagtctatacaaggatgatgagtgtataaggagaaaaaaaagagcatcttacgaatgggaaaatatacatgcggtgtttaattgaatggaggacatgcatgcagcatttaatttcgtcgtgtcgttaataatagcgagagcaacccacgtacatgtatgcaaccaagtagcttacggtcgaagttttatttctccttggttttagtaataaaatatctaattattctaggagagagtaagtgggtcgctaaaatgctagactttgtaactctattcatacccttatcttttttagcggggaaatgtaaaatggatagcctcactgaatttgatgaaatatgcacgccattaacacccactagcttgcgtgttcaatctatgttctttctgacacgttcaggttgaagtatataggtcatgcgcatatttattttacacatcgaaaggccaattctagacgaacttggtttttttttttttttgaaacttagttgtctgcactataaactcgggagacgagcgtagacgaagagtacaagtgtagacgtacgttgtgatcaagtattgagtgtatttgagtagctagcaaataaccaagtatttggtcgatgatcaattcgctgttcccttggcaagagatatttaattaatcagctaactccacacaaaatgtcttaagcaactaagcaataagactgagtgactgactaactactactccgtactacttaatttaccaattggcatatagaataccgatgactcgacatggattgctccatattataacctgtacatgtgaccatccttacgtactgtacatacattagcatccgtatgtgatcatagtcgcagagatataaatcgtgacgtcgatagaaaacaaggcatcggtccatccatggccatcccctaactgtggcagacagctcatatagtgcctgcatgcacgagctacatctacatcaagtatagtagtattcttaactcatggtggtaatttgattttctttattaatatgaacatttttttatttggggagtttctaaatttcagttgttttaattttatttctggaatacgcaaatagcgtgtatatatctttatactagggttgataatttgttttttttattaacgtgaacattttaaatttggggagtttctaaatttcaactgttttaattcttttctataatttgtaaagcgcatacctttgtactagggttgagtacttgagtatatcgctttacacacttggctgtattcttttggaacccctccccaccacacggaaaacagagcgataaattaacacgtgcttaattaagtattagctataaaaatttgaaaaatggattgatatgatttttaaagcaactttcttatataaactttttcaaaacatgtgccgtttagcagtttgaaaagcgtgcatatgaaaaaatgatagagataggttgggaagccataagaaataacacagctcaagagcattagatatgtacagacagaacacaa

SEQ ID NO: 77426 - DNA, 579 bp, Oryza sativa
atttttatttgtaacgtgaaccaaacacactcttaaatgggtgatgcaatgatgcatgtggagcaatttgcttccgtaaattctgaacaaaataattgcgtgtatgtgatcaagccacggtaacgtagaatacagggaaaggaaagtaggtgacgggcaaggggcagcaaatatctgtctgccatattgccttcgatgtgtcaggtcagcccgatgacacgtacgcatatgcacatacgatcgcgtacgacgcagttcaagaatcagcagttgatagagttgtttattttgataatattatattactatctagtgtaaaaagattacaaagattcaacaatataaatctatttgcttacttaatattagttttaatttttttatcgaaattgctacaaatagaattactgaggttgttcaaaaagtaattagcccaactcaaactttcatacctgagaaaaatatcatggaaatcttacaacaaaggctggaaaataattgataaaaacttagtagttaaatgattattacatatcatatcacgtttcttttggcaaggagatgaacataaaaagaaat

SEQ ID NO: 77427 - DNA, 1560 bp, Oryza sativa
aatatcataattctcagccataatgtaagattgcatcctactacaccaatgagaaaaatccgttccatcgaaaacatgaggcttagttaaaaacttattagaagcagccatggcaaaaactctagatcggttaaaatccaaagaagcaaacaaagctttgataccacttgtaggattgaatcacaagaactaagccaaccaaagggggggggggtgaatggttgagatacccaaaaaccaaaaacttttagcggaaataaaagttaccctcgaaatcgatggatcgcggtctgaccgaggtagtcgtccggtctgaccgtctgaaagccaccggtctgaccgagattgaaactccggtctaaccgcctgatcagctgtcgcttgctgtcgccaccgccggtctgaccgcccttacgccgccggtcggaccgccgcgatgccgccggtctgaccgccactgagatgccggttagactgccgaaacccggtgaaacacaaatcgaagaactctcaaagtagatgacaactttattgtttctctctgtgtttacaaagtgcaccaacaacactccttacaaaaatctcgactaaactcaaaaccctaactaaactagctctcaaaagcaatacaaaagcgatacaaagcgatgcagggaagactcacgctccccctctatttatacatgaggtaggcagcctaaagccacgaatcaaactcatactaagagtcctaaacaccttaggaaaccctctagtacaagaaagaacctttacataaccaatcgtaccaaatttgactccttccaaattcgactccgcatcccatacgcatacaatacctccatcatatgccatatggaatctccatcaaccacgtgcatcaactctagccttagtatcccgcatgatatttgaccaccacggacatcgtcttaccaccaagccgactcccggtccatcaccgcaaatactctcccgaggcatcgagtcacctacacatgaaacaaacaaagaaaccatattccgagactaagctatctccaacttgactcattagtagcaaacaacagtattacatacgtataatatccatctagaagccataaccatgaaacaatcacggatatccaaagaaacaacccgaaaccgaaactgacacagcgtcgaccggtcagaccgcgggctgcgccggtctgactgcgcaatacacgccggtctgaccggcacacccagcccggtctgaccggtcccgacaaactagtaaatcctgttcattttctgaaaattgattatctccaaaaccacttcgacgataatctccaaatatcaaaaccaataatcacatatgccaattgttcatcacaaaataagaatcaaaacacacattgatcttacaaatgattcatcaagaagctacgccatatagcaatgcaacctaattttcattatgcttgtagcatgacatgatttgtaggtgggtggaagttcttttggcgccatttaggttgttacagaatgtattagttaatttgtttgttagataaatacctcaaattcaat

SEQ ID NO: 77428 - DNA, 778 bp, Oryza sativa
aggatcgtcaccaccggcggatgggcaggcaacagcaccgacgaaggcgccgccacggggattcatctacattgacagcaacggtgatgacgacggcgacggccacggcgacggcgacggcggaagggcggcgaactacacgcgcggtgatggccggaacggaagggcgaatagctggattacggctctgaggaacgaggaacactaatgacgtgattagggtagagaatacgatacaagttcgtagggcactactggaatacggagggtatacgctaagaaaaaaaaatccaaattgctttacttttttccggtgctttaaaattggtgagaatacaggtggcatccatctaggatggtgcctcacgcgctgaggattggggctccgcacgagagaatttttttccaattcaggggtattggatgttgagtgttgagatcaataagctgccgcagtactatttatctagacgctggcagtcagagtcaagaccagacctgttgtaagccatcttcatctctgctctgctccaccggcagcctgaggagagtccaataaacctgtcacaaattcagattgcaacattttaaacatgccacacaattaaacgttatttggaacctcagaatcagtaatcctgcaatcgtttggaaacgcattaaagtatcaaactaaacagaattggtatgtggcagcactacggatctagcaggcaaactacaacctgttagcaacccacaatgtgccaaacaactccccgtcgcatacagatcatgc

SEQ ID NO: 77429 - DNA, 17197 bp, Oryza sativa
tcaacctttcccattgtaaaacctttcgcaagcaaaaagttcttaagcctatcataccatgccctaggagcttgtttcaaaccatacaaagctttagacaatttaaaaacatggttgggaaaatcaagattttcaaaacctggtggttgtttgacataaacttcctcctatacaaaaccatttagaaaagcatttttcacatccatttgatacaatttaaaaccttttgaagcagcaaaagccaacaaaagtctaattgcctcaattctagcaacaagagcaaaagtttcatcaaaatccaaaccctcaacttgtgtaaaaccttgagcaacaagtctagctttatttctcacaatcaaaccatcctcattttgtttatttttgaaaacccacttggttccaataacattatgtccagaatgtggttcaactaaagtccaaactttgtttctctcaaaattttcaagttcttcatgcatggcgttaatccacgattcatcagttaatgcatgtgacacatctttgggttcaaaagaagcaacaaatgcggaatttgcacaaacatcatgagtcgttaccttagaccttgtagtccgctcacttatattaccaatgatttgttccggcggatgtcgtcgttgaatgtgcaaaggagcagcaacttctgaagttgatccacgttctgtttcagtactgatcgaagttgaattctctggaggaccatctcgatcagcaccaacagtacccgaacccgacgaccctggccggtctgaccgctcctcatgtgtcggtctgaccggaggtgtgccggcggtctgaccggcctggcgcccggtctgaccggccgagccgacctcgtcgtcgtcgtcgtagtcgctctcgtcttcaaaaatatgaccatcctccccctgaacctgtgacagtgtacctgcaatttcaggtctagtaccaggactagcctcatcaaaagaaacttcacaactctcaacaattttgttagtccctaagataagtacacgataggcacgagtgtgtgcggggtaaccaagaaacaatccatcggtagggcgtgcctcaaacttatccaaatttccagatttcaagacaaagcacttgcaaccaaaaacacgcaaatgtgaaactttgggttgatgaccaaatcaaagttcataagaagtttttcctagtttagatcgcaagaaaactcgatttgaaatatagcaagcagtgttaatcgcctcagcccaaaattttctaggagttttgtatttatctaacatcgttctagccatctcaaccaaaacacgatttttcctttcaacaacaccgttttgttgaggaacacgaggagaagaaaattcatgttcaagacctctttcattgcaaaattgttcaaatgaagcatttttaaactctccaccattatcacttcgaattcttttcaaagaaccaggaaattcaagctccaatcgaagaaacaaaccacgaaagtgttgaaaagcttcatccttagttgccataaagaaaacccaagaatatcgagaaaaatcgtcaactataaccaacgcataccactttcctccaacagattgcactctagctggaccaacagtatccatatgtaatagctgtcccggtgcatccgtcatcacagaaacaataggagcatgtgaagtagaaaccatcttagcatgacgacacggtgtacaaaccaaatcaagatctttcttaagtttaggcaaaccacgaacaagatccaaaccacttaacctagtgagatgatcaaaaccaacatgtccaagtctacgatgccaaaacatcacatctttatcaaacttagcaaccaaacaagttatcacaggtgaaacagaattttcaaaatcagctttaaacactcttccataacgagaaatattcagcacagaatcaccacaagaatcaaaaattttacttctagttttcttaaagtgaacttcaaactcttcatcaacaatttgtgaaaccgaaagcaaattgtactttaaatccttaaccaaagctacattcttcaattcaaaattttcatttaccataaccaaacctgtagcgacaacggcactagtagaagcatcagcaaagacaattgattcagtcttggatgcctttttgagggaggagaaccaatctttatcaccggtcatgtgccgcgaacaaccggaatccacaatccatacgttctccttccttgccaccaaagcctacactgtcacagcctgaatttttgtttcaggatttaaaaattatttaataaattattaatagaatatatattaaatgttcattaatttacaagtgaagttaaatgtgggaaataaaatttcctaaatataaagcatggatggatttaatttgtattaaattctccatgattaattatactctttggaattttctcgaatttctcagagctcaattattaattttaataatacaaagaatagtttagcaattatttaattaacaaattaatcattaaatggtctggttttaatattgttaaatactttgagtgtccaagtatgttcaagatttttcttggaattatttgagcattgaaagtatttttaacaattgaaagatcatctcattggttaatttatttggaaaagtaataaaaatcctcctcctcagcttgggccgaattcagcccattctctcccttcctctcagcccagccaaagtctgatttacctccctatcgctacagtactccatcttcctcctccagacagagccgagccagccgtgctcgtgcacagtgccgccgcctcctcccaccaatccggcctccccgttgctcctttttccaaattagttgcgggaatggaatcctctcaatctcctcttccttttccccaagaaatccccaaaagtttatatggaaattctttccaatttcgcggatcaaatcctttcctttttcttttttttttgaacggaaaacagcactagagtgccttttcatcgaatagagcaggagaaaatacaaacccctaggggtaaaagaaaaacggagaaccactatagctgtacactatacagagtgtgggattaactcacgcaaccgcttagctcctgctaaagcccaaaggctcgcctcctctttgattttcattagtaggaagttcgttgccacctctttgtgatcaaaaatccgccgattcctctctttccaaatttcccagacgactaacagaatgagcgatcgaagtccttttttcgggacactaggcgtgtttgcaatgttctcccaccactgtttgactgactgggcttcctcccattccgttgggtccatctgctgatagcccacccatgcagagacgaggtgccagatcctcttggtgtatctacaagtggcaacgtggtgcaatgccgtctcagtctcgcggcggcaaagagggcaacaaccattgttctgccatcccctggtcgcaagccggtctaaagtccagactctgttctgaatgatgagccaagcatgaaatttgcatttccccggcgcccagggtttccaaatcaaggaattgaagtttgtactcggcgccccgcagcactgcgcatggtaagccgaggaggccgtgtagtgcccgttgtttgtgaacttccaagtaatctgatccggttctccaacatctaagtgcacatttcggaccgcttcccacagtgcgactagctgttcgacgaggtcgactgcgatagatgattgtgaatcaagcttaaaatcttgcacctaggcgtcctcctcctttccttgccgaagggattttcctctgttttttgagatcgcaaagacaagcggcatgaggtctttgggtctttgcccaccaatccatgcggactcccaaaatcgcaccgtgtttccgtcccctattgttatgtttgttgaggcggcgaagatcctttcctttttccggcaaatataaactttcccgagtttttcccgtcgatgtgggctcgatcccggcctcccatggctatataaaggaccccctagtcgtcctctacccatcccctcaagtcccgtccgccgccatcgccggaaacgctctccccgcgagctccctctctctccacctccggcagccgctccagctgccgtgcgccgtcgccccggccgtcgccggtcagcgccgccacttccctcggctccgcaaagtcgagctctaccccggccacccgttcttttgcgctgaaccccgccggaagtcgccgtcaccgtgaaggccgaaccgttgccatgttttgatctccaacgaagctttgccgtcgactccgtggtcgccggacctcgccgtatccactgtcggcatcgcagcagtgaggagaagcctggcagccacctccgcgaagacgcaagccatcggagcaccgtcgtccccgtgaagccgatctgttccatcttcagtcgcgccgttcgttgtcgtccgtcgtcgccctcggtcgccgtcgaatccattgggttcgcaggagcaaggtgaagcccggccaccggtttttcttcaccgaagatcgctgaaacgtcgccgccatcgctgacccgaccccgtcgccgcctctacctcgctgccggccgtctgccgtcatcatccatcgtcacgccgtccctcagtgagctttcctctctccgatgtcgttcatcggtgtagtttatccatcgggtcttgatccaatttaatctaatcttgtttggccctagcgtcgttgtcgtctccatgtgttgctatcggaacgttgtcatcatccctccctctccgatcattttggatcggtgagacgtctatccttgtctccttggtttagatttcaacccatcggccgcgcttgccaagccgcttcgtcgcagccgcagccgtgcccgttgcgttgttgttcgccgcgctgctgccctagcctgtgcaccgtcgctaccggttgtgccgttgttgcttgccgtcgccgctgcgctagtcgcctagccaccgttgtgccctccctgccacagtcgtgttgctcctgctgtgcgttaccgcttgaccgctagctgctgtttggccgctgctcgtgtgtgccaagttgttgccgtcccgctactgcaaccaccgagccactggtcgccgtgctgtgttgtgccgtgccgtgccgttgctgctataccatgtcgcagccgtgcgtcgcttaaacctagccgccgctttagccgttgctcggtaatcaagttgtctagccgtaggtgcatccctaggttcctaccggcctatcgtttgccataccggggctttaccatgaatcgtgtctagcccaccggtttagtcgcagccgttgttgagttgttcgctcgttcgttcgtccgtctagagtcgtcctttagttcagagccgttcagagccgccggttccgttcgccggtttcggttgatcattaggctgatcccgggtcatgtagaattgactcgttgagtcggtatctcgtgaggctcacttgccagatcaatcgaagccatccaatcttggtcaactctatgtcaagattaatcttagccatccaaaatcaatataaatcatttcctctcttttcagtggcatattattcctttttaatatatgtcatctaccaattataatctaatctttttccggaggttgttttaatcttttctctcagttataaatcatttgtaaatggtttaattaatttggaatagtcttttctttaataggtttaattggaattaaatcttgtaaaattcataactaattcatatgaaatcaaaatgaggccgttcaagtctctaaaatcatctaaaatcatgatctacatgtttgtttactttttatgtattgtttatttggtttttattagtctttttcctcgttttgcgtgttagcttgtcgtttccatcgtttcgaaggttcgtgagtgcgccggaagtattcaagaagattaattgaagatcgattattgcaaggcaagtcagacagatcccaaacacagttcctttgagcatgttgatcctatatttaaattctctatttatttcaactgtgcatttatttttgaatgtcaccgggtggtgtgaacctattcctttgttatggccagtttgcattgattaccctatttcttgattacctctggttataatttgactagttggatttatatattggttcaactagatgtattagatataattgcttagccatgcttagaaacattagcacacaattgggataactaatgtttcactactacttaaagatggacatgataatggtagctcacgatggctaatcgtgattggttaattaattaatgtgccaactaaaacttgataatggtgggttgtgagcacatggttttgatggtcgtgctcatgacaattaaggaccggttcacgagtttcggttgtgaaacattaaccgtgccaaccacaagccagaattggcaagggctggacactttgtatagcaaggctcattgtggagcaccagactgagaagtggcggagataagcccacgggggttgctggggagtccatgcctctggtttttgagggggtgactacgatccaggaacggtgcactgctttgggttgagttatgcgagggtcttgtcacaatcactcgtcatggtgacgtgtctgcgcggacacggtgacatgacggtgggttgtgtcttgtgggtacagtggtacacctctggccagagtaaaactattcgaatagccgtgcccgcggtcatgggcgggtctaacaatgtctttcgtgattagtcccacactactcattaataataatgtggtaattgatggtaattaatttagctcctagtttggaatggtacattcctagtttggagatagatctgtacagccgggtatggttgttcaggatggttgggcctgagcagcatgggtgtgctgttcagtgtttgatttaaattgatgattaattactctattgttttacaattctcaaatgtttgctaaatgctgcttttgcaaatgagccctgtattatgccattctttggtatccttgtgcacttgcatatttgctgtgtggcttgctgagtatgtcatatgctcaccttgcaataatcaatcaaacctcagttgaagacaagttgcgaaggagaagacgtttggcttatactccagttgagctgcctgtgggagtggagccggagcttcgctagattttattttccgctgcagttttcttcttggtgaggactaagtgcctcttaagtaagtatttattgttctagttaatttgatgaatctgtatattaaattgtcagtttgtgtacctcagctgattcctggacgaggattttatgcacaaataagttcggaaattactagtaaatttctgggcatgacatacacacaagcagaagttgaagcctcagtactggggttagatgataataaaaatttaggaatccagtactgcgacacacgaccagaagatccaataggcatatatccacgtgcaaaatcaattttagaattttcagaaaaattccttcgaggccggtctgaccgagatacagtggtcggtctgaccgggggccggtctgaccgcctctgtactgccggtctggctggtgtccggtctgaccgaggctctgcagccggtctgaccgcgggacccactgcggtctgaccggttgcctcgagggaaaaccagatttttgccactttgattttgcaacagcaatctctctctcctttttctgtttatgagctaatctgaaacaaaaatcaacaatatgtccatctttgccacaaaaagaacaaatatatttttcaaactagcatgaaaagcaatttgatatttttgcaataactttttagttaaaaacaactcatccaaagtgcgtgtgtgcaaagcaaaactacaagcaagagaagatctatttttcaaatcatgtgaagcattaacatctctaatttttgaaatctcattcattaaaacctcacaattttcacaatcatcatcattaggaataagatattttaacctatcaatttcagatttaagagattcaatgataaattcatgttttttatacatcttctcacactttttattttttgcactcaaaatattaatagctccttcaaaagcactcacctcattatcttcatactctgtgtcagattcaccatgcgccatgaagcaaacatcggagacgttatttcccttatcatcatctccactttcaccatctacatcacttagtggctcgaaagcggcgcaaacttgttgaaaagccttcctaagattctccatcttcctcccttggttagaacccttcgacttgtagttgttgggcttgttgttgttggtcttcccaccatctttgtcttctcttttgcctctcccaagcttaggacaatacgaacgaagatgatcaattgaaccacattcaaagcaatgatttggaccacctcttttcctgttcctggcattattcatagctcgagcaattcggttagcagccaaagccaaatcctcctcctcgatttgttcgagttgatcatcggatgtggcattaaaagcagcaagaaaagaaggcatagatgaagaagcatcaacaaccaaagaggaagaagaagaaaccaaagcactcgatttagaatcaactttgcgagaaagaatattcatctcatgtgttttcaatttagtataaagtgaatccaaagtcaaagtagacatgttaacagattcctgaatagatgtaactttcatctcccaaatagacatgtcgagaccattcaaaaagtgacgagaaatctcagattatggatagttagcatcataagaagaatcaacagatctaagatcactcaaaattttagtaaatctagaaagatagtcatccaaagcctctccagattttatctcaaatttaatgtactcctttttaaaaagatctcgacgaagctctttaatgttatttgttccttgatgaaaattcttcaaagcattccaaatctcatgagcagtttcaagatgtgcaacacgatcataatcagaacgagaaatcccactcaaaagaatattacgagctttgcaattattttcaaattcagtttttaaagcatcagtattaattgcttcaggaatcacataaggatgagaaactttcctccaaatatcataattttcagtcataatgtaagattgcatcttactacaccaatgaggaaaatcagttccatcgaaaatatgaggcttagttgaaaacctagcgggagtagccatggcaaaaagtttagatcgataaaaatccaaagaagaaaacgaggctctgataccaattgtaggatcgtaaagggcctttcccaccccaaaagctagccattgaggtgaggagctccaccacttatatcttaggtcctttgcccttccacaaccaatgtgggactattcaacaccatttatcccccctctggttggcttagttcttgtgtttcgatcctacataagatgtctagccaatcacacattggatcagctctagtcttcagtaatttctagcttttgggtgggtctcactagctagtgctatgtgtggaatttaggagttatacctctgaccgtgctgatgttgataacttgttggatgatagttgttgcttcagttgtttagctgaccaatttccaatattttctaggatcaaatcctctctcgagaaaggagttgtgaagttctgtacaactccaacaaagtcttagtgtcatcgagatatccatgaattgaatcatcaaagctggattgtttgcaaaaatgagccatttcatctgcccaacagttccatatgaggtgatgaaacttttgaaatcaaagcaatgtagactaaaaggtaggatgatgttcaaattttagtatcctttatagctcccaaaagtacctgaggtgatatcatagccatgagtgcgcaggaggcgaaatgccattgcacacgttggtatgtccagcatcacatcctcctcattgtgtagccagcatctgcaaacagtaataaaattgaaagatcaaaggaattggtacaaaacactataaattctgtgtaatccttttgttttggaaaggtagatgaaaatttcttctgagttgctgtcacctgtatgttctgtccaatatgtctcttatctcacacacaaaaatccgagaaatccccgtcctttcaagagcatcgaccgtgcatagctgggagtatatattttgcggatacattgctgggactgcagagaaatcttatgtccgttagctgcatatggttgacatttttttttatctagttcacatatacacgaaaagtgatttttacagtacttgacaaggtaatgagaaatactatattttacgatatatataactggatgtttcttcatgctataacaccaaaaacaaaaaaaagttaggaaaattagaaccatgccattataattttgtaaaatttgagatatgacatcctgacccacatatcattgactcatatcggtcctacatgtcattgaaataccgatggcatatctcaaactttacaaaattataatggcatggttccaaattaccaccagaggggtagtacttaggggtagtactacactagaaaaaaaatgtaaataaggtatttgtagctccggtaccacttcaaacactgtaaaatttttgtatattaatccatatggattgctgctgctgctgtctcgtacctgggccgccaaacttatttgtaaatgaatccaaatagttgagcgcgctgtcattgaaactatagattgctgcagctgccgttgtggaaggtgagttgaacaacgatccattctttctttgatacgccattacttcatcccaatcttgtaggctccctaacccttccgatacgtatgccataaaggcttttcttgcagaaactgttcaagcgccatccctgatatattgtcaaaattataacagtgggaaattaagaacaaactttaatataaaactaggaaggtagcccgcgcatatgcgcgggcatgtgcgtaaaatttttttacgaatgtccatatgtggatggttttctatcaaaaatattctttcactttatcataaactaaaattaaactaattcgacgtgctttgaacgctggttacttgaaacatataaattgaactaaaattactttaaaccgtgttgtttctaatacatgagaaaatttgtgtcgaaacaatagatgtgttccctatgaatgtccaattatttttgttagattctgtttgaaattttaaatatattcattttattagttttgctaaaatgtttgaatatttctatttagaatggattataaacccaacaaaaacaaattttaaattagataaattttattttattttcatttctttttatctccattttttttggataaatccactttatgaagcatcttttttgaaatgctttgatctctgtaagtcagaatgaaaatatatgtgggttgatcctacaacctgccatggggtaaaggtatcaattctaaattatctcgctccaattaagtaagaaaaaataaaatagatgtcgtagtattttcttagcaaattaccactaaactggaatatcatgtaataattgcatatttctagattgttctattctatatgtcacaaattcacgatgtactgtaggaagttttacccaaaaaaatagatatggtcttttaatttctatctgtaattggcttatatatagctgaggccacatcatggttgtttcattcttaagattccttggtgcaaccaacgtgcccggtacaatcggtttgttgttcaactggccacgtgacttcatagaccatatatataatttagaagctatgatcattttatgattatttatttatctcctgaagtgatcatttattgataaaagcatcaatatcaaaatgtatgggtaaatagcttctatatataagctgagaaaaagttgatagaaagtcgttagatgtctatcaggatataagtaatgggtcaaccagttttataaaaaattgagctgtgatattttgatttttagtgagcaattttagtattttcttttctttagggtaaaatttgctataggatattaaaaaacatgtaattggccgagagacaccgtaagaacgcgtatctgttgtggcacaccgaaaaaattggtaattagctactggtggctcacgatattattttataatatccaaaggaaatgcagagagagacaataacaaaagtataacttttcccttacctactaagtctggcttgcaaacacctttgacgcagcaacagcacccgccggcggtgagatggctctctagagaggggagagggggtcaaggagggcccgtgcacctgggcttgtggctccatgtcatttccgcacttgttgccgctacagtgtgagggctatgctggcgctaatgctccgccacacaccacgcttggggtgagcacaacgtggaccacctcttaattcatgtcgagtagggtgtcgcagagcgcaggctattgttgtcgatctcggagtcttggcacgccacgctgccataccctccaccgcccatgtcgtgactaccacggcgttagagcgatatgcgagccacacatggcaagaaggggcaaaatcatactttcgtgattgtttctctccccttttcctttggatataacaaaataataccacgggtatctagtagctaattaccagttttttgcggtgtcccatagcagatatatgttcttgcagtgtctcttagctaattatactttttttgggatgtcctgttgtaaattttacctttattgagaagaggcttcaatatggatgtgggttcataatgtaattttttgttagcagttaatatagtcaatatgggcattaagttattgttttcacttagaaaaataatagctggctagacctaataggtggagatttgtttgtggtcttttctttgctcatgaaaataattttaattttaattatcatagagatataaaagctgtgaaaagtaatgctgcacactgcaagtgaacggggatggaggaagggttgagatgtttcttttttttagaaaaatattgattgatttgatgatctaaaataatgtgttgatgtttaagtaaaaaaccgatggttggatgttatttttttctcagatttattaggtttttttttctaatttaagtgagataagtatcagcttagcgaaatacccatagggaaggagaggaaggagaggaagggaagatggtttgggatgttttttattaaaaaaattagatacaataatgatgtaaaataatgtgtgtatcgatttaagtggaaaacaatggatggatgtttctctaatttaacattgtcataccacgatttagaaatatctataagatttttaatggactttaacacctatttttgagattactttcgataaagttaatttttgttttaagtgtgacagggataaaaaacagaaaggaacagggagcctactaattgatcactctagcgtggtggactgtatgggggacgtgggtggttttggttttccaccgatttaaataaaaatcaacggagatttatctattttattagggtgccacgtggcgacttgagagtatttatagggtgccatgtcacggtttgggactgtttgtaggatatttaatgaattttgaagtataagatagatagatagtactacgtacatatggtttttctctttatcttatatggtagaaaattatattttatatttttctcccgattatgctatgtactttttttactttatcagacatgtattttttcttccgacgaacggaacataagctttattgtttttttccgaatcatcgtactgtacttatgattttttgttttgccgacggtacgtattttcccttttatacagggaatgtattatatacacacctaatgattcgtaataggtccaccaatttaaaagaaaatcatctatagatatagatataatctaatggtctaaaaatgatgggtccaccaattaaatgaaaattaacggtgagattagacagtgccacgtggcggcatatgagtgtttatagagtaccacgtggtggtttgagggtgtttttaggaagtttaatggactttgagtatataatagatagatgcccgacatattagaattcctcagcaataggaaaatataaattataaaatatatcatgagtagtttgatgcatatgttatattaatgttgtttttaatgctgtagtaatttgttattaaacctatttggcaaagaaaaaaatgtatatgataattgattaaggaataattgtctaggaataccaatcaaatagtaagagggcttgtagaagcgtcgtgactatatttgaattttattgttatagtatagaaaatcctaatttaaaaaggccatctaatttgttttcgatggttttagcactgtacttatacttacttttagggttttatagttcttttttatcgtgcttacagcatacatgtgcatgttccttttttattcacgtgaacggtaatatctcaatgttttttttcttgatagctttttttcatcgtataagtatggtctaaaataatgggtccaccaatttaagtgaaaatcgacggtgggattgtagaatgacacatggcggtctaggagtatttctaggagtgccacatggcagcgtaggagcgtttgtaggaagtttcatggacttttagtatataatagatagatagatagatagatagatagatagatagatagatagatagatagatagaagatagatagataatagatagatagatagatagatagatagaagatagatagatagatagatagatgtggatagtatgcagatatatgccaatctaccatgttcagtagtgtgcagagaaaaaacctggattttccagaattttgctgcctaggtacgttctacaataagttataattaagtgctcggtcgttcttaactgctattaatggaggaaaagctaattgcattgtgctccatagagtaatgaaatttattcgcaatcccttcataagggacaccatagatatgctagctgagtccagatcattttttttccccttctaatctgatctgttttcaaataatagaactcccaaaaaacacggatacaattcccagttagttccgacactttcatgcatgatatttgcttgatttcaatccatcctgacatgttattgtcttgccgctagtaattttacacttttaaatacaaaagctaattaaagaagtataagtacaatataaatgttcagaactgaattttattaattagtttttcactaattggctaacctttccaattcgatcttccggaggtgaaaaatctcatcaatatatgtttgcataacaggtaatcgcaaacccatcccagcggcaaggctaatcagaccagaaaaagtaatgttgaaaccagcgggagcaatagttttgacatccatcgcaacagagaaatttcttccgataaaatttagacctgtcaacaagcataattcacagcaataaggtctcaagagcatcgaacattaaggtacggagagcggcagtttactgatcctttttttaaaaaaaaaattagagaagggtattttttacccggccattgaaataggaaacttagccccacaaacaacccaatctctgaaattttctcatatagagatttgaactcagaacattggagtactactctggtcactgcaaccactagtttactgatctttttttttaaatgatttaccgagctcttttgccatcaataaatatttgaagcttgaaacaaaggttaaaatacttagtaggaaacacaaaattggtgtatatagatctctctcaaaaagtaattttataatatcttcaacttacaatattttataaatttattctaatacaaaattataatcaaagtcacaccttaaattctcttaaaatgtcagatatcatatactgtttttactagaggcagcactttttacctctcttaatgtgatatggacctacattccacctcttgagcgcaacaacacaagccaatgtacacaaaaggatatctttgtcgactgatgaacttgatgggtttataccccatgatccattgtcctgttggttttgcagtatccactcaatacaccgcggataacatggagcctgaggagaaccacgctctgacaccatactcacccatgctgtgtcatacaaggacagtgataattcaactccctgcagcttcttccttgtgttagctttgagttccttgttgtgctgcaatattacaacagaatattaaactcaaccaaggaatcagataataagagattagatatactagggtgtatctctaaattaaatacatgatactagtctctccattttaaaatatatgacgctgttgacttttcacataacgtttgaccattcgtcttattaaaaaaatatataaatatcatttgatttatttttttacttgttttatcatcaaataaaatataacctcaacttatactttttcgtatttatattaaatatttaaataagacgaatattttaaacgatatacaaaatgtcaacgacgttatatattttaaaaatgagatagtactttagtttacaaggatctaagtgcaagatattgttggtaggctatttaaaccttgaccacctcaaagaactttcagatcaatatttttcaatggacttcaataatgtcatgtgttcgtttgatcaagtatttacagatagaaattagtggtagtcaaactagaatgcacgaagcgcgtttagaagtggggcgagtagagataatcaaagccaccaaatgggtaccatgacttgcagacttcccacatttccctcaaattctatcctcttctcaacacctgttgctgctgggaaaacaaaatgaaaagaagtgaaatatgtcgccaaaaccaatccaatcaccactagaatatgaaacttcaatggctgaaaattacagataccagtacctgtgcactcacacaagttttttttatatacctttgaccatttatcttattaaaaaaattgtgtaaatatgcaaaaacataag

SEQ ID NO: 77430 - DNA, 1359 bp, Oryza sativa
tacagtagttcatcaacaactgaagcaaactgtcaatgctgcagactctcataagtcatagcatcccccctggcctacccgtgtacaagacaacactccaaaggaagattttgcacagctagaatcaacaaattggtaaagtaaaagctcccaatacctgccaaacctaaaaaaaaaagacattgaacaagcagtcacattatcatatggtgtactccaatatgctcttcttcgtcttatcttttatagagaaaaaggtatagcacaataattaaatgcactgtccaggtgaaaattccataggcttttctttggtatggaactagtattgatcaaggcctattagactgcaaattaaatagttgcaaacttcccatgtcgataggatcgaggaatagggtcaagaaacatgatacacaatggccttttacaaggtggggacgaaaatgcccccgtgttctaggccatgggatgacgtccttaggtctatcaaggttcgacctttgttcttgtgatatttttagctattggctactactcccgaagagctgataatactaatgggtttgaataaggacgcggtcttcgaaaaataaattttgaccaccattttctattataatatatatataatatcaataaatataaattttactaaagtactttttaacactaatctatacacattttgttaataatggaaatggattacactattctatacacatggttctatgtttatgacaaacattttcgaaattattcatactcaaatattttaaagtttggcgctgtctctgacggcagtagcctctcatccacatcctgcaacatgtcggtgtagtccccatggatccgcggccatcgccatccgccgtgatcagaaaaagcctccggcgaactgatgtcatcaaggaaaaagaaaataaatggcgtataacaaactgttgtgtgttcgttttgatcagctcgtgttgaccagatttccattgacggtatatatatgtttgtgctgattagagagagattaattagtacctgatccctaccatgttcatgtcgatcagtggtgataattggtcgatctctggccagttccgagctgacggtggtaatttttttactttggttgttttttgctttgctcgtgtatgtgctccggtttcttggatggtggtggagagaaagattacagcctttgccgtagcaggctgttcattgcactccccttgtgaaagggcatgtagcctagtagttgcaatgacttgagtagcagcctaaggtcctgagtttaaatctccataggagtgaatttcagattgggttatttgaggactaaattccatattcaataggcta

SEQ ID NO: 77431 - DNA, 580 bp, Oryza sativa
tgccccgcgcgttgcatagcaggtcattttgtcattttagaaccacaaaacatacttgcgcatatatatagtacgttagagatcatatcttatatttgataatggttaaggcataagaaatagtcaacaaatgaatatatttttgcaatcattgttcagtatattaaaacgtccgatcattgaatctttggacgtcaatttaacaataaaaaacaacagtaacaatatttagtaacgccatgagacttacggttccatctaagtatataaacagtctatgagattagccggatagcatacaccagttcaaaagaccaagaccaaagtattgcaaaatactccctccgtattttaatgtatgacgccgttgacttttcgaccaacgtttgaccattcgttttatttaaaattttcgtgcaaatatgaaagtatttatatcacactggtggagaaaccctttgtagtcccggttcgtaacccccctttagtcccggtttccaaaccgggagtaccaatccgggactaaagatcgagctgaccatttttttttttgcatggaataacccggagtaaagatcga

SEQ ID NO: 77432 - DNA, 677 bp, Oryza sativa
acgaacttgactatttgcttcttttacttcttaatttaaaaaaaaagattatttgcttcttttcttaccaggaacagaaacaattgattagtacaaaatggtacttcctccgtttcacaatataagactttctagcattgttcacattcatatagatgttaatgaatctaaacacatataaatatttagaatcatttatatctttatgaatgtaaacaatgctaaaaaaaattttacattgtgaaacggaaggttgtacaaaacaaaatacatcttaaaaaaaatcacttggggttacatctgagaaaaaaaaatcttaaggattaacaaaccagctatgctctcattggatgtactagtatcatgtatgatatggaagcattttatgtaaactaattgagcacttgaggtgttgaagtggcgttaattagtccaataagcagacgatttgaccctaatagagtcattacaaggagcagcccggtcggtcagtgtgtgtcactgtctctcaccctcccaacgcttagacatttcaacgttctcctccacagcaacagcagcagcagcagcatctcctcttcttcaccgcatctgccagcctagcgagcctaatcaggtcttcgtcttcttcttcctcatccccgtgccaataccgatttcgcgagctccgatggatt

SEQ ID NO: 77433 - DNA, 710 bp, Oryza sativa
gaattctgcaatttgtaagtacagattagatcaaactcaatggtatattcgcgttgtaacttgtacaaataattcaaatgaggcgatgcattgataaatggagtgcaaacatagatgcaatagcttgtctgattgtagattatggttttggggaagctaaagcaaaggcagagataagcagatcaataaaaattcagctacttcagtttgttcagtactgagaagcagcttgcctcacactcacatgcatactactggtaagagattgttttggcatttggggcaaggcatgagcaatctggcagattgatagtacacaaaaacatgtgcaggaactttcaacaaacttctctatcaacctttattccattaaattaaatgcatgggacccatgacaaccctttccaaagatcaaattgcctgcatcatgtgtcatcactggcaattgcatctccatgtccatggagagcttgcaattgcgtagtagctgaggaaacatgtgattaaggcttatactgggtcttatttaatgctagatttatgagcacacagctgttcttgagtcttggccccttgttcagctattcattcagaagcagtcactgaagaatgttgttgagcttagactcactgatttataagcttcctgtttagcaagcagactcatcggtgttacattcagaaaataccggcacattccaacttggggg

SEQ ID NO: 77434 - DNA, 598 bp, Oryza sativa
ggggaatgtgtgacttgccttgcttcttcacttggatcttctgaactcttatccttgcgaacgcgatcttccgaaacgacgggaactacacgctggcacgcaaaacgaggaaaaactctaataaaaaccaagaaaatagtacataaaaactaaacaaacatgtagagatcaattttagatgaattttgcaagttgaatggctcaattcggagttcgaatgaattagatatgaattttagaagttttgagccatttaaatgaatttctataattattcacgaattattgcgcaattattatttattttacaaaggaaatggacctcgctgacgtcatcaaaggggaggggcggcgccggcaagcgggccccaccggtcagcggcacaagggcgccggtccaccgtggaccgggaccaccgaggcggtccaccgccggtccacgggaaccgacggcccggatcggcccaaagccgatcggacggccacgtggcggcgcggctggggcacgggcacggcacagccggcctggtcgagcgatagcgcgcggcggcgtgcggccagacgaccgccggcgacagcggcgcgtcgcggcagcggg

SEQ ID NO: 77435 - DNA, 628 bp, Oryza sativa
tggttcaatgaaaacaattcctccgcatacttgagaagatataccttttctataagaaagcttatcaataatgttaaaggttggattaataagattgaaaactcacctttataggtattcttgaatttttatttcatttttaagtataagtaaatgtgttagtcctccatggtggattatacctcataactaacaatatacaatgtatatacctctctatatctaattatctaaagctggctgctgtgctgcaagctgattggtggattcatcggccatcaacgttttgacacgtgtccattttctcggctgtgatgtatgtgcgcgcttggctgtggtgactctgggtgacgacgagccaatgctagctgggcctatacagcatgggccgatctgaccatttcagtaggaacaattttaacttagcacctcaatacttaatgtggagattatgggtaccccatacccacacggcatggttatccgactagttataggggataacttatatgtatggaatatgtaacagatcatgacttgggtattacgtttccttatatattacggaacagcctaaagtcctggtttgataatattgtaaagtagatttaggaaaccgataccgtat

SEQ ID NO: 77436 - DNA, 15094 bp, Oryza sativa
acaatgtcagcgccagtcccgttggcgctgacacggccaacgtcagcgccaatgtgtttggcgctgaggcgacggcctatttttggttgaagtttttggcaggggttagtttcgaaataagttttccaaaagggtcaatttgtcaaaaaaaaacaggtcgccctgcatggctacgtatatacgagatttctagttaggcttatatatacagccagtagcaccgttgcaaagttgcagtaatatgtggaggtttcgccttttgtagtctttacacgcatgtcaaatgtcaaattagtacctgttatcacgtttgacttttgtaggtatcgtccaacggcggagcctaatacaggagtatttcttatcttaattacctactaattaattagatgattctatacttaaacaaattgtttggggggacggcgagttcataaatagttatattttggaacatataagtagtatatataaattttatatattatgatagtactttgcaagacaaatatatatatatatatatatgtgtgtgtgtgtgtgtgtgtgtgtgtgtataaccatttttatgttttctttggttaaaactaaacattttagtatcaaaagtctgtgaattgtcttaagcttttaatatatctgatgcttttatcccatcaagtaattttaattcgttggattccctaaataactaatttatttggactaatggattaattattaatgaagatgcgaataaaattctctaattttaataatatatattgtaacggtagtttaatttgactgaacaatggaatcaagaggtcaaagcagatcacttattggtcaattcagctgatagaaggctttgacctacctaccataaaacctgcaaaacctttgttgctacccctgtattgtgcgcatttatagatggcctctgtcatccacaagaaaaatgtatcagctatagatttcggacgtctaaacattttaaatttttcaatcacctaaaattgtactatcaaaggctaaaactaaaatactaaataatgtgtaattgctgtttattttcattgtgatctttgctagtctatatggatttaatttaatgttgtatcagcttgaatacttttatatttaagtcttataatgtcgtttttgatttgtaaatttgttttatgcttaggttgaacaattagttgctcaaactttttatctcaaagtggtaggtgatagtactggttagctagatttttcaactgatgatataaaatgaataccggtttgatggtcaacaattcaaatcgtttgatcaaatcttgttatatatgccatatatttatgataacgagtatttaaatctccctataattttttttctgttttaaccgaagctacataatggggttagcgggaggcttctatgtacatatgcgacagataaaaatcacttactccattttttaatatagataatgttgttgatttttggatacacatttgattaggtatcttacttaaaaaaattgtataactgcataagatataaattatgtttaaaatactttaaacaataaaatagctaacaacaaaataaattataaatacctaatttattttagtaagacgaataattaaacgtgtgttcaaaaattaataacatcatctatttaaaaaaagaaacttcgacaattcttagtacatcgagatagatacataataatcgaaggtatcaaattctacgtaaaaaaatataagtttgccatattaaaaaaaatggaaatggtatatatacggtacagaactagagagcgaggatggagagaattcagtagtacccagcaagtacgtagtgatcctacgtggattcctcgtcggagtggggcccagtaaaaccaacgcacgcactcagttcgatctctttttactcgtgtcaacatcgtacgcttgcgcgccgttgcgcgcggacacacacacccacacccacacccacacctttggttgtgtcatgtgtaccgaaaaagatcatccgctgccgcatggctcaaggcggaggcggaggcggaggtggagtggaggccgcacaaaccacacaagttgtgcgcgcgacctgtgagccagcactccccgactcccggcccggccgtatgtgtgtgtatacaccagtgtatcgcgttctcctcgttcggtgaagtgttaggttccggccggaaattaattaaccaaacgaaacgaaacacgtacgcgccttcaatctcttagccggcccgggacgacgtacgtgcaccaacaaatcgataatgcatgggagatccacaactgtagaatgcctcttttcttccggttcgtaacccccaatagttatgtgctgcaaacccggaaaaggaatccaggatgacgatctttagtcccggtttaaatactcggggagtaaatatgcatctctactcgtcaagcccctccgcgccgatcgatgcctgccgcgcagtcctctgcgccgccgcccgccgcgcctccccgcgtctgccgctcgcttgcccactgccgcaatcgcgcgtgagaggataggatagagagaggaaagggagaggataagaaaagagaggaggaggataagggaagaggtggttcctagaggataagtccgatagattatatactatgcaccaatttttaagtctcctctaaccgggaataaaaagagtagggggcgtgcactttttcgactagaactaaacatcatagaatagctgtgcggtttttaactggagctaaagatgatatttttagtcccagttcttttaggaaccaggactattatgatttttaaccgatccagcaaagatcagttctccagtagtgatcaatcagcttaatcgataatgaggctgatctattacagtgtttctgttccatgcaaccgcaatcaacgagcgaacgaagcatatgcatgccaaagcaaaaggaggcaaggatctgcagattgcagatcgagccgacgtggaacgtgaggccatcagcagccgttgcgccgagcatccacggtgcccggccagaggcgggcacaggggtgcggacctgcgaatctgcgatgcgtctgcctccccgtaccactaccaatgcaagttgcccagaaatgccaaaacccaaaaagcaagcggatgatgcaggggacggggccaccggtagctgtgctgtctcggcggcggttcaattccccggggttacatccactgcaccaaagcggcaaaatgtgcgtctcgtggattcttgtagttgtacttaattagacgagtaatggggtccgtttggattcaagggactaaaaatttaaccatacagaatcttaccatttaaaaatatttaataaattttatgtactaatttgctagatgaatatacaaggtatattaatccatgattagtaaatgattactatagcaaatcatggatttccccgcaaaaaaatcatggattaattaggttcattagattcgtctcgtaaattagcctggagattatggaataagttttgtcagtaatctacgtttaatactctaaaatatcaagattccggagggctaatattagccctccggatccaaacagggccatggagatttcgagcccggccatctgagcatatatattgcccgtgtccatttctcctactgttgtgaactcgtaccacatactatgttttattagggcctctcattgtttcgcttgtgattattagttaaaatttgaatatttagatttaaaattgaagttgattttggatgttttcaccgaagtttattttttagcttttgcttttatatcactgagaacacgtatataaaagttttatttataaactatttttcgtttacaaattggcttatccccgaataataagtgtgtaatcgaaattaggtggtgtcgcacactcgcggcctcgcgcgcggtcgtgcactcgtacacttgtctctgttgatctcgctctttaattccgtgtattatcttcacgtgttgttttgatttctctcatgggacgctttcagtgcatagtactactccagtatatagctgtgtgcctgtgtttagtgataagtggtgggcgcgtgcagctagctagctaactgtggcatcagcatgcctgccatcatgtgcatgcgcaagcagatctacgagtagtttgattcgaaaatgcgccaaaaggcacgcaattaagaaactatgtgtggcttcttatttggagaacacgagttaattgaaaaggtagttaattctttaattgatccacggatttttagcccacgagttttatctttcgttcatctggaactgataactacacactaacacacatgaccccctttctctcagttttaagtgttgatcggtcggcgatcgatcgctgcatcggtggatgcaatcaggcacgcaaggccccattttagcaccaaatcgatctaaccccatgaaaaaaacgatggattttgttgtagcagggggccaacgcccttcctcctatccggtcaaaacaccaaagcgataattcctggaaagtttctaagtataaaacagaaaaacacacttaagtgggaaaacactctcgagcagtaaaacactccctggtggaaaacactctcgagggggaaaatactctcgagtgggaaaacactcttgagtgggaggacgtacctgagtttgtttctcaccatttgcatgtaacctatcttgtttggagatgaattctaaatacatgacaggtgaaccttggcggctgggaagctggtgaagaacgtgtgagcccctaagcatagaagacattcggctagagaactcgaaggaaaaacgtatttcgagctaagaatgagtcgaatagaagattctgtaggggccacttcccaaccactcttgccagctagagccaaaagactataatgaccctgagaatgtatcataatatccttagggttgctgacatggccagggcattataggaagttcactaagcccatgagggcagaaatgtaatgtcacatgtaagatcgtatgctataaaagccggtcaaatacttgtagcaagacaagacatttttaatataaaagtaatcctcaaaggttgtgtttgttgttttgagcttatttctaagaatagacaggaaaacacttcttttcggcctattcccgatcttgttcgtgaccaaaggtcacaacagatttgatcaaaagatagtgctagtgttgcatacacatgcaaagcttccacagctggagggaggaagttacaaaagcgctccttggtgacaatactctaatgactaataccggcttctgcgcgcgctttaccccctttcttttccgatcaatgttagaggtgatcgatccacaaattaaagctagcagccagcaggagatactgcctagctacctacttagcttatctgaaaccatatcctgaacagcgaaagcataagcaagagcatgcatcgatcgatcgatatatacgtatgcccaaattaaagcacggctagcctgccgccccggccggttggtcgatctatcggagaacaagttgttggcttgttcccctagctgacgcgctgcatgctgagtcaatgtagctacgtgatcaagttatcacggtcagcttcgtcgacacgaggaaccgataccgaccagaactgggagagaatgcatgggtgtactacagaattaatgatggattatattctccgagatcaccgtgctttctatccctccagttataggccagacaggcgcagattatttcgccagcatcgtgcatgcatgcatcctagctcggtttcgatccgcaccatgctagctctgctctgatccgttcgttttcccggcgatttgcgcatagaatccgggcatccgtgacatctggtggtgtggtggtggtgatggagacgcgaattggcaggagcgacgcgggttggttccccgcgcatcgccgcgaggtggggcgtccagcgtccagcgtccgcgctcgcttgatcggatcaacgagaggcatcggttcgtagctgcgctggttggctggacgtctcaaccgatcgacgcgcgtgtgccgggggtacaatgttgcgggcctttgcggcacgaacgatgcgcgcggtgtcgtggggctactaaattccacaggtccaccggccggcgacggctgtagctagtgcctcgcggccgcggtgcgtgtggctgtgcacgtcgcgtcgtgccgggagaggccggggcattttccgctgcggttgggacgggagaggccaggggcgtgccatcgagcactactggagaaaaatgatctttgctagattgttcaaaatccacaatagctggttcaactaaaaattcacccgaattcaactttactcccgattattttactcattactaaagatgcagtttctcctatagtgtaggatcggcaacgacccgagagagatcgagaggcaacacacgaggtgaaattagcaaattcgcctttttttaatcaaacattagcgggccaacaaatgggcctcatccggatttcgttggatcaatttgggccgaatcttgaggtaaccagactaccagtgggccggagttcagtagggcaggccgacaaacgtatgttttaatagttttgctatatatttgttgataattttttcccaaaactttgtcagctgtaaatatacagtacaataatagtgtaattatatcataacttgtataattatagtacagcttgtatgtaatttttcaaattcccacggtaacatgtcattttcgtgaaccggaggtcatgggacttgctagtgtgtgccccgtgaaaaacgtctaggggttttccggttagctccacaaggtgataggctgatgatctggatttaaagtctcatccattctaattatttaatattagattcttccttaatattcgtgtcatttagtgtgtgccatgtgatttttggctttgtttgaccgccggctttctagtttcttcgtacaatcaagcgagggtgccggccactgtgtcaaaaggggaagcatattttgcccattagctggcattagggcttatcagtcttaatccagaccgagtatttctaatctaacggtcatccagcggattggattgcacgcagcaaaggagctgatctcccacgggcgaccgcaagtatattttgagcaagatgtttaacaaattgaatctccagacacttgaattcaatcaacaaatccaaaggaatattccagtacaaacgaatcatcaccatttcatcaccccagttccactcaaagaatcgtactttcaaaaggaaattattaaagcacaaaccacaactcgcgcgtgaatcgtgacaggcatgcatgcatggcccccgtttgaatacttgttacgcccttacgtgcgtacgtctgcgtcttcacctttgcacaatggcgatgcccatccatccaacacgcacgtacgccgatcgaatcgaatcgccggcgatcgatcagtagccggccgccacggcgtgtgtccgctccaccgggacggggccgcggctcccgctgtggatcgcgaggacgtagaagagctgcgtcgccgtcaggacgatcgtgaacgcctccatggttccctgaatgccaaactcccaaggtttcaattcacagaccattctgaaagaattaatctgacgaaatggggggaagaattgatatggccgggagatcatcttaccagcttcgcgttgcgtctgtcgagactgatctcctggcacgccagcctgcaaaatccatcgaattaacaagggcatccaaatttgtgttattattactctctccgttttaagttataagacgttttaattttggtaaaagtcaaattactttaagtttaactaaatttgtagacaaatatagtaatatatataataccaaattagtttcattaaatcaataactgaatatattttcacaataaatctatcttaggttaaaaatattattatttttctctacaaacttaatcaaacttgaagcaatttaactttgaccgaaagatactaatattattctacatcgtcatcaaactctcaagtaaatcatgtaagtgtaaatatataccccatggcaaggacggtgagcgcccaggcaagcaggccggtggtcgccgccggctgcagggagtagtagttccagtggcggatgtggctgaacccgacgaggccggaggcgatgccgacgacgccggcgagcagcgagaacacgacgaagaaccccgttgcccagttgccgatcgggaagaacatcgggtggaaatgcgccggcagccgcaatcccgggcctgcaaattaaatcattcaccaatgaacgaaatgatcgaattccctatactgacgagaaacttttctttgatgaaagcgcaaaaggattgcacgccaatatattagaagaaaaaaattatattacacaagtacacaacgcaatcagacaaaccaacttatattaggggaagggagaaaaagcaaaatttaaaaagactaaagaaaactacaacgactaaacataactccaaacagcgggaagatagtgacggaaagatttaatttagcatcttgtatcgttacctaggatgaagccgcgatcgatggagatgttgacggcccagccgccgatgatggcgaggatgacgtacatgcagaggttgagtatcagcagcagcaaggctacgggcttcagggtttcggccatctctgcaacctcgctagtacctgctaattaattaacacgaactggggtaatctcgctgatgataattctagtaccgagatcaactgcaattcccctgatgctttcagaagctgggacttggcttcccaatttatatgcgtccacggcgcattgcaacgagatcggatttgttctttgcttgcctctctcccaggattaagaacaactcacagtgatagctaagctcaaaaagcgatggagtttgggacttgctggcgaaggaaaggagctaagccgagttcttgggtgtacttttggtccgtgttggtgttcgtcctcctgatgcggttaggtatgtgtacgggtacagacgacgcatattcgatcggccatgttcgcggtaaattcatccattggttgattctttccgttgtgttcgccgttcggggtatagtagacttgtagctgggaattaagcccagtttgtgttggacacgggccgggacgggtcgggccgagtgggccatcgatatacagtactgggccgtggggttgaaggacgggagacgagccactccccgccatgtcaacacgtataatcagggggcggaggcaggcgtagggcagctaaggctttgagccctaggcctacctccaaaatcatggctaaattatgttatatcacaatgtaaatttaagaaaagataaacaactcactaattaagttttactttagccctactctttagtaatttctagctccgccagtaaataatgtgggtacttgaaatgcttcttgtttgtgttgtgtgttactcctacttgaaccgaactacacatccagcatatttaattacctcgatgatatgatgagcgtatagtttgcggtgcaagattaagacgccggaatcactccactcatctcaatgcagcgaatcttatgcgttctttcatcgttctgtgttgttttcgtaagaagcaatcgtgcgtgcgtacatgggccgcctgcgccgcctgtatcaatcaattaatactaacagttagggcggatccagcatggcacggtggggtctcaacgctcactcaggattcctaatttgcgtgtacgcgccgcgagcgagcacttctagcccacacggcctgtatgcgcagtgccaccagcgctgatcaagattttttttttcatagcggcatgtctaacgtaactaactctttaagggtaatgatgataattaatgaaagattttttttcttttttgagactttattactaatagatagaaaatttttaagttacatttgaaaacttttgacttaagatttaaactttgaagtcaaattttaaaaactttcaacttaaatttgaaaactttcaactcgagatttgaaactttcgactcgagatttgaaaacatttgactcagatttgaaaactttcgactcagatttgaaaactttcgactcaggtttgaaactttcaactcgagatctgaaaactttcaactcaaaatttaaaaattttcaactcaaaattaaaaaattttcatataaaaatcgaaaactttcaactcaaaattcaaaaacttttaactcatagtagtatttgaaaacttttaagttgatattttgaaaactttcaaatcgtattttcaaaattttcaaatcaaaatttgaaaccttttaactcaaaatttcaaaatcaattgtttttattttttattgagaaattactgtagcattttcaattcgttaatcactttaatatagcatcatgcgcgttgttttctttcgagaaaagcgctaagcgctactaaaacgaaggtccgcgtgcgcgcgacttatcgtcctagcgggtacgcgcgagctagccacccctctcaaccctatgctattggtgtggggatcatgagagccccacatagcgtacacaaattgttttgtcatatatagatggaaaataggctataaaactttgctctttttttcaggtcctcatgctatttctttctgaatctatcacttagcagcttgatccgttagttaatcatcatgaaggtttacagttatactaaatacttattgcagccttaatgatgtgtcctccaggttaacagcttagacgtaatcggccgtacgttatgtacaggttaattacacgtactacgaaataggtcgtttcacacacagggtgatgagatagagtgatcttggagctagacccaatcgatcaacatcgatgcatgatatgatcgaaatagcctggattctcatgcgtgttgacgtgtcgtctctcttgtctcgtgcctaccttaatttgtaggagtactacatacttttgtacgtgcatgcagttaacagttaatcacacgtacacgtacgccgttctgattaattatcggtcgttgatcgcacgctacgcttgatgtacgcatgcatatatgctttactggcatgaacatacgcaatgaagtgtgaatcgcactggtcaaatttggcataaacatagatcaaattaagcatttcggcgtaaagatttcttaattcagttccaagcagctagattcctttttgaagcctgcagggcacgcatttgttaggagtacgtagtacgtacgtgcaagggtatcggagaaaattaaaaaaaggaaaagaatataatattattggaccggatgaattctgaagaaacacttgcccaaacttgacacactttgagtgcagaaggaaattaagagacgaaaactgcctttaagtgaagagaaatgtaagatcaaagagtacgtcaaagtcaactagtacaaattgtacactaattaacccatggccatgtctgactatcaggctatgtggttagcactttgactgcgtgttaattaactaacaactactgtaaagtaggagtaagtacattcaacaacttaattagctgcaaaaaagtcatttcttttcaaattttctatgacagaaatattctacgcaacatattgtgtttgctagtttggttatgtactcatatgcttagcccaatatggttaatcataattgacattagtagaatttacttagttgattaaacttttggtaattaaaaaaaatcaatcttctggttcttatatatgtgtcttaaataagagcaatctctggtagttttcaagaaaagagaaatggggtagtgaaaatgagataaagaaaaccccaaaattaatcctgaaatcaaactctgtaaattcaaaatcagctacagattacaatacgaatatatagtttaagatcaatttataatattaattcataaccattttttaatgatcaatttatacatattaattttttgtgcgaacttcttcatattaaaactgaaattaccatgcaggcatgcacatgtggttttgtaaatactcctgccagaaacctcatcaaaaaatggttttctgcagcatatgtttataagaatttttataactaataagttggtcttatatatacatatataaaaaaaccttaataagctagaaagcagagaaaagctagcagattaataagattttcagatacgtgcgaatgccttaattaaccatgagccagcccaccatactgtaatttaaattccaagtttctgaaaaatacaaaaaagttatgtaggtaaacataatcttcagtactattcttgctgaaaatcagccaaacttaatgccaagtaactttcagaaaagaggattatttttttagataatggaataatctgcctctacatcgtgagactgatatacacagccaacttcagaaaagaggatgtatctgtatttagtaaaaggatcaaagaccaatcaaccagattatcaatctaattttgtttggttcttacgctagactagctagatagatatgctactgtttagcaggtccaaaacccaagaacaaataagtagaaaattcagcaaagttgactgccgtgcgtgtccagacacgtaatgtaccaatgcaagaatgtatgccacatgcaaatgttttttttaaaaaaataaatagcacatgcaaatgagtaatatgattatgattaattaattaaattggtgtttagtaactagctagttgctttccacattccagttgtaactttataagcattctgttttttattaagagctcaaatgcatcgactaatgctgaaaataccaaagaaacaaaagctatatataacgacagctagaaggcaggtcaacctgaccagtttgtgatccacgtaatcacgaatgtactgcagtcgtacatattaagccaatgacatttcacaactccctatatatactaacctagttatactaaattagttgatttctatagagagaattttaattttaaaaataattaaaatttgtaaattttatatcaatcagtagttaaattacaagagtatgtgcttggtttctaaaagtaataccttgtcaaaaaaacacaaaagttatatagacatgattcatatttctgagcaacggttttacactatattggttttctattgatcaaggaaatatttctgagaaatcaattgtcaatcttgagaattaacggccatagccctctaaaaatcaacatacctagctatgtcccaaaatataaaatcaaaatcccttacattttttagcagagatatagtagcacacaaaagctagtaaaaaattaaaatcatcgtaactaattaaattaaggatgagttaatataatgattaattaagtacagatccattaattggagatgtttcttttattcacaatatatcaggaaaaaagaatccatataatatttctctgtaaggtcatgtaattaagctgtacacgtacccaaaaaaacatataataagttacaacacattatttcgatttattgataccataagaccacttatatatatgtagtccaacaataataagaaacacataaataatgagacgaacagacgcaccgtagatccttaaatttgtataacttttatcatttttttttcgtatatgtatacttgtttcaggagctcaacaattgcaattttgtaaaacaatttggagtatatatataataggtatgcactcacgtcgtatatacgtactgccattttttttatttctctgatggatgtgtaggaacgaatttgtattgcatttcctgcctcgatgatcgcatgcacgccacgtacatgaatgcacacgccgccgccgccgccgccgccgtcgtcgccggtcgccggccggttagccggcgtagtcgcacaggccgaagctgcacttcttgctggggcagcggacgaagcagtcgccgcagttcttgcggtcgctgaggaggtcgacgcagtggccgccgcagcaggtctcgccgtacttgcagacgtggttgcagctgccgcagtgcgcgaagctggagccggtgtcgacgcaggcgcccttgcagcacgtcgccccggggctccccggctccaggcacaccgacggcggcttcctcttgcagtcgtagtacgacagcggcggcgagttcttcgcgctcgccaggaacctgctctgcctccttctaatggccgccgtctcgagctcggccccggtcccggtcccggccgcggcgagggtgagcgcgagcgccatgagaagcaccgcggctgttctcatggcggcggtggtggtggcgagcgcggcggtggcggcaatgcgtggtgtacgaagtttttgcttggcgaacgcctgtgtggagggaggaaaatgggggaggaaaatggcgggggaggagtgcttatagctgtagaaaaggcgcgagaggcgaaagtcagaggtcatatgcagatgcagatggttgatttgcacggcaaaagcctggagtgcagggagggagtgtgcgccgcacggatggatagctgtggactccgcaagctacctagctgctgatcgatcaccaccacaagctgatcaactttaagcatgcttgcaatggcgatctggctggctagctagcttgtgtgcgtgtcttctgaattccaggtttctgaacatgtgattaggcaaagctgcatgcatgcctgccgatcgatcgcacacgccctgaagattaggtagattaatctggtcgtggcagttgactaatcaccggaattacagtaacaatgatggcacttttaattacgtgaagagctagcgatagctagtgtgtgctactcttcgattgatcaacaaaataatttagccgtcgtcgtttccctccaggggcactttgtcggcgctgcctgtttagacagcagctgaaggaactctgcatgctggcttaagggaaagaagaactgcagtctagcatgttaccgggatcgtctgcgatgcacggcatacattggtctaggagccaattaat

SEQ ID NO: 77437 - DNA, 548 bp, Oryza sativa
ttctttctttgtgaacggtaagcattcatgcatggaaacttttgtgaccatatagaatgcatttcccatactgaagaactttctggaacagcactaggggaaatgtctgctgttggtaaaaatatataatgcacatggcacttgcatagttcaaccattctagcttatacagtgaccgtttgcctgtcaaattgcaaaatgaatctacattcctactcttttgttgttattcaattactctttgtcgttaaggcacccattatttatgatgccattcttatttgtcctcgtagttgttatgctgaggagctgaatacccctctgaaggacaggcacccagctacaacaaaacaaaagcatgcatttgaaagagtacgtatatgaattcatctatttaaggtagctacaatctgcctgcatggaaatactaaccagattactaatctcctctgacagatagaggaagaacctcttccagaaacggatgatgtagatccaacaatggaaagcaagtactttgacagcagaatagatttcctgaagcattg

SEQ ID NO: 77438 - DNA, 744 bp, Oryza sativa
ttcctgcagcccttttaaaaaataaattaatatgattttttaaaaacaactttcgtatgtaactttttttaaaattgtattgtttaatagtttaaaaatcgtgcgtacagaaaaacgggagaaaagtttgggtggtttcgacctttgaccagctagctgttagtctgttaatgcccacgccctgatcacaatgcgtgatagaatttctgacagacaacgacgcctatagaatacacaatgcgtgatagaatttcgcggctagcaggtcgtcgcacacccgacgaaaagtcccacaaaactgcacacgcatggtacgtacgtagaattagttagtactagtcagtaaggatcaggtttcccagaccgccggcggtaagcacgattatcacgcggtaaccgtaaaaaaccgtgtaaaatttatcaaaaattcaaattatttttcaaatttatttaaatttaagggggttatcgtggttttttattactgtaccccgcggtaagccggtaaccgatggtaatgtaaaccctggtaaggatagatcgagttgtactcggctcgagatcttctagaagttatagtgtactcacgagatctttcagatgtggtaagtttctggtgctgggtttaagttttcgcgtctacgcttacgcaaacgacaccacacgtacacacaccggccggcagaaaagtttatgagatttccatatatatatatatacagtacttgccaatctcggttggta

SEQ ID NO: 77439 - DNA, 705 bp, Oryza sativa
gtcattaattaattttaaattagtgataactaaatggtttctcttatattggccatcccttttcccatcagtaacaaaatgaactatctcatacattaatacatatcatattgttccaattgctattgctacagacctactatatccttcctaacaacaagttccccctgtcccctctagcattcttgctaaatgattggttgaactatggctgataagccgtagaaatataaaagaagaaaccaaaaatattttgaactttttgtctgtattattcatggtttaaaagccatgctggaaaatagactgcaatgaagaaaaacctcaaaatcacctataaaattatgtttcaaaattcaattttggctatggatgataaaccatcaagcagacaataagagttatttacaattgttgcattaaactacttgtgtcaggatgactcttcttctcgggcctccatcgtctggaaaaagcacacttatgcgagcactaaccggcaagcctgataaaaatctcaaggttttgatatttcttatttagtttaatgtagccacctctaacagtagagtcgtaccacatgactaatcactcgatggctacaggtgtctggcgagatcacatactgtggtcatacgtttaaagagttctatcctgagaggactagtgcttacgtcagtcagcatgatctgcacaatcctgaga

SEQ ID NO: 77440 - DNA, 12533 bp, Oryza sativa
ctttaggcccgtttgagatatggaatgttatctcaatcaagcctaaagttgtggcccgtcactgatatgtgtcatccgtgacgggcttaagttttatacccatctaacatgtctgtgcgaccatatcttaatcgggcacttttcggcccgattgagatgacttccttgtgacggcccgctatttctaagcatattagagcccgtcacagatagaaggatctgtactagtgtgtggaaaatgctagaatgatttacattgtgaaacggagaaagtaatactaaaccgagagaatatatatcaatctacataccgaaatatacatgctgttcaaggagggcgcagcgtcaagtaaaaaaagagtccagttcaggtcgcatccgttaaagatgttgcggagatgcacgtctctcaggcagggttcactttctcgccggtaaccgcgcggtaaccgcggttaccgggcttaccgtgggggtcggtaacgaaaaccggcggtagggtttgggcaaattttgctcaaattcaaaaatttaaaaaataatcgaaaaaaatcaaaaaaaaatcatggatgtaaagcttgttttgtatgttgttatggtgaaaaaatttcatcaaaaagatgcaggtaaattcaaatttgagcacaaaacctattgtgaattataaaaaagaaaaaagattaaatggaatgggccaagtatgcactgttcatgaggcccaataaggcccacaatgggaggaaaatatctttggaagcctctgcttcgtttctctggcgaatcctaccgtttttcccctctttcgcgtagctgcgctcaggaccgaaggggcgacggcgtgcgcccgcgccagatccgccgcctccgcgccggcgaggccggttcccgcgcggtaagcggtggtaaccgcgcggtacgcgacggtaaccgcctgggtcgacgggcaagaggtaatccctccgttttgaaggttttcgcacggttaggagcggtaaccgtgcggttttgtacggttaccgtcggcttcgtaatctatgagacgatatacgtatgtgcagtaatcgtgtgaaaaccgtggtaaccgtccaccctaccgtggttaccgtggcttgaaccgtggtatggtattttttactgtgatatgcatggacatatttggggatttaggtcaatagaacatatttttaccaatatgcatgagaaatacattgggaatatgagtttatttcggcatttggttgcccgtgcttggctaaaaccatgcatgtgaagtatatttgattgctttggtctatgtacatataggttaaattaaatacgtcatagtatggaagaatttggatgcatgcttaccagtgtacatataattacgtcgtattattgcataatgggaggtatgtttataattagcagtgataatttctcatgcatttgatacagggtggagatgtcagatagtagggaccctgtgtgggagcacggggagaatatcccacctggatggcgctgtaagtattgccatacaaagaggggcggtggtggggcaacaagactaaagcaacacttggctgcaagagggaagggggttacatattgcaattcagtgcctccggatgtccgtgagttcttctgccgtgagttggacaggataaaagatgcaggtgaccagcgtaagagtgatagcggaagaagggttgaagcagcaagggtcaactattatgacctaacaggtgatgccgacgaggaggaacaaatggaagcagccattgcagcctcacgacaagacgaaaactttaggagggatgttgaggagcgtggtggcacttatgagcatggcggtgggagtggatccgcttagccggaggcacggaaaggtagaagtaacccaattaccaatatgctacgaagggctacgtctcatagggagtcacctgctgtgagagattacaacctagcatctgccaaggcccctgtgcagccacgcattgacacaggattcttcacaaagaaggggaagcaagctaggcaagccattggtgagtcatgggcaaggttcttctttaccgccggcattcctggtagaaacgccgataatccatactttgtgagcgccgttcgggagacacaaaagtggggtacgtatgcatctattaaggaacttctttttttctaactcattgcgcactacttatttcatacgtcaattgtaggtgaaagtgtaccttctccaactggtaacgagatagatggaaaatatcttgattctacagagaaggatgtgaagaagcaatttgataggttcaagaaggattgggatgagtacggtgttactataatgtgtgattcttggacaggtccgacgagtatgtcggtcatcaattttctgatatactgcaatggaataatgtttttccacaagtccattgatgcgaccgggcaaagccaggatgctaactttgtgctgaaggtatgtatggttcatgcaacaaattacttcatcacctgttatcgtcagtgttaggggcatggactaatttttattatgttatctaccaatgcaggagataaggaaggtggtacgcgaaataggctcggagcatgttgttcaaattatcactgacaatggctctaactacaagaaggcgtgcagactactacggcaagaatacaagacaattgtgtggcaaccttgtgtggcacacacagttaacttgatgcttaaggaggttgggaaaatgccagaccacgaaatagtgattgagagtgctaggaaaatttgcagatggctatacaatcataacaagttgcatgctatgatggtcttagctataggtggtgaactggttaagtggaatgctacaaggttcggaacaaactaagtggaatgctacaaggttcggaacaaactacatgtttctccagagtttccttaggaagcgagatcttttcatgcaatggatggcttcctctgtcttcatgcaaagcaaatttagtgggactttggaaggtagatatgcacatgcatgtctatctagtctgtcttggtgggagaacttagaggcagtagtgaattctgtccaacctatgtactcattccttcggtttgctgacgaggacaagaaccctaatttgagtgaggtacttttgagatatcagttgctcaaaatggagtacgacagtctttttgcgaatcaaagggacaagtttgaagcatacatggagatcgtgaacagaaggatgcacgacctaaccaatgagactctcatcaatgccggtaaatattggtcataacataatccacatggcatattatgtaactcttacttaacctgtgccatgttttgtagctgccgcattgaaccctaggacgcactacgcgtattctccaagtgctactgtcttccaagacctccgacatgcattcgagtggatgacggatatcgatacggctgccgccgctttgctggaggttgagatgtaccgacgtaagacgggtgaatttgggagggcactagcaagaaggatggccatagatgggaaaacttcacctggtatgtttctaatcatggaactatgatatatctaattgatcttgatgtattcagaattatgaaatgacatgttacttggcttttgcagcacaatggtggtctatgttcgcctcagacacgccgaatttgaagaagcttccgttgcgtttggttggtcaatgttgctcctccagtggatgtgaaaggaattggagcacattcgcattcgtacatacgaaggtccgtaatatacttacccacaagaagctcaacaagctagtgtacgtgaactacaaccttcgccttcgaattcagcaagcaaatgcccaaattagggtggaggacgatgatccccttcaaagattagcggacctctcattctatgaaactaacaatcatatcagtgcctggatggacaatgctcgctctaatgcttgccccgaactagatgaagattcagctgagagtgacgctcccctgcctagtcaacttgtgtctgacctagtcaacttggatgacctgggaaggaccacgggagcttctagtattgctgagtgggctgatacgaatgtaggtgacactcatattgggaaaaggaagactcgaaagccgccaaaagcacgtccatctaaaaaggtaaagggcaagggtccacgatcgactagtgttgatagcgatgaagagacccaaggaagcccagagtaccaagagtccaatgatagtagctcaagaactgaaacagatgacggcgacgacgatggtcaaggaggccaaggcactactaatgtgcctcctaggggtcacacccaacaatcagatcaccacagccccgttcaattcactggtgtgatataattcagttgcaatttcaaccttcatcttccaattcagtactggataattttcttgcaattttttgatttgcaggtgagggcgacttcactcatgctactcaggaccaggatcatggtgctccaagctctcaacgaactaccattgcaccgggagtccgacaacagcaacaattcagtgacatacaacaggatagctctagctcattcagtgtctctagctttgaaagtggctatccaacgtatgtgtacaaccgtccccaagcttctgattatcctgctactacatgggtgtatgaatggcaagagcctcagtggtatgctcaattgtacgctcagtggcaaacaacatcatcatggacaggtcaaagttgggaggaatacaaggcggggttgctacattcacatggcttgatgctcatgtccacagaggagtacaatatggcatataatcagtggaatgcgtagctatgcatgtccttgtttatttcctttcattcgaactagaattgtaatcgtggacattatactgtggactctacaatatagagtaggtcatgccgaatttttctgttgtataaccacatcttaattaactaaaatactcacattttagtttttttctattatttttttcatttttcttatttcagttccaacataaactaaaatactcacattttagtttttttctattatttttttcatttttcttatttcagttccaacatatcgcggttaccgtcctcttaccgcggttaccgtaccaaaccgtgcggttaccgtgtccataccgtggatttttaattcaaaaatttggaaacgaaatttgtgcggtttttcgcggtaaccgcacggttatcgcggtaaccaccataccgcggggggtcggtaaccccccaaaacggtaaggtgaaccctgctctcaggttaccgaatataggagatagcaatttcgggtcttccggtttaacccaaatctgcaataatgaaaaaaaaaaggcaaattaaatacagcgcacgtcaacagactactgaattcagaacatatttaatattcaacaaatgaaaacccagcctgtgacgtactttctgaccacggaagttcaggtacaaaatcgacaagcttctagcgccagaaagccactggcttagaacgaacggctcatgccaaaacaggcactcggatccgaacgcgatgttatcaaggcaaggaacgtagccgaaccgcacctacacgcgccgaagcttgggcacccggatcagatccaccctccggaagttgcagtggtgcagcttcaggcacacgagctgcgagcgcggcgcgtcgatctcgaggacggcgtcgtcgaccacgtcgctgtgcctcagctcgaggaaacgcagcctcccgcaggtgttgacgagggtcgggatgtcgtccggtccgctcaaacagtcgtccacggtgagcctcgtgagccacctgaaaacaacgggacacgcttggaagaaggaccagaagcgtcgtcccagcgagaccttgtgctcgtcggtcaggtcggcgacggcgatgtcggcctccacggtgaggtccagttcctccgtgccgccgccaccgtcgatggcgtgtccgacggctcggccgatggagtgcaggtaagggtctctcaagaagaatgccaggtcgatgctcttcttggtcacccgctgcggcgttgtgatcgtcggctccaggagccacctcgccgtggcggtgtacgccgccattgtctgatcaacggtgtagccggcggcgttgttgtgtcttccgccggagccgatgtccggctgcgtgaagtcacgggcatggagtctgatatcaggaagcatgtgcgggaggtgtctccatcttctcgagagggcgctggccctgacaacggaacgcaggtcgtcggcgagacgttggagtatttcgagcaaaatatcatcaaggagtgcgcttagcctgtcctcgctagttactccctccgtattttaatgtataacgccgttgactttttaatcaatatttgaccattcgttttatttaaaatttttgtgtaaatataaaaatatttatatcatgcttaaagaatatttgatgataaatcaagtcacgataaaataaatgataataacataaatttttagaataagacgaatggtcaaatattgattaaaaaatcaacggcgtcatacattaaaatacggagggagtacatggcaagaacgcgaagaggaatccacctccatcaggccggattttctggaggacaggattgtgcaatactgtaaattaaagtaagcgaccgatcaatactggacgtacgcacacaatggtcttgcaccctggaatcaatatatatttctaacgcgatggctaattcttaggaaaaacggatcggatttccgtttccccccgcacagtgttaaaccgccctccctaagggcggtaaggggaccgcctgcaaaatggcaggccccctatagccgaccgttaggcataagccaacggtcgtctgccacgtcacgaaaaggcggcaggcgactagttttgtaaatttttgaaacacaaattagttttgtaaatattttaataaaaaattaaaaataaaaaaaaaattgtccaacgtgacttgcagcataggcgggccggctgtgccgtattcggcaccaatccagcccatccacaggccagcggtccggtgcctaaagacttgatgaaggccggctgccggtcaggggtgggtagatcggtgggggaaatgtacatatgaggtccctcatcttatcaccgaattacaaaatcgtacctcaaccgggaatatcttagatccctcgacttacaaaaccggatcaccctgagttcttaggtggtattgatcccgattttgtccgacgtaacggatgagttagcgtgggactcacgtgtaccccacatattagggtgaccacgtcataaccctctctcttctccttgtttgggtaggctacctaacggatgggaaggaggtcagcgggacgagacgggagaggaggaggtccggcggcttgcgacgatgcaaaaggggagttccgctggagccccacgagagccgacacgatgcggagatggagatggccgtcgtggcagttggcgcggaggtggtggctttggtgacctctaggccagcgggggctttgcggatggtgcccgaggtccaagacggctggtggtggtactcccagggcggagggtcgggcctcgctgagcgtggtaaagctctagcgtttgccacgaggcgcggtggccgacgagagagggcaactgccatggcctaccgtggagtggaggcggaggtaaccaacaatgtgcgatgccccggcggggggacttggcggaattgatgcgatagagctggaggtgaacagcaggggtgaggtggaggaggacgccgccgccgcagtggaagagttgcgtatggctggttcggcgtgggcgccgatggtgacggggtgaggacggattggttcgccacgtaccagggccacgctgtgctggcgctcgtgaggctctagcggaactccgtcgatttctccgccatcaagacggcgggatcctccaagcatgcggcctctgcaaccaccgcctcgactgctcgtcgtcgccgtgtcacccgtcgccagccgccggacctcctcaccgacttcctccccacccgccggccgacctgcccatatgaggagaagagtgagagagaggaggaagggagagcagaggggaaagagagagagggggggtgatgacgtggtcaccctgacatgtggagcccatgtggatcccatgctaactcagccaccccgtcagataaaaccggggtcaataccacctaaggacctagtgtagcccggctttgtaaattgaaggttcccatatctggttttttggttgagggatgattttgtaattcggggactacttttcctacatgtggtccgtatgtcatgagggcactaacccatgttggcccatgtgggttgacccatatagtgtttgccccatagttcatgcgctgggtcagtgggtagctgggtcgacctagcccatctgcattcctaggtgataccgccatgccaacgagttgtctaccacgcccagagagcaaagcagtggtacaagaaagagaccgaagaaagataatagattttggaatgatcgattttgttgcatcatatcaagccaacagttgagcaccgttgagtgcattattaatcagagatcaactaagcttgactcctattcagtccagcaacagacatttcaagcatgcattacagggaacctctagcatccatgttcagttgcagcagtaagtggctaattgaatagtgaactgctaaaaagagtagagcgatttcttggcatttcgctgacaagttcacatccatcgactgtttctagtgcgacgagtgaattgaagatgagtaatctagaggagtgggagcctagacgagtgaattgaagacgagtttatgctatatatcggaatcccgttaaaaaacgggacgattctggtaccaatatggcatcgctcttagcaactgtcgtccgccacctgcgtgcattgcagcaaaacatgaacgacgaccagcactcgccaaacgccggcttccctgcatctcagcgaaacctcctcggaagcgcgcgcctccacgcgcgattcctcgcttcctcccgctggcgcgcgcaccgtccgtcggcttctccgcatcatggcaaatcctcctagaaagcgcgtgattcctcgcttccttccaccggcgcgagcatcatccgccagctcctctacatcccagtgaaacctcctcggaattgcggcgcgcgattcctcgcttctttccagcggaaccctcgccgtccgccggctcttctgcttcccaatgaaacatcctcggaatcgtgttttgcaaggatatgatcttgcaatcaaaacaatacaaggtttagctgagaaagcttgcatcaatgaacttgacaccaaagcttgcatcaatgaacttgacaccaatgggaggacaacatgttgagaaggcccagtctaaaaatcgaggtgatatgcaggaaaaatttgtgaatgagagtaacaccatcaagacagtgagtatcttggctgctatcatggtgactacgggtttcatggatgatacattagtagaatcatgtgatacctgggaggtatcacgatccttctcgatatcatgaaacctgaaggtttcacacatgatccctcgctaggtatatataatcttgtgtgatacctaaaagtttcatacatgatactgcaaagtatcattatgtgtgatacctgtgaagtatcacatgatcctacttaggtatcatgtatgctatcatggtttctgtgggtttcacatatgatacttgaggatgatcatgtgatacctgggaggtatcatgatcctcctcagtatcatggatggtattatcaggtttcactgatgataccttaggaagatcatgtgatacgtgggaggtatcatgattctgctcaggtatcatgtctggtatcatcaggtttcatagatgataccttagaaggatcatgtgatatgtaggaggtatcatgattctgctcaggtatcatgtctggtatcatcatgtttcatagatgataccttagatcatgtgatacgagggaggtatcatgattcttctcaggtatcattaggtttcatagatgataccttagaaggatcatgagatacgagagaggtatcatgattcttcttagtatcatgactggtatcatggttcctgtgagtttcatagattatacctaagtatgatcatgtgatacttgggaggtgtcatgatcctcctcagtatcatggctggtatttactccacaaaaagtctaccccatgtaatacacttcatttgttcatatatggggaaacgatttttgcttccgtcaacttccagatcaaatatatgtacagggagtggacatgaataagttcatatcagattcgatcgatgtatcgtctatgtgctcgtaccaattcatgtcaccgattttcttgacactgcttaaagcaagaaaatgaagaacctcctgttgatggagaccgtcaaccgaagaaaacacggtgggcgctggcgtcggcgccaccaccacgctcacgccgctctcccacactgacctcgtgcacttcagcggcgacactgaagaggtggagctgccgccgccggcggacgcgagcaggtgccgccgccggctcctccaccgccgccgtcgacgccagcgagatctcacgcgccatgcccacggtgagagaattgtgagtgggactcggataagcacaagaaacgttctgtctctcttgggagtgggactcggataagctcgtgatgatttctgatgattggtaaaaaatttgtcccgtcccgaccgagcccaaacgggataccggtgtttagcatttccgttcctttcttcattctgaacatcgtcaggcagttgctcgaatagatcttcctccgccttgggaactacatagaacagattaagtgcaagtagtcacgagccttgttgttgatttacaaaaataagaaaagaactaaaatggaacaagtgcacacctcgatgatatttcagctgaattggttcactttgacttagtacttgaatcatgccaactgcacaagtcaaaagttgtcatgcatcagaacgtagcacacaaggttaataaagcaaaactaaacaggtcagcagcttaatacatgcagaacattgtttgtagaaatgtagtacgtagccatgtacatgaaccagaattactaatgagcacatgtgagaggtaaatggcaatttggcatatgtgttgaactgattgagatgtgcagtcatgttacttattcttgccttgttgtaatagttgtgaatcattttgatcgatccaaaaattgctgacatgcaagtcacatactcacatgacagtagcaggagcaattaagatgcacaacaacataaaacacggataaggaattaaggatgcatgaaactgtgatactagatgaatcagcagactaatacagtaccatacatagtttaattaacaaggttgttgaaagctacagaaacacacattaattaggcaaactaattttaatctacacacatgcaagcacagaataatgcagtgctagcatgacagtagcatcatcaattcagattcacagcagcaaatgacacattaaaggattcatggaaacgccataccagatgaatttgcagatgtgtcatgttgttctgtattcagaggctggttcagcggccatgaatgaaagaagtaggaggggttgcagtgtgtggcatgaagatctgtgcacctaatcatccttcttgctttcacatccactgtgaataggttcttgccgtggcccgtggacgaagaagagcatccctgtatgcacaggatgcgctgccgcaaccatgaggctcttcttccttgtgatcctgcttacccatctcctgctccagatctccgagaagggcaaatggcactcacaatcccaggtcgcgtgctccggatctgccagcacccatacgctgatgatcggtacgccaagtctgctgtgaatctgaatgtaacgaagcttcccaccgctgctagtaacgcagcgatgcttgatgaggtcgttctccgtgccggctacaggaggcacgcacccatctggaagcggcacgaacagaaggtcctggtgctccgtgaatggatcgcacgcgaggaggccgcaggagagatcaacccaccagagcttctgggcatgggagatgacggcatcgtttgcccagctatctggatggccaagcccggcgtacttgacctccttgctgagccagagaccggtggcgctccagtagaggcggagggtggcgtggtcggtgccgagcatgggcacgagctcagcgatggcgtacgaactccttctcctcctcctcctccaccgccgccgccacccgccgcgcaaggtcttgagattagacccaccctatggaagtcgctcagtggaccaccgacgggaggatcggggacgcgggaggccacgccagtgtgcgcgtcgcagaggaagtacgccgggacgcgggcg

SEQ ID NO: 77441 - DNA, 8078 bp, Oryza sativa
  unsure (1)..(8078): unsure at all n locations
ggccatacagttcattcatgcttggatggagtacgaacgtcgggtggaaattgcaagcttagactggaggaacaatccattagggttacctaaatggtccgagcgtccaaagtgtgggtgcagagatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatggccagaagataacagagtcagaaacacaagtagagtatcaacgattgaaggaccacgagaatgcaatgcattctgaccgacctagaaggggccgataggttaccgcatgcttgattcgtcgggatcgacaaatttgtaccgtgtatcgatggcacttcttatctatcttatcattacaatgtttaattatggtggtgattttttgtatgcgtaagactaagggcctatttggattgctaccaaaaacataccctaccaatattttggtaatttgaatagtacttgtgtttgatttcgattgaagcctattcattggtaatacgtaatctagatttgagattatgtataacattcttcactacaattttacattttggcagcaaaccaaatatgatcaaatgcaattttaccttaccaaatatttggtagtgccaaaacttgcttatattttggcactaacaaaatatttgtacggtaacattccaaataggccctaaaaataataaaattgtattttaccagtcttggagattttaatcttgtatagttttcaatataaaaagatttgataactattgatatttatacaaaaatataaagcacagtataaaatcgccctcccccagggcggcaagggggccgcctgcaaaattccatgccccctcgccgcccatttgcaggcggccccccgcacagtacaaaatcgccctagcggagggcggcaagggggccgcctgcaaatttcgttgacggccgtcgccgagagcgaacggccgtctgccacgtcactttcgccgccctctgggatggcaatttttaaaaatcgccctcccagagggcggtagacgaccacttctgtcaattttcaacatgaaaaattatttttgtaaaacatttaataaaaaaaattaaaaatacaaaaacctccaagagaagtcacctactgcttcaggtttggaggaaacgcctaagctaatccggtgaggtcgaggcagagtagtgtattgacacgtcgtccaccggtaactcttgtaacaaattccttgtaactgcttgcctcaatggccactggcataattttgtgtactgacccatatgtaaattttgagtgtataaactttagataaataaaatttagataaactttaagtaaatctctacttatctctatctctagtatgataaaaattgaaaatgtttttgctggtattttggtacgtcatccatgtttgaatcagtttttaagttcgttcgtttctagaaatacagtttgtgtttgagttggattttaaactcgtttgcttttggaaatacaagaggaatcttataagaaatctctttaaaaaaaactcatgctaacttgagatggaatatggactcctaattacagctcatgattttctaaacgagaatgctaggggacgggatactgtcccccaacgggatagctcctctccacaacgcgattcgcatcccccgccgctgccgcacccgtcccccgtcgcctccgccgccaccgcgcccgtcctccaccgccgtcgtcgctgtcccccgccgccaccgtcgccaccgcggcgtccgtcccccgtcgacgctgccgccgccgccgcgcccatcccccacctgccgctgcgcccgtcctctgccgccgccgccgccgtcctcgtctacaagggatggctgcagggggcgaccgcgcgtgtcggggtgctcctctcccaacgggatgcccagctatatctagcaggaatcacctgatatctggtaagtatcatctgatacctcgcaagtatcacgtgatacatggtagaaatcgtctgatacctcgcgagtatgacgtgatacgtggtagaaatcgtctgatacatgacaggtatcgcatgatacctcgtgagtatcacgcaatacgtggttgaaatcatctgatacctgacaggtttcacatgatacctcgcgagtatcacgcaatacgtggtagaaaatcgtatgatacctgataagtatcacatgatactttgcaggtatcacctgtaacgtgtgtagaatcgtttgatacctgataggtatcacacctgatacctactcgggattatcctgttctgtagaatcgtctaatacctgataggtatcacacctgatacctactcgggatcatcccgttcgaaaacgggattccgttatatagcagcccccttttctaaatgaaatattcaagcaaattccatggtgaattttatcctaactaaaccgtataataataataaaattaaaatagcatttatccgttgcaacgcacaagcattttttttttaataaaaattgaagatgtttttgccggtactttggtaggtcatccgtgtatgagtcgatttttaagttcgtttgcttttggaaatacatatccgtatttgagtctgagtctttttaagttcattcgtttttggaaatacataatggatagctttaaaaatattgcatgctaattttagacgatcagactcttaactgcagctcatgattttctaaaaaacatatatctaagcgaattcctacagtattgatgtactgcatacaggccatataaaagaacatttctcaggtgatcgcgactaaaagatcatgactatatagatggcatgcacaaatattcgctttgcggtggtcgctggtggcgccgttgtgatcagcgacgtttcattcgtgggcctctcctacgccaccgtcttcttcgcgtgcgctccctacgtgcctcttgtacttccggaacacgtacgtacgcttatcctacggaccacatgccaaagctgttcaagtggtgctacgtctcggtgcctatggccgttctgctgttgtcccgcctcgtgttggcggcacggcaggcaaccacgctggacatcaggctcgtcgccttcaccgccgtcatgttgacagtagacgttaccgcaattgggtttctcgaatggcgcagcaggagggagatgccgaagcctcgtggtacacgtgcgagcgcgtcggagatcgtcacgtcgtttttgtgatggtttgcttacggtatggctgtatccactggtggagaaaccatctttcgtcggtcgaccgaattccacaatagtcctggatgcaataaaaaccggggctaaagatcagctaaagatgatctttagtcccggttaaaaagagtaatgggcatatttgatctttaggttcaaatgctgttagggcctgtcaggcccctccgggataataccaactgggactaaagatcgtacctttagtaataccaaccgggactaaagatcccgggaatctttagccccggttggtaacaccaaccgcgactaaagtcccacccttatatatatatgttttcttcctcctccagctgcccgagcaagcttcaaaatttctttaaaaatgatgggaggtcatgccaaaatttttagtgaatttattttggtgattacatacaaatcggagatgcctaaaaggtttgcaacttcatcctccaatgttttttttgtcatattacatttggagctatgttttgcacacttttttatctccaaaattcagttataagttgatgagagagaaaatttgtgtggggaagaaagaatatatagaaaattagttgatttgctaaagaaggttttataaaatagttgagaaggaaaatatagtgaaagttaatcttaaataatagaaaacaaactaaaatgaaaattaaaagaagtaaaacacattaatataagtttaaaactttagaaatagtaaataagaattatttggtgtaatattttatgatttttatatgaataaagatatgtcattattgtctgactgttcaaagagtttgtaattattttataattattgtatgactgtcattattgtaagaataattatttgtgtacgattttttttcatgtcatgtagatggatcggcaatggatgtacgctgaccggcggtccaaagagtttattgacggcgtgcattattttttgagagtggccgaagctaacaggcaaaagggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaaaatgaagtggaagacgacaatattccggactttgctcagtacgttggatttgaaggaaatcaaacgggcgaggaggaaagagatgctgatggtaacgacgttgcggatgatcttggtcagatattgcaggacgtcaaggaggactgcgaaagtgaaaagggggcccataaattggacaagatgttagaggaccacagaacgtcgttgtacccaggttgcgagcaggggcacaaaaagttggataccactttggagttcttgcaatggaacgcaaaaaatggtgttagtgacaaggcatttggcgatttattgaaactcgtcaagaacattcttccggagggaaacaaattgcccgagacaatatacgaggctaagtatatatgattattnnnnnnnnnnnnnnnnnnnnnnacatatgttaattagagtttttaataattaatttactatcattcatatgctaattatatatgactattcaaatttttaaaagttttaaatcatgcatgtggcatttacatatgttaattagagtttttaacaattaatttaatatcattcatatgctaattatatatgattattagaatttttattaattttaaatcatgcatgtcgtatgtatttacatatgttaattagagtttttaacaattattttaatatcattcatatgctaattatataagattattagaatttttattaattttaaatcatgcatggcgtatgtatatacatatgctaattatagtttttaacaatttaatattatttatatgctaagtatatatgattattagaaattttattaattttaaatcatatatttgcttactacgttttatccacttaaattactacaaacaacaataatttttcgaagtaattgtcattattttttcgactttaaataattttaatgcattattttctattttagaaacacatatgtaatggaaattaatattcagtgcgcttatcagtagtcccggttcttaaccctaaccgggtttaaaaagaatttggaaatagcgggaaaatgtctttactcccggttgttctcatcaaccgggactaaagatctaggggtatatatattcccaatgcgcgccctcgtcttctccatcaacacttagaagtttttgccccgatcgatctctctcggcttctccttcgccgccactgcctagggcatccccgcgccgacgccgccgtcgtatctcgccgtcgtctcgcgcgcgtcgtcatcgccgcctccgcctcctccgccaccgccgcatctctggggtgagagccgccgccgcctccctctctagctctctctccgatctcgatctctctctctctctcggttgccgccggccgcctcgttgccgacgccgacgccgacgtcgtcgcggctgaacatgactccgccgcgccacgacgccgcggcggcacgacacgccgggacgccacgacgccgccgcgtcacggcaccgccgcgccgccacgcctccgccgcacaacgccaccgccgcgcaacgctgccgccgcgccgcgcgctgcgctgccgccgcgctgcacgccacaccgatgccgcgcgcgccgccacgccgccgccgcgccgccccgccgccactccgctgccgccacaccggcgctccgctgccgccacgtgaacgaacgaattaacgtgaacgagcgaatgaacgtgaacgagaacgtgaacgaacgaaacgtacgtgaacgagaattgaacgtgaacgaacgagcgtgaacgaacgtcaacgaatgtgaacgtgaacgaacgtgaacgtgaacgaacgtgaacgtgaacgaacgttaacgaacgtgaacatgaacgaacgtgaacttaacgttgtatttgaacgtacgtaaacgaacgagcaaagcaaaagcagggaactaacttgtgcggctactacgtgtgcgagtattgccactgccttgcaaaccaaatcatcaccacaagagagctcgatgtacgtacaaataaattcaaaatttcattacgtatcgatttgttgtttaattactaattaatttcatacattcatatagtttattcgcatgagggataactttatcacacacaaggaatttatcgcggcggttcaaaaacaactcatgggatttatcaacgaacaaatccttgatcccaagggtgaattctactacgacggaaatacagttcataggtccttagtttctgagatagcgactactactacgtcgaaatcgtagctagctaggacataatggattgtaattaatacatgtctatttttctatatacatgtgcacattttgtataatgtaaatatatattttggtcatatatatatatatatatatatatatatatatatatatatatatatgtatgtatgtatgtatgtatgtatgtatgtatgtatgtatgtatataaatatgtatataaaccatgcagcaacagggccatgcaaaaaaaaaggttagctcgatctttagtcccagttggtgttacgaaccatctttagtcccggttgagatcgatctttagtcccggttatttcacccgggactaaagatagcgatctttagtcccggattggtagtcccggtttaaaaaccgggactaaaggggggttacgaatcaggactacaaacgctttctccaccagtgatctacacgttttctacgtcattggcaatggttcgcaaagatggttcagttaatcggagtccaaaactatcagtaacaaattatgtaataatgcccgatctattgcttttgttttagagacattaccattagtcatttttagagaaggaactgttaatcagcatagtcagtcgagcaaccgaattttattcaaattgaagtgatatcagaatcagcattgcggcacgtagaatgtactgcctactggtacacgaatgagaatacgtcatgttccatgtgcggcatgtagaatgtactgcctactggtacacgaaagagaacacgtcatgttccatgtagcaacaatactcatggtcattggatcaattgatcaatgctcagcaaatcataaggaggaagcaaccggcctttgtcttcgtcgtggatccttagactggcgagactttacttgaatcacttgtactcgccagaggaacgccttttttctgatcgtcagaaccttcaacacaagcaaaaatgatggaaatgtcacgcaaggataaaagcttctaggaaactagcatttcaattgagatcgtttacaagtttgtacttaaaaaaagagcaattttacgatccttgaagaggtaccatgaggtaccgttttttctattgtaaatttggtacctcatagtaccatgtaccaagagataccaaattttacactaatttttttggtacctcatggtacctcaaggactgtagaattgctataaaaaagtttgaactcctaaaaaaagtcacatatccttatctaaaaaaagttcccatatcgttaattatctttaaaacaaaagttcacatgtagtaagaaagaaattaatacttccaga

SEQ ID NO: 77442 - DNA, 16149 bp, Oryza sativa
  unsure (1)..(16149): unsure at all n locations
ccctgcacctcagctccttgcccggcgggagagggacgaagcgcagcgccggcgcgggggcgaaggggtcgcaagtgatgaggcaccaagagaggtcgacgaaccagagcctcccggagtgcgagacggcgccgttgggggccaactgccggggagggaacgggtaggcgacctccttctcgacccactcgccgacgtcggaggagaagcagacgagcgtggcgtggtcggcgtggaggatgggctggagctcggcgaccacgtagcggccgccgccgtcgggggaggcgaggagtcccatgtggcccatgtgcatgacgagctccgggtcggggagagcgaccgcggtggccgtggcggcttcaaggacgaagtagcccgggacgaactggcgccacatgaactcctgacggccggggcggtcgatgacggtggggcccttggcgcggccctggtcggcgtggaggaggaggaggccggaggggtcggcggccatgacgctggggaagttgtcggacgtggtggcgctcgggaagatccgctaagggatggtgagcagcgagacgcgcgggggcgccttgagcgcgagggagagatcggcgcccgcagggatcccgcccccggcccccttctcgtcggcgccgcagacgcgcgggatgctgcccaggatcacccacgtcgacggcggcggcgacgcggacgccatcgtctcggctggcgacgaggcggaggaggagaagggcgcgcgggtgaggcctagcggttccgcgtacgcgtatgccgcggcggctgcggcggcggcaacggcggcggaagtggtgataccgtgtcgaggcgtggaggtggaggtggtgcagaggcgcagcagcagcagcctttgtagtttgaacatcgcggcgcgtcgagtcctcgggattctctcctcgcgtcgtggagcgtggccaaataatgatccgagccgtaacgatcgatcgatcgatcgatcggtgccgcgtgtcgggtttcgggagctgagaggatctctcggccgtaggggtgaaaacggagcggatagtttccgtccgctccggtcaaaaacggatacggatagtgttcggagcagatttttttcggatagttcgaatacggatacgaatacggatattttttctccggatacggatacgaatatggtaacgcagtttccggcgaattcgaatacggagccgaatatccggagattaagatgcgcggatatccgcgtaacgcttgatgtctctccagcctccagcccatcccttcaatttcagcacatagttttctctcggctatctaaaccctagctgccagatgggcgacggcggcggcggcggtgacgacggcagcggcaagccggcgacagtggcggcggctgtcttagatctccttggctccttgctggagttgctgggcattggccttcaatccccctagtgcttgtttgtgcttcctatctccctaaatcgtgggacagtgggaggctaggagccgtcaccaccgtgattgtagaggagtatgctaaatataaggtaagcaagaatgggtcaggtgacactgtgattgtagaggagtatgctaaatgcaactagtgctcatataaacgtcggtgtgagagtaattgtggcacttctgttttctggaatcacttgaataacaagcacaacatcaagtcaggtcaacaacatctacagatgaaaaagagtgaagatggtactgaaggagctgttgagacatacaggtatgatgagacggttagcctgaaaaagttctataggcaatcatcatgcatgagtatccctttaacattgttgagcatgattactttgtggattttattaagtctttacgccctacttttccaattaagagtcgcattactgtgagaaaggatattctaaacatatatgaagaggaaaaaagaaattgtggcagcatttgcttacactctcatgccgttttagcacaaccatggacatgtggacatctaaccaaaataaaagttatatgtgcatcacagttcattggatagatgacacttggaagatgcaaaagaggatcattaagtttatgcatgtagaaggacatcattcaggaagtaatatgtgcaaagagttttatgacagcatagttgattggaatcttgatagaaggcttgttggacttactttggacaatgcatcgtctaatgatgtttgtgttaaggatgttattttaaaactccgtaaaatctctcctttaatttgcgatggcatcttctttcatgtgagatgtttcaatcatatcttgaaccttgttgcacaagatggtttgaaacaaatcacatgagctgtattaaagatcagaaatactatttcaattctaaagcactcgccactgcagtttgaggcatttcagaagtgtgccttggaagttagtttggataacacaaagggcctttccatggatactcctacaagatggaactccacatttctcatgttgaagaatgctatctactacagaaatgcttttgataggttgtttcttcggcatggtagaaagtatgcaaagtgtgctcccaccaaggtagactggtctatggcaatagcactatgcaagtgcttgaagccatttcatgaagcaactgaactattctctggtactacatatccaacagcaaatcattttttcggtaagttttgttccatcaagctttatattgctgattggtgtaacagtacagatggaacaataaaaaccatggcaaacgccatgcaaactaaatatgataagtactgggagaagtcgaatatggctcttgctgttacatgcttccttgatccacgttacaaaacaagttcaatagagtactatggtatgaagatttatggtttagaagctgcagaaaaatttgatgagttcaatggggttatcaaaaaattgtttgatgtttatgctactagtgcgtgtgcaacatcaaagaagaaaggtgctgaaatgcatgtgcatcaacttcaaattcaacctgatcctgttcataatactgatgagtttgatgatatctttaatgagaatgacagtagccatgatcatgagcaacattttcaaagatttttgcttgagagaagtcagccaatttgtagtgataaaactgagttacaaatttacatggaacaaccactgttactatggacttccaaagatccatttgatattttgtcttggtggaagctcaaacaagcagaatttcctatcctctgcaaacttgctcgtgatttcttatgtattcaagtgtcaactgttgcttctgagtcggcatttagtgctggtggccgtgttgttgatccatttcgcacccgtcttgatccagaggctgtgcaagctttagtttgcaccaaagattggattaaagcagctaacaatagtacactttgtgtctgtgttcattgcttatttggccattccttcttgtatatatcaatatatgtatagctgatccatgatctgatctggcatcattcttaggttataagactcaggctatcatcaatgaattggacattgaaagcgtagagaggcatctggcaaacttattgatagtggtgagctattttcttattttacctctatgaatatttttcttaatataacaacaatattattcgactcctgtaggaaaaagaggagaataatgatgacatggaacaggatgatgttctgatggatgaaatggatgaataatgatgttgcagttttcatgcatcggactgcaagtgtactgaaaattgctttgggctaattactattttgatcttatctgtgttacctatagaactcgaactcaatatgtgttgaacttttcaacgtgtttcgatttgaacacgatacactttgtttaatctgtgatgcgtcctacaacgatgatatttatattaaattagataaatatatgtggtgcatttgtatctacgagcagtttgagtggtctctatattccgagaaatattcgttttcgtattcgtgtccgatcatattcgatccttattcgtatccgcgataattcgtattcgtttccgtatccgagttattcgtattcgtttccgtatccgcctaacaatatgaaaatggatacggtaagagcattatccgtccgtattcgctccgttttcacccctactcggccgtagtcgtcatctccgtgatcacgtatcgctcgctgctttttctccctttctctgcgctgctttttctcccttcctctgcgcctagtgctcccttgaccagacaggaaagagctgaatacgagtagtaaatacatggaaatcaaaattgtgtgactagtagcggtactctacttaaattagagcttctttaaaactgtggattttcaagatgcatgggaaatacccctgattagagtgctctaacatcttttattctacattttgaaaaaaatatagaaataactatttgatggagcgtatgaaaaaacacataattaaaagagatatagacaaaatatttatccatgaggaattcctcgataactcctatgttttgagccaattcaaaggtatttcatacgatttttggatagttatccttcgatccaaatggctatgtaggaaaacttttataggactaaaattcttcaacctagcccttatacatactctgacccccttttttctaattaagatacaaattttattttgatttccgttaacacattttaaaccgctccacgataaacttcgtgcgaaaaatttgtatgtagtgcctgtttggtacaactctaactcctaaatttagcttcaggagttgagtctggagtagagttgtggagctgcctaaagccctaaacctagctccacaactgtagttcattttatgagagagcttcacctagctccgctcccagttttggtggagctgaaactatttggctgagctgtagctccaggatgggtggagctggagctagagctaggggtgtaagtggctaacccgcgaaacccacttataagctaaaataagccgcgaacccgattatttggacctacaagtgggttcgtggctaacccacttacacctctagctggagctgtgtcaaacaggtccgtataagttgttttaaaatattagataaatcaattttcaagttcataataattaaaattcattaaatatgaactaatgaattattttcctgtcgtaattttatgttttcgtgtcctagtacctctgtactctgtacgcggtagaggtgaacaagggaaaacaaacatgtgtagaagcaagccatgtgtagagagtggcttgctactcctatacagtactgtacaccaccagtacagtatgcacagcagcaagccatgtgtagaagttgcacaggggaagagaatcctctctgacatcggggaaattaaagacaaccgcgaagtgctcgcaccacagcgctccgggcgtttttgggccggcgtgttcgcacctgcttgtgtccacgtcgccctatttggtgtggctgtgttgtgtgaacccatggctgtgttgtgtgaacccataagcgtactcgcaccgtcactgctatgtggggcagggagggatgtgggttgctgttcatggtcctatcaatgctttcgttgcctgtgcgcttagtccattgccttaggtttctggacctgtctctgcgtgccccacttgcagcttctttggttcacagtgcacatggagtacagggtttttaacaccctgacatgcttgaccaatggtgcagtttgcacggctccctaacggcatgactctgctcctgcctacctgccatgcgtgctccgccgaatgcttatatgcagcacctggtctaccgtgctccaggtagagcccttcggcctacggtgtgcatgcgtgatggaccaggcccacggctattttggtctgctacatcgctttgatccgctgtgtattccgttgggcttgcattgaaaaaaagtcaccacacaacgtctcctctgtaaaccctctgcgggtgggctcgctgttttgcgctgtcccacatgccatatgctctggtgcgccaaatagattgcctccctgctgcacggcgccaaatagattgcctccctgctgcgccatgttttaatgcccaccgcttgcaccggcccgctgtcaggtgaggtccaatcaacgtcggcgtccgccataccagcgtgcgtgatcatcaatggggcaatgtcctgttttgccttcagcttcttcctccccattgtgaggccctgtttagatgggactaaaacttttaaatccctatcacatcggatgtttgaaaattaattataaatattaaacgtagactattaataaaacccatccataatcttggactaatttgcgagacgaatctaatgagcctaattaatccatgattggcctatgtgatgctacagtaaacattctctaattatagattaattaggcttaaaaaatttgtctcgtgaattagcttttatttatgtaattagttttgtaagtagtctatatttaatactctaaattagtgtctaagacagggactaaagttaagtccctggatctaaacaccacctgagagatttgtttgtctcctccgcttttgctttgctctgctctgctgtttccctctcctgctgacttcttcagccatgccgacagcttggtgggttgctacctccatacctagcagatgtcttcctcatgcgatttggttggttggtttgacgctacacggttggtgtgcaggtctgcgtgtgggatttccgccagcattgctgcgtaggatttggtgttctcgcactggttagttgcttccttgatgtgctgtgtcctggatggtcgattcttcatcctttcgttttgcttgctgtgggcaggggcaggggaggcggtcgcattgctctaccgcctgttggtcgctggcagttcacggtcgagggcaagttgatctccttccatcagagtgtgcctgcaccggctcgaagaggttgctgctcttttcttcgctgattttccccctgcttttcctttctatttgttcttatgtttgcccttgccttttcgtctgggttcttttctcggtggcctctgttgtgtctgccatcctgctatgttgtgtgcgtgagaaaataatgccagttggtgcctcacagattactgtgcatgggcccgtacaggcccgcgtaccagtactggctgcctccctcttcttatataacccaaacttctctgggcacttgccccttgcgtagaggttgctcttgctggtttttgaccaaccttccagatcttcctttctaccactcacctaggccccatctagcagcgccatggttaatgtgggggtctcatttgtctctctgttgaatgccgttgcttggcattgtcagctcccgctggtgtcctatctttgggaaatagatgggaatggcatgctgctagcaggtgttgagcttgcgctcccatcggaagacatggccggccagattgttagcaagttcttttgggtctgcgcgtctactcaaacaagtgactcgcatgaaatgggcgcgcatcaggctgttaggttcttgcaggctaggtacggctttattgtccacgattacaatcttcagatgttactttcctaccggagaatagcagcgtctacagtagatgcagctgttacagcctcagcgtgccttgctaggttccagtcacgatatgctccgacagatctatcgtgtgctggtgttgtccagcgatgtaacactatatggttcaattttcttcatgaggaccacatgtttagcaacatgcacaacctttaggggtattttgtttcctttagagggtgttagtgtttttcgctactgagtttgtctgcaatgagagtgtgcctttatgatgttattacataatgttttgtattgtctgctttcgatcttatgttcttcttttgtgcattgctttcggttagttcggtgctctctttcttacgactgatctgacgacgaaaaaacagctccccttttatccgctgtgttgttgcctctgagctatgacgagtaatccctctccgcgagttcaacgggcccgtgagagccgtttgcgacgccgtgcttctattggccagggtttgtgcttcttaacttgatttagaggcgcttcttgggttagatcgataagtttgatcaaccagatagttggggtttatagcatttttgcaggctcctctgttcggcggcgtaaatcctgtggtctctaggggaccaaatggttcgccaaatgctggaatagatgtggagcagtcggttcctgaacaagctctggcttctgatgttcatgtgcggtctcaggttgcctttgttgctggcacaggtcctttgacccagaattccataaccaccgctagcagtaagttgagcgatagttgtcccatgggctccataactcctgacaatgtcgattatgcttagctcctttgttctcctcattgcgattaggaaagagaaccctactagatgtgccgcgccacactgctgcagcaaacagggaaaaacgacgcctcaagaggtctggttctcagccagaccacctggtaagaaaaatcctagaaggtatggttaaatataccttttgtttcccctgtgctcgcttagtgtggcagttatgtctgctaaccatttttgctttcaccgatgcttgcttcctgggatttcgaatgcataggtcccgttcctacagtggatgacatcttgcctttacctaaggattacattgcgtccttaaaaggtttgctcggtgtctgctgtcttacatagcttcctttctgtcaatcaatgcagttgttaatgcttgcaaacaatgcagctttgtgcccagagcgatcatactatggtggcccttcgcatgagtgtccttattgtggtgccgttttttggtaccaggagagggtaaagagagatagtgctgtttctcagagaaggattgtctataatctctgctgtaggggtggtaagatcagcctgcctgaactaaaatacccaccggatatgttagcgaagcttctgaaatttgatggtgatgcacaatcaaagcgtttcttacgccaaattcgatcttacaactcgctttttgcattcacttcattaggggctgatgtagaaaagtcaattaacaatggaaccgcaccatatgtctttaaaattaacggcgttgtgcaccatcgtattggcagcctcttgcctcagcgtggtgcgaagcccaagtttgctcagctatacatatatgacaccgagaatgaaaccgctaaccgaattaacattttcgatagagaaaactcaaacgatgagcctgacccatcaattgttacaggacttggcgctatgctcgaccaacacaatgatctggtcaaatcgtttcgctatgctagagatcgtttaaacgagcatggtaatgagcagattgcacttagactgcttgggtgcaatgctaaagatgaagtccaatataacctgccaacgagtggtgagatcgcaggaataatagtgggcgacagctcaaacgatgcgtacacgtatgatgtggttgtccagtcttcggataataggctgagacaagtctctgctttgcatccttcctacatggctttgcaatatcctttgcttttcccctacggtgaacgagggttccacctcggtataaagtacactgatttcccgagtattgctggaacatcacggcgatacgtgacaatgcttgaatactatcgatatcgctttcattataggctaaacaaaccgaatccatatacatgttgtggccgtcttagtgactcgatatgtgtggatgcatactcaactgttgagggatcgaggctgaaatttatacatgaccaccaacctgagttacgttcagagtgtgttcaagggattgtcgatgccattgaccatggcctcgaatctggtgattctgttggcaaaaagtacgtcttgccatcaagtttcactggaggtcgtcgctacatggtccagaattaccaggacgcaatggctgtttgccgcgtgttcggttcgcccgacctattcgtgaccttcacgtgcaactccaaatggcaagagatatacgatgcccttgtgtttgaaccaggccaggtgccgagcgatcggtctgacatgattgtacgagtctttagcatgaaggtcgatgaattcatatccgatattaaggagggaaggaccttcggtcctgtgctggcaggtagacgtcatctagacatgttttttcctatatcattttgtcatgttagtactgttcctgctgatatccatgcttccatgtagtgttgtataccgtggaattccaaaagcgtggtctcccgcacatacactgtattgtgtggcgtgcagcagctgacgccgaatttagtgctaccgctgtggacagtttaatttgtgctgaaattcctgatgtgtttagtgatcctttgggctatgccttagtcgatgagtttatgatccatggcccttgtggtgacaagaataaatcatgtgtctgtatgaaaaatgggcattgctccaagcatttccctaaaggcttccaagaagagacgaccatggatgagtttggctttactgtatataggcgtcgaaatgatggacgatatgtggttaagaatggaattaaacttgacaatcgatgggtcgttccatacaacatgaaattactgaaaaaataccaagcgcacattaacgttgaatcatgcaacaaatccaacatgataaaataccttttcaagtacataacaaagggtggtgatagaaccaaactatactttgaaacaactggcaacacaccaaacaagactgttgatggtactgttttgccaccaaatgagattgatgagtacatcaatgctaggttcctctcaacctgtgaagccttttggcgtgctttcgagtttgacatacactatagagttcctgctgtggaacggttgcctattcatcttccaaatatgaattttgttcagtacaaaaaaggaaccgacctaaaaaaattgcttgacagtcctgctgcaaaaaaaacaatgctaacagagtggttcgagtgtaataaaaagcatccaaatgcacgaacactgacctattgtgatttcccaaaacaatggacctgggacaatagcgcccgctgttggcgcccaaggacaccagtcgaaaaaattggtagaatttattatgtcagcccagccgctggagagctatactacctgcgcatgctgttgatgacagttaaaggcgcaaaaagctatgctgatgttcggacctttgaagggactgtttacccaacttttaggcaggcatgtgagtctagaggccttcttgagaatgataacgattggcatttgttgtttgatgaggcgatagtttctgcgtcgtccctgcagttaaggcaactatttgtgactgttgtaatgttctgctctgttggaaacgtccgatcattgtttgataagtattggttatactttactgatgacattcagcatcgccttagaacagcgctctcaaaccctgcttatgttgttccacatgataggttgctgtctcttttgattaaagaattacactctgcatttgcaaacagcggtggtaacatagatgactatgacctcccgcgatcaacgatacattcagatgatgaatttggaaatagaatggtcaacgaagaattggctcttgatactgctgccttggctgctcatgccagcctgatgataccacgactaaactctgaacaacaaaatttttttgacacaatagttagccgtgttagtgagtcgaggcctggatttttcttcgtgtatggccatggtggcactggcaaaacgtttttgtggaacgtgctcatttctaagataaggtctgagggaaatattgttcttgcagttgcttcctcaggagtcgcttcgcttcttctccctagagggcgcactgcccattctaggttcaaaataccgattgatatagatgaaaatagcatatgcagtataaaaagaggaacaatgcttgcagaacttattcagaaaacgtcccttattatatgggatgaagctcccatgacacatagacgatgctttgaggccttagaccgaacgttgcgagatttgctttcagaacataacccttcaaatagtgtgctgccatttggtgggaaatttgttgtcctaggtggtgatttcaggcagatattaccggttattaaaaaggggacacgcaattctatagttgacgcatctataacaaattcaccgctttggcaacatgttgtccttcttaaactcactgttaacatgaggctcttccagtccggtctttctgagggacgccgtcatgatcttgaacaatttgctcgatgggtcttagcgcttggggatggtatgctaccagtatcaaaaaggatcgatgagtctgaggcgacctggattgatatccctgatgatctactaattagagcttcggatgacaaaatatattcaatagtaaatgaggttttcccatgttatgtgcatagatacacagattcttcttacctagcatcgcgtgctattgtctgcccaaataactcaacagttgacgagataaatgactacatggttgctatgatacctggtgaaatgaaagagtaccttagttgtgacactatttcaaaaacatccgaacacatacctgacttcgacattttgtacccaactgaatttttaaactccatcaatgccaacaacttcccgacgcataggcttgcactgaaaaaaggcgcaacagtaatgttgctgcggaatctaaatcaatcccttggcttgtgcaatggaactagattgttggtcctttctctcgggcatcgtctcttagaatgtgtgatcttgactggatcaaacgttggcgaaagagcattcataccaagaattgtgctcagcactacgagttctaagtggccttttgtacttcaaagaaggcaattccctgtacgtgtgtgctatgccatgacaattaacaaaagccaaggacagacactttcaagggttggggtctaccttaaaaaagcagttttcacacatggccaattgtatgttgctgtatctagatcgacctctagagatggccttaggatccttattaaggacgacgatggcgcgtgtagttctaagactagaaacgtggtataccatgaggtgctggaggcagtcagattaatggtatattctcgattgttgatttccacgtgacacgaaccatgtttatccagagtgctgggatatattttaaggtgctaatttcattttaaaatgtaggattctggtacctagaaccaagtgacaacgtccatgtttgctgctgctctgttgttcttggtggctattttatcagctctgttatcgtgttcttgtgcaaaaatgtttctctatgttctcaggatcttttgctgtaagctttgttctctgtttacatgcagctcctacttcttaggagggccttcacactaatgagaaacttttaccttgctttcagatggcctacagcatgctctctaagcttgagttaggtgctgacaacccacgcatctgtgttcgtgtttcaaggctatgggagttcgctaatccaaatgatgagacacaattgctccaccttggtttggttttgattgatcaggaggtcagttcttcagagcactgagcacccagctttctgtagaaacagattgctttactaatgtgcttttgaaacagggcactagcattgcagcacagatataccctccctgcgatctgcagttcagagaaatcatcactgaaggcaaagtgtactatcttgagtactaccgtgtgagggaatggagcaggcgatacaggccagtcaacaacagcctgtcaatttgttttacaaggtggactaaagttgaacaggttgcagatccggcagctgatttccctttgtacacttactcactcacaccatatggtggactccgtcagcgtgtcgataggaaagaagaattcacaggtattctcattgtgttttgggtaataaaagcatgacgtacaatgatataatgtccttcagatcactgacaagttgcttcctcttattgtcaatacaaaaaaaagatgtcattggcattattactgaggtaacatctgttacgacagttcagacgcgcatccgagatggtgatagcctgaagagaagcatttacatacgtgatactaagttagcctcaaaccttatctattatcttcattcatgtgaattgcatttccctagatttgttgatctgtttatgtattatgtcagttgactaaccagctatctccagctgtactgactttttttcttcaacactacacaaatcatacccatagaaactatatgctctaacataatcatcgtgtccaacaaaccacacatgcgagatttttatgcacttttttactacatccattccatagcgatacaatcttaaatgtggcgctatggggagaacgtgctacaagctttcctgtcgatgaagtggttgctgctggtcagaaagaaccacagatagcgatatttgtgggcactcttgtgaggggctatggtgagtgggctctcaatgtgtccaaatgtgtttntagactatgactccaattgttttacatatcgtgcactgacacatttctttcataggcgacatatctctatcagcaactcagcttgcaaatggacattaatgtgaacactcctgaggtcaactccttcaaagaaaggtttgttctaactttcatataattcgagtagatttggtccactcttttacagattcccatctaggctcatctgtgtgttttttacagcatacagggaaaatatgaacctatcaaaatgattgagctcccagctgttggagctgttcgtactggcgccgaacaaaagtcaattgcccagatcaaggacctcaacccttttatgtttagggtatgttatatgttctgtgtatttaactttgctatcttatagatccatgacaataagctccagctaacatataatcctttttacacctagaaaaatgaattcatggttactgtcgtcattaagaagatcgacacagaatcatcctggtggtaccctgcatgtgatacctgcaaaagaacagcaaaaccatatggaaagtcatacaggtgtggcaatacatcctgccctgctgtggtgtcagcatcacctaggtgagtactgcatgtcatgagaactggatacctaaaaccaatttagagtctaaccatgtttggatccctgcaggatcaaactcagcctcattgcaggagacgacacaggtgacactaagtttgtgctctttgggcgcacagcacaacgcattatcggtcgaccagtcgagatgctgatacagaacaaccctgctggcattgagttcataccaaaggaaattacagatcttcttgagaaggagtttacttggaatgttgccttcactgaaaacaccctgtcttccagcactgtttcgttccaagtgaatttgatcgttcgaggtcctgacaatccctgttcttcagccttgcaatccccatctgcatctcaggcatcgtctgcagtgccttctcaggctttatcaccagggctatcacatggtctctctattgggcagtgttcggcagcggctgatccatctattggatttgctgatccaacagctggaatagacagcccattagccgcttcaatcaagcacaagaaaccggagactgagtatcagtcaaaacctccagctgagcttcctcaggacgaagcagaggtaatcgagcaggcatagtctgaatttttgtcataaagcatttctatgttaaaagttaacattgctaatattgtcgtaatatatataggatgatgacaaccttccactaagccagatagttgctgacgatgctactaaacatagcacgtccaagtcctacaagaaaaggtaccaagctccataaacatgtttatgttacacataaggagcaatagtttgttctatatgttctaactgaatttgccaaacagggctaggccatctcccggtataggagctgctaagaagttgttcaag

SEQ ID NO: 77443 - DNA, 554 bp, Oryza sativa
gaaagaatttcagctgcacgtttccaattatccacacaaaacatcattgaacaagataagcatgaagcaactgacatctgaggcctcccgctatcataaataagacaactttgaggggaatacttttctgaaaacacattgatatgatagctatgcaacccacgaagacatgtttttatcccacataaactaaactggcaatatgaatattaaatcatgtgtagtgtaaactgacaagacatacacagaaagccaaaatatctctcaacagcttaccttctgcagcttccttgcgggccatatttgccttcatcaaatcagccgatgcttcagcagcctcaattccagttaagccagtgcagtagctatttcggatagtctgcttgcagcatttgtagccccactgatgatctttccaccatgagccccatacggttgtatggttattaatgaaaacatcctcttcatatttgctcttgggaagggctacatcctgtatgaaatgaactttgagaatccatgaactaatacatgcaaaagacaatagataatgt

SEQ ID NO: 77444 - DNA, 5024 bp, Oryza sativa
tcttggcaaggcgccattagctgctcaaaagcctccgaccgaattcacattgggcatgccattggtcggtgacgatgccttattcaagatggaccctgcatgcaaggagttgcacgggtactacatggggaagtccaacgcaaggaggaagaatagagagacctccatgttgggctagcatgatagtcagccgttcctcgggcctactgccttcatcaccgtaaacttcaaagatctatgggacctctacagggtgcgagcgatcgataccaacctccttgagtgctactccttgtaagtatttctggctaccgatatggtagtaactgtccataaattacgcttaccctgactcttgtctttctcgtaggttaacctggaagcatgtccatcataaagcaccccatgttgccttactcgatccagctgtcgtcaatgagacaacgctgaaaaacgatcgagccaacattgtggactatatcaaggactgcttatttgcccgtcaaagacaaggacttcattatgtgtgcctacaatcaacagtaagcatgtaccccctacttatactcaaatgcgcgacgcgtacagctgtagtatgtaactagcaatttattaatttcgtaggcgtcattggattcttctggtaataacgccgaagtggagtttggtacactaccttaactccaatatcaatccaaaaatatacgattggtcggccatcgaatctgccttgaacgaggcatgggaccaatacgtggcaagaggcgggaggcataaggatgggcatcccaaactcggtcacaagaaagacttcctaatacgttaacaagttggcaaccagtgcaggttccatgtctgccataacatgaggagcttcgcagacaaggtgagattgctcgaccctgaggtgtgtccttcaattgtttatacacacataggacgacaatttacaagtatgtaaactaacttggcgccgaacatgcaggaaaaaatttcaacgattccggaaatcaacttcgatatcattagagaggagataacacaattcatactagatgatctcttgtcaccgaaagggatgtttaaagtgaagtcctaggtagctcgtctcggaatggcagaacatttgcaatgcatatgcgacaaacatttgatttttgtaaatattctttgtaatacaattaaattctttagagtaaagtcctaggtagctcgtctctatatatacttgtatttctaattacatataaaattgttccaatttataacttagttttacaagttttgatgcatgtcggcggtttggagaaaaaatggttgtgaatgacatatacttcctccgtttcacaatgtaagactttctagcattgccacattcatttaaatgttaatgaatctagacatatgtatgtgtctagattcattaacatctatatgtatgtgatcaatgctagaaagccttacattgtgaaacgaagggagtatatgtgatgtgaatgcatgtgttgtgatgggacataaatgtgaatgagttgtgatttggctgtgaatgcatgtgttgtgatggaatgtaaatgttgtgatgctgagaatataaatgctatgaattggctatgaatgctgtgatgctagcaatggggttgctgggaatgggactatatatatatgtgcttctgtcacgtttttgcagcgagcatggctagcaaaggcctgaggctagccaaattataaaattttatttttttgttccaaactcatccctgacgggcattttagtaatgcccgaaagagatatgtcattttgttaacgaccaaatttggcgagttttggacctgcactggagttaagcagatctcccaggcctcgtgttttctgtcaacacatccgtgacgggcttttagagtaaacccgatagagataagtcatccgaaccgggactcgtttgactcaacacgtggggttaaaccaatcggtgatgggctctatctaaatgcccgattgagatgactactcatccgtgacgggcttagtggtgtgcccgattgagattagtcatccatgacgggctcctaactacgctggtttgactggtcatactcatctgtgacgggctttgttttcggcccgattgagataacatccatccgtgacgggcttttgctcgattgagatttttttctcacatcagtgacctttgcctagtgacggaggccttacccgatagtgatgaggctttcagcctatcacagatatgcaatcccgttctagtggcatgcattccattggagatgtgtggaactttaattttgcatttatataggtgtaaacacgaaaatacggtgacaaaaaaaacacattttagcaattcgatcattttgtacatctttacatatcatcaaaaagtcagaaatgctagaaaacaaatgatgtgttgtactcaaaaggatgtatctcattgtgttgtattcatacattgtccctccctgttgatggcatgtactattttcgtgcattttttcccataagaattttttatggttacttccttacaatcagacaatttttttaaccattatgatatgatgatgcttacataaaaaaaaagagagaaatcatacttcataattcattgtgcatgtcaacttgcatatatatataagacttaccagcaatgtggagcattgagccctgagcaacttcaacataaaaaaattggacaattacggttttatgtttctacatctttttacttagctccatatttaatttcttttacaacgtatactttgtgaatctctactctctaacaatatgaaaaaatggacatagctaagggggtgtcttggtaaaaaaagatgttacagctgaaataaacacgatagatataattctttctaattgatatcaagaaaaacaggctggggacatactatcactgttatcgttggctgagatcatcaggattgttgtaaatactgagtccctagagctgagagacacagtggcggatccaggatttcaacacgtggggagcaacttaccgagtaataatataaatgatattgcccatatagttattttcagatagaggtagtatataatatttacagttttgtacttccctccctaaattatagtaatttcacattaatatacacatgtttttgagaatttaacaatatagtagactcgtgttcagccgcgcatatcatttggcaacataaagttttatcatggtgaactaggtaaagcaaggataacttagtagtaatcgaaatgttttgatgcgactgttgaatgcacatccatagggactagacagctagcacaaactccacggtaccaatggcctaaatctcagaggactaaccttaatgcttatttaatcctatgattagttagatgtaattaggaacatatgtaccgcagactagtaattaacttacttatactccacaccaagtgttcattggttcccttgtagtatatttgaagatcaaggatctttttagcctttttaatttacttaatcatagttcagagattaggtcagttatggagaaaccagagatctagtgtgactgaagaaataattaaaaccgtatggtgtgctcaggcagaatgcatggaacgttgcacgtacgtacgatcgacgtgcgcttattttaatttaactcacaaagacaactaacccatgagcaaaaacatgggcttagtctcactattatgttcttcatcacctcacctaataaaaatgctcgatgcctgagagaaaggaagaccagcactccaacagccacgtggatatatacatttcataaaactcattggtaatttggtacacatgcaccgtcatgcagctctggagtgcacaagcagcatagagcaagaccagtgcaaaccaacagcaaaacatacacaaacaactccatgggtattaatctgcccattgaacccagcagtctgtggaatggtgacccaacacttgcgacaaatttccaagggagaggaaaaaaaatgatttcttggacggcttgctcatgtatacttttaatttggaatgtatggaaggagcgcaatatgagaacttttttaataatatgtatcaaactgttagacatatgtgcagatataaagtacataatagagagagtgctttgagagcatagcctttcataggttggggcctaaggccaagtcccacctaagatggcatgagttaaacttatatagtttagcatttgaagatttatgttcatagatttactatgagaaatgctttcataatacatataattcgcatgttttaaaactatataaatattaagaaattgatggttaaagttagaaaaatttgatgtaaaacttaaaacaaaggaagtaaaactagtccctactcgatctatgcataacttgaagtaaaaaaaaaatcacgataatttatgtcttcgcttattgcatgatttggttatatatgttctccaatacatatatatcttcaatcctacttcctccgtttcatattataagactttctagcattgcccacattcatatatgttaatgaatctatacatatatatatatatatatatatatatatatatatatatatatatatgtgtgtgtgtgtgtgtgtgttaaatttattaacaactatatgaatgtgggcagcgctagaaagtcttataataggaaacgaagcgagtgtcttataatttcttagatcaattttagtcatcaacaagtctataattttgatgatcaagtttaccggtgaaaattagaaaaccccatatgccaatctgtttgtggtacgatagagaattaatatagacgatatcagttcatcccaatgactgattgactgcatacaagttttatgtcaaaacatccaactggagcttcaaaagggagtacctatacatctttcgaaagatttttataatcgtatcacacagatttttaatctttatattaaaatccgatagatataataaaaagcaaaaagcaattaagcaac

SEQ ID NO: 77445 - DNA, 6456 bp, Oryza sativa
  unsure (1)..(6456): unsure at all n locations
gacatatgtactttgcaaagaaatgtaaagtgcaaactctttatgtcaattttttagaattcaaaagttaaattcatggtttaactttagttacatagttttactattgaaattacagtttttcttctatgtaaatgtaacacaaatgtactataagggcctcttcagattacagtatttttaaaggatttttggaggaatactgttcacagggatttttttcctttcctatcattcggaaggcacaaacaggtcataggaaaatctaaggaaatattcctttgctgctgattacaaagaaaaaacacaggaaaaataacatccactccgaccacatttttgttttcctttgcgtaagaccgaggtaatcaagcagtaaacaagaacttttacgaatacaagcaaagcaactgagccagaactctgaaggataggaataagaagcaatccaattagaaaacaacaaggggaagaagcaactcgaggttgccagctgctcgagcttgtgatggccatggcggcagctcgttcctgcctctagaagattggggaaaaggatgatgcggtgaagaggataaggctttcctgtctagagagtactcgagaatagtgactagatagaaaatagtattctattgcttaattagattataatctacgcggttactcttgatcgtaaaattcccgtgttgtatatattcctgtattccgaatgctttctatcatcaaattccttagtttttcaatcctccgttttccatatgaaatcctatgctattcctattcctgcatttttcctatcctgtgttccgaataagccctaaatttacttttcatgtactggaatgtgtttgtgtagtaaacttcaatgagaatattcaattaaaaacaaatagttaaaatcaaaattgaataatcatgtacctttcaattttttccagattgaaattccttatcttcaaccatcggtagaatgtttaatattcctgtgtacaaaatattatcaaatcattcctactttgaaaaaagactgttgttgattccaattcaaatgtatttttttattaaagacattgttgtttgtgtcttctttacaaacagttattttctcatgaaaggcatttgttctttattttttctttttgtgaatagtttgttctactgtcctcaatttgtgttttgtttatgtaatcgtactgctgaattgctttatgatcgaaaagataggtatagagtcaattactgcaaagttatattggaaatacagaaaaaattttatgtaatttgattataaagttataaatagaactcacagagagaattatctaatcatttctacaactattaaattgataatcaattttgtgtacctaattgcttgtaatgctactgttcaagattaagacttaatttttggtttaagtgttcctgttcataactttttgattaatctgatttgtaacaacttatatacacaaattatactagaaatgtaatcagttgttgatatcactgttgttacaaatagaatctgattaatttattttgattgcatttttactgagtaatgttgagatcgccgcaatctgaatttgttttcattttaactgaataatgttgacctcgctgtggttatacgaattatactacatgttcagcaactatactgcctttgagtttgatcagatgttttatttattaactttgtgtttgatttttgaaatgttaactgaactgcagctgtaatctcaatactgaatgtgatttgttgaataagtaatctggactctctgactcaacatatctaattttgtagtgactacatggatctaaattgcaagattcagaagaagaaaacgatgaagaagaagaatcagaagatcaaatcagaagaaaacgattactacatggatctgagtttgcttgtgtgactttgctgtttccagaattgatatctgatcacgtgcttttgtcagccatcttcttggcaaacatgttttctgatgggtcacgtgaagaaatcaccaaattgggcttttcactttagaatcatttcggtttgggctttggtttggatttgggccacgataaataggccctgaaaaattgtccatactttattttgctgtttgtatagcccatttctttttttatatttttttgctgaaaaaaatgtgagctgttagattgaaatcgtatggtgacaaaatttgacagattctagatgctattttctgtcgacaggctatacacggtcccaaaaataaaacgaattcccataatagggggtttctaaaatatatgggtttttttttgcaatggaatatttcagtttaatgtaacattaaatctatacatagtgaaacattataagtacactaggtgaaacattttttgtaaaaaaaaaaaaaccaaattcccataataaaggggttccaaaatatgtgtgatttgttgcaatagtagataggagcatagatacggtaggacaaggcctgcatgcagcgtgggggaggggcgtcgcggtgcggtcccccgcgccggtcgtgcgggttagagcattcgcgatatttagggtcctagcactgcggattttctattttgccgacttaaacaaaccacaacggggaagaccagtactctcattgccgtggtccacgcgtcgcacgactgagtaccgtgccgtgacttccttctcctatcgaccagggacggacgcagcaagttataaacagtaaggctcaactatctaattctatgcattttgggcaaatctcatctgaaatttagtgttttttctttgaatttgtttatgccacgtgagctgcctaacacgtgtcacaccgcgccgaccgcagccagagagaaaacaagctcgcggacagccgcaacataaaaaggcaaaaaaaaaaaacaaaatctgttactacgccgaaaccctctaatcaccagttcacaatccccccataaaaggcggcccgcctcatatttcggcacgcccccaaatacacccgtccaatggccgccgccgccgtccacgagccgcttctcgcggcggcgccgccaacgcccggcaaggccgccgacggcgacggtccggaggaggggcgccggctcgcctccgcggaggcgaagcggctgctgcggctggccgggccgatcgtggccagctgcatcctgcagtgcgtggtgaacatggtgtccgtcatgttcgtcggccacctcggtgagctccccctcgccggcgcctccctcgccacctccctcgccaacgtcaccggctacagcctcctcgtacgcccgcacgcacgcacgcccgctagaaatttgaatcgtggatagattgtttgggattctccatcgaattgatctttcaaattctcctctcgcagacgggcatggcgacggcgatggacacgctgtgcgggcaggcgtacggggcgaggcagtaccacctgctgggcgtgtacaagcagcgcgccatggtggtgctcgcggcggcgtgcgtccccatcgcgctggtctgggcgtccgcggggcggatcctgctgctcctcggccaggacgcgggcatcgccgccgaggccggcgcgtacgcgcggtggatgctcccgtcgctcgccgcctacgtgccgctccagtgccacatccggttcctgcagacgcagaccgtcgtgctccccgtcacggcgagctccgccgccaccgcgctcctccacccgctcgtgtgctggctgctcgtgttcagggccggcatggggagcaagggagccgcgctcgccaacgccatctcctacgccgtcaacctcgccatactcgccgtctacgtcagggcgtccaacacctgcaagggcaggtggagcggcttctccggcgaggccttcaaggagctccgccagttcgccgcgctcgccatgccctccgccatgatgatctggtgagagatgggaccatcgatgtagagttgactctgaaaatacatatcttatttcaaatattcagtttgtgatcgaaaagagtgatcatatctgcagcttagaacatatcttatttcaaaaattcagtttctcatcgacaaaggtgtaggagtaattttttaagctatgcttcaaccaaaccgtttaattttctagacaattttcttttgcagcttggagtggtggtcatttgaaatccttgtgctgctctctggacttctgcctaatcctcagcttgagacatcagtgctgtcaatatggtaaccacacagttctacttttagtggttcagattttgttttaaaggcacattttgttcttaactccagctaacagttttcaatattcagcttgaacactggggctctgctgtacatggtaccattgggtctatgctcttctataaggtgcaagttgtcaacatgaaactccacagtttatagtgttcatgtaataatttccttgtcgatttcatgtttttttcttctctgtcttcctgcagcacgcgtgtttcgaacgaaattggagccgggcagcctcaagcagcgaagcgagcaacgcgagtggtgatgtatatggctttgtccgaaggattggtgataagctttaccatgttcttgcttcgcaatgtctgggggtacatgtacagcaacgagcaggaagttgtgacatacattgctaggatgctgccgattctcgacatatctttcttcatagatgggcttcacagttctctgtcaggtagaattaaaatgcattgcacatgacaaaaatctgaatcacaagttcacaaccacctaataagcaagttatcctgtacatcatttttaagagttaaaatgagttgttcttgcactttgcaggcgtgctcacgggttgtggcaagcagaaaattggtgcagccgtgaacctcggggcattctaccttgtaggcattccgggtggctgttctgcttgcattctacctccatctgaatggaatggtacttacctctgctgaatttttcccccatgtaaaaaatgacctgtagaatcaacatggatgcatctgaattcttaaactgatgtgctttcaacagggcctgtggcttggcatcgtctgcggcagcatcatcaaactactggtgcttataattgtctcgtgttgcatagactgggaaaagtaggtaagcacactaaacgaattctttcaggataatgattaggaccttctgctgttaaatctggacaacaatatgatgtcttttttgatgtatccaatttcaggcgatcttggcaaaggacagggtcttcagctcatctcttccagtagcatgaaaatgtagtgtgccacatctcacatgcagtgcaccaggcaattaataggatgcaaaattggtctatagcacatcagcatcaatcatcattataaaaagcatacgaattgatcatcgttcggaaaagcatacgaattgatctgcaagaggagaataggagccgtcttgtaacttctattgggatttagaagaagtgcaaggaaaaacgtagttgaggactgcatcaatcacaatatgattgaggccatgtcagcaattttggacttcgggtgttgtgtatgactattgtttttgctaacagtgtacaactgagctctagttaggataggtatagaaacagtgagagtatgtacgtagtatgaattttgatgaattttgatgtctctgtcagtgacattgtaatgagcagggcacaacatctcggaatgaacaaattataactttgaccctttttgtctctganatattgggcagtgacaagaaagcacaatcctcacctgttttgatcaaaggagtttacatggtaaatcataaatgacttcagatcaatccattaatcattattggtattattattatgtgcattatagtagactgtctagcaaaagccacattataaaattgatgatgatactccctttgggctgataatatttatcttttggacagaacacggtctcaaacaacaactttgaccactatttttcattataatataaatagaaatatcaataaatatatgattttactggaatactttttaaaaccaacctatgcatatgttctccataattttaagatagatattttagaaattattcatagtcaaagattttaaaatttaacatcaaccttatccaaaacgataagtattatcaacatgaagagaataatgagtttccaacacaaagaattatcatcactgaatccataaaagcatcacttatgttgccatccacgtggattgggcaatatactagctcaaaacatgctttccaatgaaaatgcaaccacaaaatttataattatgatctatcaattaataccacaaaatcaaatcgaccccatgtttcatccatagaaaatcgaaatcgaagtcttattaaaaatccattcacattattcacaatcgcctataccatccataaatctatgcaatggcg

SEQ ID NO: 77446 - DNA, 607 bp, Oryza sativa
ccccctccccctccccctccgctgccccttcccattccccttactcgcctcgtcgccgccggacgccgacgccgacgccgacgccgacgacgaagatgacgccgacgaggcgccggccttgctgcttccagatcccatctcgcgccaccacaccaccaccaccaccaaccccactcccacctctactacagatgagcggatcggggcaggccgcgcgccatcaccatcggcattgctcggatttcacgcctcgctcgcgcgtgcgcgcatggatggccgcgaaagggaagctagtaggagtagctccgctccgcctcgctcctgctgctagcctagcaaccactctctccttccttcctagcgaggcgaggcgaggcttgcgaggcagtcagagagagagagagagagaggagaagagagggttcggtaaaattaactaatgcctctctctcttcgatttgattggattggatagttaccaataatggcgtcctcgtggacttcagccttacgatgagtgtgcaataatgcactctcctctctctccgagacaactcctcgcttcctttcaccgagaatttccatttttctactctcaaatttactc

SEQ ID NO: 77447 - DNA, 551 bp, Oryza sativa
cgtcgtcgtcgagcagcttgatggtgctctgcttcttggccatcgccgcagcctcctgcatctgcctctggtactcgctgaccccggcgtcgtcgccgccgccgccgcaactgcggggcaccctcccgtacacgtcctcggcgaacgcggcggtgtcgggggaaggcgggaacccggcgaggtcgacgagccgcgccgcgaggtcacccgcggaggcgcactcccgcgcgaggcggacgacaagccgcgccacgaggccctgggagtatccgaggagcgccatgaggcggtcggagacccacgtcctgagctggccatcatcgctcgccgccatggcctcggcctccgtagcctcgtttgcggcggcggcgcggcggtgccgcgagaggcggtatcgaagggggttacgggcttgggctttgtggtcgccggtcggtggtgcggccaaggccgctttatccgtgcgtgaccgtgtttgtgtttgacgtattcgacgtggaggtggctccgctatggcggttcgtgtcagtgctgggaaaccgggaaccgac

SEQ ID NO: 77448 - DNA, 979 bp, Oryza sativa
ttatccggcctcagtgcatcggcaaaaccagccatagtaaaatcacagtgcctataataaggtttttggattgttgagattatagacatataacgatttaatctattccataaataaatcatgacattacagatgaaaactagcatgaacgcatcattagatctacacatgtaaactacacagtataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccatcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtatgaggcaaaccctagattgattttgcgtatatattgcgtgaagacggcggatcggtttatatagagaagggtcgcttgatcagggcgcccgcacgatctctactgcgcgtaaccgaaccggataagtcgcgcgtaacttatccggactccacgctgtttgcacgcaccggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgtacgcgcgccgcctgccctgccctgctaggccaggccaggcgaggcgagagagcgcgcgcgtgtgtttcccctcttctctccaccacacatgcttcaagcgactgggagggcatcctcccttttaaggaggtccccctctcctagaataagcaaggtggtactaaactccacatgcatgccatcccatgagg

SEQ ID NO: 77449 - DNA, 4565 bp, Oryza sativa
catttttccatacaggccacttaagcagccgtatggaaaaatgactctcgatttttgtagacgccactagttatggtccgcatggaaaaatgatggggcctcgtacagaaaaatcacttttgtagtagtgtcatctgccgcaatatattttgtgctgaaatatagccaacataagctattaatgtaaaatcataataaaataaatagtaattacgtatttttattagtaagatgaataattaaacatacgctcaaaagttaataagttaatagaggaaaaaagtaatataaaaatactatagagatatcctaggtaaaaaagaaggggtcgtgaatgggaagagaaaaaaggaatgggatacgtactacctgcttaagtacgtacgtgcgagggaggagtatgtacgtgtactgagggatggaggagtacatgtacatgctgggagaggagaggaagggcaaactactggttttaatcttacctaatggtgcaaaataatgggtctaccagtttaaataaaaattgaaggctagattttcccgtctattaaaatgtcatgtggcggtttatgggcgtttataggggtgcgacgtggcggcttaaaagcgtttggtagaaagtttaatgaacttttagtatataatagatagatagatatattcaatgttagtttttataaaatcaatttattactgtagaagttgctaaatatttttttaaaacttgattaaatttggctggaaaagaatcaaaacgacatttagtatataatatttctacttctaacgacatttagaaactcctcgacaacgtgtgttgtttgtggttttatgtgtgaagtcatgggcgagtagtagaccttgtggagattaaaaggtgccagttggtcgcattgatgatagtcttacattcggttagaggtttgcggatgagttaatttcggtatgggcgacaattgtcctacttgaattttccatgtctaatgaattttgccgaaattttcacatctaagcacatgcaaccttctaattccaaatatgagcaggtaatggatggaattctatttttaatcaagaagcccacatgtgtgtgcagtggtcttccatcgaacttaatgtcaaacgaaatataacaaactaatggctgctgatcattggacaaatcactagctcgtagcgacttgcttaggtctaattgattgtttgtcttcagaaaagaaaatcttattaccatttgcaattggttggatcaaccattacgagatagggcaccgtgccatcatgccgttagtctcgagctttcttcgtcttttttttttcttaatccatatatgacttggatgttgttttctttttgaaaattggaactgtagcggtcggttgaaatataatcatctgcttggatcatcaaaatcataatattatgtgtgctaacaaatcttgatttgtttcacatagaagctgcatcaacaaaaggtaattgtaatactagcgaaacatgttaatggatcatttgctttgtgcctgctagctagtttgattagaaacagaattcaggacaatacatgctcacatttggaattatgaggtcgcatgtgcttagattaaaaaaatctgtgaattttgtcctttcacatcaatataagagtaagtttaataatatagtcaactactagctttaaaaattaaaatattatcaataaccaacctaatagcctacttatataatagttatttgtaaatatgtactgcatcatcaatacttaatccactcatctctcacatggtttattgaagttcgtgctacaactgacatataaatcagtagactacttttattctttctcatttcttctcaaatatttacaatatgatatgccccgcaaaaaaaatacaatatgatatgacaaattatatagcccgtttacaacttattgtattcgctctaacaataagtttattgaactcttcaaaacttgtctcgacgacatctatcatccactaagagagagagagagagagattagaatcctcccttgcccccaaccacacccctaaccattaattataaataattgatgcacctttggaacatatgattacagaacattcggcatgaaatgaattgagaacaattggtaaaatatgtatatatatatagacacacactagcaaaaacgcatgtgagttgcaacaaatagataattttcacaattgataaaaactctgccaatttaaatgataaaccggcacaagacgaagaaaataatggaaaacaaagtaagaatcatatatagtattggacccagttgcgtaagtttcatgcatcatcacatggagaatcccttatatagacatttccatatattaacaaacaatcgggtggctattccctaagttgacgcatgggtattttgctataactcatcgaccaaagattaaaattttcatttttcaattagtgaatttttttttggtacagatggaaagcatttgtaaactaacaacttactgtatacacatcttaagcaatgataattttaaaaggaaaatatttatgagaagagaaattgcaaagggaaaaaatgaggaaaataagaaaaggagaaaataaaggatattggaaggagagatagaggatcaggattatcaggagaaattaaaaagtgaaaatgaaaatgaaaaaaaaagatgagaggaaaaaaaagatgttgatcattggaggaggggaggagtgtgcgagacggggtagtgggatggtgtgacctggttgggttgggttggggcgagccagggttgggctaggagggcatgtataatagttattacaggatcatatcgaattggatgtggttcaggtacaactaacttaaatacggatgacgtatcaaattccggcaaaaatattttcaatttttataatagtagagatagcagaaaattagattatctttttaataatagtacagtgtcataaatttatatatccaactggatgattcccaagacagaagttcaacgtatatatctttactaattaaacaattattaataactttccgttcgtcacttttttcccgcgtacacgctattttttcagccatatactcaaaattttttcgtgagtgtccgctttgctcacgatcccctctacccctacacgtcctttgtccgtctcgccgtgagaaaccgaccgaatcagatgcacgacagtacaagggaagaaagaaggaaaagccaaataattccctaaatttgtaaatcaaattaacctgtatcaattcgggttactataagcctctgggaaacccgaccgtggtgtgggttttcaccgggaagcggcatcaccaccgtcgccatgcgggcctcatcttcgcccgcgcgtgccccggcaccacgcttgcctcctcctctctgacctgccggctttgccttgcgtgcgccgtcttggagccgccaccatcaccgtggtgccaggacaggaaggctcaacttggcaccgccctaagcagcgccacccagccgacgatgttggagacgcacgacggaatcaccttcacccgcacatgccacttcgccggaccgccatctctgccattgtcatcattcactcgctcattgggagagggaaacagtgaagcgaaggggatcgagagagattgaggtagggttagggtttttcccctcccccgatgcttcaacggtgcgggtgcgatctgaaccatccatcagatcggacgattcagctcgccctctcgttgggccgtcgcagttggtggaccgtgcggattgcaagctgtggaagcgcccataggccgcgctcggcgctcgctaccgcttctcaaataaaatggactggcccattttgggccgggttcgggagccctaggccataatttttctttatagaattgttgtcaaattaaatgtttattctttccagaaattcatttaaatgccttcttagctaaataaagttggtgaaaattattttagccaccaagtatacctacttaaaaaatgggagtgtctacagatcatgcaacagattttgatgtcttccatctgtcgaattttttgaccatctgatccagatccaacgaacaacgtttttttgatcaaaatagaaggaaaaaaaataaaaaaaaacacagatcgggccagatatatgcccgtctgactcgatccaaattaaatggaggcccaaacaaaaaagtctaaaattcaagcccaatgtaataaatcaacaaaaaaagcccaaatagatgagcacaatacacgtgacacatgccaggtgacttaattagaaaacttggcacccaagaagaaagtgtcacgtgatctggagataaaaagcaaaaagcaaattcaacatagggggaatcaaaatctgaagtcagaagaaaaaagatggagattaacgagaaaattgacgatagagaagcaaatttacagtacgcacagaatggaatcacaagtttgagcgatttggagaagggaaaaggtgaagagcaggaaaaatcaacaggtaagtgcaccttttgattcctcctttgaaatatctt

SEQ ID NO: 77450 - DNA, 9782 bp, Oryza sativa
cacattgtagacagtgcctctctcgaaacttttgaattcctgttaaatgaacatcacagtatcagaacagaagagaaaattttaggaggataaacagaatcattacaattttaggaggataaacagaatctcttgggtagaacatcagcaaattcatgcaactcataaacacatctcattcaaaaattttacatgaataaggaaacttaaatcactgccacaagtaattctctccactgtcatgaaagcaagtcatctcaaactttcagaaaattaaaattcaccagcaataaacatgattgtaaaaaaatcagtgtgaactattcagtttgtaattaaaactattcagtgtgaacagaacactaaagcatgtcatgtcaaaatttcatgtcaaaatttcattacagaacactaaagcatttcatgtcaaactttcattgtttaaaaaattcattgcctactatttcattttgaaattaaaacaagtgaaattcaatgtagttcatgtccttttgtactaagaaacagaacaagtaaatacatcaaaaaattcagtccaccagaaattgttgtcaatctggcaacattttgtattcatgttgttaatgagctgatgtacttcaatgttcaaaaacaaatcaatccagattcaaacaattccattacaaaccaaagcttagacaaacaaaaactttgaaatataaaaactacagtgaatttgtaccataattacatagaaaaaaaactgtaatttcaatattgaaatcatgtaactgacattgtagatcatatagatcaggagaatcaaaatcattaaaaaaaagacataaatacaaaagtggccatcagataagtaaaaaaacaccccaattctctacacatcatatggacaagaattttaatcattattttaacttagcatgattaattttcttgcctgatgatgtgcagaaaattgatttgcttaatcaaaaaaatatttatcatcatctggccaaaaaaaattcattaagggtaatgcttctattttcaggaacaaaagagaagaaattgaaaatatcaaatgtcctaaagatggcggatgaaaagcaattcgaagcagggaaaacatcaagtggtaaatgcattactctgtattattcatgtttagttctgttttttttttgcactaatcttctataaaattactttttttgtattgaaacagattaggcaaaaaatcacagggtctgaagataatgaagcaattagcaggtatattatgctaaattttataatattatctatttatcaaattaacaatagacgagagaaaaattatgtatctgatcttaataataaacttttgcaggaaaaattgaagctggaactagtactaattctgttaattcaaaatcaggtttgcaaaagaagtccaaaactttatactaatattacttgaaccacaaaagattcatatagaaaattaaaaaaaagacataaaaacaaaagtggccatcagataagtaaaaaaacaccccaattctctacacatcatatggacaagaattttaatcattattttaacttagcatgattaattttcttgcctgatgacgtgcagaaaattgatttgcttaatcaaaaaaatatttatcatcatctggccaaaaaaaattcattaagggtaatgcttctattttcaggaacaaaagagaagaaattgaaaatatcaaatgtcctaaagatggcggatgaaaagcaattcgaagcagggaaaacatcaagtggtaaatgcattactctgtattattcatgtttagttctgttttttttttgcactaatcttctataaaattactttttttgtattgaaacagattaggcaaaaaatcacagggtctgaagataatgaagcaattagcaggtatattatgctaaattttataatattatctatttatcaaattaaacaataggacgagagaaaaattatgtatctgatcttaataataaacttttgcaggaaaaattgaagctggaactagtactaattctgttaattcaaaatcaggtttgcaaaagaagtccaaaactttatactaatattacttgaaccacaaaagattcatatagaaaaatgaaaaaatggcataaaaacaaatgtggccatcagataagtaaaaagaacacctcaattctctgcacatcatcaggacaagaattttaatcattcttttaacttagcatgattaattttcttgcctgatgacgtgcagaaaattgatttgcttaataaaaaaaatatttatcatcatctggcaaaaaaaaaattcatgaagaggaatgcttctatctacaggaacagaagagaagattttgaaaatatcaaatgatctaaagaaggctgatgaaaagcaattacaagaagtaaagacatcgagaggtaagtgtgttactgtgtaaatttcatattaagtacttttttttgcactaatcttgataaaaaaaataacaaattttggtttcgaaaggttttgaaacagataccgacaaaaaagcacagggatttaagacaatgaagcaattaccaggtaattataagaataattagaagaataactaaaagtaaaaaattatgcttctaatttgttttataatcttttgcaggaattttcaaagatggaacttgtactgctttggttcaatcaaattcaggtatacaaaaagaagtccattaaattcaaattatttttttagaaaaaaaattcatagaaagagtttaactggattctaacaaatgtgagtctttcattttaaacaggtctagcattcctagagaagaagtacaacacaactcaatcatataaaatgcaagaaaacagagacaacataaaatcagctaattaatgaatatgttacaagcactcaatgtcacgcccagaaattcactagtaatttccgaacttatttgtgcataaaatcctcgtccaggaatcagccgaggtacacaaactgacaatttaatatataaatccatcataataataacattacatacttacaaaagaaaagaaaatagcagcggaataacagtatagcgatagcttcagctccactcccacaggcagctcaactggggtataagccaaacgtcttctccttcgcaacttgtcttcaactgaggtttgattgattattgcaaggtgagcatatgacatactcagcaagccacacagcaaatatgcaagtacacaaggataccaaaggatggcataatatagggctcatttgcaaaagcagcatttagcaaacatttgagaattgtaaaacaatagagtaattaatcatcaatattaatcaatactgaacagcacacccatgctgcacaggcccaaccattctgaagcaaccatacccggctgcacagatctatctccaaaccaggaatataccattccaaaccaggagctaatcaaattattaccagttatagcatcatttattatggttaaagtgtgagactaatcacgaaagacattgttagacccgcccatgaccgggggcacggctattcgaatagttttattctggccagaggtgtaccactgtactcacaagacacaacccaccagcatgttaccgtgtccgcgcagacacgtcaccatgttgagtgattgtgacaagacccctcgcataactcaactcaaagcagtgcacctttcccggatcatagtcacccccttataaacaaggcatggactccccagcgacccccgtgggcttatctccgccacttctcagtctggtgctccgcaatgagccttgttatacaaagtgtccagtcgttgcccattctggcttgtggttggcacggttaatgtttcacaaccgaaaatcgtgaaccggtccttaattgtcatcagcacgaccatcaaaaccatgtgctcacaacccaccattatcaagttttagttggcacattaattaattaaccaatcacgattgaccatcgtgagctacaattaaatatccatcattaagtaatagtgaaacattagttatcccaatggtgtgctaatgtttctaagcatggctaagcaattatgtctaacatttagctgaaccaatatatataaagctcaactagtcaaattataatatcccaaggtatctaggaatagagtaatcaatgcaaacaggccataacaaaggaatagattcacaccacccagtgacattcgaaaataaatgcacagttgaaataaatagagaatttaaatataggatcaacatgctcaacggaacggtgtttgggatctgtgtgacttgccttgcaataaagggtcttcaattaatcttcttaacacttccggcgcactcgcgaactttcgaaacgacagaaacgacaagctaacacgcaaaacgagaaaaaagactaataaaaaccaaataaacaatacataaaaagtaaacaaacatgtagatcataattttagatgaattatgagacgtgaacggcctcattctgacttcaaatgaatttattacgaattttacaagattaaatctaattaaagcccatttaaaaaggattaaataaatttaattcaatttatggataattttaatatgtaggtctttattttatacaacttttgcaacttgaaccacattaaactgagttacaaagaattagttatgaatttttaaagattaaaccggattaaagcatttatatggattttaattgaattttgacgcaataatgaattatttttgaaaaggaaaagggaattattgcgtcatctgctagggttcgcggtggaccgggtgcacggcggcggttcacaagattggacggctgggattcatccatccaaaacggacggccaagatccatcggtccacgaccggaccacggcagacggcaacaatgacgtcggcgacgaggaaaagcggcggcgacgatcgggtcaacggcggcgacggtgctccggcggtcgacagcgacggcgaagaggcggacgaggacggcaacgagacggcgatcacgacggcggcctccccgagcagtgacgacgacccaagcgacggcggcgcacggctggagcggcggcggcgacgacggcgcgaggcagcacggcgctagagctctaccggcgacgagaggctaaggcgagggtggtggcgggtagaggggagctcgggggtcaatttataggggctagagagcggcggcgaaggcccacggcgaccggcgacgggaaggaaggtttagggttcggaggagagaaatcgatccgaatcgatctcaaatccggcgatttccaaagcgatttagacgatgtttccaaaagggaaaaggtagagaagatctcgggaaacatttctcctcaaacgatttcaccggagaaggaaaggcgcggccgaatttggaatggcggtggcggcgcagctcggctagggtttcggcgagaggaagacgacgactgacgggtgggacccacctgtcagcggcggtcgcacgcacgcacgggcggctcggcttgggccgacttgggccgagggagagagagagagcggtttgggccggctttcggcccaaaaccaaaagggacttttaaaaacctttttccatttaagttattcatgaaatgcaattccatttattaaaaatacttccttggctcaaatgaatcccagaaaaatctaggaactatagaaacaagagaagtatttaacaaaattttatctagcctacttttatattgagatttaacaaattaaaattagatcttctctctaggcttttaagatcatttctaataattcccttttagacaacaatttataaattaaggatttttaaacaagaaaagcacttaacataattatatgattaaataattactgaactgttctttgtatcatttaggaattgagctctgaaaaatccgagaaaatttcagagagtataattaatcatggagaatttaataaaaattaaatccatccatgctttaaatttaggaaattttatttcccacatttaacttcacttgtaaattaatgaacatttaatataaattctattaataatttattagataatttataaatcctaaaacgaaaatctggctgtgacactcaatcatattttcatcaaaattgtaaatgttatacaactatggattgacaacaattttcttttaaaaaaaacagggaacaggggcacttatcagatataggaagttagattgagaagaagaacacaaccaatcagacaggtaaatataaataaatgtataaaattgtttgacaactttcatactgcattaactattttgtgaaacaaatttaatagtttatatgattgaaaacaggtttagcattgcttgaggagaattacaatacacattacaaaaacaggtaagggaaaaattatgaagcaacttgcaggtatgagtaatagtaaaacaaaaaaaatcagatattttcctcatatttattttcaggtaacagtaaaaacttctcagaaacagaagctaaacttgacaagaccaaaaattcagaagcagacattggatgtagtgctttgaatgaatcagagaaaagtaaaaaatttgcagcaatatttatattatttttaagagaatttttttgattaattaaaaattacactaacctataatactggtatcaaatattgcaggtattatagaaaacaatgacaaaggaactataagttgtatgaatatgcaagaaattaattcaggtaaaaagttgaaaaaattcaatcatagttcttcagtaaaaataaacaagaaaaatcatcaatctagttgttcaactacgttaattttagaattgtagaatagcactatttctttcatataatttcttttatgattagaattttcaaaatttctgcagaaaatggagctaacaatgcaaaggttgattatgaaaacaatgttctatctctgttggaccaagactacattgcagtaagtttttggactttgacaaccttaagtttgatataatttcttttattttctttgacaatcaagactacattgatattttgttttttttttatcaaacaggattcatttatatcatacactagtctaatggaacatattatttcatcacaaccaaaacgttgcaatgaattgaaggtaaatttttttttgaaaacaaaagtattgatttgttgttcatttatgtattcatgtgttcaattaagtatagtttttttgaaaatctttcaaaaactgtttaattaaggttgaaggaacacaaaatgataaaataaagactggaattggacaagattatcaaaaggttgatgaaagtttgaattcacacgttgaatatcaatcagaacaaagatgctcgatggatattttaaatttgcaagaatctgtgcaggtatgtaattgctgtataatattttttaaaaaaagtactaaaacttctgtctattaaatttaaaaaatgagaaacctttaatttattttttttttgcattttgttttttcacaggataaaagtttagagcaaacaagtgaaattggttacagcaatgttgacaatcagtcacaacatgcatggtcactagatattttcaatttgcaagaatcagttcaggtatgaacttcttacaaatataagtttttctataaaatgaaaagtaaaacattattctaaataaatgtgaaaaaagttttatattttgtttaaatcttgtgacaggaaccaattttagaacaatcaagtgatattggtaacatcaatggtaatggtgttgatgatgctgttatgaatgatgaattgctaactgaggaagatattgaacaatttttagaagaagaacaacaagaagcattgaaagggaataacgcaaacatagatagaaagtacatacctgaattagatcagaagttcaaatcgattattgaggcacagaactatttcaacttctatacatacatggctggattttcaattgtcaatgttcatagtgctagaactacaagtaagaaaagaaatagagaagttattagagtgacattcaagtgctacaaatatgtcaaagcagattgcaatacaaagccagaaacagtagatgagactgctactggagagagaaaaacaaatgaagttattggaacagagtgcaaatgtgttatggtaatctcataaagaaatttggaatgggttataacaaggttagatttggatcataatcatgagctgagccctccagacgaagtcagatttctaaggtcacacaagtatttatcaacagaagagtgggtgcttattcgaactttgaaagaatgtcacattcccacaaggaacatgatagttattctgtcagttcttagaggtggtttaacttcattgccttacactaagaaggatatcagcaatgtcagaacagaaatcaacagagaaacaagcagcaatgatatgatccagtgtttgacatatctgaagaaaaaacaagaagaaaatccaaatttcttttatgaatttgatttggatgaaaataggaaagtgagaaatttcttttggacagatggtagatctagagattggtatcacaaatttggtgattgtataagttttgacactacttttttgaccaacagatataacctaccatttgcaccttttgtgggagtttctggtcatggaaatacaatattgtttggttgtgcatttttacatgatgagacaacagagacttttgaatggttgttcacaacatttctgaaatgtatgaatgggaagcaaccaaagacaataattacagaccaagatggtgctatgagagcagctatcaaaaatattttcagagaagctaagcatcgaaattgttttttccatataatttcaaaagctttgaaaagatctggatccttattcaaaaagaggcaaggtctttatgcaatatacagtgatatcatacataactgtttgagtgaagaggaatttgaggttctttggcaggatatgattcaagaattccatctgcaatagataaattttctagcacaatgtggcatatcagaaaaaggtttattccagtatatttcaaaatagatttatgtcctttcattcaatcaacagcattaagtgaaggaactaactcaagattcaagaaaaatgttggcccccaatatagcatcagaagtttcttgacagaatatgaaagggttatggatactattcaaaatttagaacagcatgaccatcatgaatcaagaacaaaaaggccgactagtttttggtcaaactactccattgagtaccaagcagtgaaattatataacaacaaaatattcaaaagatttcaggctcaactcaggaagacatttgaattacaagttgaagagattgaaaagttcaagtgttatgcagtgtttgaggcagaaaatgtgatcagcaagcaaatcagaaagagaaaataccttgtgatgatggacttggatacagaagaatacacatgtatttgtgcaatgttccagaaagatggcatactatgctctcatatattgaagattatgcttcaccttagcatcaaagaaataccggagaaatacatcatgcatagatggagaaagaatcataaatcaacagaaataattaaagggaaggaaatcatacctgtttcagaatcatcagttcttagatttaatatcctgtcaaggaaatttgctgaaattgcatcaaaaggtgcgaaaacagttaaagcatacaaattcttgatggaagaatcagaaaag

SEQ ID NO: 77451 - DNA, 609 bp, Oryza sativa
ctatagggcgaattcgagctcggtacccgtgacatttgttctggcacaatgtaccaacaattttgatagtgaataactgagtacaatttaaaagatgaactttcaagatgattgttttgacggattctggatgacctcttatatataaactaggccactttgtaggatctgattacttgcaatttcaaacgttccccatttctccatttactaaccatgagcatccattttacatccaggaattttaataaagaagtaactatgaaatataaggaagttactccccaatgccttgaaccacgtggcccatgctgttggcctgttgtttgtgtaggcagagttctgttgtatgcgtagattaggagttctggtcgagtataattgctggatcttagactaggttcatggcaaatttgcaatgtgctacacgggactgtattcgtatgtggtgatttgatccatttaggcaatcaatcttcgttatggcgaactggtgtctgtttagttagtattgcaaagtcgcaaactggctaccattggatgactttctttatgatttcctttttaaaatcaaaatttccatggtaaatttgatttaactaggaaaaa

SEQ ID NO: 77452 - DNA, 14318 bp, Oryza sativa
taatagtggactgggagcacaagagcaccagtccttctgggagctttagagttgttctctagactcaggtgcagaacactattctttgccttgcagtagtgcagttccatctcgtgttctggtaatacgtatatcggcacattgctaatttacatgtagctcaggccctcctatttagttctctggctatagcggaactggctatgcacaaaagtgctgctaagcagtataatttttttggtactattatgaactcaggttcataacattgtctgctatccatatggtactatttagtatttctgcacacttcgttactctgtctgctgttagaattcaatctaatctttctccattagaaatttttgtgtatagtgtagtgctaattatttaattgcctaatgtgtagaatagcagcattggttcgttcgactattattcgcttattgtacacatcatgtccacttcgtccatctcgatggttggcagtgctgaggaatatggtatgaattaatacttccttcaaaattcaatacttcattttttttaaaaaaatttctgcatgccactgaagaattcacatctcatttatggcactaacttttgcctattctcacatatgctgctgttccattaatgcccgttttacatgacattatctcaaacttcaatccccctgctgttatgggggatgggaattacctttttcctcgggtatttgttgccagtgataaaagaagtatgcaactgggaggagtcgacaatagagttgggacaagcagagagagttgggttaatacatgtttcattgatcttgacaacactgatgcagttggtcaagctcattactttcttggttgtgacttgtttgcttttgctacgcttgcaacgttagatatgcatgatacccatatttgctcgacagccctttatgcaataaaatgtatttataccttgtccaacacatggtcaagaagcagcagaaggtgttggtggcctgtgaacgggaccctgagccagccggtggtggtgacatcaagtagaatggcagtgatagcagcctcttggacagcacggaaaactcatggctggagctgccagcaagcaggaggccgctaccatgtcaggggtggctgctgaggtgatggagatgggtgaagcagcaccagtgcaggacaatctggccattgcagggccactgccacggtggtggaaccttccatcctgcagctggggcagagttctcgtcgttattttcagtctcttacactttggccatggttatgggtgtcatggactgcttggctgaggtggccaggaacctatctcagccccagcacagcatgtccaccagagctttcaaatagtggaactcaaggccactcttcctccgggcttgtttccacataaaatgggcagtaatggaacagtggaatgtgcatgaacggaaaaattagtggcatatgtgaatggtctccacttagtggcatacacaaaagttcccccaacattagttctagggtttcttgtatttatgcaaaactcataatggttggcaagtttggcatcaattctttccactgcattacatgcataatatcctaaaagaggattgctattactttgttaagtttatgtgctactactctttagtttcttggaagggcatgtgtactgttagtgaatgttgttttagtatcagataccatatctcagttgccactgctctttctgtcaatcacctttctttaaattcatgtagattgtcgattgttgtagttggcatggcaaccatgtttcttatttctagtatcctatttttccttagtcttctccttcatgcacaaactaatgaggataaggcatcattttgccttatcctcaatgcgtataatgccttatcctcaatgcgtctattatgcatgaggaacacatgtattattagtatatttgttacatttatacagaaccttcatgatgaaaatcatgctttggatttggtagatttatattgtcatttttttataacattcaggttcttgctacctcaattgcaagaaacacaagcgaaggtctgtccagttctggacatgatcccgttgacagtaatgcagagaatgatatatactatggagcagatgaagacaacatgatatctagctcaaagcaggaaaaaacaaactggtctgccaataaatttagccagtttccacaaagaaataagcatctgagatatcgcaccagggtttttgcagcagagtatgtctgttagactgttacagatatatatttttatttgcttcccacttattattaaaatgtttatttgcatggaaacagatgtgttagccatgtacctgttgccgttggaacagaaccagctcattttgacctcctattggcaagaagtgcagtagctgaaggggttcatctgtcaaatgactggctaattcttaagctacaagagttggtttcactttcatatcaggtccaaacagaaaacaaatttaatattcagagcacaacacaatttgaagaacttttggagtgaattctccgattaaaagctgacaacaacatttgcatggcagataagtactggacaatttgaaggcatgcagccaataggagtgaagcttctctgtttgattatggacaaggtatattggctcttttggaaacaattttgcgttaacataactacgtaatcaattggtgcagtaatgccaatgatgcactaacttagttaattcaaggaacatatctgaaacttaaattagtcctcaccatctgccttgttgaatattgagagtgcatgttgttgccatcaagatgctgtgaaactagtaaatagttttgtgaggtataatcctactgtatgtatgttctaagatgactttggcacatgatcattttttcctagataagtaattgattatttaggtaaataggtttattatcaggaaaggtgaagatatcctaaacctgggtgagacaataacaagaacttattctacatttctttacagttgaccataacactgcctttaaatttccttattggctgagtgttgtatttttttatatatttctagtttggcatggctgtggatcctgaatttcctgggcatatattgttggagcaatttcaggtgattattacatctcagtttccagtgtttcttctttttttggggtaacatcatgatcctgtaccttagtcttttatatatagccctgtaaacttgatttaatcctgtagttgaatgattgctttactctgcttttttctgtgtttgaaatttaaaatgcaggctcagctcgtttctgctgttcgaacggccataagtactgcttctagtccacttctccttgaggctggccttgaacttgccacaaaggtttctagcaaaatatttcccgttcgttcctttttttcgccctgtacaccagacatattgataaatatctgtgtttggtggaaccaggttatgacaagtagcgtaattgggggcgacagggtagctcttaatcgcttgtttttgctaatatgccgtccgctaaatgacatagaggacctattttatccatcttttgccgattgggttgtatgtaaggtattatggttctccaaaattgccttaagtggtgatacactgtatccaaatttgtttttgcaatttgcctctacggagctcctgagctagcttttgtcatctgacagataaaagtacgtctgcttactgctcatgctgcagtaaaatgctatacttatcaattcttgaggatgaaggaaaatattcctgatgaacatcagcaattggcacctttgcttgcaaatagttcatctctcttaggaaagtattggattggagccctcaaggattatagctcgataagttttggtctgcattcaagaatcaatgtaagatcatctatcaagcctttttaattatgccctaaagaggttataatgttcttctgtgtcttcttaaaaacagcacaagccgttccttgatgggatccagtcattcttggtgtcatcaaaggcaaaggagtatcttgatgaagtttgggcactaattcttcaagcaacagctcttgatgcagctcctttggagttcgaaatggatgattctgaagatacgcttggacagacatttatatctggacatagtatggtcaaactgaatttaactgaattcaagtttctttggggactatcggtccttgtgctttgtcatacacaaccatcaatgtcgaatagtgctataaaaatcaatcttgaccgtaataatgagaaaaagattggaggccttgttgtctgcgctggactagataatccaagaccatgtgatcaaatgttgcttgtgttatcgtccctcacttcacaagtgttttttagcatgaattttcttacagtggatacttgtcaggaactcctacaggtcagtgcatacctgctgttgccacaatactttcaaaacagttaaacttgctggcccctatcttaagttatttacttctattaatgatgaaaacccaagcttatgtgtaaactaccctaattccctacacaatttcacaacaaaatactatacatgctttatttggaaatggagtagcattttctaagtgtctcatacttatgtgttgaaatagtaatggtacacctgggagattacattggataccccttggaaggacatgttcaggattgaagatttgattatcatatgtcaaatgctaggaacatgatgaatatattattgttgtagcttaatatgccaataggcggaagggcacttgattcccaggaaaactaatgtgggattaatattagagttaaatattcattaatattatttagctttaatagttaaatgcttcaattgtaataatttaatgtgcctcttgaagggtgcttttcatctggtagcttttaatgagagtggaagtaggacacttatttaggtgatacagtttgattaaatccatgcttgttaattgtgttgggctagatgactcggcgttcttctcatctcaatgacctctgccactaatactccttcccatgccaagccatacttctcattctttgcttgattaagttattccttgattgacaaggtatttgtacaatgcaggctcttacttatgctgattgttcaagtgctcctgttgtatgcctgttctcccaggtattgtcttgtctttgttaatttgcttcctggacatattgatctacgacgatctacgaccaaatcttaatgctgttgcagtgtctgcagtcctaaaacactatgcttgttagtgtgtcccaaaacactatggtgttagtgcagtaattttgaggatatatgaatattagtgtttggaggagttagaggagataaaaacacacaactaattgccaagaggaaaaaaaaactaacgagttattaaacagcataagaaacaatgcattacgttattcctgaattcggcgccatcttacctattaccttttttgagacggtaatcctcactgtccttgcctcaattgcctcggtggcttttttttttaatggagatagccatttttcccaatttaccttaacatttttttggatttcttgttgatgcttagtaattcagtcattgtggtttctaattataggaggtgcatcatttcacctttatgtcaacacaaattgctttgagtttaaaattaagtatttttttcaaatgcaactattatatgaaaactattgcttttctacagcttttagctttgcattttacctagctacaacaataagagcatgaaacttcattatcaggcaaacctttactcaaggaggtcctatatatatgtcattctctgttaatgtgggctgccccacctgacaacatgtgacgacaacagaattgcataggggaatgaatgacaattaggacccaattgaataattaatttgtagactggtatccaataacaaattgcttcttgcccttaatgtgcaaaattattccattgcacactaactattttgatgggacatctaattgctgacttactttggattcctcatgtagataatcagactgtgccctgacaacttctttgaggtggaggagtttgtttttgttgcattagagttctactcatggtatcttgctactatacttcaaaggtaattctcagattctcaccacactcaaaagtcaaaacctttttctatgcttctggtgattactttatttcctttgacaagatttggcaagcactccttttacccttgtatgttatttcttttaatctttgcagtaggtgcggaagttctcaggaatgcttaagcaatagtttgatttctgaattatctgttgctactgagacaatggcatgccgaatgaaaaatgaggtagtgatatgataaaacctgggtttccctgatcatatctagttggcaaaatttgctacagctacctcagctaattacgcgttttttgcgtgtcctgtagcaaattttgcctatctagttagcgccttttgaattacttttgagatgcattgaatctgataggttgttttttgtggcagcattggtggaaactgatgatgctactggtatccacgtcataccaatcatttcaacaagtcccctctaatctatgcttgtcaaatatcatctcctttctccaaaatactttgccaatcatgaagaaatatcttcaaggtaatattatcaagtcttatttacttgctgatcaacttttcgcaaaataccccttgcggttcagtaccgctaaaagctcaacaaactgctcttgcttcaataaacatcaattcttagccccgtaagggttgagtcctattcttgttttgataaccctggtaagaatactgttttatttttgctcaattatttttatggacattaaacacaaaactaaatctaatgaaataacatagtagcatattactatagcagatttgaatgagtcccccatgtaaccggtaacttaccactctgactccattgtctcccttatcacccacttttgtacaccaatacaaataaataatgtgatgacctcgattctcagtcttttatatgaaccagatgctttggatgtgcttctaagatttggcctttgagtttaagaacaaacattctgttagaaagtaatgttgaatttgccaactctgttgtactttgacctggggcaccttggttatttggtcccattatcatagtccaaatgccccaaatttatggagcaaatctgtgagctgatggctggaacaggactaaaaagagttgcttaacaagtaccttcctaaaaaaccgtgggatggaagagtgctattcccttataaacataaaacaatggttagacaggaagaccattgtactaatttaagaagtgattatttgttttgtagaaagagctgaaccaggtgatgagtgtgccaactgcgaagttgccttgggagctttggttagtctggtggcatacttatgtacacaatgcagcaacaggatatcaatgctggataacaagatttctgattcctacaaactgttggcaaagatactatatttctgtttgggagaagctattgctcttgcaaaacttgttgatgagattggatatcatggtgaaaattgtacaagcaatgaacttatgtcaggtagcttcaggcattgcacacaagttgttcaggcttcactttgcagtacaaccatacaggtaaaatagctggatttgcttactatgcatgccgaaaatgtcatgaagtgttagtatctaagaagatgattcctctaaacaggtacaaatgttgggggtacatgttcttaaagtctctgcacaaagagagctagctgaaggctcacaaacagcaacacattcttttatggtgctatttgtggaattactggcagatgtgttttctgtgattcaaactgcattaaaggtactatttggaagcttaattaatttgggattgtaaatttttggcaagatcagatggcattccctgacaactttattcctccagggatgttcgagcaaggactctgtcagtgtcattgatgaatgtctaaaattgcttttcctcttccattcgctagcacagtcaaagaaatgcccgcaagaggctacaatgcttctgctggatgccttactgatggttttctattcttctagtgccacgggttcacaggtagcacaaattagttagctagttctcatcatgaaatcaggtaaatgtacaattgaatccagtttgatggtctttggctgtgctgatctgatccaggaactcactgaagtaaacaacatatccaagaagttgttctctcattttattcagattccatctgctgccatacatatcaaagatataatgttgtcagcagcacctacaaaaagacaactacttcaggtatttgcattattatgtactgactgatttacatggagctgaacttaatttttttcttttagattctgactttcatgtccatttttgaaaatctgtcaccctactctttactctacagtatgtatatacaattatgttacctacactatgtttgtgctaactaactgattcccatgctactttattttgctgagatgtgacacagcgttgctgcatttttaatatattcaaatttaggtgttctctgaaaattgtatcttaaataacctgtgctgtttgtaggacatgatccgagcttcagtcactcagggtcagacaatagtgcctgggcatatcagcgcaaattcagagcagaatgctcagggtggctttagtcaagaacctgggctcaatgccacagatgcagatgaagagaagaatgaaaaacaagttagtgatgatgattgggatgatgactgggataattttcagtctcttcctgcacatggtaccaacaatggtgcagactctgctacagctgcctcacctttacctgaacagggttctgttgcaagtcctcatgacgaacagatccctcaggtaaatattaatcaagaagttagtgatgtagatgtttcagatggtacaacagaaggcctaagttcttttgataaatatcttaaagaaccctccacttcacatttctcagatactgcacaacaggtcgagagcaaatctcaagagttctcctgtaaggatcatgaggaatccccaaaacatccaaaagttcattgcacaggatcatcagctcatgttactaaagaagagacggatgatgaatcacagcagattcacggtgaccaatttgtgagtagggaaagcaagaattatgacttgtacttatcgaatgagatcgctggttcagcaggtgaagaggaaaatgatacctctggagaaattagaagggccacgggtgatgcgctggatgaaaatatttcttccgtagatgattccaacttgaataatatttcagatggtacagaggataaatcaaataaggcttgtgacaaggtgttggttgccaatgaaaaatctgaaacggttatcacagactctggggaaaaggtgtctgcttcatctgatgaagtaaaatcagatttgtatcctgaaaatgtggataccaaaccagaatcatctggtggtgaaatcgcggagtcagggtcatgattgtgaggagccttggtctagacaaaatctagatcatttgggaacacatccatacaggtgactgcatgccaggattctggaagtaaacagcaaaagctcctagtatgtgtttgtcaagtcccattcttgatactgagctcaagtaatatttgttagaatatgagttctcacaagtgctgtcagaaggaactattgctctgaaatgtttgtcagatttcaaggctggactttggagcaaacgaagagctggcagcggcatgtacttccaaagtcaccactatacggactgttgtacattttacccaactttttactcatgtttacatgctgtggaaatgtagatctatcagattattcttgattgtcaggacaagctggacggattgtatacattactgactaccctgtgcatgtgtttgacctcatgtcccatgttgtgaacatggtgacagagtgtggtttgtgattgtaaacatgctgatcaaagcattctggcgttccatatgttttaagattatcaggccagttgcatggcgaaatgatgtttgtttggtgctagctctggttgttcgtgcgaataaataagtggaagctacaatgccatgactggtacactccacatcttataatagagatgcacaaaacaaacaaccgaaaagaacagaaaactagcttcaagtttttttctcaacatttgaaacattggggaatgcggaggaatccatgctctcgttgatgctgtagcaacggtaaaagcttctccgctccaccgtgagctaagcggatagagctagtctgcccaactatcttgtcgtcaccaagcaccatcctcatgccagcagataatctgtcccctcagcattaacgtattcattgctggcatggcatcatcgtcatagggtaccatcttcaccgagttgctgtagcttatctcactaaaagccattgccctactccattgccatatcacacgaaaacgatcacgctaccccaccattgtcggtgtagaaccttgcctccaccgaactgtcgaaagctggagaatcgcgatcaccacgccatcttcgccgctgacctctgccactacccttggcgctgtcaactgtgttcggctttgctcctagcgcaactccaagcagaccaaccaccaccaccaccaccaacattgccattgtcacctaggcccctagcaccgtcattgtgcacgccgctagtgtgtcgccgttgccggcccttccacctctaagaacgaacctgtcatcatcatgagctgcccaccactaccgatcaacaagccggtattgactggcctctgacttctgccactgccaccatgcctccctaactccgagttcgacaccattatcgaccaccagttcaccttcgttgttgccatgaaccctcgctaggcgaggccgatggaaccgtccgcctccaacacgactccgctccacctcaaccagcgagaccgggaggagcgggagggaggaggtagaggaagccccaccacccctatcgccaagcagcctcccgcctccatctccatcaggctaggctgctccaccatcaggggtcatcagcaccatccgccccaactcagatggctaggtggggggaacgagagggaggggagaaggagaggaggaaggtctaccaccactcgcctccatttttgcagcgcctctccgcgttgccaaccgggtcaccaccgccacctgcctctaacgccgcactacccctactcgggtgatgagactcgggaacaggagcgagggaggagagggaggaaggaaagccccaccaccaccatccttgcagcagtcgagggtgcgcttttcaggcaacgacgaggcggagaagctggtggcggcggtgcttagggttaggaagaggaagaggaaaagttaaaagaacctcacaatgcgtacctataaatgtatcatgataaattaccatgccattttaggatgaaaaacacaaaagataaggtttgtaatgtcggttgtctttccaaactccccgcatttgcctttgtctgtgttttcctcggtgaattaccatgggagttctctaaacgatggctagccaaaaaagaaaaaaaatgattatttcagcggttgtaaattccaattcaattgtttagtgatttaaacaattcaattgtaactttaaaaaataatttttctgttttccgttaccatgttttataactgctaaacggtatatttttttaagtaaagttttctatataaaaatttctttaaaaataaatttatttttcaaatttataataattaatatccgattaatcatgagctaatgtcataccattgaaaattgatacttcctcatcccaaaatattacaatttactactccctccgtcccaagataaatgtagttttgtacggttcgtatccaactttatcggttcattttagaaatttttatatgattagtatttgtattgttagtagatgataaaacagaaatattacctgatgtgtgactattttttttaattttttaataatttttttaaataagacggacaattagacgttggacacagatactcacggttacacttatttttaggacggaggtaccccgtgacattttggaacggaagtagtactcgattagggtatgtctcgttccacgtgttacgcttacgtaccgaaaatcttaccccaactgtcctcatctgaattcatacgcgagctcatttgatcaccacagatgtccgctgcagtctgtctgcatcatacacacagggcgtccctcagtggatgcactcactagaattaatcctctcatcaatttaatggcctataaaattagtaatatatacatcctggaatcggcagctgcaactagctaggagaatactgaatacccgataagagggaatgtaattttcactctcatttctgtcaggaatatatatatccatttattttattcaccgaatgctccaagcacaaggttgctagtagtctcccatttcagcaacttgtagtgcagatccctcactgttcaccattggttgggatctggcaatctctgctgcatgcagatgcggtaaaacaggtgaaaacgtaccgtcgtcgtgtgggctcccggcaacactaggacccactataaaagcgacccataggcaattaattataaggtagcaattgctgtgtatggttcatatggctcaaattacgggcctgctcacttttgatgtcaaaaaaaccttactaaaatttggcattgctaaaattttggcaacttactaaaattttggcaggatttcttatatagttaccaaaatttagcagcaaactaaatgtagccacttttttaggtaactttaccaaaatttggtaagattaaaaatggtatcaaagtgaacaggccctacaatgcagttttgtgtgtgtgcgcgtgtgtgcgtgtgtgtctatatatataaccggttttgagcctgtatcttttttttgcggaacctataatataaagttattcccagtgaccccacgagcggtgggacccacatgtcagttaccacgttcctctgactttacatcagaggatctcaatcccttttacacatgttacccagatggtggctacataggtgaatctcacaaaatcttactaagagagatgtacaagcttgtagcgtaagtgtgtccaccatgataaaccacaccattaatattatttaatattattgtagattttacaaaactacacatctaaggttgggtatcttaattaataaaactacagattttaagaatatataatatcttaaaactaaagatttattagcatatgaatatctcaaactacagattttcgatcgaggtttcgtcctaacattatttttccgcatggagcctttaaaatctgtagattaatttgtgacaataccagtgctaaatatctatagtttgagacattgtggatggaatttataacactaaatctatagttttacgggagttatgttaccctagaagtgatatattataataggacataaaggaatatctatttttctccatacatgggcttgcaacctttgaaaaattagggagacgcaaaagctacgaatattttgtaaagctagttgagtatatagcatcctccggataatgattagtgacatcaagaatatacgtggcttgcagctacgaaaaggcctgggagtgttcccctcaaaataaagttagaagattttccaataaaagatcatatgcctgggatcccttttgttttctccctagaaatgattctgattccctacattgcatgtgctttgctgtatgtgcagattgagacaggtgcaaccgtgcaaggtgatctagtcactacaagaagctcaagtagctctgatagacaaaaaccactactgcaggaaagatcataggtgccagttcgaagaccctcataggtgctggtttcgagcccggtaccaattacccaagacattggtgccgattactgaaccgacacctatgggcattataggaacgaaccggcacctatagtgatctcggggatgacctggatgctttataggtgctggttattgataggaaccagcacctataataccatataggtgccaattctatggtttttttttgctggcacctacaatgccacatgggtgccggaat

SEQ ID NO: 77453 - DNA, 1393 bp, Oryza sativa
ctctatatgcgggttaaataaacctaacattttttttctaatatcgcctccttcaagcatccactctagtccggtctccaaaaaaggatcatattgcatgcctacaaaaggttgagtgggtcttgctccttgcaccaatgcatgtttgcttcgcccacttccagtagtgaatatagaaaatgtttagagcttagacaaataaattaaagttagtattgctatagggattctatcttctatcctcctaataacataaaattttaatggagcatccgctgacaagtccgaatggctgcctaggactgccaggtcttgaatccgcctatgctcactcatctttccccgttgccgtcatccacttgcagcaacccttgcctaggttgttagcatctcctctccataatttcgcaatggtagagcggctggtatcggatccgtttaaatatcgtcttgtgtatgattgactatatatttctggttcttgcttcttgttcctatgacaaaatcataatttctaaaatttccgatgatgttgcttaattagtttttgggttttgtttctggatattctgatgatgttttctatttttctccctttttttattgagatgagttatctaatccttccctttacaaacatcacagaggaacccaagatttgattatgatcttatatatatgccaccttcaaaatccagtcagaaattttacttctcaaggctttgctcaattgctccccttttctcaatattaggcctaaagatgatcaataaactctcaggtgtaacatatatttatgctctcacgcaccgtacgtgctgatatcagggatgacgtatgtatatattcatgtacatacacgtacggactgttatttttaattgtccactagctagtagtttagtactacactccagtaattttatatcccatcagcgcggtgatctgtaggaaacttaatcagggacggcatcgtgatcagtacggacacaaacgcgagacgataagctatcgccatcacattcaattcatgtaatgtcaactccttcagtacggaaactaataataacgacgattcttggatgttacatataggcttaaaataagctgatctactatcgggtcattggtaacagtataattaaacatttgtacatatattatagtactgacgacacagctcgagaaaatgtttgcaagaataataataattgatctgatcggtagtgcattggtgtgtacatgctgcccatcagctatcagacgggccacacatgttcaatgacagaaaccatgtggtggaacatggatcccaacaatgatcagtgcaatcagatcacaacttgtcctaaggttaattagttagatggtgtatatgtgtatatacatatag

SEQ ID NO: 77454 - DNA, 1144 bp, Oryza sativa
gttacaatgttagctaaaatgagtcgctacagaacaccgatgccaaaatatgtataaaaaaatcccacaccgttgtacaaattaccgtaaatttaccgtttacggcaattttcaattgtatcaagaaaattttctttggtagggacggaaacaaaagtagtgcacctattacactttaaaagttaaaaaaataaaggtaaaatcatgtaaaatatactaattaatccttatagttaggaagattgtgattctgccattgttctttttttttggatattgtgccccatttttctttaaaggtgaccatatttggactggttttattctctcttttttggactggttttattctcctttttttggaatggttttattctccttttttggacttttcatatgtcatacaatttaatgtctctagaaaatgtctctaccattttatagacattttataaaatatcttttcgtttatagaggcaattcaccataagacacttattagacatttttttaaaatgcctttatagtattgtaaaggtatttgaaaagcatatctatagttataaaaaagtctctataaagcatttttcttgtagtgttatatcaacacgtatatatacttgtatttgtgattaattatttttttaagtaatagatgatgtacctaaataacgatgtatctgtgatctgtgatgaagtttaatattaagatacaatctttccattgtgtttattggagttatgcatgtactgatgtgtgtttttataatcatgagtatgcgtattaacttaacatttgtgtgaaggaattttctatacatttgtcgacaaattttcttttagaaatttaacaaatgtaattatagtacaattgcgatataattacactgtaactttccatctaactataatacaacttgtatgtaactttcaaaagtctctatgtaacatgctatatttcggcgaaatgggggttgtgggaacaaatcctctcacacgtgtgcgagcacttttttccttccgcacttgcacaaatcttgaaacaaatctaacagttcaaaattacgtgaaagttacatacaagttaaatattgtagttacatgtaagttatagcgtaataatatgtaagtttcaatctaatta

SEQ ID NO: 77455 - DNA, 817 bp, Oryza sativa
aacaccaaccgagaccaaagagaggtagcagcggtgagatggtccttttcttttttttttctttttttttctctcgaattaagtgggatacatatcccaaatcaaacctcaaatacccaaatcaaacccaaaccaaagtaacatcacaaatcttatacatcacagatccatacaaatgtacaatgaatcacaatattgtccatacaaaagtacatcacagtgaatcacaaataaaaaaacaatgttgactgccgctgtcgccggccgccggccgcggccccatcggccgccgtcgcacggccgcctgccgcgcggccgccgcacggccgaggccccacctaccgccgcccacggccgcctcgctccgctgccgccgcacggccgcctgccgcgcggccgcctcgctccgccgccgccgcacagccgcggccccaccagccgccgccgcgcagtcgcctcgctccgtcgccgccacctcgctccgtcgccgccgcccggccgcagtagagaggggaaggaggaggaggaggcggggatagaaagggggagcagagaggggaaggaggaaggggaagggccaggggaggaaggggatatcgaggaggcgctggaggcggataccgagagacttaaagagaagagaaaaaaaaggggacttaaaggcggggatagcatgggaatctttactcccggttggtattaccaaccgggactaaaaatacatctttagtcccggttggtaactccaaccgggagtaaagcttatgttgatctttagtcccggttggtaacaagatccctatctttagtcccggtt

SEQ ID NO: 77456 - DNA, 9425 bp, Oryza sativa
aaaaaaaaaactggaaatgtatttaccaagtgaatacaaaaaatgagaaagctgtaaaaataataattaaaattgaacataacaaaaaaaaagtaaccttcaaattgcagtcaacagatactttctttttattcaacttcagcttcaaagatcgcaatagctcctcttttgatatctcatcacaactagttttagagtcctaaaaaaaatagtgaaaattaatcatgtaattagaaaacacaataaaaaacacatataagtctcttgcttcattgtacaaaaaaaaaggaaaaaaaattaagccagaaatactcacttcactatcagaaataacatcatcattttcagaacttttagaatcagaacaagtagaatcaacaaaaatttcatcactatcctttgcgtgaaccatctattaaaaaaaagaaatgtgattacacaatgggaatagcaaacaaaagcaggagcaaatattttaaataatgctaaagtaatcaaattacatataacaagagactgcaaaagtacttggacaaaagtaacctatgtaacataattgttcaaacattaatccacagaaaaaaaaagtctgcatatagaataatgttttcagttactgaaaaagatgaaactatgttattaagtgcattgctggaggatagcaccaaatgcattacatgaaccttatatagctggataaactcacactcacacagccccccccccctcaaaataaacactgtaaggactcaacaaacacaggaaatgaaataggtatagtactattggatcaaatattacaaatgaaacctaaatagaatagaggaaatatagttagaacagattgaagtaatgaaaaaacttaaattaacttcaaaataaaactactacagattaaatcatttcatttaattatcatttgtctttgtcatttcctgaatcatggtacatgcatgaatgtgagcttatagtttatagttaactaataaaaagaggtgcaaccacatatcaacccatcatttcattaagcatgttcagcagagatataatgccagctccacttgagatgacaaaaggttccaatccaaaacaaaaacacattaaatcatcaatttaagtgacaactgatgtcacgaaggaaagtgaggatgaactttcatcagtgcacacacagacacttcatctaaggtgaattaaaaattcggtacagctatgtcttatggtgcttccaatgaacacaaatcatataaccacactcacttaggatcacacaaatcattcttagattcaaactatatatttgcaaaactacagatctgagcatccaaacaaaaaaccaaaacaaaagtaaatcagtctagggcattggtaaacagatctacatgagaaatcaaactctattaaatccagttaaaaacaacttcagatcacacatagtgttctacataatttagtacattcattttcagatctacaccacatcaagttcagacaaataactaaccttaactgaatccaccagatcgaagcttcaaacacctaagagaacacgaccctgcacaacatgagaaaattaaacaacatgatctaatcgcacatgaacaacatcacatcgttgatgaaagccaaataacacaatctccaaagtaaaaaacataagcacacacaaaatactactactcatccaaaaaaacgagatcccaaaaatcccctcctcataaacatgaacaaatcccttcctcatcaaaagcaaaaacaatccactcctcctcaacagcaaacaaccacccacctctccccccaattaacagcaaaaatcccccactcatcaacagaaaaaaatccactcaaaacctcaacagcagcaacaacccttcccaccgccccacccacctctcccccccaatcaacagcaaaaatcccacacacatcaaacagtaacaatgccccactcatcagtagaaaaaaatccactcaaaacctcaacagcaacaacaacccttcccaccccccacccacctctcccccccccaatcaacagagaaaatcccccacacatcaaacagcaacaatatcccactcatcaacagcaaaaaaatccactcaaaactcatcaacagcaaacccaaaccaaaacgaaaaaactcatcaacgcatgcagttgagcagattcaggtgatgctcgaaggggaatggaggaagaatggacgaatctaccaacgaatcgccctcacgtcgagctactcaccaacgaatcgccctcacgtcgctccgccagaatcgccgccgcggtgaaatggccttctgttgacgacgacgaaatcgtcgccgctctctgctctcctctcctaaaagcgttctctctctctctctctatgtcggaagaaatgagaaaattcagtaaatgtgggacccacagaagagacaagaaaaaagcaggcgcggatttcaaaattgaacagttgctgtgggacccacgaggaatcaataaaaaggccagcccaatagataaaaaagatcggtagcccaaacagagaagtccatcccacaacccaattattgcacgaatcttaaacatgatggacggcccaaaaaacgaaagatggagcccagcaaaatctgtcgacagaagagtagccaatccgttaaaaaataggtaagactttcgggactattttttgtccgtcgtcgttcgtaatccgcatcacgcttcatcctggtggccgctatctcatgcttaattagcacgtaccaccgtttatgaatttgaaaatcttattatgtttttcttctagcataacaagtcacgtcgcatacatttttattaggagatgtatcagatggttttgtgttccatgactttgtgtaatcgggggtgagcatgatacgacgcggtagcaagccttatgagcaaagatcataattcacaacatagagaatccattatatgcccctgactttactctagttcaatgatttgccatcttcctctataatatgccaccgactttgataattttttctacaatataccagaatggatacttttcaaaaatacctaaaatgcccttcaagacacacaaggattgccgattgattggctcattataagttttgaaaaaatatgaaagttttagtgtagccttcttatacgatataaagtttctgtacatatttcaagatttttttttcaaaaatatttttatgtggtatatgaaagatgaatcacatacacaaaacatagctacattagaaaaataattttgtgtagcatatgaaagatgatttacataaacgaactcaacgctagagtatttattagcatatgaaacataaactatattttcaaaaaaattaatacatgcaaattgaaaatcttaaaatccacacacacttcatattatgtgtggggactatgtaaaaagttttatatgtttgcaatacttctagtaggtaaattaattgtcaaccctctatggcttgaagcacactttaggcatttttaaaaaagtatccaccccagtgacatattgtaaaaaaattatcaaagtcggtggcctattatagagagataaagtcaatgacgccaaatcgtttaactggagtaaactcaggagtatagaatagattctcttgtaatatataatatataagatatcacggttccaaatgagtatcagtttcccataccaactcgcgggcatctttttctatataacaaaaggaagagattggagggccaaaacacagtacacacatcatcagagagtcctactgtacacacaagaccataaacgctacggatactaatacataaatccccacaacattattgtactacaggcaggatgacacacggccggtgtcgcgaccgagaaaaatacattttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctacggctacatcttcacaggcgctcaactggggtataagccaggactccacctaggacttcttcttcaaagcttctcttactgaagggggggagattgagcaagaatgagtacaaccatagtactcagcaagtcccaccgggagatgcatgattaatgcgagggagtacaaggggtaataatataggggattaggttttgcagtaaacagcatttaaaagacacttagttgcccaaagccattttataaagacgatcctagagctacatagtgttattaatcaaggccgtgaaccctcacgaacctgccttaacccaaggcctacgatgattcagaccgaactggcaacccgaccctaggtcccagctcgtcccaagccaacccaggccaaccattccacattttagttgttaagcaggttttaagaattaaaaaactaacttggtacattgctaggcttgcccataaccgagggcgcggctattcgaatagattatactctgatcagaggtgtacatctttacccacaagacacatcttcctcatgtgtaaccacgtgccacataccaccacggcatacggatgaaagacgtgacatagttcctaacccatcctagccataaacaagagtaccgacccaaccccacctacggccggaaccttcgggacaggcaggcaggattgagcccctagcagcaggacaccagccctgtgccatgacatctccactaccgggccgcagctcgtgtagccttcatttgtcctagagatgtccatcgacccccaacttcgtccatctccatccgtgtacttttgtttataaccagactgagtcacaaactaagccttacccactagacatgtggaagtacggtagtgctttgcaacagaggcccgagcttaatccttatagtacccgaggtacgactaacaaaacccaaccatgcacctcgagcccagcctaaaaccattttgggggttttgaatagagggggaggtgtgtgtccaattccaacataagccaaccattccatagtgtccaaatgatatgagaattcccaaagtctaaagttataaaaccacctaatgttgcctaataaatcagcgaagcatctacctaaattcatactagtggaaccatgaatagagtacccactagttggggttttattttcctagggtgaacaaggtaataataacaataacaacaatgataaggtcataacaaagataaataggcatggctaaataaaatagtgataacggggaatttaaataaagcgataatgcattaatttaaatcaaaataattttataaactggaattcaatatgctcaaggatgatgtgacttgccttgctcagagacaacggccttccgaaccttcggcgacgaccacgaaccacgcttcgggaacctccggaacgacagaagctacgcgaagcacacaagcaaagctacaagcctataaagaagcaataacaatacataaaaagaaagcacgcggttctttaggttataacaaacattaggagacttgaacggatcggttcggagctcgtatgaccaagacatggtcatccgaagtttaatgctgttatatggagatttgcggattattataattaggttttacaactataaaacatgtgcaagcgctagcctggaaaagacaggaaggctgcgctgttgacatgcggaccccacatgtcaacctaagggaccacggcagaccgggtacacagagacggtccacgggtcgacggaagcggatcccgtgtgtcaaccgaggcgagtggccgacaaacggactccactagacaccacacggcctgcacacgtggaaaccatgcggctaccgagcgggcacactaacacggtcaccacacacacaagcgaacgactaccgacaccggtacacgggtaccggggtcgacaaccgcacaacgggcatgggcgacaccgaaaggacgaggacgggggcagcgagaggacggatccttaccaccatgcgacgaggcgtgggaacgacaacgacgaacgggcgcggcggaggcggccgggaacgacggaggcgaacggcgagggagcgacttcggcggcgatctttggacgaaggcgagacgcggccggcacaaggcttggcaacgcggaggcgaggacgaagacgacgacggggctgcggcacttgagggagtgaggacgacgaacgagaacggcttgacggagggacgaacgccacgacgaccgggaacgacgagaggacgacgaccggaaccggcgaggaggcaacaagggcagccggcagtgctgcacggagacgaggacggcgtggaatgcgccgctgcgatgacgacgagggtggtggcgcagcgagacgacgagccggcgaggaggaacgatgacgacgacgacgaacaccggcggggttcggtcgaaggggaggcgaggccgaggacgaccttgccgctgcgatgccgaaggaggagatggcgacgttggacggcgcacgggcacggcggaagggactgccggaggagacgtcgatgaggaggaaggagaggtcggcgcggcggcggcggtgttccggcgaatccgagggcaggccggggtggagggcgaatccgcgacgtcgacgaaggagacggcgacgtcggccgacgctctggcgcggcgactggggctactgaaggcggtacagtggcggcaacgccactattttgtcggtgaggacgcgtctccggtggtttccccgcgaaacggagggctgaccgggggagagaaggcggctgcgaggccgctggtggcgacggcgcgaccggacggcgctcgggcgaggagggagaggtggctggaggcggccggcgtgggggaaagagaagggcgacggcggggaggggttatacgaccacggggaggctcgggatgaggctaaaacgatagaacggaggatgaggattccattttataggggaggagagggagccgggcatgggagagggcggaacggcgacgggaaacacggccggcggccatggaaggcggccgggaatggcgcggccgttccgggcgattgggggcgccattccagggggaaaacgggggaaatcaaagaggaatcaatggggactaattccccctatttaattttggaatcccatgattaaatcgcacggatttaagggaggaaaggagctagggttcacgggagagggaggaggccgtgcgggaggaggaagacgaccggcgcgtgggccccacgcggtcagcgcgtgcagtcagcgcgcgtgcacgcggctggctcggctcggcctggggggcgcggcttgggccgggcggccggcccaggaggagaggagggagaggaggcccgggagagagaggggaggggagggagctgggccgaggggaaggagggagggcggcccaagagagagagggggaaggaaaaagagagggaggagggaaggactttggccgcgggccgagagagagagggaggcgacttggcccaaaggaggaaggaggatttatttttagttttctttttaataaactttgataaaggttgttgttgcttaataaatattttcggtgctctgaaaattcaagtaaaatttgagggctccttttagaccaaggagaatttaacaaaaattctccggaccacattcgaatttttcttgtatgtattttagtgtttgctaattttttttcgaattttaattaattctattattccttttagggaataatttttatttcggaatgaatttaccagtacgtgacagccagcgccgtgtgggtgaccagcgagatacagttcccatcgagcacacactgcacacctgtatcgtatatgcaataaattcagcgcaccatcgttttatatccagtcttgatctagccagttggctatggtgatgtttgaatattaagctgaaggtaagattaagtgttacatgtaaaacgaggtaataataacgtatgattaattgagttttaattattataaacttaaaaaattaattaatttgataatttagagcaactttcatatagaaagttttcgcacgaaacttaccctttagcagtttgaaaagcgttccacgagtatccaaaatttcatccaacaagagaaacgaacgcagatttagattactataaacggattattacagcatattatgtatgtaataaaaaaataaattaaattcatcgcaaaaaataaaaataaattaaatattctaataaataaatcttgaatattttaaaacaaacagtgtacgtataaagaaaggttttttgagagagcctgtttgctgaaaaatagagaaatttattaatttcagtaatataggattaataatatgaaaagacgtatttaattttcacttggtcgatctctatgacacgagtacacgactgcgctcatatgcctatatattaactgagagcacacccacaagagaacggtactttgtggtggtgataacatggcagcgtcgccgctgccgaggtgggctccgacgccgagcccgacgaggccactgagaacgccaggaaccccgagcgccggcgccggcgccgcctcgtcgtcatcgtcatcgtcatcgtcgtggcgcagctgtgtgccgttactcaccaccttcagttccgtcttcggatcatcagctgcgcggcgcggtggtggtctctccggcggggagccaccgccggcgctgccccacgccggtcgccatgacatcgtcggcggcattgcgcctctcgacggcgtggaagccgccgtcgaacggcgccggaaggacgagatgatgatgagcgccacgacggcgtgtagccgtggggtgttcctgacgtgggacgatctgtccgtgacggcgccggcagctgccgccggctgcggcggccacggccgccgcgccgtgatactcgacgggctcagcggctacgcgcgccccggcgaggtgctggctctcatggggccttccggctgtggcaagactaccctgcttgacgccttagctggtaattactgataacttacttctaaagcaacttttattcaacagtcatatataaacctaaataacttgtgtgttcattaaaaaaaagtaaacttgttttcttcacatgctgtgttaattgatgcgccgagtattatgcatgggccgatatactgttggatgtgtgtccatgtttgtgcatgcgctatgtcttgtatatattccgtggattattatagactagataatctatattcatgtaggagtgacaattaattggaatgggcaagtggacaaaaacaaatttaattaaagaaaaacaaaaacaatgcacaaatgtaccaagcaatgcatctgaccgttggatta

SEQ ID NO: 77457 - DNA, 3911 bp, Oryza sativa
aaaaacagacagagattaattaatttgaggtgaaagttggagttcaagaagaaactttgattggccaaaatttggatatatattaccatttttttaaaatgttcaatttggtgtgagtcaaacacaaatggtagttcaattttttatatatggagttatagatcaaaatggaagaaaatcctaatcaataattactgaaggcaccttgtaaatattttctgtagatcactcactgcatgcttaaataggtccactgctcacgatttgacctttctttgtgtgtttttagttcttcgaatctaatggcttcccatgtcccttgaggaggaatccttctgatcacttcctgagaatgattaacaaagactttgaggtataaaatgaatatagaagctttctctatcaataaaattgttatacagcattaatatatatgctatatcattagtatgtttcttgacactaactatgccccacttggagtggtgatgtatgaataggaatctgaagaaggatctaccattatttctccacgtgctgccgaagtgatccaaaaactaatgggttctttcaaatcttgtggtaccttaaggacagaaaaggaagcatgtgcaatgattaatcaggtgttttttctcaaaagagtacaagtcatgaaaaaagggatatttttttaaaagtaagttattgttctgaattttaattattttcaaacaattatttgtgcaggggcctctccaattcctcaaaggcaggcaacattcttgaccaaaacatatgtgctaaccaaaagatcaattgttaacatgcacagagatgcaggctactattggttgcgatttgttatctacattgccatttgcttaagcattggtacaattttttttaatgttggctcaaattttgcatcaatccaagtaagtgatctcaatatatatgaggtaaagttgcagaaagttggagtatgtgacatatatgggcttcttcatttcaggcaagagcttccatgctaatgtttacatcaaccctattaacaatgatggcaattggaggttttccatcttttgttgaagatatgaaggtaaatttcgaaattaagtctgcacgtgcaggagcttccattgatgtgtgattttcatggttcagatatttcgaaaagaacggatgagtgggcattatggtgcaacagaatttgtgatatccaacacactctcctcaattccatacctaggcctcatctccataattccaggggcaatagcctattacctgacagggcttcaaagaggaatagaccacttcatctactttgctgcagttttgtgggcctgcacaatgctggtagaaggattgatgatgattgttgcagcagttgtgccagattttctgctagggataatcactgcgtctggtgtacaaggtgtactgatgctcaacgctggtttcttcagactcccaagtgatctgccaaaaccagtttggaaatacccaacatacttcatctcctaccacaagtatgcaacgcagggactgtacaagaatgagctgttgggcttggtctttgaagatattggcggtggcgggctcacgattagtggcgaatacatcctaaagaattacttacaggtggaattaagctactctaagtgggtggatcttgcgatattagttgcaatgatcataatttacaggttgcttttcttagttattataaagatttccgagattgtgaagccaaggatgcttcactttctctgtgcttcaaaggtatagcattattctagttgttgttgagtacaatagtatccatggaacgtatgtagatccttcttatatatctatcaataatttatcgtgatgatcagaacaccatcatgtataattgtatattactgaatcaatgaaattatctctccttttatcccctgaaaaaaactatctcgtcatttgatcagaagttcactttactgagcttcccttctatttcaaggcagaaatgtttgtgaaacttgatctcacagggcacattttaatgcactatcaaaaaaaaaaaagaatgcatggtattattttactaacaaatagcacaaaatagatgccagtctatttgagctttttccctataaaattagcgagattttcctatctgtgtggcgggctacacgaaaccaacagcaggtagcagagttggatgggttgttactcttgctgcctacggtgttttggcttagtttagtttcctctgttttctgtactcttcaacattttcttgctcatcattctcgttcactatggagtctcgtttgttcgtccaagtctcccacgcggcacgatctggcgtatgggatggcacacgctgtgaaggatcatgggattgcggacgatggccacaacttgttcccgtttgaataaaagggagaagaaaccacacaaattctgttggaaggcatcctctcctgattttcggctgacacgatgaagcgatgaactctgggcaaggacccatgttgtgattgagatcaactaaaggaccgaataagaaaaaaaattatcagaaagaagaggtggatccagttgtagggcagctagggcttaagtcctaggtctgggttctataccccatgtaaatttcatgtaaatttataaaatttatatgcatttgtatatgaatagaaccaggtaatgggaataagccctaggggtaagggtgcaagcggctacccacaaaaacccacttatagattaaactaactcactaactcgtttattttgaactataagtgggtttacggatgacccacttgcacccctacctaggggtgggctctggctggctcggccaccgcttttcactaacgataagaagaaattgaaagagaaaggatagcttgcaaagttgcaatgcctcactgagagtacatgtgcattatcaagagttcaacggagatataagagatgttcaagtcgaacacgaattgttcatcagcaaattttcaaaaattagggggttcgatatattcttaggctgcaatccttccacccagctcccaacccctctccctccttttcagcgcgtacgtttttctaaacggtacgttttttataaaaagtttatatacgaaagttgcttagaaaatcatattaatctatttttgaaaaaaaatgacaaatacttaactaatcacttgctaatgaatcactccgttttccgtgcgtaggagttttgttcccatcctcccagcgaacacaaccttagtatattccttctcaagcctttgcgaaatgatatgccttttgatggtaaacttatcaaattgccgtaaacaattgtcaaatttttacggtaatttgacaagtttacaataactattcaaaacgatgataaatttgtatacccctttgttccacttcatttaataatcacattagtaaaccagtgccacgtacctgcactcctcacctgttatgtatatattgcaatatcctcatgcttttacaaacccatattaattaggtctgccagtgtcaatttcttcatgagtacaccgatcgtacgtcctctgttcggaaaggattacttgaggttattcgtactcaaaataaataccatcttgctgagaaatttaattatctgatggtgcatacaactaactgctggcctggaatatatgtggtccacaggtacaagagggcagacacaacactgtaacagttatcaatgttgacgataacacaaaaggcatatatgtatatatccaatggcgtttgcctctttgatctgcccctgcagccttctgtttggtttcgaaacaaatgttccccttctccaatatttcttttcatgatagcgaaaattcgttgatgtgtacgtccattagtgtaggctgtaaaaagcgatagggctgcaggaa

SEQ ID NO: 77458 - DNA, 2197 bp, Oryza sativa
tgtggccagatcaataacgatcaagacagacgaaaaaattgacggaagtgctaaaaatgggaacagggtgaactttggatgctattaaagtgaaccggtaactttcggtgctataaaaccaaaaacgtgaactttcgatgctatataaccaattttttcaaataaaaaaaacgaatgacataaaaacccatatgaaagatataatatatttgcaaatatgaaatattattaaaatattttcatgtaatgtataaaacattaagttattacatctgaaacattataaaatacaaattggaacattgaaaaaacaatatgtgcaacatttacagatgtattagtgaaacatagcgtactagtactagttgacacatttaaaagaataaaaaatattttttcatcagaatatagtcatgtgtgattttgttctaaagatttaattgcaacaagtttaatagtgtaatcggattgtaaattggagaagtgatttaagaaaaaagatcatttaaatataaaaatgtatacgtgcatcggtgatctggtaaagtgctctacatagagcaagggagtagtaaagtgctttgcatggaggcaaggcagtggatagaagcatacatgtgatgagataatgttatgtccgatatttcgctggagcgtcggacagccgacgcgaagcattttcccttttttatcttcggcttttttcggttttttccatctgctggttttttactctctttttccagtttttttatcctcttttttttcgttgccatccttttttttttcgcacgcagaagggtatgcgtggggtaaggatttgttttttttatatgccatgttttttcttgcgcggccaaagcctagcgtgtccccatgcgttccctccaattgattgtaaaaatcgattccccacagctcccttgccattttcccccataattttcccttctaattccactttaattcatcaaatttaatctccatttaaaagccatcgtttttatcctgagttttgcaaattcgctccgattttgataaaaacagaaaaaggagatcaagtgtataaaaggagatcaaccaattttaaaacatcgagaataattcgaccgaatttgatgagaatgattcattcaaccagatttgatgagtaggattcgaccggatttgattggaatgatcggttttggcatcatacggacactacaagaatctatttaatctgtgatgaaatttgacgaaatttccatgatgttttcataaatcgtcacggatatgcaactatggatacaaggcccataataccgtgatagtttatcgatttcgtcataaaccggcccacaacctgtgacgttatagcaatttcgtcacgatttaaatacttcaaaaccatataagagaaatgtaaattttgtgaacaatgttactatcactttatcggttgaagaaatgactaaaataaaagttcggttgaaaatgttgtttgcaggttgtcataatttgaaattcaaattcaaattattgaaacagagtaatataccaaaatgaccaaaacaaaagttgtagatactgatgatttatacaactttgttgttgatgacttttttagttgaaatcatttagtatttgaaaatattgtttgaaattgtcataatttgaaattcaaattcaaattattgaagcagagtcatatagcaaaatgaccaaaacaaaagttatagatcttgatgagttatacaactttgatattgatgaccttccagttgaaatcatttagtatttggaaatgttgtttgaagttgtcataattttaaattaaaattcaaattattgaaacagagtcatatagcaaaatgaccaaaataaaagttgtagatattgatgatttatataactttgttgttgatgactttttctgttgaaatcatttattatttgaaaatgttgtttgaatttgacataatttgaaattcaaattcaaattattgaaatagagtcatatagaaaaatgatcaacacaaaagttgtagatattgatgatttatacaattttgttcatgatgactttttcagttgaaatcgtttagtatttgaaaattttgtttgaagttgtcatattttgaaattcaaattttatataggtcaattaaactcggatggagaaataaccaaaataaaatttgtagacctaaataat

SEQ ID NO: 77459 - DNA, 4083 bp, Oryza sativa
ctaaacaaacttatgtggaagcgttgtcaaaaacaaagttgtataacttattgagatctacctattttattttggttatttctccatccgagtttgattgacctatataaaatttgacttttaaattatgacaaattcaaataacatttttaaatactaaatgatttcaactgagaaagtcatcaacaacaaatttatataactcatcaatatctacaacttttgttttggtcattttaccatatgactttgttttggtaatttgaatttgaatttcaaattatgtcaactttaaacaacattttgagatactaaatgatttcaactgaaaaagtcatcaacaacaaagttgtataactcatcaatatctataacttttagttttgtcattttttcatccgataaaataatgataatattgttcacaaaatttacatatctctgttatggtttataaattatataagaggtatatacattttgtaaacaatgttacaaatcactttgccggatgaagaaatgacccaaataaaagttatagatcttgatgtgttatacaacttttatattgatgactttttaaattgaaatcatttagtatttgaaaatattatttgaagttgtcataatttaaaattcaaattcaaatttttgaaacaaagtcatatgcaaaaatgaccaaaacaaaagttgtacatcttgataagttatacaactttattgttgatgactttttcagttgaaatcatttagtatttaatttttttttttaaatttatcataatttgaaattcaaatattatatagttcaatcaaacttggatggagaaatgaccaaaagaaaaatggtagatctaaatgagttctacgactttgtattttacaactttttcatacgagttgatttagtgccataaaaatcgattcaaaatttccaatgaaaattgaaaattttccctccgcaacccttcaaaatttttcatctttcctctcccctctctctctctctcccccctctgatatttcccccttctcactctttttcttactctctcaccctctcttctcttcctctctcggcgccgagcacgagtgggcggcgtgcgcgtgccggcggctggcggccgccgcgtcgtccccgtcgctcgggctgccccctccgcggcggcgccgaccccgacgatgagtgggcggcgacgacaacgagtgggcgacgacgacgacgacgacgcgggtggtggcggcggcgccgaccccgacgacgacgacgagtgggcggcgatgcgggcctcgtccctcccggatccgacggcgggagcggggccggccggcggcggaagcggggaatccggcggcggcgcggaaaatccagctcaggcgcggcgacgacgacctcggcgacgacaacggcggcgggcggtgagtgctcctctcctcttcccctctcgtctcttctatgcctgcaaggacggtgcctcatcgccgttgtcgccatagtaccgctgactggcacccccctttcccctctccccatggtgtcatcctctccgatacggccccttcctcttcttcatcggatggggtgaggtgctcagcggcggcaacgagctcgacctcggtaggctgggcaacgatgtagacctcggtagcagcgcggattgagctggaggaagggggcttgctcaattcgatttcccgggagggtgatggggtgcttgccagatgagtgggggtgtgtgagtggcactgcgacgaagctggtgcctagctatgatcgagtgaaaatttatattagttcaaaccagttttttgggttaatactttctctggtagtacaagcattaagattcgatggaaatatcaggtgttgattcagatttcacctttgcatgcaatctatttctaattttctacttctgtgttagtaaaacttatataagtgatattaccatttacttgcaacaatctatcagtgtcagacctgaaattgttcaaacttggctcttcagttccagctgcacaatttttttgtatgggctttactgatgatgtactcaggtgacacaatcgtacgatggttaaaaaaaggcctaggttatgatgttagacagttcataataagataagggaatttggtaggagtacaatttactctgcaagaaacagagaatttatgcttgttaatccctgtagatcattgagccatcactttgttttacagcagtagctttgctcaagaaaatgtttgccttttactgaaagtttttttgtcctcgcagtgcgaccatcatcactgtcaacatgcccttgtcgggtgcatggctgaggccatctgcatatgctccatgaactcaagctctgtctgtctctggtacgggatggatgttgctggtcaaggtagggctgatggtaagggaggttggagccagctgaggtaagtgcctgttctctgaagccctgacttcactttgttcactattcaagatggaacaactgggttaacatattacctctcttctgaaaatcttagcagaatactcaggtttctggtacatgtttcgtagagtaattttacttcattgcttatgctacccttcacttgttcataattttgcatctcaagcttgtacgaaagtctgaatgtcatttgtttgcatctcaagcttccccaaattacctacactgagatatcacaaatcagtttcagtatttttcagctagaagtaaaagatgcagatcgtctatgttttctttcatcatactagctgttgtacgatggtctgaatgtcatttgttcttctgtcggtgctactgttgaagtatggatgctaccgaatctatattatgttccatgattttttttcctaaattatgtgcatgttgtaaatgtttagtacaattcaggagcagagaaactggctgaacagttaaattaaaaaatatataaatttgctgttatttattattctacccaacagttagaattacgcaattataattacagtcactgcaaaaaactaaactggccaatctataattacgcacagcaaagccgtgcgaccttcctagttagtacgggttacttctgaatatttcagtgctgtttttatactctcagctgctatactactaggtgtccattgcagcattttgactgatctgtgtttcccttttttacctttctgttttccttttttacctttcagttgaaatatttctcaaggcagctgggtacttagagtgtgctatccagcacgctctcccgaagatatcgcctgaaaaaaggtggtgtgcttgccctctcattgttggatgaacagcgttccatttgtaattagtgctccataccacgctgaccaacacacggccgcgagagaagaggcaaaccacgcgatcagcaccacactttcttcattcaattgagctataaaatctttccataactcaaagaaaagacgcctaaaaatcattcgggtctcttggtatccttattgttactaactgccattttgtgtaggaaaggtcttcctgtggacctaactgaaggaatcctgaaagctatctgcatgcaagctcagggtcaagtaaagcctttctccctctgcctccttttttttctaggtgaatctttctttcaaacagctagaaatcacatgactcatgtaaatagcagttgaaatgtccatttctcataacatcatagtaatatgatataatccaaattcataactttgcgtacatgctagtttttgtggcttttatgtctgaagaacatctggaattgcaatagatggaatcattctttctgctttgaaagttgcagtccacatttagatcttttttagatcttacagcatgtatattagtgaaaaatgtgaaagaattgaaaaaaaactgcaatcttccattctttgagaatgaactctcattttgcactccatttgctaaaagaatcttttgtttactttgcagatatggaagatcaatttctcaaatagcttggttttgctacacaaatttttgttgcttgctgtggaactattgtttgattctggaagcagagatgaattcttttgaatatga

SEQ ID NO: 77460 - DNA, 10999 bp, Oryza sativa
  unsure (1)..(10999): unsure at all n locations
caaccatctgtgacgtttaatttcgtcacaaaggttgggcctcggctagactacactggcccataagcgttttatgacggttaaaaaacgtcatagattgtgctgatccgtgacaatttcggagaaaacgtcagacagatttaatctgtgacgctcaatagatgacgataagtataatcgtcacagacatttcctgtgacgaattttcagtgatccatgacgaattttttcgttatagattaaatagattcttgtagtgggacaaatgtcctccttgggttgatgacggcatcgtacggcagtcgcgtatgtaaagatggacttacagctccactcgtcagttgggtcaaagagagatggaccaaacaacgagctggacctacagctacactcgtcagttgggtcaaaaagagacggaccaaacagcgagttggacctacatctatatttgtgggttgggtcaaagagagacggaccaagcagagaaaggtagcgggctgggctgggacttaaaattagcttaatgtacaaaacaaaagagtaaaaatgtacagcgattcaaaaatgtttttacccgttgcgttgcaacggatattttttctagtataaataaaaaatggagagaaattgacagggtaattaccgatcgttgcctttctcctcacaggacctcacccagtatacataactatatatggcagtagaaatcatgataccggtaattacgcaagttacgcatcatgtttccttcaaaaaagaattcgcgaaggatgagctatatatgtgtcgcgtcttcctcccgccccatttttggaaacacttgcactaattattactcctcgatcgcgtcctccatcgtcattcgcattgcagtgcatctacggcgtcgaggttttgaggcgcaaagcgcgacgcggagagcagcacagagagaaggagaaggccgcgcaggagggcgatggtgaggtcgcgtgggaggccgagcctggggaggcagaggatcgagatccgccgcatcgacaacagcgggcggcggcaggtgaccttctccaagcgccgcaacgggctcttcaagaaggcgtccgagctgtccacgctctgcggcgcctccgtcgccgtcgtcgccttctcctccgccggcaacgtcttcgccttcggtcaacccaccgtcgacgccgtcgtccgccgcttcgacccgctccacgccgacggcgccgaccccgcccccgcggccgtcgaagacggcggcggcggcggcgacgacgtcgtcgtcgcagaccccgaggagctggatgcgttgaggcgcgcggaggagcagaccaaggcgcaggtggcggcggagcaggcgcggatgcgcgacgtcggggacaaggtcacgcaggccatggcggggagggccctctggtgggaggcggacgtcgaggcgctcggggaggcggagctgccggagttcgtcagggcgctcgagcggctcagggacagcgtccaccgccacgccagcacgctggcctccacagccacgccgctgccgccgccgccggagcaggaagaaaaagttcctgagctagacgtctcggattattccttttaggtgtgttactatcgcatgctgttaaaacctcattagcggcgccgctggttaattaattaattgcatgtgggtttagggtttcgatgctccgttttgttcatagaagcagctagtagtaaattttgcatgatcgaagactcaaagtgagctaaagcctaaagcttgtccttatttacccataaaatgtttttcttaattagcttgcttgatgccatgaatggtttgataaaaaaaaacattgttatgcatttgtgcttgctggtgcttgtatttataaatgaatgaattgttaacattagtagttataattatggtgcgggtgcagatgagtaactcaaaaaaatcattgatcactaatttgcaattaacttgtacttataattactttcttgcctgccagttgttactccctccaatttttttgtgacgtttttgtaaccaacatccacacatgaggaaacagaggtagtacttcgtgcaggtgcagttgaaaataattgtcgtttcgggcaataacattatctccaaaaattaactttggccactattttttattacaatataaagagaaatatcaacaaataattttattacatgtagtttccatttttctatgcaaatatattagaagttattcatagtcaaagtaattaaagtttgatatcaatcttgtctagaactatagttatttggaaaaagtacgaattaccccctgaacaatcacggtcgaccgaattacccctctaaacttgaaaaaccagactttcaataccggacaaaacaccaccctgagcactgttgcaagcggtttagggttcaaatagcacacgtggcagtccagtcatctgtttttttaaaaaagaatcgctagggcccactagtcagaatcctcacccatctctcttctccatcccttctaaggaagcgcgcggcggccggcctgagagcgcaacgcaacgggcgctcttctccctcctcttctgaagcgtgcggcggcggagggagacggggcaacacagcacggcggcctgaccgacggcggcatggaggcggaggcaagggcggcgcgtgccggcagcggcatgaaggcgaaggcgagggcggcgcggcgagcgcgcggaggacgcggcggcggtcggagtaaccgggcacgaggacaacaaggatgggcggcaaactcgtcgtcgtagcctgccgcctccaatgtcctcggcgccacccgcctgctgctcctcgccctcacctctgcacggagacggaacacgggagtactagtagtttttaatcaaacaaacccagtatgtatgcacgacacctgaagcaattaatctctctgccataaaatcaagaacagataggcgttcatccgtagttgagacttgagaggaagttgatttagccaattttatcacaccataaacatatcactgtccatgctagcttgtatccagtctcggtacggtctacgtacggtgtgaggtcgtcgtggtggcaaggaggtgatgagagcgaccgatctagcgccggggatgaatccacagtgtatggacctctatcaggtggtaccgatgactttcaacaaaacctatgcttaaattgcttatccatatattatgacattatgatccaagtataattagtatactatgacaccgctaaacatttgacaccaacgaactaattttctgaatcctccattctggcgcagaggcagttgaggagacaagcgatgagcagggtggatccgagccgagccgttcccatggatatggcgacggagtggatccccactgctcctactccttgctccaaggcggcattggccggtgagctctagggccggcgcacatcaaggcaccacacgggccggcaagctacgggattggcccagagctcacctctcctctacgagtgtcgtccccctccagtctcccgaattttttacattttggtcctttttaaaaatttattttacgaatagacctttggaaaaacatattgcaggaatggtcttttttggtgcgctagagaggctggcgtcgtcctccatcatggcggcgccagccaccctggtgccgtcaccatgccagtgcggcactagggcacgtggttgggctgacgtggcaaagaggggcgccaaccacactggcaccgttccacatatcacggcgccagccgtgctggcgcactcccccaaggtgggccaccccttaacctgcacgggccccacccactctctcctccccccactcatttttgccaagcccccagcccgagcacacagagaagcccttctccctatctctcccccctcacctctactcatcaaatacactcaatttgaagtcgtttttcgcaggatttttttgtggaaatcgaagagaaagagaaaggtatactcctcaattccaatctttttttaattttaatcggttgaatttgtagattggagggtaaccctagaactttttttttgcctaaatttatgattttcaacatccattcttgggatttgcttattatagtgatacatgtgtgcaatgtactcggtagtgccatgattttttgaactatatatgtggtaatgtggatttttaaatggttttgttggatggatggatggatagatggaggcattaaagaattattaatttgatggactagaggctttaggttaaatttttaggtatgaattatatgttcacttagatcttccgaaaaatgttcacttaagatcaagctcctcttgtacttatatgttcacttagatcattaccgcaacgtctctttgatggtcatgtctcccctcttctttccttacccatacaagtcttcccgctttccttacccatccaagccttctcatacttatatgttcacttagatcactaccgcaacatcttctttccttacccatacaagtcttctcgctttccttacccatccaagccttctcatacttatatgttcacttagatcactacnnnnnnnnnnnnnnnnnnnnnnngtctcccattttctttccttgcccatccaagtcttctcgctttccttgtccatccaagccttctcataccaactcttttaccaaatcaaagtaaatttaccattccaactgacctagcatatttaatatatacttatgcccttacaacatcgtacctcctataaaaacgaatctccacatttatcctcgatccattcaagaacttctttcactcgtgaccttaattagttatatagagttgggtgggtgggaaacgaaaacctcctataaaaacgaatctccacattatcgtcgatccattctagaacttctttcactcgtgaccttaattagttatatagagttgggtgggaaacgaaatggtcttcaatgacatatccttaaactcaacatgtgtaccaacgtaaggtttcatcactctaccaccatagtaaacatgaacaattctatccatctacaccaaagaataaaatgtggctttacaactaaaattacatcttccttcctaaacgtagttcaaactaacatattataaccaatgcataacttagattgtcccaaagctactacttcacgaaaaatatttaatccacatccaaaagtaccaacaactttactagtgcattaaacatcaaaatattacaaatactccatcatacaacccaacttagttctaattaactttaataaatttctataatgctaccaaattcgcctccccttcatataattcaaacctaaaaatttaacttaaagcctctggtccatcaaattaataagtcattaatgcctaagtctattttttcatccatccatccaacaaaaccatctaaaaatccccattaccacaaatatagttaaaaaaattgtggcactaccaagtacattgcacacatatatcactataatgagcaaatccaaagaacgaatgttgaaaaccacaaatttgggataccctccgaacgaatgttgaaaaccacaaatttgggataccctccgatctagggaggactttagtctacttagagctgtcaccacctccacacccacctcaaacatactgtgagagatgaagcaaacaccgaaaattaactacccagaaactacgtctatgtagttaataactactttagtgtttataactcactaaagcaatcactatattttaatggactatagtgaacaatgatcccgtacattgattaggaactaaccaagagataactctcatagaataaatcttaattacttaaaatgatattcgattaaagcagagtaattaacagagtaaaacaaataagaagaggattgccgacaactccggaattcctctgacttcctctactctactctactctctacctaatctagtatacaataaagtacaatagagcctcttataattcagcttatgctttggtgtgtgtgagaatgaaggaggagaggggtatttatagtgtggaggtgacttgagagagtggagatgctaaggaatattctccatagaatccaaagagcatcttccttctccctttgccatgtatcccttctgatgacagtttcaaccggtattaacggccacaaccgtcataggattatgataactatcagctggtgaaaaatgggcctggttgggccagctggtggtttggccgaaccaggggttcattcgaacctgactggccattcagcccagctccttctctggtgttatgacatgtaggtcccactatatgtttgttgacagttgttaagtaccaaattaacgtcgtcaatacctgcataagaccataaatatgaaacatccaacatagtggtagggtttatttcaaacaatttccacgagtgttggtgtatattcgtatgcaggtgacaaactacctaagttgagaggaaatatacatgaaggaggagaagaatcaaactcatatccgaacttaaggagttttggacccaacaacccaatcaaagacctccaaatgggccaaacattcatacgaacggattgaggggcccaaaatgaatgtccaggccaaaaaccggagtgaatggagccgtctcgggttcggccaaaccctcagtgaggccgttggctctgcctaagtccagttgggtagcaatccgcttcccaatgactgttatgaccgttttcaccggtagaaaccatcataagtatggatacttggcaacacaagagtgaagatgctctttggatgcttggaggatctccactctcccaaggcacttctccacctataaatacccctctcatcctcacttgtaaacacacaccaagatgtagagctgaattacaagaggctctaagtatactttaggttatttacatgttctatagtatacttggaatagggagatagtaaagtagaagaagttggaggaatcctctccttattcttgtactttgttaattactctggtttaatagaaatatcattctaagtaattgagatttgcttcgtgagaattattcttggttagttcctaattatatagtgattgctttagtgtttagctggcactagagtataattattaattgcgtagatgcggtgtctgggcaattaatttccagtggttgctgcgtatcccacagtacgttagaggtgggtttagaggtggtgacagccctcaagagcacttaagtcctccctgtccaggtacgtagtagagcgacatcagcgaacagcgggttgctagtgcttgaagtattgcgttaggattaaaattaagctttcctcagacattgtttctcactaggaaatcctctttaccctttgcccataaccgactaggatcctgggtatttccttgcggagcagatgtttgaaatttaacccgagtccctttaaatatattctatctatgcatggcaccccatacccagtcggatatatatgtcgtataggtatacgatgaaaacaccgagccgctcggcaaggctggtgagcgcgccgacgtgcaccggctcatgctccctcgcgatcctcttgacgtcgtagacgcggcgcacgaagatggaggccaccagccgcgtgaagccgtcgagctggccgggagctcgatcccttccggtgagcaacttgacggcgtaggccacgtggtagccgacagcgaacgtcgcctacgacgacggccgcgcccgccggatcaggccggagtcccagagcagccacgccgtagcctgtaccaatcgacgccgccgcgcggcagcctctggcgaagtcgacgccgcgggctcgcatcgcaggtgcgcgatggacctggcgtccctctggcgtggcaagtccaggttgccgacgtcgaagccgttcaggttggactcgaagacgaacgcctcgccgccgccatcgccagtgcggatggcgaggccgacctggatggccctgagcgcgtcgacgttcgccttgagcaccccgtaccgctgctcggcagtgagctgctcgaacggcctcggctcgccgccggggacggggcagccggggtattgcacgttaatataagcgcgacgtggcgggcgcgccgcgcgacggagcgtaggatgtcggactcggccttgaagttgtcctgccacaccgagtgcacggcggcggcgtccattaattgatgttaattagatccaagttaatttcgtagtccgttttgcactctgatctgaaccaatcggattaattggtttttgtacatgtacatgaagaactaagaaattatgatgggctatgagtaagggctcctttatagtaacaagaaagaaataatgaacgcactactacataaaacccttttccctcgtatttaaatatttcaattattattttttctatcatatataacttaatgtttcattcgttgatcaactgaaacatttggccgtccaattttttaagttatcagacgtccgatgtgtagttttctcctaatttagtttttccattgtaccgagcggacagccggacactatgctagtatcagttaaatacgggaaattatatctattgtaattttgagtttcaaactatttttggacaatgactgctttaagcgtggtagaatgttttgcttgttgtttacccatttgagccatatgatttgttcgccatacttattcgactatttttaaacacaagaaatctgtataaattatttcaatcctttttaaacacaggaaacccaagtttataacacgtctaactaatactacaatccttttttaaaaaaacatttcatgagcgtacctcatttggtaattgctcaagttatctagaccactttagaaaaagttatgcagtaaagcaagcaccatgagaacatttttgcattgcagagtttctattgctaataaaagagaacacagcaaatacgattcattacaattattgatgtgtaatcgagacatggaataacttgtgttaatacaaagttgcattgtctaaaagaaataatccatatatattcatctaacattgctactaagtaattaaaagaatggaattatattacatagaaaaaaaaaagcctaatcacatcggccgttaaaccgaagggcagaagcctcgaatcaccgcagatgatcgaaattgaaaaaaagatcaataagcgcggagcccacacatctgttggccgtgcatcgccacccgggcctcaccgaggcgctccctcaacgccttgaagcattgcagcgtcgagacggcgccggcgctggcgaccatcccatgttgggccgccaccggcaccacgccgatgcacgcggcgatctccctgagcgagaacccgcacgctgtgttcacctccgccgccagccgcttcacgtcgtagacgccctccccgagggtcccggtcgccatggtcgtgaaggcgtcgaggccggacgggagctcggcccccgtcaggatcttcatcaagtacccgacatggtacgcgccagtgaacgtcgcccatgacggccacgcttggagcaggccggagccgaggagcagcaaccggagcctgtgcggctcgacgccggcgcacgggagcctgccgaagtcgacgccgcggccccgtaggtgtgcgatggaggccgggtccctcaggtcagccgggttgttgatgtcgaagccccggagattgaactcgaatacaacgagctcgccgctgtcgccgtcgtcgtcgttggcacggatggcaaggccgacctgaatggggtggagctcgtcgatgttagccttgaccatgtcatagcgcttctcggcggtgagactcccgtactttttccggccactggtgcccgcttgggcgacggcgcatccggggtactgaacgctcaccgcgacgtggacagcgcgcggcgcgacggcgaggagctgggctgattcggcgtcaaagttgtcgtgccataccgagtggatggcggcgaagttcatggtcggcgctggggctgcggcggcggcgttcatggcgagcgcacgtgcacaaaccgaagcggcagcaagagttgggacacctgcaggtgggctggctactcggaagtctgcaaaaaaggttggagacaaagctagctaggcttggcgcacgatcgatcgaagacaagcggcggcggcgtggcagcgtggcgtctaaaatagttaatggagcacgggcgcaatgattgtgtcgtacgtgcaggctgctggacgtaacgtggggaatatatatagggaagatgtgttcaggtgacgtggtgcgcggccggccgcctgtccggaacagactcaggttggaagtcgcgtttatttcgttaattgacatggttgatgactttgattgtaattagatccaagtttcgtagtccgttttgcactctctgaaccagtcggattaaatggtttttgtacatgtacatgaggaactaaaaaaaataggacgcgactagactagggagcggccgttcgctgatttatgttttaatcatcaaccacttcatacacatataaatctctctttagcttaaaaaaaatacaatggtgcatttcttttttaacctatgtaatgacttatatcttttaaatcacatattatttttaaaatctatttgcatcattgtaccctgctcaaaatatgtgacaaaatgagatgcatgttgaatatattaaaaaacatattagtttaaaagtaatttatttaaattatagaagtaacttccctatagcatgaaaagtaattacattctgactgagttaaaataagaaactatgtggagtaaattcataagcaaagtgtagagaagattttcaagtaaatacatttataaaagtaaattcaataaagtctaaaggtaatttacataaatcataaaagtaactttgcacaaaatggaagtaaattgttacaacattagaagtgaattccttgtatggagaaaaata

SEQ ID NO: 77461 - DNA, 5770 bp, Oryza sativa
ggtcggttaaaaggtaaacgcccaacaacggcggcataataggtcagccgtgcagccggaaacaccagtcgccggcgaactagtcgcccggtcggtgaagacgtagacgcccaacaacggcggcataataggtcagccgtgcaggcggaaacaatagtcggcggcgaacgaggcggctggtcggtgaagacgtagacgcccaacaacggcggcataataggccagccgtgcaggcggaaacaccagtcggcggcggacgaggcggccgatcggtgaagatgtagacgccagctgtgcaggcggtgacaccagtcggtggcggcgaaagcaaaccggcggtgatgttctgactgatccattcctagagcgtaagagataagcttaaagccatgaatcccttttatgcatatctggatttggatcctgcagaacaaacatataggatgagtagtatctgatataaatataatactcgaggaaaattcaagcattttaaaatatttataaatatgtatttcttctcttgtcaattttgatttccccgagcagatgactcattacgtttaaacactctgcccgactagtcatagccaccaagcaccgggagtcggcctaagcacttcccaaacatgcatatgagtgacatgagttcgtcattaatggaacaaagtttcacgggccggagtttattactcgggtacttttgcaattattaagagcagaaaataaattatcttatctctatgcttttgatttattccgaataatacttagcaccttgcgttattcggtccatctaacaaacccccgggtgctaggaatcggcccaaaggcaactatccattggcaaaccaaacggaaagcataggaagatgaaactccatcactcgataggcacttttgtactcagattatatcgcaagcaatcaagataaatattataaaaaatgtttaaaaaatatgatataacatctgtagcccccgactcactagtcaacggcgaaccagttgatgtagtgaggcaaaggaaaaggcaaaatatcatataaagaataaaataaatgatgacttagctttgtcgtattccctcggtgacagcagaagtagtcgatctaggaacaaagtcgtccatcaatggcgatgaaaacaccagccgtggaagcaacctaggcggttggcggtgaagtcgtagacgcccaacaacggcggcataagaggccagccgtgtaggcggaggcaccagtcggcggcaacggaggcaggccgacggtgaagtcgtagacgcctaacaacaacggcataacaggccagccgtgtaggcggaggcaccagtcggcggcaatggaggcaggccggcggggaagacgtggacgcccatgaacggtagtgtgaccaaccaaccgtataggcgaagacaccagtcggcggcgacggaggcaagccggccgatgaatacgtagacgcgcaacaacgacggcgtaataggccagccgtgtaggcggagacaccagtccacggcaacgaaggcaccaatccgtggtagcgaatgccacgtatgtacgtgtatataaaaataacagatcaaaaagtaattagagatctataaattaaatgactagaaaaatcaatagattaatctggtttacataaagaaaataaaaacgatagacctgatgaaggtttatgacccagactcttgatgcacgtatgttgtcggcattacatgtatcgacctggttagtctactgatcaaagaatttggaggtccacgtgtccttttgcatgtccaggaagcctcagtgatgagatttaataaggatatgtgtcctgtgtagcttgtcgtgctcctgcttgcatgcatatatgaacgtgggccggagcaaacttgaacaaactcatgttgctctttaattgtgcctgtatgcatgcatatcgacattcagcaggaaccgggcagacagcttctgtcttgtcgatcgaaaaaagaactcgcggcggtggaaattggcatcaaactcgccgagccgagattgatcttctggttagattgatccactcggtgtcgacgaagtaactcaaaattcacgggctgcgcagcatgctaccgatctcgaattcgatgaaaattatcttcccgactgagttgaatcttgaagcgaagacaacgccgataactcctaatattagttccatcacacttgtagacgggtaattcgacgccacccctacctggcgcgccaactgtcaaaacaaattttcggcaatatgaaaagggggtagcgcacgagacctaaaagtggatggatgcggagaaaaaggatttagataggttcagaccctctcgatgagaggtaataccctactcctgtttggggatttgaatccgccggggtgttgtattgatctgacgatcaggttgtctcatgccccctagagggcctcctgcccctcttatataggatggggggcaagattacaagatagaaaccttaaccaatacggtatcggtttcctaaatctactttacaatcttatcaaaccagaactttaggccgttccataatatacagggaaacgtaatacccaagtcatgatccgttacatatttcataaatataagtcgtctcctatagctagtcggataaccatgccgtgtgggtatggggtacccataatctccacaccgattgagattgtgagaattataagagagatagcatttgcacatcccccgcccacaaatccctcggcgccaccgcgttggggcggcatccgatgtcgtgcccccgcccaccccgacgtcgtctgctcctgtggggatcgatggcgcttcctccggctttggttctaggtcgtccgggaaaaggaaggggagggcccaagcttctccgaccagtggccgggaaggatgttctttatgtttgttcggtctattattttagtgtttttgaatgtttgttcagcttgtttatgtgttcttgggtgtatatgattttttgataccgattaatatattaatgaattctggtcagggtgaaggggagctgctcgagcattggctcgattttttttattcttagaccacctcaaatgtgtcgttcactgggtgccgtttagaaaatttggcattcatggatgtttcccaacaggtatctatagttgttcctgtagcagtgggtacctgtgtgtagtaccgtgtaacatgcatagtgattgctactagagagaattaagagatggtacctgtctatactacatgtagcgtgggacactgttgttctcattttcacggacctatgcttgaaaccaaggtatcatgtcctaaacctatgtgtactatatatatcggcacaatgatcccgcggctctatgcgtttccaatgagattcgcctcggcgatgttaaatttcgagcaaaataaggtccgaggtgtttctgatgacaatagcacttcaggtcacacgttggctgagtactatacctcagttttcgcgagcactctttctaatcaaaagctgctaaacttaattaataatgggcagcatttattaaaataaatgtaaaatttattttccaaattaataatatataatacttaatttatcatgagtcaattagccgttgaaaagtgtgcctggttaataagctcatccatgaactgagtctaatgggaccttagggcatggttctttttcaaggaatagaaaaatagattaacgtgacatgttacgtggagagtgcatttcaaactcttgagggaaaatcctattgttgtttccatgtcacttaaatacttatgaacaaaattgaaaagatgtattaacatataatatataacttcataaatatgcaacttaaaatttaacgtctctatatatcgcaatgaaaaaacaagtatgacatgtacaagttgaatgttgcatgtttgtggagtgatatatcatatgttaatatatcttcttaaacatttttttaatttctttcataacaactatttgagtgacacgaaaaaaaaagagacatcctctcgaatacattcccatgtaatgtgatcttgtaagtggtgtgattttcgacaaaacttggtatatctgagttcttaatttaaaaactattttaaatttaattttcaactttatttgcattagtacctcaaacaatgatcacaaaatcattcgtgtcattcagcttttcaagaaaaaaaaaagaaaacaaacaaaaggaagacaccgaagacggctcgaccgtaaaggcgaagcgatatattcagctgcagcagtggagcaaagagaaagaggagtgacactagctgctagagaaaacgttttttttttgtctggatatgacaaacggcatgtaagtctgcgtctgtaaaaatcaacccacattttcacatccggcttgttaagaagagtgcatgcaaaaatctatttttaaggcggatctcttaacaaaccgtatataaaaaaaataagcctattttcacatgcggtcctaagtagccacatgcaaaactctattttcgcgtgcggacgaataagtggttcgcatgtaaaaatactcccttttttttctatccttctctctctttccctcctaaccacttcaaaaattttcacccatctctctccctctcctgatattctcccctctcttaattctctcctcctccgaatccgtgtgggcagcagcaggtggcgacaccaacaaggaagccaaccgttctgtgtggcagcgggcggacggcgagggtgcgacggaggatccggcggcgccaccctcgggtgcggctgtggcttcgcgtcgatgggcggtgatggtgggcggcggatccggcggcgccgctctcggcggggcggtggggaggggggcggatccgtcgcccttcgatgaggctgtgacctcagcgacggcgggcggcgagagtgacggatccagcggcggccgctccccctatgcgtcgtggcggatctggcgccagcgatagcaatggcgggagtagcggcggggtgctcggccggcgctagcgaaagagcgggtggcggagggggttagggtttggttttttttttgaaattttattttttttcgtgatttgaaattttatcagtgtgtatgtttcaaacagttaaaacgtaatgtttcatacacaatagtaatatgttttaatatgtatcttcagtgtatttcacaaaatttatggaactaccagccactattctccctcctctctctccactccatgcttgcatgcattttagcaatgttcaaaataatttgtttttttaaactacttttccaatctgtgttccggtcgtactgttgtattcattgtaattacacattaacaataaggtattgcatattttgatggaaaaatatatgtttcaatctgctaacacttgttgttttatttgtgatagtgacatgtatcaacccgtgtttctgtttcacaaaatatttaaatatttaaattatgttttttcatcatatataacttaatgttttactcatggcaaattttgctacaggactctgcttatgtgtggttttagcactaggacactgcccaaactcacttttaggggaaaacactccataaacgtggtaatttgccagtagacaccgcgccgattaaaataatactttccggttgaagaggagagataaatcgcgtgaaatatcaaaaatgcccttgggcccacatgtcagctctatatcctatctctcttctcatctctctctatattctctctcactctcatagacg

SEQ ID NO: 77462 - DNA, 6960 bp, Oryza sativa
ccccatgcgcctctagtagtgagagagaatagagacatgagaagagagataggagatagagctgacatgtgggcccaagggcatttttgacatttcacgcgatttctctctcctcttcaaccggaaagtattattttaatcggcgcggtgtccactggcaaattaccatgtttatagagtgttttcccccaaaagtgggtttgagcagtgtcctagggctaaaaccatacataagcaatgtcctgtagcaaaatttgcctttactcattggtcaactgaaacatttgaccgctcgacttttttttaagttaacgggcttccgatgtagttttctcttaatttaattttttcgttggacagcacggacactatgctagtatccctaaaatacggtaaagtgcacccattgtaattttgagtttcaaactacttaggacaatgactgctttgagcgtggtaaatgttttgcttgttgtttacccctttgagccataggatttgtttgccgtacttattgactctttttaaacacaagaaatttgtattaagttatttcaatttccatatggttactctaaaatttccttttcccaaaagagacctagaatgtgaatgagtgcaaaccgctaaattatttggcaatatggattacaaacaaatccgttgtactgaaggttagtgataccgtctaactaatactataatcctttttttttcaaattccatgagtgtacctcatgtggtaattgctcaagttatctagaccactttagagaaagttgtgtagtgaagcaagcaccatgagaacatttttgcattgtagaatttctattgctaataaaagagaacacaacaaatacgagtcattacaattactgatgtgtcaatcgagacatggaataactagtgttaatacaaagtcgcattgtctaaaataatatatatatatatatatatatatatatatattcatctaacattgctactaagtaattaaaagaatggaattatttacatagaaaaaaagaactcctaatcacatcggcagtatccgaaggcaaatgacagcacggttaaactgaagggcagaagtctcgaatcgccgtagatgatcgaatttgaataaagatcaataaatccggagcccacacagctggtggctgtgcatcaccactcggacctcgccgaggcgctccctcaacgcctcaaagcattgcagcgtcgagacggtgtcggccccggtgactatcccttaggccaccgccggcaccacgccgagccacgtggcaatctccctgagcgaaaacctgctcgccgtgttgacctccgccgccaaccgcttcacgtcatagacgccctccccgagggtcgcggtcgccatggccgtgaaggcgtcgaggccggacgggacctcggcccccgtcaggatcttcatcaggtacccgatatggtatgcgccggtgaacgtcgcccacgacggccgcgtctgcagcaggccggagccaaggagcagcgaccggagcctatgcagctcgatgcgtgcatgcggaagcctgccaaagtcgacgccacggccccggaggtgcgcgatggaggccgggtcccttaggttggctgggttgttgatgtcgaaaccacagaggttgaactcgaacacgacgagctcgccgccaccgtcgtcggtgcggatggcgaggccgacctggatggggtggagctcgttgacgttagccttgaccatgtcgtagcgctcctcggtagtgagttgggcgtacttcctccggccaccggtgcccgcttgagcgacagcgcatccgggctactagacgctcaccgtgacgtggacggcgcgtggcgcgatggtgaggagccgggtagattcggtatcgaagttgccgtgccataccgagtggacgacggcggcgacggcattcgtggttggcactgggcagctgcggcagcgttcatggcgagcgcacgtgcaggcgggaggctactcgacatcagtaaaaaggttagagagaaagctatgtaggctcggctaggcagcaggttttgcataatgtagctataagaggtcgacaaggcggtgatcaagtcggattcgaaaacattgtcaacctaggcaacagacaacgagcaaagttctggttccactcggtttccgtcagggtttccaaaaccaccaggaccggggttaccgtgccccggcggtaagcacggttaccgcacggtaaccgtggtaactgtgaaaaaccgtacaaagccgtgcaaaatttatcaaaaatttaaattattttttaaatttatttaaatttaaggaggttaccgcggtatttatattaccgtatccccgcggtaagcccggtaactgcggttaccggcggtaagggaaaccctggtttccgtctccgtgtgcacatgtgtaaaccgttacaaacttatattgtttcagttacaattatggctatgtttagatccaaactttggatccaaaatttgcagccaatcattgggaagtgacatttcaaacttctaaatcggaatggggtgtttagttgactgcccaaaattcaaatgagggttcatagaagacaattgtacccctatttaatgcagcaacttgcatgtaacagcatacacaaaaattcaaatcagggttgcattcacacacattcctactgcatgcacacttctcagcagcatgcatgaccttacatgcaatccatgcacacatgcaaatcatacaaattaaaacagtccatacatatagttgcccttcaaaattacattacaactgttggttatcacatactgctagctgacatactattgctcataaattactacaccaacaaatgacagccacaacattgccttcacacatacatgtcctcacatattacaaacaacacatataaatcctcacatattgcagcagcacaaattattcctcccaagttacaacaacaattccatgtggtgacatgcaccacatggaaatacaagtctaaagagaattacagcatacaacacttgtgccgcaacattcccatgtctcatggtcgatgcaacaactcgagcgcaattgtatcgtgaaaagcattcatacgttcacattctaatagctaggagcctcatcttctggtggctgatcttcataggcctccggaggaacataattctcatctcggtcgcaacgaccaaagtgtctatccgttaaaccgctaagccttatgtaattatggagagctatgcaagctactatgatatgtgtttgagtttctgggggatacgaaggcacatatttcaatatgcgccacttctgcttgagcactccaaatgatcgctccatgacatttctcagggaggaatgtgcataattgaatacctcctctttaccttctggttctacggcgttttggaactcttggagatggtactttgtgcccttgtacggcgccaggtacccaatccggtttggataccacgagtccactagatagaacttccctgcagtggtaaacacttgtaagttacacgtgattacagttagacattggaaacatacaacaggtagctgtgtacctggaggtggatgagggaaaacatttttgtatctagtcattgcatcgttgaataccctcatgtcatgcacagaacccggccacccagcaaacacaaatgtaaaaatcatgtcaaagtcacaaaaggaatgtttctgaggcagcacatacctaacacaaatagcaccactaattgctaaacagacatagcttgctaaacatacataacacaaaaggcaccctaaacagcgctacatgaacatgtaaagcatgcataagaaggtctagctgtcgacccttgcgtagttctcaatgagggtcttcgttcctccaggattcgacagctcaaacacattaatgtctactgggtccttcaccatcttcaacataccaacccacagctttggggtctcatcagtgaccccgcactctctactcaatcccatgatacgctcggccacctcccgcacgcgtgccatctcatcatccttcttcttctcacgcctgcccaagtagttgtccatggctgctactttgtccttctgcaactcgttgtggaccttcaattcggacaccatggcgcgcaccactgggctcttcaactttttgctcggactagtagctgtactgcgcgtgcttggtgtgctcctcatgctgtgcgtcctcttcgtcccaacgcttaaggggcttaggggtccaagtcatcttcctcggagtcatcttcatcatcgctgtcaatgtcctcaatggggttggccggctgtgctgagggctaggtaggaacaaaggaagtcgagccgtccactgccacccccatgaacatgcggtccagttcgtccagatacttgggcatcccattcttcggcttcttcaactcagcatggttctgcaaaaatcacacaaagcggtcaggtgaaggacaattattgtggacaaaacatcagaatgaacaatgtaagcattgtaccttcgtgttgtcatcccaccacttgtcagaagccacaacggtgccatcaggccagcggcccaacccagtatatgtcctcaacttctgtatgaaggaccacatagttttcaaacccctatatctaaaattgaactgctcattgtcatggagcaacccagtgacagcgtaaaacccctttctgatctccttccaaccgaatttggtcatgcttccccttatgcagttgccgttttcaatttgcttgcaatacagctcgcaaaaaagtttcgtattttcattggtccactatgccctgtcgttcacttcctagaggcacaattaaactgacaaagcaatgaccttaccactaaacagaagtaagcagcggcatcggaatgaactatgtgatgactatgtgctgttagagtactataatcaagcgcaagtaatgttagagctctaaactcaatatgaagtttacagaacaataatcaatcggaactaaacataacacttgtaaacttatggtactttgcgaatccacacattgcacaaccaaaatatttacttacctctatgagccgacgccgtgcaccacaacccctgcctcggcctcgcgcctacgatgcggccggagcctgaggacggatgggaggcacgaagacgccttcgtggcctgcacctccaaatgaaggtggcattggcggttctaacccagcaccaatcgaatgcaggccgccgactcctggtgccgccatcggaccgccccatatccgcttgctccttgaccactggggcacccacgaaacccgaccgtgcggttcgcgctccgagacggacgtgtaagcccagagggcattggctgccctcccatccgccgccgcgaaggtcttggtagccatgcatggcggaccactcgtatgcggagttgaggtcgagcgtcctgaactcgagctgagaggggttttggctgctcgaagaccccttgccgaatcccccaaaggtgaaggacgtgtggccgccttcacgagaggggtgcagaggctgcgcgaggaagtctcgggtcgggatgccggcgccgaatctatgctcggcccagtagaggggcctggtgccgccgccgccgtagacacctccggtgttgtcggtgccgtaaccgccgacggtgctgccgtcgccgtacccgccaccgttatggctgtcgccgtagccgccaccgttgttgctgtcaccgtcgtacgcgtccatagccggttcgggtggtttccgccggatacgccactacggatgtggtggatctggaagagaaccccttggattcacccgggggaggatcgggaagatggagggagagtgacggcggcagagatacaaccctagggtttgcgcatgggaggagccgagggggaatggataggagcggcggcgtggatgcctcccacaggggtattacgggccactcatgccctaggctactgttgggccttcaatgtgtcaattggccaaattccaggtgcccacccgtttagttccaaagtgcagactgtggcctcgtgccagattttttttggcactttggccctatctaaacacggcctcacttttgcctcagattatttcagttccaataaggccctgtttagttcacaccaaactttccctaaactctcaactttccatcacatcacattacacccaaaacttttctactcacataaactcctaactttttttccaaactaccaactttccctaaacttcttcccaatttcagaaaaacacagcctaaccccaaacttcttcccaattttagaaactaaacacagcctaaacacagcctaagatcacttcagatgagcaaagtacgagagaactacactgaggccgtttgaattttgggcagccaactaaacaccccattccaatttggaagtttgaaatgtcacttccttcattgactgcatttggatccaaagtttggatctaaacacagcctgaatccattttgcaattccgacaaacataccgaacaacacgaatatcatgaacaagggtttatcatgttttatcacggatatctacaggcagcttcagtagcagaaacgtagcattcagtcacgtttagatattttagatacaggcttcaagatagaatgaacatgaactggcatcactgaagcacacagcagcgaagccagcaaaccacccatcaagcagaacgaacattcagctgctaccgtcagtaggacgcgacgcagttgggtacacctgagaactcgcaaacccgacaaaagacgccacccttccgaatcgagtccccttgcgcaacttattctagttcttctttggcttcaccgggcccctgggtatcttgctcaaaaccttggcatccagcacctcatagtgcttgcaggcctcagagtgagcccttccagcaaagtggtcgac

SEQ ID NO: 77463 - DNA, 2678 bp, Oryza sativa
aaagattagtttatttaggctgtgttcgggaggaggggttttccgggcacacaaaacgaagctcgtattattgcaagatcaattaagtattaactaattttttaaaatatggattaatatgatttttttaagacaactttcatatagaaagtttttgcataaatcccaccatttagcagtttgaaaagcgtgcgcgcggaaaacgagacaggtgggttggtaaaatgggggcggggtgttcttacttccccccaccacttttccaacttcttcctcctcatttttcacgcacgcttccgaagtgcgaaacgattagttttttttatttacaaacgttttctataagaaagttatttaaaaaaatatattaatttagttttcaagtttattaactgatgcttaattaatcacttgttaatcaaccgtttggtttagcgtaccaggtgtgaagggttttaatccttcccaccaaacacatacttcctccgttccaaaaatataaggagttttggttgtgttccatctaactaaaactccttatataagtgattaggatgtgttccatccaaccaaaactccttatattctgggacggagagagtacttagttttgtacgctactttcttgtctattcggctttattcataaaaataatcacttgttaattatagataagagataaggtggattctcccaaaaatatttgaaaacacttacataattaagaatttcaagattgcattaggtaatttgagccacattgccatatcactagcgataaaacagagtagataaatacagatacaattcaatacggatacaaatacaaatactaatagtttttcctggatatgtatacaaatatgaagtcgaagcttctgacggatatggataataatactaatatctggtgaacaatgttattgaaatatctaccaaaggaataaagcataccctatttcttactaattctagaccttcaaactacacctttaaactttaatactagcccacactactagcactagttcacattattaatattatttaaacatgtaaatattttaaaaaactagatttatatgttataatatcagttatgcttccatatatatatcggtaatgttatatgcgttaaacttaatggacactatttacactttaatgaaactttttatatgaaactagctaattatgtgtgatgatatatgtttctatcataagttaggtggttttcttgttaaaacaaaatccttatttgtattcgagataattcgtatttggtttcgtatcaagctaaaaatatgaaatgaatatagcacaagtatgatgcatccgtatcagttgtgttttcttccttgcatgtcagtgccacattagataccactttgtgtgtggcccaagattgaaaatgatctgttttgagttttcacaatttactactgaattccacaggattgtttttttctagatgttaatatttaactattgagtttgtaaaatggattctcctaattccaaacatacacaatgcaatgcacaggaactaaataataacttttattcgttccaggattcatgagctactcgatcgatggtaccagacttttttttaagaaacatattatataatggcagtgtgttttgaagtgcgataatggaattgttattcggccgctgaagaatcagaataaaatatctttaaacaacagactgtctatcccacattcccaccaacctgacaataggcctcattagccaggcacacccacactcgcagatatagatacccaaatgggccgcctgacccagcacggcccaagcacgactgggcctaggctgaggtcagtcgggccggtatggtgccatgtctgcccacgagctacacccacgacccaacacggcccgaaggcacgatagcccatcgtacttctctacagaattccctcatacctttgggttgtgtcttatgtggctggaataactctattttttatccctcttctctttggatagtgccttttagtaagttataaggatgaattaagtttattttttatccctcaactatttttttagaccatgtcgtgctgggctgggcccgaaaccagtcatgtcgtgccgtgtttgggccaggccatcgttcctcgggccttatggccatctatactcgcatggaataagttcacctgacgtccctcaattttacgccgagtctgtctgaggtccactaatcgcaataccggaaatgtgtacccctgaactacgtataaccattcaaaaaatgccccaaggcagtatagataccagatttcgttgacgtggcctagtcataaaaaaataaataaatatgtggggcccatatgtaagtgagagaaaatggtataggccgccaccctttctgttctttttctcttctcttctctccttctctcgagcagacgcggcggcagactcggcgtgaggcggttggctgcggagcaggggtggcgacagagggagaggtggagagagatggccagcgtgatggtgagctcggtggcggagaggaacggcgcgcggcgcggcggaggggagaagagcggtgcgcgacgtagcggcgggggagaggagaggagtggcgcgtcattgggggctcgccagaggaaggctgtcctgcagctccagtgctcccgta

SEQ ID NO: 77464 - DNA, 689 bp, Oryza sativa
tagattttgttggaatgaaggtatgaggctgccatctattgaggactgtcctgggtgcagtgatgttgcggagagctcaagccgatcatatagtaggggcaatcggctaaggcagacaagacttcctgttcatcaaagattgggtccagtgaactaagatcatagccaggaggacaatgaaaacaggaaaactcaatggtgtccttctggtatctttacgaagaatgaaaagagaagggttcaaagattgaggagcagggagcgctttcaggaagtcgaacaggaaatcaaccatcggctgaagaagacaaagccgaagcaggacaggcgtcttaagaatcaagttcctgtagccgatgaagccacagccgatgaagcaaaaaggttggctaaaggaaaaagtgttgtaactgcttcggtcaacatggtcttcacgttgcctgccgagtttgggatcaagcaagccgatattgacgaagttgaagaagaattggctaagttattttgtcaccagagcaggcagtttttgagaagtcagaggggacgaagaatcagcatcttaagccattgtatataaatgattatgtcaatgggaagccgatatccaagatgatggtcgatggtggggctacagtaaatttgatgccttacactacattcaggaagttgggtagaaacgctgaagatct

SEQ ID NO: 77465 - DNA, 2377 bp, Oryza sativa
  unsure (1)..(2377): unsure at all n locations
cacaagttgttttggtgccgtaaagctcttgtgtgtttgcttctgtgtttgtgtttcttcctctctgcctcctgcctcgttcagaaagtgtagcctgtattcgcgtgagttgcttaatttgattcccaacaggccttctgcttccacgcgaggtggcctgtggctagcagagaacactgtgtcaccgtgaagcacgactccacgaccacaagcaggcgagcagcgatcttcttgtgcttctcttctctaggaggccagaagcgaatccacgatcaggagcaattaacaggcccgtcgggcttcgcagaagtgtgctctgttatgaaacgccacgagatttaacgtggaaaaccctcttaaaacaggagagaaaaaaaccacgggcgccagcctgaggtgaggttaaatcgccgcacgcgggcttacaagagatatatatatggtgggaaccctaaaagggataacgatccataccaaactggcatttattaagtgcaaataaatttggatcacaactcaacaaactccaccttaagacaaattccttcttgtagtatgaatcaatccttcaccctgaacccaccaaagccaaaaccactttcggcgccaaatagcctcttgggctaacccactataccaactaagcttgagcaaaactcaaacttagcaacaggaacaggctttgtcatcatatcagcaggattatcatgaatacttatcttgcatacctttagcttaccttgcgcgactacatcacgaacataatggtacttgatatcaatgtgctttgtcctctcataaaacatctgatctttagtaaggcagatagcactttgactgtcacaaaacaagttaatgcaagaatcaactccacaaagctcaacaaaaaatcctttcaaccaaactgattctttacatgcttcagcaatagccatgtattctgtttcagtggtagactgggcaacaacaggctgcaatgttgccttccaactcatagcacaactaccaatggtaaacacataacctgtgagtgaccttctcttatccaaatctgcagcaaaatcagaatccacatatccaacaagccccttatcagtcctgccaaacttcaagcaagcatcagctgtgcctctgaggtacctgaaaatacactgaacagctttccagtgttctttaccaggattcgtcatgtatctactaaccaaactcatagcatgagataaatctggacgggaacaaaccatggcatacatcaaagaaccaacagcactagaatatggaactcttgtaaagctgataatttaaaatgaggtgcaataggagtacaaacaggctttgcatcatgcatgttaaaacgctgaagaaccttcttaatgtagctttgctgactaagaaataacaaaccagaatttctatctctagtgatttccatacctagaattttcttagcagcaccaagatccttcatatcaaactcactactcaactgtttcttcaatgtagtgatttgttccttgctcttggcagcaatcaacatatcatcacagcaagtatataggtgatccattaacaaatttaatatacacacagctatcaaattcagacctcttaaagccatgtgacaacataaatgaatcaaactttttataccattgacgaggagactgtttcaaaccatacaaagatcttttcaacttgcaaacataatcctccttaccaggtacaatgaacccttctggctggtccatatatatctcctcctcaagctctctatgtaaaaatgttgtcttcacatctaactgctcaagctcaagatcatgcatagcaacaatactgaagaatgtgcgaatggaactatgctttacaattggagagaacacatcattataatcaacaccagcaatttgactgaaaccttttgctactaaccttgccttaaacctcagaggctcactaggagataagccctcctttctcttgaagatccatttacaacgaacagacttcttctgttttggcaagtgcacaagctcctatgtgccattcttctcaagagactgcatctcctcctgcatagttgagatccacttctcacggtctccagaaacaacatgtagcgcccgatccgtcgtggcgcctagcgggaaaattatctcctaaaaaccctaattgcgaaatttgtttcttcgcttgttgtctagtgtccgtgccatctcaagatctcaatccccgatctatcgtcgagttcaattccgaatccaaatccttccaaatcaaattcctccgcaaaagtccattttgcctcccccggggtcgatgggccgattntctctcggcccatcttcccctctcccccggccctttcccctctctcccc

SEQ ID NO: 77466 - DNA, 777 bp, Oryza sativa
caatgtgtcaattgccaaattccaggtgcccacccgtttagttccaaagtgcagactgtggcctcgtgccagattttttttggcactttggccctatctaaacacggcttcacttttgcctcagattatttcagttccaataaggccctgtttagttcacaccaaactttccctaaactctcaactttccatcacatcacattacacccaaaacttttctactcacataaactcctaactttttttccaaactaccaactttccctaaacttcttcccaatttcagaaaaacacagcctaaccccaaacttcttcccaattttagaaactaaacacagcctaaacacagcctaagatcacttcagatgagcaaagtacgagagaactacactgaggccgtttgaattttgggcagccaactaaacaccccattccaatttggaagtttgaaatgtcacttccttcattgactgcatttggatccaaagtttggatctaaacacagcctgaatccattttgcaattccgacaaacataccgaacaacacgaatatcatgaacaagggtttatcatgttttatcacggatatctacaggcagcttcagtagcagaaacgtagcattcagtcacgtttagatattttagatacaggcttcaagatagaatgaacatgaactggcatcactgaagcacacagcagcgaagccagcaaaccacccatcaagcagaacgcacattcagctgcgaccgtcagtagcacggtacgcagttgggta

SEQ ID NO: 77467 - DNA, 1025 bp, Oryza sativa
atgtctggttttgtggttcaggagggtaattcgtactttttcccatattatttgtaacaaaccaagacatgcaacggccaaaatctttgcttagtttggctttgcaagcaaatcaaggtctcctttagaatgtatcctaaaatacaacaacttctccactaaaagcatcacaaacagcttcccaaaattatatcttaaaaattttggttataggaatcctaaacagatattaaaggtgttaaaattttcatcccaccacaagattgggtaaattagctttctaaaaaaaactaaaagtaggacccacgagaaaacttccaacggaaaaatcgtttctagttccctctctctctccccgctagatcaggccgcgagcgtgacccttgccggtcggccctcgccatgaccgcgtgcaaaagagcgacgtgagaagtattgggaacgaaaccgagccactagaagtggagaacgaaatatccaaagttgagaactcgattaattgggaacacttctgttgtatccgatttttgaacaaaaattcctaaattgcatatagggaatggaataaagaagctgttggtggtgctctaacatttttttttaaccaattatgaccctccactatttaatttcccatctactttcacttatcatctaatcataacatgctctctcatttaattatacctacttttcataataacatgttcatcctaaaattttttatattttaaaacaagggtagtagtatattacaactgaattgattaggttccatgatctaaccgtttgcgtttggtatttgatttggtatttgtacggttaaaaaaatactccccgttctattttaagtgcagcaataagtttccgtgttcaactttaatagttcgtcttaattattttttttttaaaaaaaaaaaatataagctatttatatttcatcatctaataccattaaattctaatcataaaaaaatttaaattaaataaaatagacgatcaaagttgaacacaaaactttatgg

SEQ ID NO: 77468 - DNA, 2402 bp, Oryza sativa
agaggtatatagaatcgaagccaggtcttcaggcaaaaaaaaaaaaaaaaaggtagtagaagccagtcatatggtatactcgtatttcattaaaaaatggtaatgatttgaaaacaatattttattaaaaaatcagattgtttagctactcattgtagacaactattcccaacagtttcacgttggctgtgtttagattccaaaatattttggccaaaaacgtcacatcaaatatttggatacatgcatggagcattaaatatggacggaaaaaaacaattgcacagttagtatgtaaattgcgagacgaatcttttgagcctaattgcgccatgatttaataatgtggtgctacagtaaacatttgctaaattaggcttaataaattcgtctcgcagtctacatgcgaaatctataatttgttttgttattaatctatatttaatacttcaaatgtatgtccgtatatgtaaaaaaaaattggctaacgaactaaacacagccattgttgcaagttaggatcataggtctgacacatatttgtaaaatttgtgccaacagttttttaagactcgacattgatggcataaatatcattaccgatttttctagaaaactatttgagttagtgtcggactttttaaaaaccgacactgatatattaggagcccacgaagtctactgtttagattcagagacttaactttagtctctatatttagacactaatttaaagtattaaatatagactacttacaaaactaattatataaatgaaagctaattcacgatataaattttttaagcctaattaatccataattagagaatgtttactatagcatcacataggctaatcatagattaattaagctcaatagattcgtctcacgaattagtccaagattatgatgggttttattaatagtttatatttaatatttataattagtgtccaaatatccaatgtgatagggactaaaaagttttagtcccatctaaacagggtcgggaaaccaatatcggtgatgggtttgatcgaacaggtactatactaatgtgttgttctatgtagtaatgggaacataatgattagtctattgcagaggtagaacatatatttattcattcaattattccgagacttctaaaggttaaaatagaaaaattgtaatgtttcaaaaaccaaacgaaaaacatatgaaagtaaaaaatgcataggacacacaagagggagatccatttctttgttcacccttaaaagatatacttggtcccaccggttttcaacatacgagcttgttgaaattagacaaatgttttactattcctcttactggaaacattttgtaattattatttatttttctatgatttgttttatcatcattgatactttaaacatgttttatattttttatatttacataaaaatttaaataagacaaattaatagttaaaatgtatccaatagttaaaagtgttgtaaaatgaaaactggaggaagttatattttaacaaaaaaaatatagtctttaaagacattgtcctagtgtagtcgggtgtacgtcagagcatccaggattaaatttgccgataaaactaaattaatttagcaggctgtcagcatgtcacagtcagtaaatttaaatacggagtactccactagactgttcgggaagggaactttaattactcccggttagcaaccctttctagtcccggttgtctaaccgggatactcaatctggaactaaagatgtttatttttctgcaatcgagacgtccgatccgggactaaagattttcatcttttgtgcaaccaggactaaaaatacatacctagtaaaaaaaacccagtcttcatgcgcgttaacatcccatctactacacacatttgacttggatagatatgctttctttttaaactaaccctggaggcatctttagtctgggttggatggtaatgttgacaaagatgattatggagcatatctgtagagattattgtggattgaatagtgtatcaccttgcattacttacgccattatatttctagctaggttgtattgattcgagtagatgttttacagcaaacaagatcaaagaagatagtgaaattaattgtgaaagaatccgtcgtgattgtaatggttgcacagcgacaagcagccactgtgtgaagatttcaaaaaaataggacacgtggcattggcgttgtggtgatggaggatgtacgggctatggtgcacttacaaggtattcgacgcttagttcattggcgcaaaaaaaaaggtgacaattaatggaggggggaggggatatgaacgccattgccaaatcggcaggtaaaataaaaccttgactaaatcatgttatttgccagatccataaaaatcct

SEQ ID NO: 77469 - DNA, 4660 bp, Oryza sativa
tgtgtgtttttataatcatgagtatgcgtattaacttaacatttgtgtgaaggaattttctatacatttgtcgacaaattttcttttagaaatttaacaaatgtaattatagtacaattgcgatataattacactgtaactttccatctaactataatacaacttgtatgtaactttcaaaagtctctatgtaacatgctatatttcggcgaaatgggggttgtgggaacaaatcctctcacacgtgtgcgagcacttttttccttccgcacttgcacaaatcttgaaacaaatctaacagttcaaaattacgtgaaagttacatacaagttaaatattgtagttacatgtaagttatagcgtaataatatgtaagtttcaatctaattatattatgattatgctataattacatctgtcaaatttttaggagaatatctatcaacaaatatatagcaaaattggtttgtaataatgtatttctgaaaaacatacgccctccgtactagtaaagaaagccatttagaacaatgtttaagttaaaccttggaaatataaatcatgaataacttagtttgaaaatgtaaaaattatatgaataaatttgtcttgaaaaatacgtttataaatcatacatatatcacttttcaataaatatttttatagaaaaaatttaaaattgtgttatgaagaccgtgtcgctgtccaaaacgcctcctttaggagtacgtgtgtacgtacgcacgtgtacgcaacgacgcgcgccacaccacccaccgcccgcgtggccccgcacgtcagaggccgctgctgcacagtcgcgcaccgccacgctgccacgtaggcgcgggtggagtacggaccccagtccccagaagagacgtctcaaaagtcaaaagccgtacgataggggagccgccttgtcagcgtcgtacacatccaaaggacgccgctgctgccgtcaacacggggactgttcaaaccgcaggaaggactgcaggagacgctggtggttgagggcccccacgtgtcagacctccggtcaaacgctcgtctataaaagatttttctttcttacaacggtcactggtcttcatgtctagtagttgggatagtttggactgagttcctagctccattcccttatttctcacgtgcatatttttcaatatatatgctaaatggtgtaccttctgcaaaaaatttgaaagttgttttaaaaatcatatttatctcattttattttttaagctaacatttaattaattatacgataataaacttttttttccgtgctagaagggaaggtttctaaccgacacaaacgaacgcatctatgtgtatttagtactgaatttacagcttaattaagaaaatctatttttataggaattaaccaaatcttgtaacacaatggtcaccttgaaagaaaaacggggcaggatatcccaaagaaagaacaatggcagaaccaccatcttcctaagtctaaggattaaatagtctattttacatgactttacctttatttttttaaaacttttaaagtgtaataggtgcactacttctgtttccatccctaccaaagaaaattcacttgatacgattgaaaattgttgtaaatggtaatttgtacgacgatgtgggattctttttatacatattttggcatcagtgttccgtagtgactcaatttagctaacattgtgaccctgctaggatttttatggatctagcaaataacatgatttagtctgggttctgagcctttttggttgccattcctgcgacaaagctgtggctgcaacgcttgtgttgtgtggttgcagctgtgctgtttgttgcttcagctagctgccgtgcagctgtagaaaatgccagccgaacagaccctttaacatcactggctgatttggccaatggcgttcatatctctgatctccactaattgtcaccttttttttttgcaccgatggcctaagccttgaacatcttataagtgtaccatagccagtgccatatgtcctttttttgaaatcctcacgcactggtggcttgtcgttatgcaaccattacaatcgctatgttacaaaatccattacgccggattcttttgcaaataattccactatcttctttgatattgtacgatgtaaaacatctactcgaatcaatacaacctagctggaaatataatgccgtaagtaatgcaaggcgacacgctattcaacccacaataatctctgcagatatgctccataatcatctttgtcaacattatcacccatccataaacactacaatgcatattgtttgcctactcttctttgagcgcaaaatgaccatcttctcctctaccaaacatgggctgagttcgtttattagagctcctagctccactcccttatattttcacgtgtatgtttttaaatatatatctgctatatggtgtgctttttttaaaaaaaaactttgaaaagttgttttaaaaaatcatattaatctattttaaaagttttttttgctaacattttattaattatacgctaatgaactgttctgttttctgtgctagaagggaaggttcccaataggcacaaacaaacgcattccgtatgtgtttagtactgaacttacagcttaattaagaaaatctctttttttaaggaatttaccaaatcttgtaacaaaatggtcaccttgaaagaaaaatggggcaggatatcccaaagaaagaaaaatggtagaaccacaatcttcctaagtctaaggattaattagtatattttacatgattttagctttattttttaacttttaaagtgtaataggtgcactacttctgtttccatcccaaccaaagaaaattctcttgatacaattgaaaattgccgtcaacggcaatttgcgacgacgtgggatttttttatacatattttgcaatgggtgttccgtagtgactcattttagttaacattgtgactgtgagaatattcatggatttagcaaataacatgatttagtcagggttttattttacggccgatttggccaaaggcgttcatatcccccctccattaattgtcaccctttttttcttttgcaccaatggcctaagccccgaataccttataatgtagcccgtacataatcgatcaccacaacgccaatgccatgtgtcctttttttcgaaatcttcacgcagtggcggcttgtcgctatgcaaccattacaatcgctatgctacaaaatccattacgccggattcttttgcaattaattccgcaatcttctttgatattgtacgctgtaaaacatctactcaaatcaatacaacctagctggaaatataatgccgtaagtaatgcaaggcgacacgctattcaatccataataatctctgcagatatgctccataatcacctttgtcaacattatcacccatccataaacactacaatgcataatgaccatcttctcccctaccaaacatgggttgagttcgtttattagagctcctagctccactcccttatattttcacgtgtatgtttttaaatatatctgctatatggtgtgctttttaaaaaaaaaactttgaaaagttgttttaaaaatcatattaatctattttaaaagtttttttgctaacattttattaattatacgctaatgaactgttccgttttctgtgctagaagggaaggttcccaataggcacaaacaaacgcatcccgtatgtgtttagtactgaacttacagcttaattaagaaaatctcttttttttataggaatttagcaaatattgtaacaaaatggtcaccttaaaagaaaaatggggcaggatatcccaaagaaagaaaaatggtagaaccacaatcttcctaagtctaaggattaattagtatattttacatgattttagctttattttttaacttttaaagtgtaataggtgcactacttctgtttccgtcccgaccaaagaaaattctcttgatacaattgaaaattgccgtaaacggcaatttgcgacgacatgggattttttttatacatattttggcatgggtgttccgtagtgactcattttagttaacattgtgactatgaggatattcatagatttggcaaataacatgatttagtcagggttttattttacggccaatttggccaaaggcattcatatcccccctctagtcacccttttttcttttgcactaatggcctaagccccgaataccttataatgtagcccgtacataatcgatcaccacaacgccaatgccatgtgtccttttttttcgaaatcttcatgtagtggcggcttgtcgctgtaaaacatctactcgaatcaatacaacctagctggaaatataatgccgtaagtaatgcaaggcgacacgctattcaatccgcaataatctccgcagatatactccataatcatctttgtcaacattatcatccatccataaacaccacaatgaatttttttcacctactcttctttaagcagcaaaatgacgctcttctcctctatgaaaacataggtagcgaaatgaccgagaggggtagtatagtactatcacccttaaccccctcccccctctctctctctagcatcacattctctctcacccctttgacattttc

SEQ ID NO: 77470 - DNA, 7015 bp, Oryza sativa
ccccttgcgcgaggacggtgcacatgcttcgctgctgtttgggcgcggtacgggcaccgcgcgtatgtacgtgtacgtgcacggcggcacggcgcggtgcatatatacaacccccaatcccgagcaagaggcaaccccaccagcgactgcggccgtggctgcggttagttgtggcagagcccgtgaccgatcgatcgctcggtcgctgctccacccgcgcgctcgattcgagcacgagcgcctttttttcctttttgttcttttgcgcggcccgccggaagcgtcggtttggccggacgcggagactcactcgatcaaccgatcggtttggttcgcagctaacgccgatcgagaggacgacgacgactacggattgctatacgcggacggaatatggatgcgctaactgtagtcgaagaaaaaaaaatagtacgagtataccgtatacgtactacgtagtagtgtcttccgagcaggggaagaaagaaaccaaagggcgcgacaactaggccgcggaggtaaagcgcgaaagggcctcctcaaccaccgtacgtcgtaaccaccgctctaggtctctaacctccgcgcttatgcacgtagctagctgagccgacttcaccggtgggagtttcgctaacaacgtttcacgtgtgcccgattgaagttaatgtgaaacgttgatgatgcatagccttgtttagcagaacagagttaattaaatcattggaccccctgaaacctgaactaattaagtggtagtactaagtacattaggtgattaggaggaatggcgcggcaagcatagctgctagtagaacggatgtcgttttctcttcctatcctcatgcatacgtattttcaatggtgccggccataggataacgcattcggcacccgaattgcctaatcgcgacgacattgtctgtcccctttgcttacgacattcccggtaagatagccagggagcttgtatttttctggcacgacattggcgcatacgtacaattatggatgtaacatcttgcgcgccatcacgtggtccatcatcgtagttaggccactgcatgcataataatgcaatccgataccattgcatagtaacaatatttttttctcttgaaataaaatattttattggcagacactcaagaagacagtgagcagacgacatggttgaactgtcaaatgctactagtaactgacttgtcagctcggctgcgaaaaggaagcgtaatcctggattaggtaggcccgtcaaatcgatcacgggctgtaagctggatggctcgctgaactaatcggtggagtgctaaaagggcccgatggttggacattgccatttgccaagcaagcacattccatttccacggcgagaaagggtaccactaccagttcacgattacgtacaggtacctttctgttgcaaagtcgagaaatcaggagaagcggtgaaacagtgcaaggaattagcggcagtgaacgctcatgtggttggtcaaaaaagttaatatcaaagcgagtaaatggtcatgtgctaaaatagcttatcgatagggcaaatttaagcctgaagcttccatcaacggatgaattcagtcgtactactacgaaccaacgagcttggaaagctatatattcaggtgcgccgatcgagcgccacgaaattaaaaattgtacttgttatcatattcgatcgtactactacgaattaagagctctcatgttctgttcgctgttaattaatcgtctaatcataagttcagtgctcgtatttattaatcaaggacagaattctggcagttcccttcggtcagttcggacttccgacgtagatgcatggccaaaccacatgcgataaaaatgaaagtaaaatcacatccgttccgtgcagaaacgtataggggtctaacggctagctttataaggtggtgggctagacgacctggattcaaagcccaccccttctaattacttgatattaggtcattctctaatattcatattttttttaccctttgtgatgagcacctgcatctctgcacgtacatgttactttccccatccaaaaaaataaaagattttatctatatgactatatgaatataatcccttgtatttagagataaagatgttgctagtacgtatgatgtaaatactcacacgtgagctctgcaattatttggtggagtccacgactaggtaccgatatgctcacgtagtatgatccaacgagcaacgagacaaggccccatcttctgaaacaatagccatattcatcactcattcactctgtcacagtgtgagtgaatggaataatggagtgtccctggggagtaaatgctcaaagtgaatctgtgaaggagacttgcacagcgacctgatggatgatgatcgatcgaaccttcctgggtaaagtggaacacgcaaattgacggctagctaataacccaacagcctcccatgcacgccgatattgccgccttcgcgccccccgtgtttatatactacaggcgcctgcgcgccctcaggaccaaaggccgaagccgctcgcgcgcgctcactcgatcgaccagtcgcgcgcgcgacgagagggagagcgacgcggcgccgaaccggctagctctcgtaggcacaaaagcccaaacacgttgcttctgcagtagctagtgtgccgtgcccgtgatcggagatggcaggctcgttgtctgccgcgctgtgcctcactctcttctgcttgctgggggcatgcattgcgcccggggcgcgtgctaacggccggcacagccggcgggacctcgacatcaacctcggcaacggcaacggcgggggcatcagcatcggcataggaggaaatggtggtggtggtggtggtggctccagtggtggctccagcggcggcggcggcgatctgcggccgtgcgacttcgagaacgagcggctgtacaaggcgtacaaggtgatccagaagttcaggaggacggtgacgtgcgacccgcagaacatcatctcctcctggagcggcgccgacctgtgcagcacctacaaggggttcttctgcgagcggccgcccaacatcaccgaccggaccatcgcctccgtcgacttcaacggctacaacctgcaggcgtcgtcgctgaaggagttcgtggacgccctcccggacctggcgctgttccacgccaacagcaacaacttcggcggcgccgtgccggacctcagccggctgcagtacttctacgagctcgacctgagcaacaacaagctgtcgcccgccacgttcccgacggacgtgctcaagctgaagaacgccaccttcgtcgacatccgcttcaacagcttctacggcgagctccccggcggcgtcttctgctcgttcccgcaggtgcaggccatcttcgtcaacaacaaccagttctccggcagcctgcccgacaacatcggcgactcgccggtgaactacctctccctcgccaacaacaacttcacgggggagatccccaagtcgatcgcgcgcatggccaacacgctcttcgaggtgctgttcctcaacaacaagctcagcggctgcctcccctacgagctcggcctgctcgccaaggccaccgtcatcgacgccggcaccaaccagctcaccggcccgatcccggcgtcgttcgcgtgcctgcgcaaggtggagcagctcaacctggcggacaacctcctctacggcgaggtgcccaacgcgctgtgcgagctcgccttctcgtggtcgggccgcctcaggaacctcacgctctccaacaactacttcacgtcgctcggctcctgctgctgggacctgatcaaggaggggaagctcaacgtcgaccgcaactgcatcccgtacgcgcccaaccagcggtcgcacgacgagtgcgccgccttcttccaccggaccaagacctccgcgtgcccctgcaacacctacgtgccgtgtggccacaacaagcactccgccgccgcgccggcagcgagcaggacacggcggcggcggaggaggacaagtacaggacttactcggcgctgcatccatgagcgcgagaaggaagcggcaaaagcactgtgcttctcgtgaacgtgacacgattattgattgattcggttgctcttggctggttgtgttaattgatgtgttgtgtctacttttttgttacttttgtttcctttctcatccactgttacgtacggccaacttagtttcacatatatctgcatgtttaggtaaggtaatggagattttattttgatgaaccacagaagcttgtaataattcagatcaccatgaaagatcagctttaaatttccctgcattcgtcaacatcactgcgcatgcaactgccaatatataatcttgaaaacataatacctcaattttttaatgtgtgacacagtttactttattttatctcaaacttttactaacaatataatatttattgaataacgagtatccatagatctattatgaaaagcgctttagacatctagctatcttaagatggcagaaattttgtcagctgataggtggagttggctttcaatagtttgttgacacgtgttgtttcacctctctcttaactatctgtctaactagtatgtttacctcttcgcattaatattactagaaggacagatagttaagtgaatttaaaagtcgattgtgttatatattaaaaaaaagtaaattacacattagatcacatttgtttaccaatgtttcatggaccaggggtaagcaacacttttcactttggactagttcttcctctctagaccagctcttcctcaggctctctttaattaccctctctctcttctctagttctctctcagctcactgtaccactgaaaaagccatgccaatgatcttgatctttcgaaccattagcgctacgaggaatggcatattgcaggaggtaaataatcttactgctgcactccataggtgctgatcgttgctgctttcaatgaggcaaaggtaagggcctgctcagtgctcaatggagagttgagcgctcagagagagagagagagagagagagagagagagagagagagagagagagagagagagagagagagagagagagagagagagagagagagagaggaggaatgcatgggtccaaggtgaaacactttgcaaaaatttatagtcaaaagtgaaaaatagtgtcatgcccctagtccaagctacaataatggtggtaatcaaatgtggcccattgggcaattaattctactaaataaaacaaatgtagtagtacgctatgaccctctttgtttaggcttataaaccaacttataagctgaaaagtctaaacgtaaacaaacaagtagcgtttttgtttggctttttttaatgccataagtcactcttacattattaagccaaaaactaggttggagaaacttttttttttttgcttatgtgagatatatgtattactctactattaaacttagacttttaaatctattggcttataaatcatataaaccaaaatactgacttaaaagcctaaaacaacacaaagaggacttacattcagaactagttaccatattcactctaaagggtttaaaattatcatctattaagagagaaaaatatggaccacaaattagcaaggactagctagaaaaagactccatgtcaagaataccacttaaaagccatctaattcacctaaatattagtaaccaagggtgcatgtagaaaataatacatgaataactgaagttatggtaaataaaaaagaattattcttgtaaagcatatggcatatgattagctaactaaaacagtgtgtaaataaaaaagtccccctccccccaacccaaccaatatcctggcaatggcctttgatgtactaaatatcatccaacataattgctatcagccaatatcaaatttgaatccaaccatatagctagcacatgcagattaacggtacagtactcgagttacaagcaacatccacgaaaaaacaactgataactgagaagcatcatcaccggtttgatgcagagtgcacttatttttaagggtaccatggaaaatagtttagctagccaagtaatagggttattcgttgttccctctcccagcttttggcatatgcagtttgaatcgaaattacacaaaaccatgaggcagagtcagcttcttcggcatcacagggtaatctccattactcaaggccttcttgctttcttagaactggtattttcttttctcccttgttggatttacttcctcctgatttcaaaataatgggtgaaaggaaaacactagcttcagtaccttgcacgttgaacagaatcaattcaaatacaactatgcaactaataaagagtaaggtaaaatattctaaatcacattatacaaaaccaaatcacagcctagatcatgttatttattttgtaacaagcttctaaaattgtatgtttaaaattcataccactacgttcgccataggaatccattgtcctctgcaaataaaattataagatatatcaagattttgtttctgcaaaaaaattttagtacagcacgtatacaatcatataaaaaatgacctagattgattttttttcatataccttactgtattataaaaaagtgacaatttgagattacaacttacttttagttttcacacttttgttccagcaaatcccaaacatcaaatattgtgctaaattagactacatatataataggtattagcacaaaatagttggccacctaccttcttctgtagcttttgtcctttgaacatatctgtcccgttgactagggttgttttcaaaaatagtttaacgtctgacctggaccgtaactgttttttgtatttctgatgatagtagaactgcaacaaaaggtattacgaaatcacaattcatatattgtaaggaagacttcatggtttagaccatcgacttaaaaaaccaaaaaaaaacacgagatgatcttgtccatgcccaacactaa

SEQ ID NO: 77471 - DNA, 10837 bp, Oryza sativa
ctaccattgccactgtatattttttttatagctatgacaagaggatgaattgaacatgcaagtttgcttaatccgtaactccatctaatgcggcattatactttctcggggcttaggtcaattcctcaaccacttgattcccagtacggaacccatgtataatggtgtgataaacccacatgacccacttccaggtcatacatgggatcggttcctgaaatggtaagtcatgaggcaacttccgttaccagcttctaaaaagggttgggaatcaatacactaattaagcttgatccatatgcatgtaaaggtcgtttaggcttgtagatttaatggttgacaaccaacaaacatatgattagaccagacaatgttgaatgcaaatacattacaattacaaggattcaactcatgataaaactcgtgtaaaggaattaggcatgccatcgattatgtatgaaaactcatgcatgcccattttcccatgaaaaaactcataactaatgagaaaccaacaatacctatagtagtaagaaactagagattaatcaaccgtgatctcattatcatcaatgatgtcatcaaggcagacaaaatcaacctttacgtccccacgttctagatgtgcgagaagggatccattgaaatggatccgactaggtacatccgactctacagagatggagcgtcacctaaagtcaagtgtttggttatcgacaaaaagctagctcgtgatacttcttttgaatctgggtagatggtgggccaatagtgcttgtttagttcaacatcaccaatagttggaacatccaaggttcgatgtggattctgagccaatgcctcgaacgcggatatagttggccgagttttctagtctaatttgcaacatgtcatttgtccaatgacttttgctgttggccagctttccttaacctaataatgcattgttacatggaatcttggtggcatgattatcatagaactattcttcacgttaaatctccaatataattcacaagctctatcctaaaatttcaacattatcgaatccttattgaaggagtgtattggtgttaagccacaagagtatgaccataattggttggtccatacaatattagcaatcaagcttgattcccttcttgaaggttttgcaacgggagaactaatggcgatccttaaatttccatggcatcggatctcttgtcatcgtctttgttcattcttttgaaaagaaactattgcacaataaatttaacatagattattttccccaagacactaatctaataggcatgatacttttgatagttatgttgacttaagattttctttatcccttatttttgctagtgtgatgactatgttcatccctagctattggaaacatggagttaccacatccatgatcagtaaaaaagagaaagaatgtatcatctttcaccaaattaacaaccattaattaaaaaagcctctacattcttgcactgattgtcatagagcagatatgtaagacttgaccctccaaattatgatctttagtgctccttatatcgaactaaaacctcctctaccatattatctccaactaattgttgaatattatgtgaatttatagtgtaaacatgaccgtgacttgcttcacattgtgatattgtttttgaggctatattccgatactccattttttattttagtagttctaatatcattttttttatggttctaccatttttatttccttttttaggaaaaaaaaaggtcagcaaaatggtatttttctgaccattttcatcgtttcttcgtgggcaaacaaggcttgtaatggcgaaacacacatgcatacatgttaggtataaaagggttaaccattgtcaccataaccttatttttttatgtatattgggcttgtgtgtcggcctctagtccttaagcccttgaactttgacctcgccaaccaccgccacataggcacacccaactatgtcctgccgctagtatgcacatgttttgctcgagattgacttcctctagagctcccattggaccacccccaatgccaccagatttgatttcttccttatctttcttgaatcttcattatcatgctatatgtgaattcaaccactccggtcatgtctacatccatatcagaagcccatttcccttgatcaagagcttggcttggtggacttgatgatcgatggcaatgacaaactgtatgaagacatgtgctctggagttatatagatatgcgctttgtcgatgtaagcgtcaacattaattagcaccacaggctttagctgccaaccgcagcatgtaatgacccatgatggagtttctacccaaatagctcggttaactttttctaatatttttggtaaccaatatttaactattttcttttaaacacaagaaaaaaaattgcagctccaaagtaggcacttaggagttacgtactactttttatttagagggaatgcaaggttatgggatcttgtccctcatctctgttcggtatcccctaaatcatcgacgccggaggatcagtaccacctcctctatgtttgagcttgagctctaccaccacctcattgacttagcctggcggatgcgatgaagccgaagcataacctctctagatcgatggcaaccatctggcgatagagaagagttaccgacgtcctttctacttgatcacctcctccactctgtggcgattgtgatggagccagagctagagctcgaactctctccaccatgggcataaatctagttgagcttggggaggagagatactatgatgacacaagaatcgacaaggctagcgacaatcatacggacacatgaggctcgatttgaaggagtcgtcatggtcctgtgggctagtgaggagctcaagctcaccgaggtgggatggccctacgacctagagccagcatcttcgctattgtccaaggagagaggggtaatagaggagagcgtctgaaagccccagcctccaatgtcgttgtcccgcaaagaccacacccctaccttcgccatcgctgctcgatttgtattggttggtatcacctaataccccacaggtatgacctaataactacgggtgtcagatctgataagaggtaagtcaaatctgatgcttacctagtatcatcccgttcgaatgggatcccatacaatagctatcctcttgttcagtggtatagggagggggtggtgtcaatgactaatgaggactattacccttccttacacctgtagaacatatctatgcatatagtttctgtcttaaagaagactttgatctaattctacgacaatttactcaattacttaagaacataatatatttttgagggaagcacataatacattatgaagttcctagttatgaaaatacataaattaatttacaccaataccactatcataacaacttttcaatttgaataaattgactgtgtaaaactactctttgttctataaacggaaagtactaatgatcccctctatttctccacacctagtactttctgcgcaaagattcccattactgactataatcaaagatagtaacaaatgcaattatcaaaacatccaaatatttatcacaaataggaactataatgtaacagatgacccctcctacatgtatttctatatgtacctagttagcatgccgattaattcatataaaacataaccaatatattttaaatgggtttaataatattcaaccaaatcgatcgttttattttggaaatagtatggattagtcgctactctatgccatcggattgtcctgttttatagtaaatgcattcatcttctaatgtacaacttgtagatactgataaaattgtattaatagtataaatgattacattatcgtgtggtgaaaatatccatttcatatattttttacatgataacacaagaaagctttaatttctttcaagcgtgctttgttagatattataaatgtgatgatatgtcaagattgaattagatgtacataatattcatcaatatattgacaaacaaatggaagttatttacaagtcaacaaaacaagaaaaaactaattgatagtatgtcataatattttgaaagaaaaagtaagaagcctaaatactattgcttaaaataaatctagtagatcttgaaataaaacgcaaacaccttattcaaaagtgtatcaatcctcactattctagatatatcaaaaatatatataaaaaagcaaagcatatgtaacaaatttaataaagaaatgtaagattgcaccactaacccaatctttatgtccatcatcccttatttgaaggaacactgtccagtccccatctttgtagttatcgagttgtttcatccattgaggaaccggaacctcttctttactcgaatccactttttggtgaaaagccacctcttgcctgaagggaatggagttcaaaggtacaatatccaaaggttgattattgccaagcttatctggaccttgaagattcaacatggatgacatatcagacatattttcctcttcctctaaatctgcatcaatcactataggaggaatgtcatccagagtcgcctctgagtcagaacttgaatattcagaaccactcattggagctacgccctttgaagcgttattactcatagagagagagagagagagagagaggaaagtagtataaaggggatagccttaaacaacttgtcaaatatataatactaacacaaaagggtccaaaatagatgttgtcgtgtgtgaatacgtcctggttgccctgaacatttacagctcatgcttccaactggaattggtggcatactgtagtaatgacaaaataaagtgtatcgctttaactgatacatatcttcctccatacaaggattcaacatttaatgcgatatatatttcttcaatatatgggcgtatcatttaattctacatatatacatctttcatttgcacaatttaattctacctatattttgcttcttatttgaagatccatttatgtgatacttttttaacagatacacatatcttcctctgtagcacaaggctggatcattaaaatttaatgtgacagatattttgatccatttatggctgtgtcatttaatacaatacattttttcttcttgtatgggtgcaccaattatttgtgacaaatattttgttcgtatattcacatatcattcaatacgatacgcattttttttcttacaaggatgtaccttcaagaaatacatgctttcttcctcgtctggttctgctgtttgttgcaatacacgtcctctaacagatgcctgtatttacaaagacatttgtcccaccaactagagggaaaaaacaacgtacctcatgacaagcatgcatctgtggtccacatgcataattacaatattataattctttatatctttgcccttttttggatgtccttccattttcttattttgaatgtacatctacataaggatagtgtgaataatccagagtagtaacattctccaatgctttattagctatgtaccaaatgaatggcacacctaggaatgtgttccaagctgtataattttttggatgaatgtacaccgcaagtaataggaaaactttgaagcactttgtttttcttttctattttagcagaacaattggcttttctaagaagcaaccaataaattggttagccccaccttaccatggtcaccttcgcatccaaataggtcatggttgtagcatgttacacatagggtttaattactggtagttaccacgaaaactaggcttaccatcgagctttagtagcggaaacgaccagtaaggtttggcaaaatttatttaaattcatttctttttccaaagagaggaaattaaaaataaaatcatataagtagtatagtgctatctggtgaaacatttatgaaatatatgaagttaactttatattttgtacccaacccaagttgaaaataaaaaaaagaaaaataagcaaatgggctaggctaatagtgagtgctattcacaaaacctatcttagagagccgatcgtgatttctactatgtttcagtttccaaaatacaaaaatggtcacacgaaattgcatgcttgattgctttattcttttacatcttctgaatttgccctactttttctagaattatctatgatttacctgaatttttgaaactttttctcacttttcgggtttcccaagaataatgtttgtccccctgagtttgaatttttgaattcaattttttttaatatgaattttatcagggttatggataccacatacctaatagtagttgactaaatctcggcaggacccaccacatactatgtcttatacggaaacaatcttcggatataggaggagttccgcacaaggaaggatgaatagagttctacatggaaacgacaagaactactcagattgtatccatattggttttcctagttctacttggacaaggggacacctatgggtataaatacaaggctccataggaggagaggggacacgaaacaatagatcaagacataagatcaacatacaagccaacatacgccaaaacaagacgccggatatcgacttcagagataagtatggctagtcccctacagcgtctacgaatactgtcaggagagacatagcgatgtctttgatctcgctggatgcggattctaggaggaaggctaccctgttgtcgactatgagtcagcacttcagaccgccatgtcgacaatagttagataggctaccccaaatattgtactagtgtgattatgatgaataagagcaacgaccggcttcgaccaacaggagtaggcttattacttgacaatttaggggctcgaacctgtataaaaatcctcgtccctatatcttttattacaatctcgcatatatcataataccaacgatcctcatactatgcaaataccggaatcgcgacatcaaacgtcgacaaatttcatctagttttcacatttaccatgtgctatatgtgttatcctagggtggccgtagggtttcaattatcaaagcacaaggtcactgataagtccgattttcccgtttatcgctacccccgataaaatctcctatcggccaaacatttcgggttttttttgaattttctggacatagcgtcaataactactacaaagttgctttgattaattcgttatgacctgtaggttttaatcaataggttttgtgttcgattcaagcaaagatatgaatttcttctctctctcttttttcacttccatttgcttgcgttgtgtgtgctataaaaatgttgatattatctcatttataaagtatatattaattttttatacaaaatggtttggatataatctgtatgatttcctaacaacttttgttcaatttcttttcaaattttatccaaattttttttctatcaccgttagaattccgataaatctgataatccctttatcgctacccttcgatattttttagctatcgataattaaaactaactgtggaaactactagctttttatttttttttaaaaaaggaaacaaactggccttttctaagatacaacaaataatttggttagccccacctaaccattatccacatcaccacccaaatagtccatcatggcacgcattaagcccatccacaaccaagatatcatgcatggtaactaggtttacaaccacgcaaggccttcttcgtttagtcaacaagagagggattagagggattgtgaaaaattaattccacatctcaataggtgtggaattattctcctccaaatcctcctcgatccccttgtgggtgggattaactgaacaaggtctaaatgatagccaatctaattagttgtagtcacagtcaaagacttagtgcaataggtgatgttgtcaagctaaatggtcttatgggcgagaggggatagatgcatagtactccatctatcctaaagtctttatccaatttcattttttgtatttttttttcaaatgagatatgcttatctgtagtcttcatacatctaaaacttaaataaaagggctgtcttttcattttacaatgctaaattaaatttttgatcgaaactagagcgaccatcttaatattcattggttgcatgcaaacatataatttcttgattttgttatatgagggatgaattaatccctccttaggttgtgttcttctctcaactttcccaacctcttctctcttgttttccgcgcacacttcccaaattgcatttttttcgaagattttctatagggaagtttgtcagggttacggataaggtataccctttatccttggatgtatgttgtatactgatacggtatacccgcgcgtatacgaatagtttccgtatacgttaaggaaatctatcacgtgatagagacggtatctacggatggaaggagttctactcggacaaaactgggtctttaccatatcgtgaggggtccgatatctccgagtcctacttggagatcaactgacccgcggtatataagggaccccctgggcaggacctaaggcatcaaatatcactgccaacacacccaccacagcctacggagctagagcgtgcaggagccaagtcgccgggagatatagtcggaccaactcgactgcggtcttatcggtatcatcgagttctgctattccctttgtaatctgtggtttccatcatataatgccataccaactggattagggctattacctaccaagggacctgaactagtataatccttgtcttttgtttgcttgatatcgtactacgtagatcctcataccaacggaccccaataccctctatatccggtctacgggtatcccccgtcgacaaagttgttttaaaaaaattatattaatctatttgtcaagatttttttaactaatacttcatcaattatgtgctaatattttgctttgttttccgtggtggtgtttggatccacggattaaactatcacatcggatgttttgacattaatttggagtattaaacataggctacttataaaactaattacataaatgagagctaattcacatgacaaattttttaagcctaattaatctataattagcacatctttatagcatcacataggctaataatagattaattaggctcaatagattcgtctcgcgaattagtccagggttatgaaatgggttttgttaatagtttacgtttaatagttctcattagtgtcaaacatccgatgtgacaggaatatttgggagacttcctcattgcaaggctgttaacagtcatatatttgagttgaattaatttagtcggtctgaaacgagcttaaagaacatacgagtatttttccctatgcaaaaaaccctttttaacctttgtatgtggctgtgtttttgaaatgtacacaacatgcaactttttgacaaaaggatttgctaatcaaatccttctctcccacacaacgcactccgaagtccaaggaagaattctccccatcaaagctgtaattgcaaagccagcaatctcacgctgtcacaaaatcagctaaacttgatgcctatcgcacaatgccaaacccaaaaaataaaaatatcaaattttggattgcctcgagcccctgcattttgtgcggatcaatgcatcggcctgtagtagctgtaggtgccgtagaaggtctgcgtcatggtgagcagcagcaacaagacaccggcgaccaccgagacgatcgcccatgggttgctgaagtagttgtgcttgaggctggcgatccaggtgctccacttgtggtcgtagtacctgttcacctggtccgagagccccgagaggtagctgtcgttgatgtcgaacaccacctcctggcacagccggttgaagaggtcggccacctcggcgtcgctgcccagccagtgctcgatgatgccgcggtcgtggaggtacttgacgtcgtcggcggagttgatgaggttgtccatgaagatggcgtaggaggtgatgttgttgccgcccggggtggcgatgtccatgtggcattgctcgaacgcgatcaggttgaggaagagggacttggtgccgtcgtggatgaggatgcgcgggatctggagcacgccgtcgtggaacctgatgtcccagaagcggtccgtgttccgccgccggcaccggatgccggcctcccggagctccgacacgcagtggacgaactgctgccgccgcttgtccgccacgcgccggagccccgaccacttcttgagccacagccgcgcggggggcggcggggtgggctgcagccccgcgcggaggaggctgcgccggaacacgtcgaggcaatggagcatcgggccggacagcgggtcgaactcgaacgccgccgccgccggtgaggcgccgatggaggactccagcttggaccggtccttgcggagcagcggctcgtcggtcggcatgagcgggtcgaagaagcgcacagcgaggccggcgacggcgccggtctgctccgggttgccgagctggaggccgagcaggaggtcgagcacgaacaggggtatctggttctcgagcaggatcatgtcgttgcggatggcgtgcatcgcgccgcgcatggcgaagatggggtcgtgccgcgagtaccccaggtcgtcgccgaaccccttcccgccgtcctgcgcgccgcggaagagctccagcacgaaggtcccgtccagcaccaggcactcgacgagctcgttcccctgcatcccggcgacgcggccgtcgtagcaggcgcgcgcccgctcctccatcggccgcagcgcgtcgag

SEQ ID NO: 77472 - DNA, 1968 bp, Oryza sativa
ggggggagagatatgggagagagagggggaggaataaacttttttttttggtgaatgacatatgagtcccacattttttttgtttttattctaatgccacgtaagcgccacgtaggacatacttggtcaagactgtcagtccgtcacgtcagccaaaaccaccgagatattgtttataccggttttgatagttggaggagtcgaaaaccggttggaggacatgaatcatactcgggcaatagttgagggactcaaattatacttttttccatccaaaaatgggcggggcctagacgggcttttctgggccctgtggctccatgttggtctacccaacccaaccacccactgacccacagtcccacaccgccggagaagaagactagcgacgcgaggcgaggctctcggaggagtactatcaccacccaccgccggcggggaggaagcagatcatggaggatttctacgtcaccatcccgtatggcgccgcggtcctcgtcgggggcgtcgccggctacctcaagcgcgggagcaaggcatcgctggccgcgggcggcgggttcggcggcgcgctcctcctcgccggcgcgctgagcgccagggccttcgcgcgcggccaccccagcggctccctcttcgccgccgtcctccagactggtccgtttctgctagttttgctacagtgctactcccccccatcctccatccatcccatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggtgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacactcatctggtcgcaaataagcacgtatgataataacaacttatttacttacagtgaactggagcaaccaagccttgctaggcccgactgtagagtacggaggaagggtgttggtcggtcctaggtgtggaaggcgtatcacctgctcgaagcgcgcagtgatatcctccttccacccaaaaaaaccgtccacgggaccaactggtgctcccgtcagcggtagcccgagcaggtacgacacgtcctgcagtgtcggagccatctccccacagggaaggtggaacgtgtgcgtctcaggtctccagcggtctacaagagcagcaaggagtgaccggtctgcatcccaccgcttcgctgggtcacggtcgtccgccgccgcctcaacaagcctacaaagtggtagaaggcctgccgcacgcaacctgtatagagcaaatttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaacattgaattgaaattacacgatagaagtatttagtccgaacactcattacatcaca

SEQ ID NO: 77473 - DNA, 3133 bp, Oryza sativa
aaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgcagcttcggattcataccagtgcaggtacatccaccatccgctttcaagacacattcttgcacggcttgcttgcgatagataccacgcgtgctcctatcaacacacattatttcataccgatgcacttgtgtgccttgagcaacaactctatgtctccgtacctttttgattttatcttccatgtactttgtcactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgtccctaacctccttctcattgttggtgggtcatcatgtaatgcaccaagaggtatgggaggctcgtcaccttcaactagtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcacaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaataggctctttgcagcacactctttgttcgatcatcaaccgatgtaaatgtatgtaggtcatagtacgtattattattcctctgggcaatggtggctaacaaacgaggcaaattatcataagaagcttcaaatgtgccatacctcatctcaatgatcttttgtttcgctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccgtgtaagtagcacttgtgctcggtcacaatgctaactttccaataatcattccatttacccttatatgcatggacacgccacggcaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccacttcctcattatccgaatcttccctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcatcagtgctgtccatcggcattagttcctaaaaataaccttctgttgcacgactcactacaactgacactgacattgtgtagacttcttggtctattctaaatcctctcaataaccaactataaattgactgaaatgttctctccgcaggcctatcgatgcccttagatgtcattacaaaatctgacagatcaacaccatctggaccaaatctaatatttccttcaccatgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctcctcttctgctgccctcccccctctctctctctcgttttttttggatttttagtgaatataatgaaatttcacagaggagggactgggctttatagggggaggcaaaaatcgccctcccccagggcggcaagggggccgcctgcaaaattccatgccccctcgccgcccatttgcaggcggccccccccacagtagaaaatcgccctagcggagggcggcaagggggccgcctgcaaaattccatgcccccctcgccggccattgcaggcggccccccgcacagtataaaatcggcctaacggagggcggcaagggggccgcctgcaaatttcgttgacgggcggtgcccgaaagcgaacgggcgtct

SEQ ID NO: 77474 - DNA, 2683 bp, Oryza sativa
ggagcgggccgatggacaccacctgcggcatgtacgcgcgctcgtcgccgtcgcggagcgacttgggcacgcggtacacggacagccgcgcccacgggcacgctgcctcctcggcgcgcgcctgcgccagcttcccgcggatggccaccacccattccgggtcctgcggcttcgggctgtgcgccggcgactgcacctggaccttcacctcccgctcccgctcctggcgcggcggcagcgcgtcgcctcccgctccggcggcctcgccgttggtgagcagcggcaggttgcggttcagcgcctgccacagcggcagcgcgccgggcggcggcgcggacttgttgaggttggcatcgacggtctccttgagcttgaccgtgatcaggtaccagctcaggacgtccttgttgaagacggcgaccatcgagatggaggctggcagtggcaggtgcagcggcttcgccggcggcgtggggctcgccgcagtagcgtctcgtggttgccaagatcagtggccccgggacagagagagcaagccaactcgagagggaggcgaggcaagcaatgtacctatgaatatcttagaacgataattttatcagctgatgatgattgatagtggaatttttgggattgcttgcttgttgtaaaatattgtgtggtctttgacaaaattaaataaagtttcctcttgcgatcatgtgcaattttcaacgatggacattgctgccagcctgcgatgtgcgctcatcagcaacttacgctgcattgcacgtactccattccgtcgaagactaattggcgactgcacgataatcccaccgctgtaatataaagaatatagatactttggatttgtaatataacgatgtattccatctaattaaaatattttatattttaagacggattgagtatttaactacgacacgtatgatcggtactccctccatttcataatataagactttccaacattgctcatatttatatagatgctaatggactagacacacatatatatatttagatttattaacatttatatgaatgtggttaatactagaaaggcttattatgaaatagaggaagtagttcgctaccctaacaatctcagagtttttcttttccggagaggatctagacatgtagttcgatccagtgcactgtaaccgcacacaagctaacatcgtagaagtacctaccacaagcgactgaccagcgatctgaaccagaagattactctacccgagcaaagcgccaaccagaagcccagaggcaaccgattctccttacgcttcgggaatcgtggaccagcgaaagctggcgaggcagtccggcacatggccgcatgcccgcatacatgtatccccttgattcccatagccgttgggttgcctctcggggatcggaagtgacgagctagtgcgacgccacgatgaacgcacatcctcactcacccagcgaaagccgaacacccagctgaagccttctgccggcatattgtcacgcgccccactggcgaaaaatcacgccgcccgtgctacgaaatgtacgcgtcgatgaagatggccgccaggtcaggtcaggtcacgtcaggcgggtgcggaagcggtgggccgatggtggcaggctgggcctgttggaggcagcctgcgggcaattaattggaaggcctgcagtagcagcatgggcgcgtatttagagcaagttcaatagtataacccgctacagacttcaaattaactataactaatttaatagcttatttatataatagttaattataaaaatatatattactcctattaatatccggtctcacatctcatacacacatacgtcttgaaattcatgctgcagctggctacaaatatatagcccgctttcttctctctcttctatttttttctcgatacgtggttataggtggcttatagcctgctattgtcgctgctcgtatgctccggggccgggggcaaaggtggataagctctttcggtgagacggtgacaattattgaagtaactgatcgtgattgtgatcccttcattgcatgatcaggcaatatttgagcagtagtaatttttgctgcacaatagattgggccttcaaacaggccgatgggcttcagtgcttcaccaagggaataagttcacttcgtgacccttaaaaagtgatcaaaatctaatccgtgaccctaaactacaaaaccggatatctcgacccccaaactcttaaaaccagtgcaatttgactccttcagcgtttttggagagcggtttcgctgacgtggcgcctacgtggcatcccagtcatcaaataaatttaaaaaattaagtggggcccacctgtcagtgactccctcctatattctctctttcttctcgttggcatcaaataaattaaaaaaaataagtggggcccacatgtcagtgactccctcctatattctctctttcttcttgttggcagcggcggcgggaggatgaggggagcggcggcggctggcggcaccggggcgcagcggaactaggggcggcggtcggcagcgtcggcatccggtggtggggacggcgttcggcagccgggggaaggagccgttgcccaatcgacaaagccatcggcttcctccgcctcatgccacttccactcgcttcctcccacggcgggctgcaggaat

SEQ ID NO: 77475 - DNA, 566 bp, Oryza sativa
atcaaaaagatgcagaaccgggacacttattactagcggccttaatcatttgagcattagaaaaatcatactcatcaaattgttgggctactgctagctcccaattaacataagcggcggaatcatacttaccatcaaaactggcaatttagattctacccttgtaagatcattatcatgtatcatgatttagattctacccttgtaagatcattatcatgtatcatgcgtgaagaagtcgctatatctcgttgatggggaagatgttgacattgagcatgaccatcttgtttccccttgcgcaatcctgccatggttagcagcaaacaagaaacatacacaagaatatacacgctcctatcaactactaggtagtggcagctcaaatctcacacactcaagcttttaaccaagctcttacaagatcttaccaatgcaagtggaatggtgatgtacaccgactcaaccaagcaccccaatagaggttggatatatcgatgcctcggcaaacacttgctgtacggctgcaatcaaatctatggagctctgggtaggcttaaatatgt

SEQ ID NO: 77476 - DNA, 19299 bp, Oryza sativa
  unsure (1)..(19299): unsure at all n locations
atagaattttaaattagtagagattatttgaaaaatcgtattaatatttttaaaatttttaagatataatacttaattaatgatgaactaattcaccatgttgctatatttgccgggagtgaagatttctgaacctataccttcaaaagcacccaagcagtgttgtgtaccggcggtgtagtcggctgtaaatacgacacaatagcaaaatcgttctgttaatgtgacaagggctactattattattcattagtatttatgaacgtcaaaattccatttttaacgattaatcggccactttttttaataatccgggtaatcatttgcatattgcacttgacgatcttttagagtaacaaatttatttttttacgatcttgttttgtttagtgttgtttagtactacctccatttttaatggtaaattttgctacaggacatcgcgacttcgtggaattagctccaggacacctcacgaagtgagttttggggaagacacattctcaaaacatggctatttgtcataggacaccgcgcccatttgtttggtatattcgtgctgactaggcttgagcaggcccacatttttacgtgaccaggccaaattgccctaccacatattctttaggcccacacagattactataaaaaaaagaatattgggttgtactccagctccacacagttagtgggaagcaaccaagtcagctccatggctgccgccgcccacctggatgggcttcctcggcctcctcagcttccgctgcagcgccaccgccgtcgcctcctttggccacgcgcaggacgacgagctgcatgtcctccacaccctccaagcccacgtcgccaaccgccttgccgcggttgttaacaaccaaatttggtaacatcagcgtcggagagaagattagatcgaatcaaagtcggaagcggagatcgagtttgaaaacagggcaggaatcggctgaagtccagatcggctatgacaagatcggctgggtctgagtcaggttaggtaagccgatgtggccgattccgacaatacgacttgtacacggcatcaggttcaagttaatgtacttcaagatgattgccacgcatggatagagtcctgggaaggcaattgtatatattaattaggatattttatgtaaattccttatagataaatgtgggcaaaagtctgccgcaaagacttatgatatcttagagtttgttagagataatggtcatgtctggtatgggcatatcttataatcctcgagtataagtagaccccgagccctatgtaatttttaacgacagacgttcaacacaatttcggcgcatcgccaccctttttacttcagttttgtttagacgagttcttgttttcgggttgagctgcatcgatttcgatcttcaacaagaggtaaaattcattatgatggattgcgttcttaggattagtgcttccatctttatgatactctaatcccgtttatcccgtttatgtaattcatcgagttatcatatgtcttacataatctctagcaatatcatcatctaacctgccatcggttagtatctgttaatagagggtagccgattaggttaaatattaatattgatctagattatatgagacatctaccattctatgaaacttctagcgacttgattatctagatatcgttcttcttttcatacttaatgctgcatcagttgagtttgatctattaagtcgtgcttagaatattgatctttagcctgccctctagttgccgattagaatagcatcggagtttcagccgatcgtatctgatttaacttcatttgttatatatgccttattgatatgttaaatctgccctttatgttaagatattgttgtatctaagtatgttaggcttttgctcaatatattattcttgctttaatatcttgatatagagtagtatcggagtattagccgatacatgctagatctatctgatcggctatgttataaacatatatagtcttgttattgacatatatttcgatctaagtgatttatactgtctcggcatgatgaccgatctatcccaatcacttgatttaagtatacatcgatatgaggagtatatattgttaatatctacagccaatcgagtagatttagtccttctttacttattcatgactgccgatcgatgcacagatgacatcggctcaaagataaatgatatgtcatcggcatctagccgatcggctatcatttatggatttaaccacggtttctttgcttctatttcttgttgattacaggatcaaatcaactggcacgctaatacatccgaaggcgagctttggacctacactggagttaagtagatctcccaggccacgtgttttctgtcaacagcggtctcccatcagccaccgctcctctccctcgccttcctctccaagctgctcgacgtggtgctctcctcatccgacgccttccgcgacatcctcggcatcggccccgtcgccgcgcgctctgcaggccgcctgcctcactggtgacctcctcgaccacaccgttaagacactcgacatacttaaagccgtctccctaatgctcgcttcgctccggggctcgcaccgcaccgtgctcaccgccatgtcgtgcctcctcgccccgtcgctacaccacgcccactttggccgcgcatgccaggccatctccaggcaattccccgatgccgccaagctcgctgccgcgccaggctgtccttcagcgtctctaggaacaggtcctccggccgccacgtccacgccatggcggcgcacttcgcaccgccgccacagtagtcgcccacgtttgcctcccccggcgcaggttgcgggctggggctggcgctctacaccatgagctcggtgctcgtccgctgaagcatctaggcctccggtgttaattttggtaattgttggcgatatggcatgaggcccttcgaccaaacatgctgaaagcatgcacccgatgaggattcaagcccgagacatcaaggttagtcaaggcgaaccctccccatgtcgaagactatggagcaaggacgacgagaggcagggaatcgcagccgagctggaggcctcctggccgaagggcgcaaggcgaagagcgtacgccgaagggggacgacttcgccgtagcaggttcggccccgggaaggccgaagaagctatcctggcccatcaagcccaggggttaattgggtcgactataaccagtcggcccgctaagggcccatgaacctcaattacgctatgtacccatgtaaatatccctttcataagggcaaccatgtaaattcccctgcataaccaaagccctagtagtaagacctgtaatgggggctataaatagccccatagggccatgtaatagggggatccaagaaaaattctctaatcaatacactttactttttttctcaaccactgttgagtaaccacgtctttcgacgtatgcagttgtcgtttcgacaacagctggtgccgaccgtggggacctccgagcgaaaccactgagagtgaatgccaccgaagaaggtcgtaaaggaaaaggttacaaggcgaaaggaaagcgacgccggggcggatatggccaccgaagagggagcagagccttcggcgcctgtcgctgaagatggaggagcgccatctgcttccgcacctgcgccatcactaccgccttcagcccttgctacctctgtgcaggtgccgaacgcagctgacatggcgaaggcagctgcggcggcgagggcactccagaccagggcggagatcctttcgacaagccaactgctggtgccccaagccactccgtcacagccagcagcggccccaactacgctcgctgctgtgcaagtccaagtcaaccctgaccccgagacacaaaccgaagccgacatggaaggcatacgacagaacatgacacgactccaagacatgcttcgccaaatgcaaggacagcaacaagcgtacgaggcggcaaggcggtccaaggtcgcctcggcaccaatcctctagtattcggcaggctatgtcccaccccaagtctatccacaagtgccgacccagccccttccaccacaagtcgcgcgagcgccaatgtacttcgccgggcagccatcgaccgcagcagcgcatccggcccctcacgtgcaactgcaagctcaaccggtcgctgcccaagtacatcctcaaccgcctagccaagtgccacaaacaatggcagaaggggcttcagctctgcaggcgcagctccaagctttccttcagcagctcagccaaccccacaacatttcaagtacagccccttcggccctcccggaggggaatacaagtcaagatgcgcctagttggttgccttcaaatcaaccaggtctgggggcttcgccgtggagtcaaggaccgcaattcgactccatcaatgctgctcaggcgccaaccgttcggccgcaagcaccaacgctaggcttcagagcaaaccaagcaccaaaccagatcaccatgacatggtcacagccaactttcgacccattcatggcggctcagcaagcatcaccaatcggggctgtgtagccgagtgccatggcccaatctcacgcgcaagccgtgatttcacccttcgccacgccgtacccgcagcaaggtgctgtgaacagggcagggggcgaaaaggggcaaccgctgagtgggggaatcaagacccgcacaatcccaccccagtgcaagttcccacccgtcccacgctactcaggcgaaactgacccaaaggaattcctctaaattgacgagtccgcgatcgaagcggctcatggcaacgaaaataccaaggcaaaggtaatacatctcgctctagacggcatcgcccgttcgtggtatttcaatttgctagccaatagcatttactcatgggagcaattgcgcgatgtctttgtccttaactttcgatgtacatatgaggagccgaagatgcagcaacatctgctcggcattcgccagaggctgggggagtcgataagggagtacatgcgtcgcttctcgcaagctcgatgccaagttcaagacataaccgaggcgtctgtcataaacgccgcttcggctagtctgctcgagagcgaactcacaagaaaaatcgccaacaaggagctacagacacttgaacacctacttcacatcattgacgggttcgtaaggggcgaggaggattccaagcgacggcaagctatgcaagctgagtatgataaggcttccgtcgccgctgctcaagcccaagcgcaagttcaaattgccgaaccacctcctctcactgttcgccagccccagccggcgatacaaggacaaccgtcaaggcaaggtcaagcccctatgacctggaggaagttcagaaccgaccgtgcgggcaaggctgtgatgactgtcgaagaagtgcaagccctccgcaaggagttcgacgctcaggaagcaagcaaccatcagcagcctgcccgcaagaaggcccgaaaagacctctactgcgccttccacagacgctcttcgcacaccacggagcaatgccgaaacattcggcaacgtggtaacgagcaagattcaaggccacagcagggagcagcagtcgaagcacctcgcgaagtagctcaagaacaagcacccccggccgaacaacgccaagatgcacaacgcagagtaatccaagtgattacaagggccgacccgccaatccaactgtcgaagcgacaaaagaagatgcagctgcgaacgatccacaatataacttcagcaggcgaagggtctccgcaatatctgaaccagcaaatctcttttgggccagaagacgccgaaggagtaatgttcccgcaccaagatcctctggtgatctcagccgagatagctagtttcgaagtccggcgaatcctggtggacgaagggagttcggccgatgtcattttcgccgaagcataggccaagatggggttgactacccaagcccttaccccagcaccagcattgctcacaggcttcggcggagaagcagttcaagttaatgatagccttcggctcgggggaaaatagacgcgaagagcaagtattgttcgacgttgtcgacatcccgtacagctataacgccatcttcggccgtgcaaccttgaacaagttcgaagccatttcccatcacaattatctcaagctcaagatgcccggcccgaaaggagtgatcgtggtcaaggggcttcagctttcgcctgcttcaaaatgcgttttggccataatcaagagagcagtacgcaatgttgaggccgaaccgcatgaccgggcgaaacatgcgtcaaagcccgcacctcacggcaagatagtcaagatgcagattgatgatgccgaccccacaaaactcgtatcactagggggcgacatgggcgaagaagaagctaagaacatcctagaggtacttaaaaagaacattgatatcttcgcctggggccccgatgaagtaggaggtgtttcggcagatctcatcatgcatcacctggcagtcaagccggacgccaagccaaggaaacagaagctatgcaagatgtccgctgatcgctaggaggcagcaaaagccgaagtccaaaaattgcttaaggcaggggtcattcaagagatcgatcatcctgagtggctggcgaatccagtgctggtgcggaaatcaaatggcaaatgacgcatgtgtgttgatttcacagacttaaacaaagcatgtccgaaggacaatttccccttgccacgaatcgaccagctcgtggatttgatagccggttgcaactcatgagcttcctagatgcatattccggctattaccagattcgcatgaacccggccgacatccccaagacagccatcatcacaccgttcggcaccttttgtcacctcaggatgcctttcggtctgagaaatgccggagcgaccttcgctaggctggtgtacaaggtacttttcaagcagttggggcgaaatgtggaagcttatgtcgacgacatcgtcgtaaaaagccgcaaggctttcgaccatgcgtccgacctacaggaaacctttgacaacttgcgtgcagcgggcatgaaactgaatcctgagaagtgtattttcggcgtccgcacaggcaagctattgggtttccttgtttctgaaagaggcatcgaggcgaatcccgagaaaattgatgccattcagcaaatgaagcctccgtcgagtgtacgcgaagtacaaaagctcgcaggccgaattgtggcactcagtcgattcctctcaaaggcagccaaaagaggtttgcccttcttcaaaaccctccagggcgcgggaaaattcaattggacacccgaatgccaaacagcattcgacgagctaaagaaatacctgcaaagcccgccagctttgatcagcccggcaccagaagcgaactgctactatacctagcagcttcgccagtggcagtcagtgctgccctcgtccaagaaacagattcaggccagaaaccggtctatttcgtctccgaagcattgtaaggagcgaagacaagatacattgaaatggaaaagctcgcttacgccctggtgatggcttcgcgcaaactcaggcattacttccaggcccacaaagtcatagtgccatcgcaataccctttgggcgaaatactccgaggcaaggaagttactggctggctcagcaagtaggcggcagagctatccccttttgacttgcattttgttgcccgcactgctgtcaagtctcaagtgctagttgacttcatagccgaatggacaccagcattcacccccgagcccgagctggtcgaacagccctgggtgatgtactccgacagttcgtggtcacacaggggggcgggcatcgcggtagtactcacatcgccgaatggtgtgccgattcggtatgctgcaaggctgtagttcgacacaaccaataacgcagcagaatacgaagccattcttctgttcctaagaaaggcaaaagcactgagggttcggcgcatgctaatccgaaccgactccaagctggtggaaggccatgttgacaaatccttcgaagcaaaagaagaaggaatgaagaggtatctggaggccgttcgatctttggaaaaatgcttcactggcataacggtcgaacatttacctagaggccagaacgaggaagcagacgccttggcgaaatctgctgcttatggtggcccacattcgcccggcatcttttttgaagccctatatgcaccgagtgtgcccatggacagcttggaggtcatggcaatcgaccaagtgaaactgggcgaagacccatacgtctggtgaaccccgtttgtgaaacaccttgaaaccggctggcttccaaaagacgaagcagaagcaaaacgcctgcaactcagagccacaaagtacaaaatggtctcgggacagctctatcgttccagggtacttcaacccttgcttcgttgcatctctttcgccgaaggcgaggaaatggcgaaggagatacaccaagggctatgtggcacgcaccaagctgcaagaacagttgcctctaaggtgtttagacaaggagtttactggcccactgtgttgaaagtctgtgttgagcaaatcaagaagtgtgaaagttgccagcgtcatggccgaagccagaccgcgccccagtatgagttgcagcccattgcgccaatctggcccttcgctagatggggactggacatcattaggccgttcccggtggcgcgaaacgggtacaagttcgtaattgtggccgttgaatacttctctcgatggatcgaggccgaacccccttggaacgatcacttcggcagcagtacagaagttcgtatggaaaaacattgtttgccctttcggagtgccaaaagagttcatcactgacaacggcaagcagttcgactctgataagttcagagaaatgtgcgaagggcttaacctggacatcaggttcgcgtcggtcgcacacccacaatcaaatggggcggccgaacgcacaaatggtaaaatcctagaagcactaaagaaaaggcttgaggggggcaacgaagggcaaatggccagaataaatgctatctgttctctgggcccttcgaatgacccccacaagaccaaccaagttcagcccgttcatgcttctctatggcgatgaggcaatgaccccaacaaagataggggctaactcaccaagggtgacgttctctggggcgaagaggggcgcgagttgtcgctcgaacttttggagggggtaagagtcgaagcgctcgagcacatgcaaaagtttgccacagacacttcggcaacttacaacaaaaaagtatgaccgacggagctgttgcctggtcatctcgtcctaaggaaaaaaggcgaacccgatagccattggcaagcttgattcgaagtgggaaggaccgtacctcatcaagcacaaatccaagacgggatcctttcaactggcgacaccggaaggcgaagagttcgaccattcctggaatgctacctctcaagcgtttctatgtctagaacgggtgacacccaaatcgccaacttgtaaaaatgtatatattgttatgtaagcccttcggcaactatgtaagcctttcggcaagaaaaaaaagaagaaaaaaaagaggaaaatgaaaaaagacaaaaaactggatgtagggctattatccaccacggacgcccgaaccagtataaaatctttgtgtcctctgccttctttttatttgtttgtgcgattgataatttgcggaaaaaaccccaaggcaaacgcctgatcagcgaaaaagaccagagggcgaaacgaatcggccgaagcatcgctcgccgaacgttgaaaccgcaacagcttgttttcggggaacaactaaccgaacaccgttacactcgatcaagaggaaagcgcaaagtgctccttacaacgcagaacgaaactgatcgaaaacggaagccaaaagctgaaaagtcaaaacctatttcgctaatatatgcaaaggggccgacatgttccgacccaacgaaaagcacgcgaagtgacaatgcgaaaatagcgaaaaggaaataaaatgcaccttcattgatttcaagtaaaatacaaacccatcacgatgctacaagtgagaagagaagaacaatggcgttacagcccagcttacagataaataacatcttcgcccccataatcactctctctctctagggaatgatcgtacacgaccctgagaggggaaggaggcgaaatacagactagactgtaacgacgctgaaagattaactcctgccattcagtcttcttatggtttcgccaaaaacgagccatatcctccaatcgtcttgtatgaacaaggtcgtagtcttctaagatccgcccggggtgcgcccgcatccagccggcgaccttaaacaccttatagatgtggccatttatcaccatttcgcgaaaaacaggccgaaatgggcactgtaacttcggcaaacccttcaacgccacaaacttctcgttgctgtttcgccaatttttaacgggaggtcaaacgcaaaccttttgaccgcacccctgccggcaaagcgccaaagaaaagggggggagaagtacaaaaaagagaagagaatacagacgaagatcagccccgatttcaaatagaaacaattaaataggcgaaagggtaatactttgccagtggaatagagattatattaagtacaaggtgaatgcggcttaaagccgaaatgaccaaaagtctatatacaaaagacttaggctaaaagaaggtccgaaaggaccaaaggaaaaaataaaatataataaaaagacacgagggcgaagggcctcacacctcagggtggtcttggcctccgtcgccttcgccctcgtgccccggtgaccgtcccgacggtccgggacccttttcggagttggcggcagcggctttctcgttcctcgcgatccattcaaggttctcgcggagccgaatctttgcacaatcccggccgccatcctcccaaaaccccttccgaaaggcccttaatgcagcccccgagcactgcgtgttgctaggccattcttacttcacgaaatcgggaaatccccgatgtggtcgcagccgtgcgcgtgcaagaggctgagaacgaatcccgccgaaacacgagttcaacagtccnccgtaggcgcctgctacttcgacaatcgagccggccgcctcctgcgtctattcggagaagtcaagtgcagtcccgccttcgcccggagcaccttccgcccgcgccccaaggtcattaagggccagccgaagagtgtaacaggcctccttggcggactctatggctggcaccagggttgcggccgtagcttcggccgacgcaagacaggcttcgagggatttaatcttctcctcggccgaagcaagttgtcagtctcgttcggcgtcccgctggcgtgatgcttctaggttagagcggagagacctgttttcgacattcgccttcttcaacgccaccacatgcctttcgtcttccttgtggtgaaaatcttcttcggacttgcgaaggcgaaggcgatacccatctagttgctctaaggcggacttcttggcactcagatgcgcggcaaggccttgataaaaaaaacaacatacattacgtcagagagctagtgaaagagcaaaattcagcacgcaaagatgggccatacccgcacaaataggctctccacagccgcgcagctttcgccgaactcgttcagttcggtgaaaagcccaaggcctttggtcggcgcaatgacctggcacaccccgtccatgaacggagtgatctccggccgcgtggcgatgtcggtagggacgaaatgcagggcggtaagcgtcacgtccgaaacgctcgcttcaaccgccggggccttcccctcgcgttgaagaataggtgaaggaaccgcatcgacccgttcgtcttcagcaacgttcgacccagcggttggggttgaggcactcccgcccgtcgccgcttcggcattgctagcgggtggcggagcatgcgcctaccacggaaagttgcgcgtcgcaacaccgacgaagtaggggtcccgtcggacccttcactgtccgaaaacccatggccgacctgcacgacctttcctttcttatttttccttctgacagccatcaccagtttcgcggctgtactagagatcgccaagagggtgttcgctacgacgatgtcttgaggtcatgtaggcgaaacatgggagcctgccctggatttcgcaggggtagggctgggggtataaccacgagagccatcctcctcagaaccggcatcagcatcctccttatcctcctcctccctatcgctttcgacggcggtcttcacgctacggcgagttcggacttggctgcctttcgagaccgcacgcttgcgctttttcgaagtgccagcctcgtcatcgccggcccgagaggggttcgatcggctcggcaattcgccagtatagacacgattcactcggccatcagcttggcgttggtgcaagcgggcaaacttggctgtggttagagccttgatcatcttcgacgcctcaatttcagcgtcttccaatgtccgcactgcgaaaatagaggaacacaaccgtttagcctgaaaagcgctttcatgaaggaagcacgcggcctaagtcaaaaacaaagaaccttaatttcggccccggtggggagaactaggcggggaagcccaagaacctctttgccctcgttcacggaaacatcccacacacgggcgagaggagaaatccgaaggaggcaaaactcctcgcaaaggtcccgagtgctcagccgccgggcaaccttgcgaaggagaatgagccgggacttgagagtcccgtcgatttgcatgttcggcttcacgttgatggagacggcagaacgctcaaaaagcagccagctcgcttgagcatcttcggcggagtaggggttgtttatgtagaaccatttctgcatccagttcctgtcccatttcaccatcgacgcgggcactggtcaagcatctgaacgctccggccgcagcatgaagttcacgcagccgaaaacggtcttcctcgggcccgccggcatctgcacgtctttggtcgaggcgcatgcagtaaacagaacggcgaaaagctcggcggtaggggcgaacccacaggtccgacacattcaagcgaaaaccgccagcttcgggaacgccgacgggctaagctggggaagcctaacctcatatgtcgaaagcaccgaaggcaagaagtcatcgcacgggaggcgaagaccaagcagcaaagtatgcggcaaagacaaccgttcacccatccccaggcgagggaacaacggcctcgcccccgcacgatccttggccctctatgagagaaccggatgataccagttcgcccaagtcggcctctttgacaagcgatttgccaaggaagcacgaccatccttcgccaaggcttacaggatcttcgccaattgacccgtccttggtaggcttgcggggggccattaggctcatagcacagaaaagagaggcgaaaagccgaaaggctaggaggacgacgatggcgaaaaggctgaagaaacagaagagtgaagagagcccggagtgagtcaagtggtaaaaaagggggagagcacgcgtagagtgaaaaatggcaggccggtttgggggtatatataacaccgtagcgagaccgttcgcctgccaaccaatcgagctctgacacgtgtcaatgggcagacgaaacggtaaattcccatcgggacgatgccaaacagtaaaaagcccgaatacgggaaaggaaaagtccgcagggcccattactattcatagtaataaaagagactaaataaccccccttcgacgctttgcagcgaatgcgaagaggagttcttctaaaagaaattttctctaagcgaagaaataaacaactttacttgcaagaacgatgtaggtttcggcaggagcaccagtcgaaagggggcgccacataccatatcacatggtttgcacggcctcggccgaagctcctatctcacccttgcccgtgaggggcttgttggcgatatggcatgaggcccttcgaccaaacttgcagaaatcatgcgcccgatgaggattcaagcccaagacgtcaaggttagtcaaggcgaaccctccccatgtcgaagactatggagcaaggacgacgagaggcacggaatcgcagccgagctggaggcctcctggacaaagggcgcaaggcgaagagcgtacgccgaagggggacgacttcgccgtagcaggttcggctccgggaaggccgaagaagctatcctggcccatcaagcccaggggttaattgggttgacaataaccagttggcccgctaagggcccatgaacctcaattacgctatatacccatgtaaatgtccctttcataagggcaaccatgtaaattcccctgcataaccaaaggcctagtagtaagacctgtaatgggggctattaatagccccatagggccatgtaataggggggctaattgtggactaaccgttgctatttatatatgttttaagttaggcctacgtcatgtgtgcgcacggatgattatcgatggattaaaatttgatgacgcgaagcgaagaaaagaagacggtaaaactagtgctttagttttaaaattgatcgaggtgaagggcgatcaaatttgctagtttatttttagtttcgccgtactatcaagggggtaatgacctagcaatgagatgattttaattgccacattaggtcattgcatttttcacttgtgctcacatttcatcacacacacacaatctctttgcatctcactgtctggcctgaccaggggcggtcagaccgaccacatagtggcggtatgaccgatggccttggccggtctgaccggcaagagagtggcggtctgaccggccaggcagtggcggtctgaccggcgggtataggccggtctgaccggccggccatatggtcgggatggcatgctctgggatggccgatcccgagccgccggagccgtattcggtcagaccgagctggtggcggtctgaccgagccgaggccggtctgaccggccacggcagtggggcccaatgatagccctacaatcgctagaaaactagccattgtagagtagcacggtctgaccggccatatacctccggtcagaccgacagagcacagagttgggggatttcgcccccaacggctagttttggttggtgggagtataaatactccccctccagcagcaaggggactctcttagcacccaattcaattgcatacaccccttgcacctctctcgcacccacttgagctttgtgttcatctatctagtgtgttagagggttaattagccaagagtcaagtgcattgcttccatttgtagagctagtgtggcacttgattgatcatctccacgccgggtcattgcttgttactcttggaggttgccacctcctagacagcttgtggaggagttgctcggtgacctctccaagaagattgtagaggagtcccggcgtcggtttgtgagtggtttggagttcaccaccttcggagtgaaggaaaaactaccccgagtgatcgaggcttgggtagtcctctccatggcctggctcccgccttgcccaccccttgacgaagggggcgtgcggtggcttcgtggttgagcggtggagttaggctcgcctcaacggggagtaggaaaccggcgagtttccgaacctcggtgaaaaatctcttgtttccttgtctcatttgattgtcgcatttacatttgtgcaatttatatttctagagacatacttgagatcatatcatcctaggattgttaaacattgatataggagtgtgatttactttcctagagatataattgagccactatcaccctaggtttgcaaaacataacttagttgcttagttagagttgaccctcaccaagcctagcaatttatgttagttttgattaggtttcatttagttttaaatcgcctattcacccccctctagtcgacatctcgatcctacatccgcagccaccaacccccagtggcaaacggattaccagtaatccttttctttagtgagggtgaacagattcaactgggcctaaggaatatgcgcaggggcaatttggtccggtcgcgtcaatatgtgggcctgctcaagcctagtcagcacgaatataataaacaaatgggtgcggtgtcctctggcaaatagccatgttttgagagtgtcttgccccaaaactcactttgtgcggtgttctggagctaattccacgaagtcgcgatgtcctgtagcaaaatttgcctttttaatagatgacgttgttgacttttgaaataacgtttgactattcatcttatttaaaaacttagtgtaaaaatgctaaaatataccccctccgtcccaaaaaaaaactcaacttgacccctcctaggacagtgaagtcgcgatgtcctttatcaagattcgttgtgctaggaggggtcacatccccttctaagttgagtttttattgggacggagggagtaagtcatacttaaagtttatttaatggtaaaacatgccacaacaaaataggtaacatttataaaatattttgagtaagacgaatagtcaaatataaacaatgttatctatttaaaaaaataggagtactaaacaacaccgcacaagatcgtaaaagataattttgttgcacaatataattttgaagctcatgggtcacttacgagacgccgctggccatctccgcgtgccccagcctagcccaccacccctgccgcggccgcggccgccgacgaaacccaagagcctacctgcggagatggactccgagcctgagctcaaggcgccaccttcgcctccacttcttgccctgccacagccacaagcggatggtgcagcgaggccgtgaaacctgcgacagcggacgcggcggcgcccagccgcctacgtgtcgtgggctatagcggtgcccgtgccatcctcatcccgacgccagaagcgcgcggcgttcttggtgtttctcaccccggaggagatcgaggaggacatctatgcgccgccgtccccctcactcccatcagcgccgccgtccttctccccgagttgccaccgttcccctctctctcgtccgcgccgctgtcctccttcccatcgcgtgctcacctccagcatggcggctcggcgagtggagcggaggctaatggagaaggagatggaggcgcggctatggagctcgcggtgcagcggccgccggagagaaaaaaaagagaagaagggagaaaaaaaaaggaggaggaggaagagaaaaagaaggaagaagggagaaaaataaaaaatttctatgtcattatccacgtggcgtgccacgtaagaccacagccaaacaagactttggatcgggttgatacaataaaccaagtttagagatctcaatgtgcgttttataaatttatggacctaactgaaacctcacggcaagtttaagaaccgctggttttactctttcaaattcattttagctaccactaataaatcatgtactaaccatcgctctgtaccctcacaatcgaactcagcctacgaattgctttctcgacttccacgacgatctgtgacgggaagagggtgccagggatcctgtgctgttgtcgacgaagatgaggtcgaaggcgtcgtccatcaagaggagttggaaggagccgatggcatggtcggttcccttgaaccggtcaaagaagaagatgtagcagaggagcagtggtgttcttttctccaaaaacatgaagatgaagattaagttttttacgtaaaacgaggtggtattaaagtataattgattgagttttaattattataaactttaaaaatagattaatatgatattttagagcaattttcatatagaaagttttcacacaaaacacatcgtttagcagtttgaaaaagaatgtgctatgaaaatccaaaatttcatccaactcttattggagaaatgaacggaggagagagggagagaaagaggaagggggggggggggctggtagtgatgaaatataggtccttcccgctataatttttgtaaggcacccgctaccatataggcctcctcaattttttttattttgtgtgttttattccgtgccaaaaaaacgccatatcaatgtcatataggacgaagaccatgtcaaacgtaccacatagacactacgttagataaaaccgccttctaaaccgtctaggatttgatttacattgattttgatagttggtggatattatatatctgatgtcgcggttggggcactaaaataaaactcaactcataattgagagacctaatactttttctaaaaaaatttctgactaggaatgccacgtcagcgaaaccagatatttatactgctacgggacctaaattacatggttttgtatagtttatgggtgaagatttatggtattaaggataagggatgccaaataatctcggtgtaaagttttattttcgggggaaaactcggtgtaaagttgagggacgacggatgaacttattccttttcctcctgttatccaggctcgtgcgagctcatcaggcattcaggcctggtttgccggccatatattataacccaatccaaaaaggaaaaagtatactttgagtccctcaactatcgtccgaatatgattcatgtcatccaaccataaaaccggatatatcgattcttcaaactattaaaaccggtgcaatcaatgtcccttggtggttttaaaggtggttttggcttacgtcacctacatgatggtcttaaccgagtctttgtccaatgtggcgcttacgtggcattagaaaaaaaaacaaaaattaaaaaaaagtgtgacccatatgtcattcgcaaaaaaaggtatcgtgggacccacattgtatcctccctctccttcccttctttttctctccctaatctctctctcagctatcggaacatgaggagacggcggcggcgtcggccgaaagtggcggcaatggctttggggacaacagtagggagtggtgacggcgtctggtggtggtgcacgcacccgtccaaacccaggcgacgtctgcgcggtggggatgaggaggagaaggcggaagaggttgtttgcggggaggatgcggtggaggtggacggcgtagttcagggaggag

SEQ ID NO: 77477 - DNA, 5418 bp, Oryza sativa
gtagtacttaattaattagctagtgagtgctggcctggatgcatgacaatcatataatcagacaataataatgtgtaattaatcaaaatctccaacagaaataaaattatcttcatttcctcatatagtttcctcagtttgtcctcctttcttggacatgtttgcgtcttttcttacagattctttatttcgttttgtgcaacattttctttttttttccatacataggagtatagatatgtagtacatacatatgtacataaatagatcgaagtagtaacagtatcagcaggtacccagatgatggaacagctaataattaaaagagttgaggaaaagaggggaaaaaaggggtggggtttgttggtgtgggttgtggtggctcttcttgtctcatccctttcactgtgcccatatttgggtgtgatatgtggctttcagttcaggctagcactgctgttgtgcctcttttttgggcagatgaggaccatttgtagtatgcatttaagggtttgcaatttcggtaaccaccgaaatttttataatttcgtgaatttccgtgttttcttcacaaacttatttgaaatattaacatatttccactgagtttgaacacattttaatcaaattcatatatatttgaaaaatctgaaaattttgggggagatttgtgtttgaccgctgtttacacccaaatttgacacgtagtaggatataaatatgagaatattgccaatgtctgaagagcgtcgggtttccttcatggagccagtctgaccgccgtctatgggcaggtctaattggtggcatgtggtcggtcagatagacagagtctgacgccaagccaattttcgtcggtctcgagtttccatactcagaatatatgtttcaggtttttattggtttctaagttaagttggacatgaaagacgacctgtaggaggcatgaccaacccctatataagggccaagaccgatttaattagcaacacaatctacttctaacacaattagccaattgtatctttttttaatatgcagttaccttttcacttagtttagcctactttcatcaatctttatcgatttgcgctttaaatcgtccacttttgccgtgagagtacgattatccttttgtagatttgtcccatatataaatcttccgttcgccaatgagacgggtaattatcttcaaatcgatttaaatcagccttgagattgatttgatatctaaattggcttcactagctagtttagtcttacaaaacccatcttgatctagttttgctaggtcaaggtggctagcgactcaatccatatccccgcaaggtgtttaggtgtcccgatcatgattgttttcttgccaaaaaaaaaaaaaagttgccaacgctcgcatgttaaagatgatgcaatagcaatggaacggatggcattttagttctctcctttaatttgttcttgacttctgccactagctaccattgcatctattttgccaactgttcctgcttctatctgctggtgtttttttttgctggattcaatgtgttttaaatttgattgtgtggtgtgattaatgttggttaattaattactctttactgtacactttaaatttctatttgatgttaacatttacagtagttgaaagtgtacaatacactttcaaccactgcaattgttaacaataaagagtaattaattaactagcataaattacaccataaagtcaaattttaaatacattgaagtattttttttttcacatgtgaaaaaagacactgctatttattgagtacgactagcttgttgttactactatgtggtgcaaataatattaatccctttagtttttaggtaaattggaaccatgccattataattttgcaaagtttgagatatgccatcggtatttcaatgacacgtaggacccacatgagtcaatgacatgtgggtcaggatggcatatcttaaattttgcaaaattataatggcatagttccaattttcctttttttacgaaccacaaaaaatatctttttccacatatgatttttttaaacattaaccagtaggtgacacaactgaattttgtaagacgcgtgaaatgcaagtagtaacttgttgtttgttataagaacatgttccattattcggaaagttgattcatctaatttccttcacaagggaatactcttacgccctaaaagggcactaacagcagaataatgccgatttgatatatacttttttttaacaaactgtatcaaactctccgtctctcataataaggtacaaaaggagcttttttattttctaaagatcaacttacctgctcgaaaaaagtttgaaaagtcacttgaaagcttacatcacaattgaaagtggcgaacctatgtgcttctcttaatctcttatcgggttttgacagcggtgaacctatatccgaagaactcgtgtaaattatttgactaattaatttatattatgttaattagtataaatgattaaatatgtatagagtctagtaatttttattctaagttcgggattggccaatcgaaagagttaatcgatcaaagccggcaacctgatgaacaacagtgatgattcctgtacgggcggcggcagcggcagcagcagcagaaccagctcagctatgttcgttcatcgtgcaaatcgaccgtcagatcttaccctaaaattttacaccctatcacattaaacattagaacacttacataaagtactccctccgtttcgaaatgtttgacgccgttgactttttatcatatgtttgaccgttcgttttattcaaaaaatttaagtaattattaatttttttcctatatcatttgattaattgttaaatatatttttatgtaggcatataattttatatatctcacagaagtttttgaataagacgaacggtcaaacatgtgctaaaaagtcaacggtgtcaaacatttcaaaacagagggagtattaaatataagctaaaaaataactaattgcacagattgcaactactttgcgggacgaatcttttaaacctaattgctctatgatttgataatgtatgctatagcaaacatgtgctaataacagattaattaggcttaataaattcatctcatggtttactgaccgatactgtaattatttttttattagtgcccaaacattccatgcgacaccctatataatacccgatgtgatatgctaaaattttaccccccagaactaaacaccccctaattctaagatggagatcttttttttttgtcaatgcgttcgtgtgcatgcagttgtgcagtggtagcagttatcagtgctacccctaaatagtagcttgctaagagccagtggtagcagttatagcaggctatataagtcagctataacatcgagaagaaaagagaagagagaaaaaaacgggctacagatttgtagccagctgcaatacgaactctaagacgttatgtgtgtatgagaggtaggaccggatattaatgatatagtatatttttatagttaactattgtatgaattggctattagattagctataggtgaattggagccagtagttggctattctattaaacttgttctaaaaatataagaatatataatgtttcttagtacaatatatttggacatgtttagatttattgtactataaaatattccattcagttttagattattgtatttcgggtcagagggagtacgggtttaacttttgtagcctgatcgatgatacggtagaagcggacgaggcttctgtttgtgtagtttgtacatataccactatactgtaggctatagaaagtactccctccataagaaaaaaacaacgatggtagaatgtgacacagtagatttgttgtaataagattgtcacatcaaaatactaggttgacttttttttatagagggagtacggctcatatattagtgatttaagtgcaaaccgcggatccacttttatcataagcatgtattgtgggttttatatgttctagccctttttaattatttattattactatttccattatttttgaaaaatagtatgaatttgtcgatatttgatgtcgcgattccggtatttgcatagaatggggatcgttggtaccaggatacatgcgagacttaggtaaaagagatagaaacgatgatttttatacaggttcgggcccctgaattgtcaggtaataaccctactcctgttggccgaagccggtcgttgctcttattaaccataaccctactcctatctaactgttgtcgacttggcggtctgaagtgctgactcgtagtcgacaacagggtagccttactcctcgaatccgcatccggcaagatcaaagacagcgctatgtctctcctatcagtatccgtagacaccgtaggggactagccatgctaatctctgaagtcgatatccggcgtcttgtcttgacgtatgttagcttgtatattgatcttgtgtattgatctattgttccgtgtcccctctcctcctagggggccttgtatttatacccataggtgtccgcttgtccaagtagaactagggaaaccaatatggatacaatcacagtagtccttatcgtttccatgtagaactctggttgtctttccttatccggaacttctcctatatccgaaggttgtttccgtataagacatggtatatggtgggtcctgccgagatttagtcgactattattaggtatatggtatccataaccctgacagaattaccctactaaactatcgcggtcgaccgaattacccccgtagacttgaaaactagatattttacaccccaaactattgaaaccgaacaaataccactccctcactcaatccggagaaaaaatggtggggcctactatcagatctctaccctcccacctctctccaccaccatgtgttgtggccgacgatgatgccgcctgtctcccaccatccctctttacccaccacctggcgccgccgccacactcctcgtcctaatcgaccctccccaccgcacgcaagcgcaggcgtccccatagcaatagccgtcggtgatggcggcgccgcgtcgtccgtgtcacgggcagcgtcagcagcgatacaccacgtatccactaccagcttctccttgggtgatgacctcactggagaagccgccaccatggacaacaacgacaacgacaatggccgttccagcatcttctcgcgagacagccttccccaccaagccgagcaacgcaaatgtatcctcttctcttcgatcctaccacggcgcgcttgctgtcacattccccaactccaaatacacctccatcaccatccgggcactgctagggtgcacctcctcttcggccttcgccggcacatgcacgaggagagtcatag

SEQ ID NO: 77478 - DNA, 2064 bp, Oryza sativa
ttgtgtgtgatgtgaatgtgatgtatctgtgttgaattttgtaaaatttgtgatgtatcgatttggggagttgaggatttgaggatttggggataatttatttgggattttgggatggggatggggtgaaatcgatatattaaaaacaatgaagaaaagaaaataataatggagtaaccggatctagctagcctagctctatctttaatcccggttggtaaaaaaatgttctatctttagtcccggttggtgttaccaaccggggctaaaaaggttctatcttaccaaccgggactaaaaatggatttttactcccggttttttcacccggtcccggatgggggttacgaaccgtccgggggttacgaaccgggagtaaagcccctttctccaccagtgtttggtcggtttctcagccttcacctttaaaccacgaagaatatatagaaataaaatcctatcctaaaattattgtttaggcttcgtgcctcgtatataccagatgatcgtcccgcgctttacgcgggatatatgttagataatagagaaatgatttacattgaaatattatgaaaatgattcgagaatgataatttagcatgtgtatgtttagttttagaataaaataaattctaacatataattactatatgcttacatattgagctgtgtatgtatgttttatgagtgctaataatacattaatactatactacaagtatattgagttgtaggtgtctatagcaaagggtagtagtaccactatcataccggtgagcacgataaattaacagcgctgcagctggtgcgaagaaccaaaggctcggttctgcgtatgcatgcatacatgcctttcggcaaggtcaacagccacgttccagaccacagtttgtcgccaacatggttgatgccgccctcactcctggaaacatttctacactccttcaaaaaaaagtctctaattatactatggtgacagtaaatctacagtttttatttttaatattgttcttttagtttcaacaaattgcctcataatatttttaaatattatgggatagttcaacattagtttcaaacaagtaaaaagcagataatcaaataagtaaataagttatactaagatatttaattaaaaaatatattttgctatgatatattgtgatttttttcttctacccatagcaaattaaagcttgaacattttgctagtacgacatacatgcatatggtcagtgaaaataaaggttaatacagctctgactataaaagcctctgcgggaaaatccatcagatagccaatgtgccgggacctaggagacagcaatgacctggatagatagatggtgaagcaaaaaccgcacattcattcaatcatgcatgcatccacatccaacccaccctactcaggtcttggctagtcaagtggtaactggctacccaaattggatctaaaatatgtactctctccgtcccaaaaaaaataaatttaaaactacatgtggcacattctagtagaatggatctgtacagaggtatgtccagattcatattactaggatgtgttgcatccagtactaggttggttttttatgagacggaggaagtatagcttagcgacattctccaatctccacctctggttcgaaacatttctgacacaaatttttctccattctgtaatttcattcgggtgatgtgaacaatttctgtctacattggatttaaagtataggtagccacattattcacctccaatctggaactctctgacaaaatttctctcgattcaacttcatttaggtgacctgaacactctttctaccagaaatttgtgtctccaatacaataaaacttgtttcgttcatgccaaatgccgccacagccttcagccaacaaaatgacaccgttcggagtcaggccaggcagaaggtatacatacgagccaatggaacaaaaaaagcaaaatggaaagacacaactcaaataaacaaccaaatacttagataaatgtgtgcagacatggattacaagcaagtaaatattagctatgcagaaggccaa

SEQ ID NO: 77479 - DNA, 7803 bp, Oryza sativa
atgatcagtgcgatgataaagaaggcataatgttcacctttgagtccttacatggacattatatatctagtgtccttctctgaatcattataactactgctgcaatgcaaggatagaaagcactgattttattgtacaaaggcaagatatggcatggcagatgttgcgataagctagcactcacagtggcagggaaatgttgtggtgaacatgatgaataatgcagcagcactgtgtgcaacaactggacaaaggagcaacagtcaagcatacctttgccaaaataaatgtacagggttctgattgcagcctgaagttcaggagaattaggccaccttgacgataggtcaatgcaaaatggtcaagcatccgaatcctgttgctggaagaaaacattttctgggacagtaaagcacaacgaacacattcatggactgaagctcatctagttgaccccccactgggccattctggtcttggccactggccagtgctaaattacattgatcccacatcacatttggagctttgcaagaaaaaagaatatcagtttcgtttgggttgaacattcaaacttctcatgttaaatgtcataatattgcaacacagctcaaccatttcttccttacgttctaagtgaacagcacagctcaatactgttgacacatcttctctcgacatcagaccatcaaatctgaagtgttttggttaaattaatagataagtttgttttaaaccgttaaaaataaagaccttcaaatgataggaactcgacatatgcatccctttatccagtgggtattaaactgaacttttagtagtagtatgatatacaaacataaaagcaactcaaaagttcctttacattcgagacataactgaacctaataagagattgtaagtgggatggactatcaattatgctgagataatagactagcaaagtaattataaaagagcatctataatgggcataaaaaactatgtgatgtctgaaatccttggaatgttatgttgttgacccaaagaaagttttgctctgaaaattactgacgtatttttggaaaaatctgattagttttcctagtgactgaccattttctagctctagatcaacctagcaatttagcatctgtgtttattcctttcatattagtggttcccaggatgacaaataagcaaatcacaataagtaaactgcaggtggaatcaaaactgaaatgaccgttctcaaatgtgttttcagaaaccgaaaccattttctcaaaactgaaaagaactctatgctcagaaagtacgtttcagaaacgttacttttgaaaggtgaattgattagtggcagactaagtaataaacttaccacaacaaaaaattgaactgcaagttgtcatgaagcaaggtctttacaggaaaccatttcacaatgatgaccctgatccatgaatctagaaagctaacaagcatttcactggacctgtaatttgcacaagcaactgagtgagccaaaatctgctgtatgctggatgcttcttctacattccagagccttgttaaatcctatcactagtacaaaaacatatgcagttttagtgcaaatcaatatgaatgtctgagcaggtatatgaaattacagaatgtactgctatttacttctggccgataattactatgagacgtgccattcatgaagaaagaaaatatgaacatatccataaactaagaaaaactttggcatgacagtgaagcatattgcaatactctgacagagaaattaagtcacactatcgaaagctttctgcaatgctgaggaaactgcacttaatcatatggaaacaggaaacagctctcgacggaatcttcagctccacgccaactatgcctcaaagataattttaaacttgtagcatatcttcgtggtttggctttattaactaacttaacttcaagtaattccttcccccctactcggagttcctcccactactaggaaaaccatctttcatggcagccatattgggttttcactggcggaatttggagccgccacaaagcaaaagccagagaaaatagaagttttcacaggcgggaattgaaccaccagcgaaaacggatttttgctggcggctatattacacggaccgcttgtgaaaatggattttcgctggcgactgtgttaggcgggccgctggcaataatccatttttgcaggtgtacgtgttaggatgactgccagcgaagctcatctttggtttaaaaaaaaattgaaaatacccgaatgcatcttctctctaaccgccagatgcaaagagcaaatgagcaaatgcattcccattccgcattgcaaccatttcacattgcaaatcaaatccaagacccattcccattccacatgtcgcagtacaaatccacatatctcaacaaattccacaaaacccatttccattccacctatcacagtacaaatccacataaaaaaaccttaacaaattccaaaaaaaatacaaaataagcaaatctcaatgagcacatcgacgagcttccccgcgccgctgccactccgtctgtcactgccatggacgagctccccttaccagaagcagccgctgccgcggccgccgttgcccgtcgccaccgccctccccctcccttcttcggttggatctgggaggggaggggaggggagccgccaccatcctccgccctccctcctttggctggatctcggaggaaaggggaggggagccgccgccacacccaaagcagcagcagccgttgccaccgccctcccccctccctccttcggctagatctgggaggggagccgccgccgcgcccgaagcagccaccgctgtcgccaccgccctcccccctccctccttcggctggatctgggaggggaggggaagggagccgccgccgtgcccggagcagccgccaccgccgtagtcgtcgttcgccagcgccgccaccatcctccggccacagcttcggggccggatccgaggagaggagaggagtggagaggagagaagactggacaaagttggtggtggatgggtgggtggggatgcggtttttaataccgtgcaatgcattttccagtcggtgctcaacagccaccagcgtagattaaattttcgctggctgccggtaaagtggaccacctagaaaaatctaatttttgcacgcggttgtttaggtgagccgctagcgaaaatagctatatttttgctagcggccctcttaacccggtcgctagcgaagatctatttttgctagcggtccgtagcccctcaatccctttaatattttcgctgacggtttccacgtataaccgccagacaaaaaaaaaaaaggtggtgtcactaaaaatcgattttgtagcagtgtctatatttccctgcctgaactaatgtgagtatgtgacctttataatgaatgcatatggagaaccatgagcattctcaaacaagtaatgtatgtaataaagaagaaatatgctgacagtgcacttttgacaattgcaaattgtagaacatagtgatctttaattgacatccattaacagcggcaatgtggcatgagcaaatctgcatttattccttgagactgttgagtattcacatcttattttcacaaaccatttctgctcataccatattcagaatgaccaaatcttattttcgcaaaacatttctgctcataccatattcagaacgaccaactaaacccgataatgcagtaagaaaattcatctgacatagagcccggccggcctgcaaatgtacctggtactgagcaaaaagttacaaaatgaacgaactcggtaacatctagttataccttataaccacacaatgttttctgaatcaaaaacattattcaagattaggcgagcgaagtattaacctctaatcgatgggaagagcagccgctgcttctcgtacggcggccgcggcgggacggcgatctgtcacaatccgcgtcggagtgggtgaccaatccgacttgttcaatccgcttacgagaggacgtaattattttgaaaaaaaaaacgaaataggttctccaattaatttacccttgcctatgttaccccgataagggatacagataagataccgatacggatacagatatatagcgttttctaaaaaacatggatactaggatgcatttgtgaaattattatcatgattaatatttgtgatgaataattggctttacaaattatttatttaatgaattgatttgaaaagatgtgtggatgttggtgtgagtgcgtgtgactaatgtgggttaggtaggttgtgatatatgtgtccagaaacggttgttttgtctgattgtgtgcatgtgacttgagatcagccttggtcaatggtgaggatcgggactatgctcagggaggagcagaggctagtgcggtcggaataacatatgagaaggtgactagagttaggactctcgcaggttaactgttgagattataggcatataatgatttaatctattccataaataaatcatgacattacagatgaaaactagcatgaacgcatcattagatctacacatataactacacagtataacatgaacatatcaaatatgcgcaacatattgaacacgtaccaaggtggcggaaagactcggtcgaaacttttcgcaggcatctacgaaggcacgcagcacgcgagcgaagaggaagacgagccgtcgcggaagaacagggagcagtcacgcaaagcgctccccaaaaaccttattgccgccttctcccagtgcagaatgtcgaaggtagaggttccggagacctgctctcccgatcgcaggtgcacgccggcgagcgggatggagtaatctacgagcgacggcacagcacagagtcggaggcaaaccctagattgatttcgcgtgtgttgcgtgaaggtggcggctcggtttatataaagaagggtcgcttgatcagggcacccgcacgatctccactgcacgtaaccgaaccggataagtcgcgcgtaacttatccggactccacgccgatctgaatttgcagcaaaacaaaactgcaaaaggaggctgcatctgcgcaaggtgaggaaccaattttgacggaccattcgacgcgtagccaggcgaggcgaggcgagcgagcgcgcgcgtgtgttccccctcttctctccaccacacatgcttcaagtggctaggagggcatcctcccttttaaggaggtccccctctcctaaaataagcaaggtggtactaaactccacatgcatgccatcccatgaggtgggcttttttgatttttcaaagaattaatcttcgagtgggctaaggcccattcattaattctgacaatcccccaccaaatctcaaaatcccactgagatttgccttttccaatgtactgtttatatactagcggttcgatggagaccgattaaagttgaacatccacctagaactccaagctacatttactcacaacttgaacaatggactatgccttgaattgcaagtcttgtgcaagcaagtttcactcagaatcttatcttgtactagaccgtctgtagactacccctcgggtggagcgtataagtcatactcctaggtctttagtaagcttcctagaagattcacccaaaatctccatagactgcgaccaacagtcaagctcacaaaggtgagttctttcaagaatgctctacaggacagcatcttcgctaattaaagccaacagaactcattaaggcatagccaacctgccttgcagttcacgagagtacatgcatcttcacttagagagggtatagattggtactctcctctaatttacttatggtttgttcttcccatattctaattcacgggatctccgatcacatagactgggttaccaccatagtataactcacatgggtctcaaatccatctccttcgatgcattgtctatcacatttcatgatagtcccttcgtgaagggatctgccaggtttctagctgtttggatgtaatccaacgttataactccggagtttcttaatttcctgacagacttcaatcatcttttcacatgtctagacgatttcatattatccttagaactattcactttgacaattaccgtttgattgtcacagttcataaggatagccgcctccggtttttcaacaatagtcagatccatttgatagatcacgcagccattctgcctcaacagtagcggtatccagtgccatcagctctgcttgcatggttgacctcgtcaaaatggtctgtttgcaagacctccatgaaacagcaccaccacccagtgtgaagacatatccactagtggctttgatctcatccacatcagagatccagttagaatcactataaccctccagtaccgcaggatacccagtatagtgaagccccaattccacagtacctttcagatagcgcattactcgctcaagcgcacgccaatgatcatctcccggattagaggtaaatcggctcaacttgctcacaacaaaggagatatcaggcctagttgcactagccaggtacatcaacgagccaatgatttggaagtattccagttgattcctagcaattctcttgttcttgcgaagtaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatccttcatatcaaaattttgagacaaaaatgatttaacctcatttatcacctcaaggtttgtcccaaatatcagtatgtcatcaacatacaagcataaaataactccctcacccccaccatggcgatagtatacacatttatctgcctcattgactgcgaagcctgcagatgtcaatgtcttgtcaaatttctcatgtcattgcttaggagcttgtttcagaccatacaaagacttcaacaatttgcacaccttgtcttcttgaccttcaactacaaacccatcaggctgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgcgaaagaaatcttcgccttctttctgagtgtagcccttagcaacaagccgagccttgtacttttcaatagtaccgtcaggcctaagcttcttcttcaacacccacttgcatctcacaggtttatacccatagggtcgctctgtcacctcccaagtcccgttagcgataatggaatccatttcactacggacagcctccttccagtagtctgcatcaggagatgcatatgcttctgaaattgatttaggagtgtcatccacgaggtacacagtgaaatcatcaccaaaggacttagccgtcctttgtctcttactccttcgaggagcttcactgtcatcctcctcagtgacatgttcatgtgtatgttcagtttgttctggtggtgtgattgaactgagaattatttcagatggttggctcgaactactatgtgtatccttcattgggaaaaagctctcaaagaaggtagcatcacgagactccataattgtaccaacatgtatgttaggtacctcagatttgactattaaaaatctataggcaatgctgtgatgagcatatcccagaaagggtaccgagctcgaattcgcccta

SEQ ID NO: 77480 - DNA, 2702 bp, Oryza sativa
agcacccccatgtgcgcaaataagaaagtgatggttttctcccaatcaatatctcatatggtgttttgtccttatttctattaggaactctgtttaacacatgattcgaggtcaacaatgcctccccccaccatgctttaggtagtcccgcagtgtccaacatggcattcaccaagtcagtcagtgtgcggttcttcctttcagcaatcccattagactcgggagaatagggaggcatcctctcatgtatgatgtcatgttcctcacagaataagtcaaactcgtttgagaaaaactctccaccacgatcagacctaagtctttttatttttctgtcaagttgattttcaacttctgccttataaattttaaaatagtctagagcctcgtctttcgttttcaacaagtacacatagcaaaatctagtagcatcatcaatcaaagtcatgaaatatcgttttccatcctttgtcaacaccccattcatttcacaaagatctgaatgtaggagttctagtggtgccaagtttctttcctcggcagccttgtgaggcttgcgaggttgcttcgattgcatacaactatggcacttagaacctttgacaatggaaaacttaggaattaaacacatgctggaaagccgagacatcaagccaaaactaatatgacataaacgtgagtgccaaacattagcctcatcatccacactgccacaaatatggttcacagacttgttgcagaaatcagaaaggtaaaagcggaacaggcctccgcacttataatctttaccaataaaatatccatgtttagacacgactactttattagactcaaaaaccaacttaaatccatctctagtcagacgggagccactaacaagattcctgtcgatagaagggacatgctgcacgttcttcagctgcacgatctttcctgaagtaaacttcagatctaccgtgccaacaccatgaacagaagcatgtgacccattccccattaggacggtggaaccccgtgcgtcctgataagaagaaaacaatgagatgtcagcacaaacatgtacattggccccagtatcaacccaccaattagtagactgattaactgaaaaaacagtaggtaaattaccatacccgcttccatctccagtgttgccaatggtcacattagcagacttagaagtatgccctgcaggtgccttcatccccttgcgctgtggacacttcctagccagatgaccaagttggccacacacaaagcaagtcctctcatcctgattaggattgttgttcttcttcttttgcttcttgaagttggtggtctgttgagctttgtacttccctttgctcttgttctgggccttgcgcacaacattggcactggactgtccaccatcgcccttagatgcgacatctttttcccgagctttctcctcaacatcaagagacgctatcaacccctcaacggagtattcctgtctcgtgtgtttgagtgcagtaccgaaacttctccaagatggaggtagtttcgcaataatgcacccggcaacaaatttgtcgggtaagacacacttaaggagttcgagttccttagccatggtttgtatctcatgagcctgttcgactacagaacggttgtcagccatcttgtattcatgaaactgctccatgatatacagatcattgctagcatcagtagcatcgaatttagtattcagtgcatcccacaactccttagcgtcggtcatatgcatatacacctcgaccagacgatcgctaagaacgctaagaatgcatcccacaaagagagtagtggcttcctcaaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacaatgcctacaataagggatttggattgttgagattatagacatataatgatttaatctattccataaataaatcatgacattacagatgaaaactagcatgaacgcatcattagatctacatatataaactacacagtataacatgaacatatcaaatatgcgcaacatattgaacacgtaccgaggtggcggaaagaccggctgctcgatcgaaacttttcgcaggcatctacgaaggcacgcagcacgcgagcgaagaggaagacgagccgtcgcggacgaacagggagcagtcgcgcaaagcgcttcccaaaaaccttattgccgccttctcccggtgcagaacgtcgaaggcagaggttccggagacctgctctcccgatcgcaggtgcacgccggcgagcgggatggagtaatctacgagcgatggcgcagcacagagtcggaggcaaaccctagattgatttcgcgtgtgttgcgtgaaggtggcggctcggtttatataaagaagggtcgcttgatcagggcgcccgcacgatctccactgcacgtaaccgaaccggataagtcgcgcgtaacttatccggactccacgccgtttgcacgcaccggatttttcggaacgtttccaaaacaaaaacgaatccgaatttgcagcaaaacaaacaaaaacgaatccaaatttgcagcaaaacaaaattgcaaa

SEQ ID NO: 77481 - DNA, 2902 bp, Oryza sativa
ctatagggcgaattcgagctcggtacccttccaacaataacttcggtcaacggtgcggatcgggactagactcagggagaagttgagatccatatggttaaagataccggatgacaaagttggatacgagatggcacacggtggatagacatcgtgtgagtgagatctttgcagcgggcttcacgaggtttgcatgcagacgtcggtgttcgcgaaggagattggaagaaattgaggaggggtatatatggtgctacagtgcttcgggttactgtgtagcatgcatatatgtatgtgtactgtggctagcagtatatattgtatcgcggcttgcgtgcatgcatgtatgcgtgatatacatgtgtgcggctcgatggttatgcttgctggtgccgatgcatgcatgtgcagtcggcatggcaggcgacagcagcggctcggttggtgggcaaagccgagtcggctcagggagcagcagcgagcagtgaaggctcacgcgcgaggagatcgagtccgactcggtgtggtgcggctgcaggttttggtaaattgtaaagggtttgaaaattaagggattgagttctactgtgaatagaagttctacatctactttgactagtaaattttaggtataaatagatgagggttagggctaggagatatcgactttttggaaaataaaagttagggtttacttcgaggtttcaatcctagttcgtgagttgagagaggagttctctagatgcactttgtaaacacatattgatgcaataaagttgatatactttcaagtgtttcgtcgatacgtgtttttctagatcccgacggtttgaccgaaggcgagtcggcggtctaaccacacgggggcggtttaattgacgataaggcggtggttagaccggcagcgtgcgagctgtctgaccggcggcgacaggactacgtcaagatctccatcgatttaagggtaacttttatttccgctaaaagtttttgggtttttggttttctctactattcacccctctctctggtaggtttgtttggttttttgcgatcctataacattgatatatatatctatgtttacatattattaaaatacagaaaattaaggaacttttgcaaggaaatagcaatataacactgagtgctagcgcagctgacttccataacaattttctgcacttctctcttatagataattccagttgacgaatggattaagcatacacaagtgtaagactataaatagtacacaaatcacaatttaatagctcaagttactcttgataatttgcatcaacaataacagcagcggcactaccactggacaatctaaaaaagcgatagtacctgtcgtgatcagaaaataaggaacgcatgcagatgaagcgaacaccaaaagtgtagacggctccagcgacgggcgacggcgtcgtcagatctggtctccccgcttggccggggtgaccggcgacgggctcggtcgacgccgacgcagctccacggacctggcaggggggtggctagcagcggcgatggtggcggatgtggcggcgacgaagttggcgacgacggcggtggactgcggcgcgtgccgcgacgccagccctcgtcaagaaccttgctgccacgagggaggcgcggcgccctcgtcaatgctccggcggtgaacaccgtgcccgtgacgccttccttcatgtgccggcgacccgcgctttgcgctgcacctccgatccgcgccaccccggtcggatctagatggctggcgtctggcgacgctggctagcgacggtggcggctggacgggggtgtccgtggcggtggcggtggcgatgatggctgacggtggcggctggtgacggtggtggctgtggcaatggcggtggcggctgtcgacgatggtacctatagcggcgatggttgaaggccatcatccggctgacggtgcgtcgtcgtcagcggtggtatgtggaggcggggaaagggtctggtagcggggaaggaggagtccgggtgcgggcgcgccatcgacggcgggaacaattgtgggcggtggccttggccgaatcgctgaagggacaatgttgttgaccgacgacgatccttcttgtgcggattggtggtgtgggtttggacagggaatcgcgggcgaaagccttgccgagccatttggccggctgacaatggcgacgccgtttggcgttgttcccctccttggaggtgttgttttagcgtacccctttcctttccctaccatattctctgggtgaaaaccttgcttcggttccgaacgagcggtggcggcgatccacgtcgcatcctccttgggggcaccgctttggagaaacctcttcgtgcaaggatattatcattggtctatgcactggcttcgaacttcagtcctaggcctggacgaggccttctagctccatattttgttttgcttttctcagtttgggtcctctcttctcttgtttggtgtgttcaacttgtcttggactacactctcttatggagtggatctttgtaataattggttgtagttctttttaagtaaaagccaggatattatattctattatctaaaaaaatcacggggagtcagcgaaacaaaggaaaagaggtgctccgtgcttcgatggccgttggttctatgcccggcggtggagggcggcggatgaagggcagcggcgagctttgccgtctccagatttgtttctttatttggaaatcgcgaatatacaaaatacgtatacatggcagtaaaaaaaatcaaagttggcatgtttctttatcgtgtccgaatcggtttcctcctgcaagatttttttttgaaacattatttccgcaagatttttggaaacaatttaacgagtatttaacaatcctatcctcctca

SEQ ID NO: 77482 - DNA, 5286 bp, Oryza sativa
agggacggcgctggccaaaggagttgctgccgggggatgcaacggcgaccaccacaacgtcgccgtcctcgcctttcaacccgaccgccgcgctgccggggagcggctcctggtgttctttgcggcgtccaggtcgcgcacccgcttcttttgctgcagcctccctttgccgcccagcgcagctccagcgctcgccacctgccgccggcagaagggggagaatggatgagaaagggagagaaagagagagaaaagggagagaagaagggatttatgtggagaatagaaatggaatccatggcggcggctccggcttgctcccacccgccgccatccatggcgaccgccggtgccggaaaggagaatagaaaggggaagaagaagggggagagagagagaaggaagggaggaggaagaaggaaggtcagagggaggactgacatgtgggccccacatgtcagtaggcccacatttctttatgtgtgaatgactaatgggtcccacgcacatttttttatttctaatgccacctaagtgccacgtcaacgccacgtggaaagaagaccgagtcaatactgctacgtaggcgccacatcagcgaaaccgccctccaaaaccgcccagggagtcaaattgcatcggttttacgagtttgggggttaagatattcggttttgtggtttagggttacgaattagatttcgatcacttttgagggtcatgaagtgaacttattccctgagctaatgacagaagggatgggcctcttgagttatgtatgaagaggcatcatctcaggcattggtatcaatgcactgcatcaactttccttctctttttcagaatccgagggagcgatgcctatccagattttgtttggatgggaaataggaggctatccagatttgtaatattagaatatgtttgtttcaaccaaaataagggagtactaagtacatggacatcatactacttctttgttcatcctcaaataaaatgttgctacctagtatctgattggagtacttcctagtacaaagaatctgaacagggagtatctaatcaagtactaggtatagtaacattttaggacagatgaagcaaatgatgagcagcagtgcaggtgatgaagtggtcaagagactatccttctcattgcactagatgtcgtagcatgccacgcctctcataccgctacggaacatgacgatggggggcatcgccgcgcaactagaacactctgggactctgagtaaacatatttaagtataaataacaggacctcacgaggaagaaaaatacatcatataaaggtagatactatatagaaaatatgtatcagattaaatagtatgtgcatataacaaacaaaatatttgtcccgttaaatggtgcactcttgtgaggaaaaaagatacatcatatcaaatgctacatccatatcaggaacataatatctatcatattaaatggtgcaaccttatatagaggaagatatgtctatcagttaaagctaaaaactttattttatcaatattgtagtatgcccccaatttgcaatataagttgtaaaagtttgaaatacctagaacatgttcacaaaacacgacaattattttggagcatttaatgttcacatggtatatctatcaatgatatttcgcagaagaaatgtttaaggttaatggatagattcctcctatccccttacattttactttctctttggaactctatccaagagcactgaagctccaaagagcgtagccacaaagagagataggagtcgtctatctgttacccttaaacatttcttttgagaaatatcattgagagatatatagtgtaaacataaaggcttcaaaatagctgttgtgttgtttgaacacgtacgagtattccaaacatttacagcttatgttgccaactagtgggatactacaatgctaacaaaatgaacttctaaaagctttaattgatgtacatatctttccctgtacaaggttgtgtcatttaatatgttagatattttgttccttgcatagacatagcatttaatatgtacatctttttttcttccttataaaggtggaccaattaatgtgacagatattttgtttctataccttttaatatgatacatattttcttccttatatggacgggcctatatgaaatacattttagaatgaaagagtagtaattatcccatcaatcaactctcatttaaatttcttcatatctcataccccagtcatccttgaaccttatccacctctcatttaatgttgtgtgccaaagtgttttgttttttcccttattctctataattattttataaatgattattgtagtcggagggggtatattctaggataaaatttgaactctaaaaaagagatattccctctgtcccagaatatgaggattatatttttaacctaagttaaactattttaagtttgactaagttttaaactacacccgtctcaaaatataacagaattttcccatataattacatgagccaaatcacttattctttgaaatgggtatagcacagaagaatattaacatctaccacacaatctaccacataaaaacagtaaattataatgatatattttataatgggtctaatgatgctcatttgatattgtaaatattattttgttttcataaacttagttaaacatagtttgacttacaacaaacataaggtcctttgagacagagggagtatatgatatagtagtaccgaatgtaagagcatctccacgagtcccctaaacatattctgtaaatttaaattttgggaattaagttaaaacacatgtctccaacaaatacccaaaagagctcccaaattttaaacacctctaataccggcgccatcctgagctagatatggggcacctcatagaactcccaatccccggccacaatcacgccaattttttgccgctggcatcattttttggcaatcgtgcgcgatcaacctcgcaatgatgtacaggagaaatataatcggccaaaaatagttgaggagggcccactagcgatgagataatatatttcaatgttttgaaacctaagcactgactctgttggagaagtgggtgattttcttcttgcatatttttgagatgaccataatccaagattatcgggagtacaattttaagccattggcctaatctatacacacttatcacagttaacaagtataatccaaaattagcaggagtttaattttgagactggtatgcctcttattatggtttaccatattgctcatctaaatgtttttatcatactgtttttgagattaaaaactagtatttatcggtttgtcgaaaaccgagcaaaaacctgtgaaaaccaacaatttatatacaggaaccagcttaaacaaccccgtttcgggaagcctagtatgcaaacgtttgcggacaccgggatcacacgaacgcgttgacttcccattttccgacttcatgttctatggggtcgttttatttttagcgcaaacgagatgaaggcctttccgcccctagttttagctatttgtgtcccaactttccccacataaaatttcccgtcaaaactttacctacataacccttccttgtataaactttctatcgagaaactttcattgtataaactacttcccgaaaatattacccatataaacttttttcccaaaaacttgcccgtataaactttcgcccaaaaactttccacatataaactttctccacataaactatttccatataattttcatatagaaacttttatagagaggagattacaaataaatgaaaaaattatttcaaaatcatatgaaattttaatcaaatctcaaaaagtatatactcaaattcaaagaccttgaaatgaatctttcaataaaataacttctcaaaaccctgaacttaaccatggcatggagctcaccggggtgcagtggattttttgctggagagaaacagatttcgtgcacacaacaccttgccagagggaggaaaaagcacgtcgtcgttgacaaccacagctgcgacagggccacctcgcccttcgcttcatctgtgatgacgacctcatcactgtgcgctccgtccatctcgccaaggtgagaagagaggggaggggggaacagggctcttaccgaagaggtgaggaggaatagggagtatgcacacaacttgatttgtcgcgatagtggtggaggaagtgtgagaggaactcaagcagggaggaaaaaattatgtgatagaacagatctacttcctccgtccttaaaaagagtcgattcctagatccccaatgcaaattttgtataaacgtgaaaagacaaaagtgccctcattaactatatccatttatcaactatgccgtttctatgcacatgtatgtaagagacatcttatgcataataaacaacgccaaaaaaatttaaaaaaattcacttgctggaagaaaagaaaacatctacgatctctccaatctgaggggaaaaatgctcttaattccccctgtaagaactactactgcaaacaacggcaaaaaccaagaataaagaaaaaagaaagacaaaaaagaatagagaaaaaaatacaatggtatttgcctttaccactgtaggcttgtgcatcgagagtcaggattagatcccctgtaaatgaaaagcatacaaaacgcaagagaagagagatggggcggagataagatttgtggtgttaaagcgtgaatgatagggagagaggccagagtcattgaatgcttctattttttaagcattctaagtcggttttttataggacaaactctccctcgtacattcgtggtgaacgttcccccacccccacacaccccccgttttcacaaaccgatgcctaacatgcttgcgtgcaaacatcgatagtgcgaagtttttgaatttgaaatgaagagctggaattcatgagcagaagtatcaagatttcgctgtacgaaaatataaatgcagagacgctcagggggtgctaaacaacaaaaactgaacgaatgcacgcatccccacgctgggctcactcttcccctgtttccgtgccaaagatgagcatccgaagcaaaagagcgtagcgcaagaggaaaggagtagacaaaaaccgacaagcttcacgtttcggattaatggcaccgaggcattttcccagcacccaggcgttcgactgacgccgacggggccaacggcatttacgcctagcaacaagcacacacagtgcttgggggtgcagg

SEQ ID NO: 77483 - DNA, 4394 bp, Oryza sativa
ctagctgatggattggtatatagctcggcacgggcagatctcgcggagttttgggggaaattttttttctcttttttcttttggtgtgatactagaaattttttttttttgggagtagtttttggttgcgggatacaagaggccgtaggcggagagcacgcggcggaggcgagactctctcaacggtgggcgaggccgacgggggaaggcgttgcttttatcagcccaccacccgtgggagggaggaggacggagatgccagctacgcgcctacgctagggtttacgcgcgccccgctcgcctggacccggtgtttggtgcgccacgggagcgggtggccgcctggtctacacggggagcaccaagaccgggtccacgtatcctaccgctcgcccgtggttttttctcttgcgtgagagcattcctgtctcggtggatgggttggggttggaccgttcgactcggtcgtcgtcgttcgtagggaggagtgcttcgggttctgtgcaaattggtctcgaggcctgacgtgtgttgcgtcttgaccgcttcgttgggttgggccaacgttctcgaagggccgggccttttgggagaattgaacgtgtttttttctaaccattttattagggcaacaacaatatatataacaaaattagtccatatagatgggacccggaaatgctactgagcgagctcgcccaaggcgatcatattcgggccctcctctccacctggttttcttttttagcaccgcattactttcctattttaataaatttatacatctcgagtttacacatctaaagtttagagactaaaagtttataagtcaaagtttatatatccgattcaaatttgaatttgaattcaaatatttttttatatatagtatttctatacataaaagtttataagtcaaaagtttatatacccgtttcaaatttgaatttgaattatatctgatttaaatttgaatttgaattcaaatattttctatatatagtatttctatatatctaaagtttatacacctaagtttacagatccaaagtttataagtcaaaagtttacatacccgatttaaatttgaatttgaattcaaattttttatatataatatttatttacataaatttttctaacttttgttttttaaaaacaattttgtggtgttctgtagtagggaagagaaggagaggaggggggagaagagggacgtataggggagggggtcagcgatcacccgcttcatacgattaattatttttggaggaatactatccaaaaaaaattccctttcctttggtgctggtttcacaggaaaagtccaggaaaaaatcatccatcacaagctctttttttgcttcctacatgcaagtcctagacagtcaacttactgtgatccgcatgccctcaacttttgtactcctttgtttttcattattctgttttacgcttaaattccttctctattcctatacttttcagatcctatggttttcctatcctttaatccaaacgagcccttatatttacgaactctagaaaataaactagaagctagaaacaagtttttttcttcttctagattgtttctcaagactcatactctcccaaactcaattgtactgcttggagcctttggatgcctactttcattaccatccagtacccagttacccacagaagaaaggcaaagaaaatttccagccccccatgacgaagcatcgaagaggacatcattgactaccaagggaattcgttgcttttccagctcagaagtgccctttaaaaccaatcgtgtctaacacatccacggtatcagaattaatcgacaacaaaatggcaattttcccaaggactaaataaaagtacagcaaaggtctcattattaagaggtgaaacttagggcatgttcactttgatgccaaaaagaaaccttaccaaattttggcattaccatgacaggatttcttatatagttaccaaaatttggcagcaaactaaatgtagccacttttttttgataactttaccaaaatttggtaaggttgaaaatggcctcaaagtgaacatgcccttattttacccagatgccatactaacttccatcttcatacctactattcgctacgcagttgcaaccgagttgcttgcacataaacattagactatcgttaggatacctcgctactatttgatattctgattgaactcattcaattaacactctcaaggatgtactaacagagggcatcaaattggggagaactacaaatacaagaaggcataccatacataacatgaaatcttccactatcagcatatcagtatcacctactgcctttaactaaacttcaaagcaacaactagcatatcactatccaacatctctataattaacgacaaaaaatggcacttggcataacatatgcattatcttcattgtttacagaataccatttcaatagcacactacatgtataacaagctagataaatggaagaagaatcttaaaagagaacacaagttcaattatgcatgtttggttctaaaacctaatgcagaatcggagactgcagtgcaaagagcaaccaattatatataccatgttgtaggctgccctatacagctaattattccaatgtgctcgacagcgatggcagctatttttagtactgaggtagttaagcttgcaggccagatttctacaactcgaagcaaccaaagaaataaatttgtatagatgcatcctaatcatcaacaaaaagctaaaccaaacccttttttttaatcagagaaagggcaacaactgctgatgaaatagcaatggtaacacagaattatccatcatgatgattttgcgagaactagatagtaaaattaataacctaaggaacatgaatatgagattagaatgcataaagtagcaaataggttcatcaattttttttatctcacatcacagagctggaggattgccaaacctcctcctgagtgctgacatgacgctcctcatcctactacttgcctgggcagatgattgtgcattgctggcgttagtcgggagatccatggctgccatctgatcagtaagctctgtaatttgcacctgtccagcctcttgcccgccattttcaattgcacctccagcatcacgctccaatacaatatccaagctgatagagaatgagccacccctaaccaccttcaggttctcaatacattcatacgatacgccccggcatctcttcaatttcaccttgaccaagctggggcagcccccattcagtgcccacatcccacggtctgagactgggcaacccttgatgcaaagcttcttgagcgcagcgcagcgctcagccaggcaaatgatctcaggatccccaacggtctcacacccacaaagggcaagacgctccagtgagcggcaatgttcaccaagcatacggagactctgcacggtagggttgaccccaatcaagacgagctcttgcaggtctggacatcctcgtgcaacagccatgaggccatgatccccaatcctgtttgtgcgccaccatcaatatgtagcttgcgcagtttgtgacatttctcggcaacgctgattatgcctgcatcagtacactctggggtcttgacaagaaacaggacttcaaggtttgcacatgccgatacagcggagaggccgcggtcacccacctgcagcttctcaaggtggagctcaacaaggccaggtacacgcgcggcgatgacctccaatgggagggcccaggagccagagcacctcaagatcttgagcgaccggaggttcggcgacgaggcaaccaacggcacgaagcagagggcgctgtacaggtctttcaggcagactgaccgcagcgacgaggcgggcgggaagaggatctcctcggtgatggcggtggtggcgccggcggtgtcagggaggccgcgaaggcgcttgacggagaggtcctcgaggagggggccgaccggaggacggcgacgaaggccttgggcccaaaactgcaggacgcgacggagagcttgcggatcaccggcgtggcgccagcgagcgacgcgagcccgtcgtcggagagctgccggaggccgcggagcttgagcctggcgagccgcgcggacggcagcgcggcggccacctggcgcgccccgtcgtcggagaggctgtccgtcccggagccccgggcgcagcggagcgcgagcttgctcaccgccgtgaaccgcgcgaagatcccctgcgcggcgtacccgagcgcggcgcgggcgtcgagcgaggggcggtggcgcgtggaggcgtccacctccttccaccgcgcgcaggtgagcgagcacgcgttgcggtcggtcggggtgagcgacgcgaacacgaggga

SEQ ID NO: 77484 - DNA, 3019 bp, Oryza sativa
aactctctttactgtatgtaaacaaggacgagcttataatataatcgcgtaacctgagcaaagataccaggtacataagcagaacataactgtatgtcagagtcacagtgcggagggacgcttcctcgcgcaaaggggcgtaaagtaccacctgtgctgggagatcggcttctcgcaagcccgcaattgcacgaatcagagtaccaggtagcagctggcgttcgcttaaaccggcttaaaattcagttgacgaaaggagtatggactatgataccatcagccatcaggggaaaaggtcaagcaacaataccagttcattaacacgataacacgaaacattacataacatcgaaaatgcagaggaagcacgccatatttacagttgttccttcccatcagcaccgctacatatttacacggcctaaatacgtgccagcccttcaccactaggccatccatcagacccttcagcaccagggcgaccagacacaccgatacaagcaggactgacgtacagatcactcgagcttgttcttgtgggaatatgtacatttgtcctgctctaagcaggtggatatttacatgtggacacatgtgcagctaccagattactcgggccgcacactgacgagattgggcagggcagccaactggagcttcttgatctcaatcgcggtcaccttgcaggactccagagacaaggacctcaggttctggagtggcttcagatggtggagcccagaattcgacacccgagagttcgacacgttcagggagaccaaggcagtgaggcctgtacacatggaagatatgcaaataaatagataaattgtgtgttgaatgctttcattcctgacgagcgcaaaagacatacgggaaatcagctctaaggatttgtcagtgaggttgccattttgagataggttaagcagcgtcagagctttgaggtctttgatattcttcactccagcatctgtaattaacccaccgcagacctcaagggactgtagattcttgaaatctgaagaatgcattagcaaacagatttaagtgctacgtgatattttgatgcataaaaataacgagaatcccccaaatttccaagggaataataatttcccagtaaaatatgcaccaagatgctgtcatattcaatgctaataatagcaggggttgagaaaaaaaagttccacagaatgctaggttaataggatttgctttatgtgtgcacaatgataagctcggtgctacacaagtgcaaaaaggcccaacgtgccattatcttaactcttatagtaaactagcttgttccgataatccaaaatcaccagactagtaaacagaaccttagcatggaccaactttttatgtgcacacttacatttcaagcagtttgtcccagcatcagttatacgagctccaaatagatcaaggtgtgtcaacccagtgagacctgcattaaacaaatgtcacttcaaggcaaaatacaaccaaaggactacacaacgatacagaactggagaattcagacgataaccttgtagccaaattcttactcctactacaatgcacaacaatcaccatttgattaaagcgaaacatcaaaccttgagaggaaaggaacaccatcctaaacagacataaaaaagaccaacactctacatgccccaaaaaataacgtagcacccaatcatgccatatccaattaaattgctaaaatgggtaagataccatgtctaatgcataacaggaaacccaatcatgcacgccagtattaaacaatgtaattttaccaaaaatgaggacatacatgtaagagctgccaaaccattatctgtgatttggcgattatcaagattaagggatctgagtgaattcaggccagaaattttcttcaagccaatgtccgtaaccaatgtaaaagagagattgatgctctgcaaattccgtaggcctgaggagatatattagttgaagaactgttgtgagtaataactaaaaactgaaaccgcttgaactattcaaacatcatatattttttttaaaaaaaataaagtcaatggcactagcatttgtgcagaagattaaacaaaccagagagatgacgaagtccattgctcccaacttctgtgtctgaaagttccaagcttcttagtttcagaagtcctacagcacagagagatgtacaccaatgatttgagaccccaaaaaaaaagaatgtaaccagtaatacaaacaattaaaccaattaagaattccataaggaacaaagtatacttagtcaatgctaaactgacaattgcggactagtctggtacaaagcactaatactatatgccattaaacaaaagtaaactacgacttactgcatgaggcttattgtgtgattctccgccttcagtgttttatgaaatactagcaaaatgccagtattttaaagcccataaaaagttattcctattgtctaatatattgtcatcatgcaacttatgttgtcactttctagctttgtgcctgataagctagctgtagaaataggcaaagtcttatttcactgttggtgggtcccacactaccatctttcgtataagtatagacaagataacaggaaaaacaaagaaaagacatgacaactaagaaactcacctttcaaatgtgctagcccctcgtcaccaatcttgcatgagtccaagttcaaacactccaaattgatcagttctacaagaacagaagaacatcaggaaagctccccacttcatgtgttaattagcatatatagtatataatgatgtcagacttctgacatgtttccagaaaaatcaatacaatcaagtgggtacaccttccacttggtgcggcgtaaacatatatattgaacaaaaacaacatggcaaaagtgaaacaaaagcgtattctggtatgcatctagtctcatatcatcggcaattttaatgacagaaacaagagaatactggtatattaagaaaatataagtgttatttcttgagtaatagtgatc

SEQ ID NO: 77485 - DNA, 6477 bp, Oryza sativa
agctctcttaggcgtcgtggtctttgtggtctacagccatcgatgaaaatagttgaagatgatcagatagggatgagagattagctctgagagactgactatgggccatacgcccaaagtgaaaggttttggtataaaatctggcctaagtgaaaacattatattaagggtagcccaaagtgaaaccatagtaaaaaaatatagtccaacatcacttttacaggcaacccagattacttagcagataagcctcctctttctcctgatcccggttcgaatcacccactctaccacgtggccccgctctcctccctccaggacccccgtgtgccgctgcccttcatcagtggtcatgccctctcccttccttacttcggctcctattagatggcctaatcagctaaaaaaaccaaattttaaattttcaagcttaattttgagatattttcaacgtagtttcttttttaaaattggcttttaaattaccaagaacacgtttataaaaattttatttacaaatttatttttattttctaataaaccgttttggcttattagcgatggagaccttcttcgggtctgttgtcgtccatttccatcaacttcaagagccttgcatcgatcctcgcttctcaaccacatggctgatggctctcctcctcccatctcaacaccaaccctcccatcatcctcctctatccatacggcactaccggtcttatgctcttagcctgtattcggtaaccttttttaacctatctccctcgtttttcacgcgcacatttatcaaactgctaaacagtgtgtttcttttgtaaaaagtttctatacgaaagttgcttaaaaaatcaaattaattcatttttgaaaaaaaaagctaatacttaattaattacgtgctaatggaccgctccgtttttcgtgcgtgctgtttccggttgggaacaaggaattgcgaacacagcttacaacagcgttgttatccctctaaagctaccctaatcgtccccttaccccctcccactgactccaacgccggatcgtttattcgtgagttcacagttggagtctagggtcgtcggtcagccgccagcctaccaccattgaggactcatggagaagttgctgccaatgtcgctgactcactggcgaaagtccctctcccccccccaccacccatggcatgctctctctatcgctctcttatgtctccctggactagagatagacgaaaccatctggctaccggatcaacagccgacgactttgaacaacccactgagatttaggaaaacttgagtctgatagtaaagatggtatagatatttaaggcccccttcgattcatatgattaacaaatgagtttttatagaatttaaattcctctggattcataagaaaggaatacaacttctcataggattgtattactatgctttacatttcatagaaaaatagcaagaggtacgtactctttgtaatatttcctttgtttttcctatgacactatcaaagggtttgttggtatttcttaacgacaatactagaaatataattcccagcaataacgtagaaatacttctggtatattatggttacagagttcatccgcaagcgcatggatataccattgtagcatttcactcaagagtattctaagggtatcgtttttattttatctcgtaggaagatcatgtagagagaactcaagtaataatttatatattacttgtggtaatcatattctaagtaggggttaagataattcatgggtagagtgacacacaagcattactactcatcctcataataaataatctaagctaggtggaaagaaaagagaaagagaatctattcctatatttctaatatacatagtatatatacattctagttaattgatatactagctaatactctctatccgatgccctcctggtacttcgagaagccacccctaactgccgagttccttatgacagcccgtcatgaccatccaaccggggctaaatacggaggaataccctccccaggaaattaacttaggattatatataggcgtggaggaatacccgtactgagctgtcaccatcagcggtccacctctcatccgcaatatataccccaaataatgatatcccgtaatctagacaccacatctaaactactagatactactctaatatcattgtcataacatagagtaattgcataagcaaacattatacccgcaccaaagcatctcccagataaactagcagtatattcagtataacaagaacataatgtaaaatgtaaagttagtactcatatactcagaaagtatttcaataccagaaatgtatatagaagagtattctaataaaagtacaaagcttacaaaagaggaaagaaaagctactagagccagacccgaactcttccgaagacttccggactcctgattcctattctaattctattctaccagctagatactactaaactaaacttaagagaaatgagaaagctcttacttgaggtgtgtgttgaagtgaagagagtgagctccttatatagaggtaggtatgacggttgtggaaggggaattgtccgaagtgccctccaaccgtcattgggatgcaatcctggacatccgcgccaaaacctggatccaacggcgccaggattggttcgactgaaccaccaggttcggccgaacctggggctggcccaatccagcccaatttcggctggtggcctcctctattgctcctctccgcggacttgtgaattttggcctaattcatcgtgtcaattcttagttcttggcccattcatacataagtctggtcctctacatcgtctgattgatttatcgttggtgtttgatgtcgattctccttcactttattgtcattctctgtaaaaggttagtagacataatactagtggaatattattgttctaatatatttatgcattgcaagcatcactagttctctgctgttttagtaatattgacggtcgaaactgatcgataacgaccgtcaacagagttcctatcttttttcatgtgtgttttaaattctagtaaaattaaagaatcataccgcttcaattcctacgtttttcttatcactaaagaggcctagaaaacggttcatctcctgtgggagttcaaattcctcactggcctggctgcaagcctgatcaagttaccaaggcccatcacactatatgaggaattttttttatttataattttttttattaaaagttttacaaaaataattttccattttgaaaattgacggaagtagtcgcctaccgccctctgggagggcgataaaatcgccctctcagagggcggcgaaaatgacgtggcagacggccgtttgctctcgggcgacggccgtcaacgaaatttgcaggcggcccccttgccgccctccgctagggcgattttatactgtgcggggggccgcctgcaaatgggcggcgagggggggggggcatggaattttgcaggcggcccccttgccgccctccgctagggcgattttctactgtgggggggccgcctgcaaatgggcgggagggggcatggaattttgcaggcggcccccttgccgccctgggggagggcgattttatactgtgctctatatttttgtataaatatcaatagttatcaaatctttttatattgaaaactatacaagattaaaatctccaagactggtaaaatacaattttattattttttagggcatatttggattgttaccgtacaaatattttgttagtgccaaaatataagcaagttttggcactaccaaatatttggtaaggtaaaattgcatttgatcatatttggtttgctgccaaaatataaaattgtagtgaagaatgttctacataatctcaaatctagattacgtattaccaatgaataggtttccattttcgtgtgtggtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcagtccgggggtacggcacggccaacccgtcctgcctgtataggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaaagaggccccagtaccgaagatcccggctgcaaatcttgctggacaaggaccatcagtttcgtacaagtatttaacagtagtaataaaaagtaaagtaccgtgtgggcgagggatcgacgctccgtgagaggaagagctggcgaacgcgcccgaagaggtggcgaacgcccctgcggagctcgcggaagcgccggtcgtgcgtgcgaacgcgctcgaaggcagacgaggtcctgcgatgaggaaacgtgcagttaaaacatggtgacatattcgtgcaaaagctgaaacaaaaatgaactaatatctgggctgaactgtaccgtgcgaaaccggtgctgtaggtcgcactgctccgaagctaggggcgctcgaaggcaaatgaggtcctgcgaggatggaacatcaagttacgacggggtgatgttttcgtagaaaaatagaaacaaaacttaagaaacctctgggctgagcagtaccgtgcgaaacaggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaagtaatacaaattggacgtaccgccacgaagtagtctcggtcacggtgcatgggatacgcgtccgtgacagcggcaacgtgcggctctggggcgtctggagtgaaggtcacacgcgcacgagtgcgaggaaggtaccagcgaaggtactcacggtagttctcctcagtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacattgcccggaaacacctgcctaagtccgaactatctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacatgaagtccgggtaaccacgtctcacctggacgtgagcgtaacgacgctgcaataaacatgatcggaattagacatgttatgtgaagaaaaaaaaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtc

SEQ ID NO: 77486 - DNA, 4563 bp, Oryza sativa
aaacttttttgagaatacgcacaaaagccttgtgcatcttttgtattaaaagaaagggagtttttaaaactttacaatcttccgctgaaaggaaaacaagcaaatgagaaagaaagaaaacacaaaaggcgtggggctatatctcgcaacaagtttggcaaccgtttagtgagcggtggctcagatgggcaggccagccacacgccagaccgctgcttcttcctccatggccgcgcttattacccccccccccccccccccgcccgatttcctctcgttgttgaacaccttattgtttctattaatgaaaatatgatctcaccaaacagggagcttgttaagtgttatgtaatcatgaaatagattacatcaaagagcagtacaccagagttgtcaaacatactgtacgctgagtacagagaaatatcttaggcaactaaagagttctataaaccaagcattttaatcgctagctgcgcaacagtaatatggtaagcctacccttcacagagaaatataggaccgaaaaaagaaaatcaaagtgatcgttaagtcgaaaataaaatttctttgaaaataataaaatgaaatcccattaccatttataagcaccaaaagtaataaaaaaatctctcatttacaagaagcagcataatagtcctatagtacttcctccgtttcacaatgtaagtcattctagcatttcccacattcatgttgatgttaatgaatctagataaatatatatgtctagattcattaacattaatatgaatatgggaaatgctaaaatgacttacattgtgaaacggagggagtagaagcaagacactctcaagttacctagccactttgtcattctcattcaacttgcaaagggaatttctaaaactttcatgtcaaatccaccagaagagatttctctggggataaatccatgaggtagttgactatatatagaatgagaaccaaaagaaatgtgtgaaatttcatgacatgcacttcttcaggtccctaaatatccatttttggtaatgaatttaatggattattctacatgagttctggcagatgtggcaccctttcaacagtcaaattaaattaccccaaggacttccctagaataaatgtaagacattttcatggaagcgtgaactgataacatagcactcgtatggaaaagatgcaaaacctgaaataacctccaaacaagcagcagttactgcacagccctccaggtttaggtgagctagcttcgatagacctgtaaagaacaaatacaaaatatgaaacagaggctaactttagatgaaacttcatgtcattatattaatagaaacaacgaattaatcagaatattacagatacaaatggatgtagctttaggtagataaggttccactggaaaaggaagaaatttatttctgggatacctcttagataagaaacaccaagatcacttattttgcagcaagaaagttgaagctctctcaaatttgtaagatctacaaggaaaagggtatttattagacgtgcagatcagtatgtgtgataacatacactgcttgacactagatggtcaacataaaggtgttacctgataaatgtttcatatcagaatctgtgatgccattacaatacctcaaatttagcttttccagttttctcaagcctgaaaaagaaagttattattggatctgacagaagtataattaaaatgtattcacgattgagtagcgtttgaacaaataggtagcatgccagtcttccctgtatttattacaaagaaagatatataaaagctctggatgataaatatatctctgtttcattggggtgtagggtgcggggaacacatggtaaatgataaaattagatcatgcatttataataaataagttggctgtggttacattgtgatgatatattaatgaaatagcaggaaaccttttaaatgaacaagtccaccatgaatcttcggacatcgctcaaggtccaagctacccaaattaaccatgtttgcaaaggctttagctccttcagcagtaacagcagaacattttttaaagctcagggatgtcacatttgagaggcctgcagaattaaaaagcaataccataaatgacaggaacagaatatctagtgatcaggaacattgacaccactcttatcatagagatggaagaaaactcaactctcaggctatcagaaaatcactaacctgacaatgttttaagtccatgctccgatatctgatcacagtaattgcatgacaaactttgcaagttgatgcaatccttgagttgattcagtccaccatcagtcacatcagagcaagagatatcaacagataacaatgattgcccttgagaagccgctacttccatccaagcatccctcaccccagggtagtctgccaaacagatgtcctgagaccaagtagaagaatagcataggaggtcaatatctagtctcagagtaacttatcccagaaacaagaaatactccaaatttggtcctttctttatgtggcacacaagtaaagcgattgcttggcttgcttgtagcaggaagatagaagcatcatctgagttacacagaataagatagcagctgtgcacgtgagctcaactggtctattagtatcagtacccagtggaggcttccttgagtggattttcctcaattgcttacaggataaattttaccaacacattttagtttactttcctgagttagcttataaaaataagctataaaatcgtttacaacatagtaagaattgttccaacaagatgcctttattcgttccctgatactacattgaaagttagaaactgctacaagggaatgtcaggattgcattccatagagtttgcaataattccatattgattttccttgtttagaattgagtcatttttttcgcgaacgtgtttagagctcagtcataattacgtgccaaacaagatcaagcacttcacctgcaatgcacaatcacgaaaagctccaagcaactcttcagtgagaatgttccactccaccagttcattaaatacctgctgactaagatctctaggcagcagcgagaaatcagaatacttcccaatatcctgaaatcacccctcatcaagtcaggcaacaatacacacagaaaactcaatcatccaaggccacaagcactacctcgcggactttggccacacagagctccattagcgatgggcaccgcacaggcactggtccctgcaccttcctgtgtacatcagagccgctgcggggcaaggtgtgcagtagccacttgaagctgctgctcttggagaaccttgcactgtagagatcttcctcatcaacaagcagctggcctctcttcctagagcaagcacttcccatggcgacgatgcgagcaccgatcacaaaccaatcacttcttcttgatggactaaaaagcgcatatcattctagctcgtgactgtgtgattctttgtcatccattcccagcacgattacgacttggcatagacttcgctctctttggccccattctgcacatcaaacaatcgtgtaaattgacttaaaattatcagattatatacagatactgccaaacaatactaaaccccacgagtcctcagtttttggtgggtgtgttcatctttcacgcaacctaggctcttacaataattacggattgctgccaatcctaagtgcaatccaggaaaactaacagatgacactagctcaagaaaaatgaaccatgtcttacgaatcaaagcatcaaccctatctacgtattatcaaatcccccaaacccctaatagttcagtcactgtaccctactttcgattgttccacaccctgttctgcaaatcactccatcaagggagaagaaaccgtaaaattaaaaaaaatgcccaaaattccaacccagaataacacataagcatcgagagagtacgagttgggcagatcaacacgacaaccaaccaacccacccacccaataaaatcgcaacagaattacacagaatacggtggtggagaattacccgattggatatggaaattctcacagggacgcaaatccaccaaaccctaggccaagcaaactcccggattagagttaaaccaatctatcgcgattaaattacctctaatcacacagccaatcctcgccgagaaagagagaggggggaggagagggactcgagaaggggaaggaaaggtggagaagaaatggtttatagcgagagatggagcaacgtgggagctccacgtgtcgccccggaggcccgagctggtacgcctgccccgcagactctgtcactgacatgtggggtaggggtaaaggtggccaacgttgtcagtgggtggagtgggtaagaaggttggtggcgctgtgggggttggggggatgggggccacaggggagtggaagggataaggcaaaagagtaccgggcgggcgctcggcatcccccggattgtgctgccggttttgtgggcccgcgactgttggtccgttctgcggcctacacgtgggccccgcggttttacttctactg

SEQ ID NO: 77487 - DNA, 6277 bp, Oryza sativa
taggctggggttgaaactaaaaccacagctcatcatttgttttaagataagcccagcttttcagaaagcaacagttaatccatgaccagacgctctgcactctcttctgttctctgttgccttgcctagctatgccattgcttgcagatttgcaacagaaattatagtgagcatgacaaatgattattaattcagtaagtactactagtaccaagtttgctactgtcgtgatcatgcaacccaatcatctcatctcgttattgtgaagtaaattctctgaagatttgttaagctgcattgcctttttctgctaccacttggttgtcgtcgatcgctgcctcttgtcttgccctccgccgcgtcctctcacggaggaactccacgaggccccggagcgcggcgtcggcgtcctcgctgcgcagcagcatctccgacacctcggccggcgtcacctccacgccggcgagcagctgccgtatctccgggaacagcgggtggtcgccgacgaggaagtagttgtgcgcgagcgtcttgaacgcctcccagccgcagtagcccatgtagacgtgcatgtccatccgccccggccggagcagcgccggatcgaggcgctccttgtagtttgtggtgaagacgatgacgcgctcctcgccgctcgtggaccacagcccgtcgatgaagttgagcagcccggacagcgtcagcttctgctgctggagatctcccgcgcggcgcgctctgggcggcgcgccgacggcgtcgtcggagtccgacgaggagaagtcgaagtcctcggcctggtcgagcgccgccgtggtgatcttgtgggcttctcttgggttggcgtcgaagcagcagtcgatgtcctcgatgacgaggatggatttgttgggcatgctgatgagcaggcgctgcagcgcggcgttgacgcgcacctcggagaggtcgaggtcgtagaggttgaagcggaggtagttggccatggcggcgacgaggctggacttgccggtgccgggcgggccgtggaggaggtacccgcgtttccacgccttgccgatgcggcggtagtactccttccgcttcaggaagcggtcgaggtcgtcgacgatggacttcttgaggtcgggttccatggcgatcgtgtcgaacgtcgccgggtggttggtggttgaagccgtcccacgagcgcaccttgttcatgaagatcctgagcacgcgctcccgccgctggagctgctccgccgtggccatgacgaagggactgtagcgctcgagcgccgtgtcggtgtgctcggcgtcgaagctgagctcgaggcactcgcgcggggcccggtgaccgcggtcaccaccacccttgccgcccctcttgcagtagtcgccgcctccggtctccatggacgtccacctgaactcgacgccgtcgaacacatcggtggtggagtccccgggctccaagcacagcagtgtggtccagctgctgctcccgtcggcctccttgcagcgtgagcgcgcgaggctgagccgccgcagggcgcgcgggtcgatcttggtggcgaggtacgcgcgcgccgcctcgaacagctggttctcgctgtacccgccgtcgagctgccgccggatcaccaccgtgtgccgctccttctccgacgcgccgagccgcgcacgaacgaacgccgcgccccaccgcgccgcggcgcggagctcgtcggggagcagctcccgcgccatagaccgcgccagcacggcgtacgccgccaccgacgccgccgtcgccagcgccttcttgtatgcgtcaagcaccctcccgtgctgcgcccctgcagccggcgacggcgccgacgccgccgccgccgcggcggccagtggcaagtgatccatggctggcagctggctacctcacccacaaacacaagacgcccaaggcaaatgtcacgtccattttatggcacaaacaagtgtggtttcgtggaaattcccaaaaacagggtgattttggcgtttgtttttgtttgtttgcttgacctcatcaagtctcgtcggatcgaattgacttaggccattcacagtgcaaacaccggaccaagtagcttagtccaaaagaaagccccaaagacactcattcccatagtgcatgtatcctattttgcgtgacctaactggatggagatactgtgcaagggaataaaccccacaacgcgcgtgacccggttttaaagacacgggcgagtgaaggaaatctattccttcacctacccttgttcccgtcgtcctcctcgcctcccacgccgctcctcgcctcctagcctcccacgccgttcccctccaagtccgccgctgcgccggttcgccgctgcgcctcctcctggtccgccgccgtgcctctcccgacggtgggagcagtgggggcggcggaggaggaggggaaaggctgctgctccggcgtcctcctcgcctcccgtcgtcctcgtcgcctccctcgtcgcgcctccttctccgactgctgcggcggcgagacgcctccaccgcggcgacctcaccgagggagatcccgagcagccgccaccgccgccgcgaggaggaggagcgggttcgccggtcgtcgtggcgacagcggtggcggtggatctatccgccgcacctcccctctccctctcccactcccttacttcaccgcgtcgcagctgcagcggcttggcatcggcggagccgcaagcgcccatggaggagccacgcggcaccggcggcgcggggagtgcggcagccgccgccgccgccgccagttcttggcggcacgcggacgccggtttttggcagcacgcggacgccggttcttggcggcacgcagacgccggccgccggtacttggctcgcccggatccgagttgtggtggcggtcgtcaacgcggggccccggattcgccaccggatttgcgggtcgtggcggcggatgtggtggccgcggcggaagcggacggcgcgacgccgacgggaagccgcggtgaggaggaagctggcgcgtggtggcgagattattgattgttgtttttttttgcatgtgagatgtgttgtttcttggtgattcctcttctgtttcttgggacggatcgtgtaattttttctgcgttcttgcttggggtgtttcggtggcgggaagaatcgtgggcaaattggggttttcttcacttgatgcggcgcaaggggacggcgcggccaagaaccacaccccacagtgcgcgcacctcgcttcttcctctccttctcgtgccctcgttttggcttggtttcgcgtggctctgctcgggggcgaggagctctgctagggggcgattccttctgccacgtatgcttcaatccgagctggcaccgtgtagcaccgctccagctaggagcactgtgagaggcctcagcaaagagtcgagtcgtgcagctgatgctgccatggacctcgattggattgatttcactcgagaaagaagttggcatgtgaaaaaggagagggggtgtttacatctatggaagttttgacatgtcatatcgggtattatataggttgttgtatagggcgtttggacactaataaaaagtaattacataatccatcagtaaaccactagacgaatttataaagcccaattaatctgtcattagcaaatgtttactgtagcaccatattatcaaatcatggagcaattaggtttaaaagattcgtctcgtaaattagtcacaatatgtgtaattagttattttttaacctatatttaatactttatgcaacatttcaaacgtttaatgtgatcggatgtaaagtttttctgtggtaaataaacatggcctctttgatgcggatgcggcacaaatgacagtggatgatcgatcgaatcacggcattaggggaccgacaaatgactattattattggatgaaactatacggcaaaggccgtggtaccgatcacttaatccactgtgattaaaaaaacccagcaaactatatacccgtggcttgtttctattaggcggccctgtttgtgaacactgtgtgcactgtgcagtgggaaggtaaagtgcacctttttctcgcatgttgtttctcgcatgttgtttacgggtgaaaacgggatgaggattttcctaccgcctatctaacccaaagcttacgggaaaagcatgagaggaaaaatgggatacccgatattatccgagtttaaacttgaatctataaaataatatgggttaagatacgagaagaattgtatccgctcgtataaaatctattataaattcacctataaacataataaaagattaattaatcactatttttgtgtgctcacacgtaatattatataatttatttttttaagtaatgttttattttattatctaaaacaaaatatctataagttagatatataaataaataaccgtttccgaatctgattcgaagaaaataatatggaataggatacgggatgagtaataagttatccggcactacatctactcggttctgaatttaacaggagatatatgagaatgatgtgatccgaccgacccgatccattttcgcctctattttcggcttgctttcttttttttttttctgtgagatgctaaccaacaggtgtctgcgtaactgcgttcacatgaatgttttgtaacgtagtacattctcgaatttgggctgtttttagataagaggtgtaaagttttaacgtgtcacgttagatatacggacacacatttgaagtattaaacgtagtctaataacaaaaacaaattacagaatccacctgtaaactgtgagacgaatttattaaacctaattaatccatcattagcaaatatttaccgtaacaccacattgttaaatcatggcgcaattaggcttaaaagattcgtctcgtaatttacacgtaatatgtgtaattagttatttttttgtctatatttaataatccatgtatgtgtcaaatattcgatgtgatagggtgtaaaattttacaatatctaaacagtgccatgatcgttttaaatcagtctgcagcccgtctaaaaatgtagaaatacatgggcttgcgattcattactcacttaatttttttagagtaaattgtatattggtccatgttttttaactatggtttcacattggaccaccattaactgaatgctttcactttacaccagattttattaccaaaatgtatcactttggaccagtggcccacttgccagtgtggctgagggaaaaaaaaggaaacttctcggttgggaaggaaccagcgagtccgctggctcatctcctaccacaccgtcgatctctttccaacttcacccaaccatctcatggcggtgtgggcagagatcacgctaaagccttgggggcaacatggggagcttgggactggaaagactcatgtggaggtcgatgttaggcgacgtgagcaaaggggagctcgtgtatgtccaggtacagcagaagtcgagtcacggaggcgacggcggtggagaggagcttgagctccgggatagcgcgcgggcatcggagtagccatggagatcgaggttgagccgggacagcagagaggagcttgagcccaagtacgacgcgctagtgctactgaatatcgaggtcaagcgaggtgcgacgacggcggagaggagctctagctcggggacgacgtgcgagcgtaggtgaagaacgaagtcaagctagcgagggccgacggcggcggagaagagctcgagcttgaggacggcacgctagggcgacggagccgcgtaggtcaagctggggtggtggataggagctcgagctcaaggacagcgtgtgggtgctgctgcctgctggtgcctggaggtcgacgtcgagcggggggagacacggcagaggtcaaggccgggggtggcgcgccggcatgggactatgggagagttcgaggtcaagacggggcatgacgaaagcggagattgaaattgagactgggaaatgcgtgcgtgcgggaacaggcggaagtcgaggtcgagccagcggacgacatcggcggagattgaaatcaagccaggaaatggcgtgcgagtgtgggcggaagtcgagatcaagccaccggacatcgagcttgagcctgagaccggccggcacgacgggaacaaagtcgagctagcgtgatgccgtgttggcggaggttgaccccgtgctggctggactacgagcttgagatgcgcgggcgtcagctctgttatatatgctcgagctctcttaggcgtcgtggtct

SEQ ID NO: 77488 - DNA, 3273 bp, Oryza sativa
gaaaaatcgggactacaaatgattaccaatcgggacaacaaagcgtttctccaccagtgatagaccatgcttacatttgtcatacgttccatcataatctactaacgaattaacggagaaaacacaactatcagtaaaccaatttatagtgttttggcacaatttgattttcttctcgatgcaagggttagatacagatttgaatcaatatttatatattactaactttttaaataacgttttaccatttatcttatttaaaaaattagtgtaatttgctaaactataagtagtacttaaattttctataatgataaaagatatcacaacaaaataagtaatattatataaaatattttaataaaatgaatgataaataaagttaacgatattatctattaaaaatggtaggagcagtacttgggccctgatcttttctaaccctaaacttcaatttcctcccttttgtttttcatgtttcttaaacggtttaattgatgtgtttttaaaaatattatatagaagttgtttaaaaaattaaattaatttattttaaaatttataatagttaatacttaaggtttacgcatgtagaaaattttccttatatttaaagcaacgaacggggcttaagaagacaagaacctccatgccattatttgttgaagaatttcccaataactttcagaggaaaacaaaaacgatgaaatttcccatttttcacgcttttctaggtgatgactgatgagtagtgcagagcacctgaacggaaatctcccccatatggtccggtcccgatcatctttctgaagactgtaggcgctgccgctgacccggacggcgcggtctccggcggtcgattcgccgccacgcaacgcaaccctccctccctccctccgccgccggtcaaacctccgccccgccgccccccacccgagcagcggctcacgcacacacatcctcctcaccaacccacccgcaccgccgctgacgcgtgggcccccgagcccacctgccagcagaggccggtggcgccaacgatatactagtataaaatatattcagctcgtcggcgtcgtcgtttaccagtcgcctcgcctctcggcgtcccggtcgtcggtctccgctgcctctctctcttctctcttgccctactctactactactaccagcagcacacggtttccgtgaccggagcgcgcagcagccgcccacctaaaggctaaagatccgatcaaatcgaagagacttaatataccttctttttttttcttgagaggaatatttttttttcgctttaccatttcttcgtccctgggggattttcggggggattctgaggagcaagaagcattcggccgcggcgggggtccggcgctaagctcgagagattcttctccggtgagtccttttgctttcttggagctctatcctgacgcgtggtgtttctgtggtggtttggtgtaatcgttattgcttgtttacgcggttagattgcttcatctaaaacaaggatggttttcttgcttgatggtgtggatggcaaaccgtaggaggtttgtcgcatcaccgatcgcagatgattctaccgttgtgttcttgggacatcgccatgggagcctctgtggtagtactagctttcttgatggttaccctgtgccgtcttgtatgcatttttctataatggacagtcacctcgcgttaagattgcgtgttagactttctgaagctctaattttgctataatagcgaggggaagaggggaatacctcgtttggtgctgttctccatttgcgggatagctcaaagtcaactctcagtcaactcatttctttgcctgctttctgtacacatgtgttcgtctatgttataatgatttggttgttcaacaagttcattaattgggaccttatcggtggtgatgtgtgtagtaggagtgctatgcgtactacatagcacgattttgcttttgtaatctgcattcttgttgcatgcattgctcagttgctcaacaagatactcgctataaatatgtagaggtcaaagactggcacttaaaatgcattgtgcaaggcatacgccaaaaggaagtctacctatggtttgggagataattcattcatacaaagtgtaactaatattgcaaaatagcatggatgtctagaaccgaattattcttctactagatggtaaattgttgttccactcattatgaatcttctgattacacgtggagaagctgagagttctcctttcttgattgatcggtgcatattttggtgacaaatatgtctatttctgctattcattttgtactaatgtactaccgtggactcatgttatcgctcctcgtatatcttttagtggcattctttccaaaatgctaaactgaatgcttcgatctttttgcagtttggattgcacttgtcagagtaaaagggctaaggacactatgctaatttaagacatctcatccaaatgaggcgcaccacacttctttgttggcaaactgaaatcagatagcattctggtagccactaaacctacagggatgtttcttgtgtgttttgaagccatgtgcccctgttttggttcaagaaggaaggatgggagcgaagaccctgttcttggaagggatggaaattcctgtaagttaaatagcaagctttcatctattggtgatctaatctgttaacacaatgaaacaatgtagatgtcacgtttggaagtataaatgaccatcatgaattgtgacacattccttcatccttgtttttccagtgaattcttctgagctgaggtcaatgtctgatagagttcctccaagccctcttcgagtacctgcaagtccatctagattttcattgtcttcatcaccaagtagaaatgagccattgaacctgagtcttgaacaagttattaaactgacacataactttgcaccagacctgatgattggtgaaggttattttggaaaggtctacagagcacagctgcgagatggccacattgtggcaattaaaagggcaaaaatggtaggttttattttttatttttatttttttaataaaaagcagtgttggcgcaatgatagggctgtcaacaagcagctatactagagatttctctatttagaatgactgaggtgttttttttcaagtagtctcgctggttgatccatttttgtgtagatcagtacggtaatgaaacagtaatgcaccggtaaagcatgtactcacattgcattctttgcaccagtagggctgcaggaat

SEQ ID NO: 77489 - DNA, 2554 bp, Oryza sativa
ccatcctccatccatcccgtccgttttattgttttgctcatttcgacatggatttagtaccgattatgtatgccatgctcgtaaatttcttgcgtttttagtgaatctaacaagaatctggacctttaggggaattgatgctgttgactgacactggaattgaactgcgagaacctgcacaattacatacctggtggttgtttaacctttattgtatttaaagaaacctgctattgctgggaatggatgcatcttacatttatgtttgaattttagcaagatttaggatgtagattgatgaaaatgtttgaaatgtaggttcctttttttgaggaaacaaattcagcatgcccaaattcgcattatttttcagtttagaatataataagttaacaagaaacaattgcagttccaaagggtgaacctccacgcagttttctattcttttattatgttgttcactgaataaaagttctcccacaagctcttttcgcaattatcaggagcaattgatttatttacaataaagaaaatgacttcttggaagctttggcatagtattttagaaaagtaatttcttttagaatgtaggggttggctagctctttgttgaattctgataaagaggttcaaagtacagcatgaccataaacttgggttacagataaacatgcagcatttttttttctttgcaagggaaacatacagtgttttggaaatgaacaatcctgatcttcacaccaacaatactaagtcccttgtcatgacccgaggccatgacgggataaacaccaccgggaatatagccgggcggcgtcggctcctggagaatggatgtagatttaggctagggagaagaacattgttgagagggagagattagactaattgatattcattgcttgcctgataatagacacaatgtacaacttgacccctaagtaagaacctaatcttatattatctctaactaactaataatcttcttatcttatctctaactaactaataatcttatctcttaacttaattggtatgcgctacctataggccttggcctacggcccaatgcccatgacatccatgctaagagaaataaaatgaatcttgtggtggattgtgtattgcttcaaaacagcacagcagcataggataatgcctttcagaaagtcctcgcaaatttcaacaaacctgaacatataacattattttgttttggcatgtcatgttgtcttcctcctgaaaatcagtacaactccagggctatctgtaccagttccgctagcaaatgcaactaattgtatatatcaacatggacttcatatgataatttatgcacatatcctaatctgatgttttggaccatcttcgatgaagtggaattcttgtttgttttttcttgttaagaatttatcttataagctttatttttgaacagtttgtgctgtagcattaactgtcgttatgggaataagatacatcaaaacaagaaaggtaatgccagctggaataattgctgccgtcaggtattctctctctctctctctgtctctctcatgttattgtgtcccttttgtcaggttctaaatttgctatgctttaataaaatccttctgtagttctgtactgatatttcattgtgcctttcatagcctatattaaccatagccattgtcagcaaagtgtagttatatgtgctatatgttaaacaatattactaactagccctttggctttgattctcagaagtattttttcctttgtgcatggagcccacaaccactacacatatttgagaatacttcacctagtcaagtctttctttccttctttcatatactagataatagatactactccatgatatcttattcccatccttggtgccttggttgttgccttgctgttctgtgcactctaatttaaatatatatagatgacgccttaacatggtctatacatgtctttgcagtgcacttgtactgatattctacatctacaagatatcaaatggtggcaataaggtttatgtcccagtgagcgcggagtgatactggaggccagggtattatggtgcattctctggataattctgaatcgatcgatctgttcttctaatttgttgcatacctgtattctgccatcccagtgatgagaacatcgttctgcataatgtgaattatgaatgacccatgaaaaatctcggcagttcagacactggttcagctaagataccaaattcttctgcgattgtgacatatgttccgcttgtatcgtgtgaaaactatattgtcattgtactgcacatcttataatgcggccttgatacagtgattgcttattagtcattactaggaactaatttgggatgatttggtttgtttcaaaatttttttgggacgattggctcgttcaaaaacaaggtgggatgattgatgtatctatgattggataatctgcagttccattatgcagagttcacaaaaatgattcagaaagtgtctcattattcagaaatgcagagtcccatttcttacccctccaacgcggagta

SEQ ID NO: 77490 - DNA, 926 bp, Oryza sativa
aactcagccctaagggatcaaaattgaacttattctgtgcggagtgtacatgcggcccataatgcagccaattgtgtggagagccacagccatctgatctgatcttcggtcccggttgatctggatctatataaaagttcggcagcccaaaccctaaccctaaaatcatttcccctccccctctctcttaaaacgacagcgtcaacggcgcctcttcccgtccgttgtagcggcgctgctccccctctccctcccacagtggcaggcagcggcaagtggtgacgccctcccttttgggaggagcagaggtagcgagcagggtggtgccctcccctccgctagatctagcgggaggggaggcagcggcggccccgtgtcccagcgatggcccggcgtcccagcagcggcgcctctctctctctctctcaaaacgacggcgccagcgacactgttcccctccccctctcccaccggcggtgacgccgctccccctccccctccacggtggcgggcaggggcagcgccctcccctccgccagatctagtgggaggggaggcagcgtcagcctgacatccctgcgatgacggcggcggttctatggcgacggcagcaccctccccttccggcctcggtgtttgagcttatgatgtgtcttgtgttgtcgttgttgttgatgaaatatgttcttgtgttcttatagtattgttttctccaggagttgggtccaaatttgatgcggactcgcattaagtgttaaattgaatcggactttctcttgtttttttgtttgtatgtttttataacccttttttcgtaattacggcgatggaaacgttttcaattttttaagtagtagagatagagattacgattaagatatatcgcttcagaagtgtttttaattaattattatacaataaaaaat

SEQ ID NO: 77491 - DNA, 823 bp, Oryza sativa
ttttggaaacaatttaacgagtatttaacaatcctatcctcctcaacctgcaaattgcattgatcgagtcgagccttccagggcagagcacgcaaagaaggaagaagccgcaccgcccacgcccccgccgtctcctccgccgctgcctctgcctcctccgccgtcaacgcaagagccagccatgggtcggccgcgaggggggactagcaaggggaagcagaagatcgagatgtgctgcatcgacggcaaggagaaacggcaggtcaccttctccaagcgccgccggggcctcttcaagaaggcgtccgagatatccacgctctccggcgcgtccatcgccatcgtctccttctccaaggccggcaacgtcttcgccttcggctcgccgagcgtcgacgccgtcctccgccgccacgtcgtggccgggccttccacctccacctcccacgcccacgccggcggcgacgtcttcgcggacgacggcggcgacaaccccgaggtgctgaacgcgctgaagcgggcgacggacgaggccgcggcggaggtggcggcggaggacgcgcggcagagcggcgtcgagggaaagatcacggaggccatggcggcggggaggcggcggttctggtgggacgccgccaacgtcgaggcgctcggggaggcggagctgccggtgttcgaaagggcgctccataagctcaggggcgccgtcgtgcgccgccgccgccgcctcgccgcagcaagaagaagctcctgaattagacattacaccgtgaatgcttgttaattaggtgccactgattaatcaattgcaaacgggtttagg

SEQ ID NO: 77492 - DNA, 573 bp, Oryza sativa
attcttagaccacctcaattgtgtcgttcactgggtgccgtttagaaaatgggcatcaatggatgtttcccaacaggtatctatagttgttcttgtacaagtgggtacttgtgtgtagtaccgtgtaacatgcatagtgattgctactagagagaattaagagatggtacctgtctatactacatgtagcgtggaacactgttgttctcattttcacggacctatgcttgaaaccaaggtatcatgtcctaaacctatgtgtactatatatatcggcacaatgatcccgcggctctatgcgtttccaataagattcgcctcggcgatgttaaatttcgagcaaaataaggtcagaggtgtttctgatgacaatagcacttcaggtcacacgttggctgagtactatacctcagttttcgcgagcactctttctaatcaaaagctgctaaacttaattaataatgggcagcatttattaaaataaatgtaaaatttattttccaaattaataatatataatacttaatttatcatgagtcaattagccgttgaaaagtgtgcctggttaataag

SEQ ID NO: 77493 - DNA, 615 bp, Oryza sativa
tatgacctccttgcccacaaggttgggttcaactaggctggagctttctattggtgtccatgctgaaccactttcattatgatgtctgcggttgagttttaaaaatacctcatcctttgaaatgtaatcgatctttttgttcaggcttctaatttttacagcaacttcatgacgtatacgaatattagaaaagcaggatgaaagtgaaaggccactgcaagcagttgatttccttgacgatgacataggatagtcaggcagtaggacacttcctttaaatctagccaaatcaataatatcatcaacatcatacataacatctcttagctggtcaagccatttttcaactactaaatcttccatcctccttgcctcagcatcctgaagagaagatcttatgacgtttgttcttcgttgcagttcttcaagctcatcttttacccctaaaatgagtattgtcttgtctgtaatgatcgcttgcaacttattgatgcatgatccacccaatgtgtctactattgttgccatccgacaaactcaaaaggggtaatccaccatatataattgatcaatgtaaaaaatgcagcctgacatgtaaccaaacttgtgttaaca

SEQ ID NO: 77494 - DNA, 7564 bp, Oryza sativa
ttcctgcagcccgtcttcatcaccaagtagaaatgagccattgaacctgagtcttgaacaagttattaaactgacacataactttgcaccagacctgatgattggtgaaggttattttggaaaggtctacagagcacagctgcgagatggccacattgtggcaattaaaagggcaaaaatggtaggttttattttttatttttatttttttaataaaaagcagtgttggcgcaatgatagtggctgtcaacaagcagctatactagagatttctctatttagaatgactgaggtgttttttttcaagtagtctcgctggttgatccatttttgtgtagatcagtacggtaatgaaacagtaatgcactggtaaagcatgtactcacattgcattctttgcaccagtagttgtggatagttattataatttggtgtttttcaccgcttgatcttgttggtcactagtcaaatttcttttgcaatttatatttattcaaaaggtcctgataaagtattaaagttgctgatagaaactctgcttcctacatgtgatttttcttacaagtgaatcgcagttttcatccggtttctttatgcaggaacattttgcctctttacgggccgaattcagtaatgaaattgcattactaaaaaaaattgaacacaggaatttggtccaattacttggttatatcgacaaaagaaatgaacgaatcgtcataactgagtatgttccaaacggcactcttagggagcatctagatggtaaactgcatactaagattctcttttgttgaattccatatagaacaatcagtaattttcaaattatctttcaggtcaacgtgggcttgttttaagctttaatcagcggcttgaaatagctatagatgttgctcatgggttaacttatttgcatctatatgcaggtatgctttgtcacatgtttctgttgctgagcataaaaacagtttaaaaaaacaactgactgttatttttatttttatttttataccaagtcatgcatcggggtattgtcactaagtaatgcaagaactgtaaaccagtattttaactatattttccccctctaaaggttggtccattggctcataatctgctaataaatgctagtatcagatatcctgactgtaatgttctgtagttcggaaattgtttgtggctgtgcatcaataaaggttgtgaaatgagcctaacaaccaagttgaataaaccatgaaaattagccatgtaatcagatgtgtatctgattttaattctttgatcttcaagctttaaagtagcttacagagattctagtttgactattcctattggcaatttgcatatgtattttatttatttgttctgtacttttatgcttttagagaagcccataatacacagggatgtgaagtcatcaaacattctactaaatgaaggcttcagggccaaagtggccgactttggatttgcaaggactggtcctacagagccagaccagtcacagattcagactgatgtgagaggaacagctggctatgtagatccagagtatctcaggacaaaccatctgacagtcaagagtgatgtattctcttatggagttttgctcctggaaattctttctggtcgtcgtcctattgaggtcaggagagctgcaagagaaaggatcaccgtgagatgggtatgtcttcacttccctactttgtgtttacattggtttagacttttgtttctttccattgttttttctagataactatttaggagcaatttacctttgttctggttattttcttgcccccctgacccctcttgcccctgcatacgctcttgcttttctttctcgagcagttatctgcacatgaattcattttctttgtcgacaatttgcaatcccatcacaagttaaaccatacaacatgtaaacttccagtgtgcatgcacaaacataacaaaaatataatattttctaaacactcaacattttcatttacctgggaagaaaacaataataagcttgattcattttctatagcagttaagctgtttggtcatgggttttgtcagaatttaaggcatctgaggctctctattgttttctaattttgatacaggccttcgagaaatacaacagaggtgatgttaaggaaatattggatccaatgttgaccgagtcagtaaatgaggatatactgaataagattttcgatgtagcattccaatgtgttgctcctactcgtgctgacaggccaacaatgaaagaagttgcagagaggctgtggaagataagaagggattatgcaaaaacccaacgcagagcagaaatggctctgtaaaccatctgatcctagcttctgcttttactcgagagagcatttggtgaactcaccagtgtccagcaaagatccacaaaaacaagttcagttttgcgaatcgggacaactaaaatctatacatggttgcaggattattatatgcgctgtacatggacttgcatgtttaaaagatcaatatgatgtacaccgacatgtgaatcgaagttttccccatatagcctttttgctctatccaagctttcagtaatttgtgtctcaaggaagtgtgaatggtcttgttttgaagcctttcaacactcaacagttcttgatacagctttccgttcttgtgtatattttgctggtcctcctagtggtacagctgatctttttgtcatgttcagtgttgctcatgatgtgaggtgtttttaagtgtaattatggcttttgggatgctatgttgtattcgtgtgctgtaaccagatcttaaggcaatggatgtgcattaattgtgattttttaaaaacattattttcaaccttttacagtccttgaagatgtattgagagatataccgcatttttgtagtgcataagcattttttatgctgcacccaaactattttcgtacaaagtttgacaaatctatcacgttctatatattggatgaagcctggacaggcattcccagttcagtttccctaacacggcttcacacagtccatgaataggcattctcatgcatgcttgaaaaactggccaattgaaggaaattgctctagtgccaaaaaaaaaatcagggatgagtcaaggcataataacaaccaggatttccaacagtgatgaggatctcacctgtggacctattcgccgaaagttgatggcactgtcttacattgctgactatccctgacaataaaaggctgtccagttctggatttaacaattcccctgtttagttgacacaaaacttcccccaaactcctaactttccatcacatcacatcacatccgaaactttcctacttatataaactcccaactttttttccaaactaccaactttccccaaacttctccccaatttcagaaactaaacacagccgcattggacgccagattcttccttcatccaacaagctcttccatccattcattcctctgaatattttagtttgctcctgctaaaatggaaatattacagcagcatacaagtggaaaaacatcgttaaaggtggtggtcatggataaacttcagaaagtagtacattcattgaaacggtggtaacttacaaggaaccatctggcttaaacgttcaattgcataaagcttcgcaagacatcctagtgtacagacaaagctctcaagtctaaaatttctccgagggattcaccctcatatatataaaccctgctagcggttcatgctctagggaatttgtacaccggaatttgcctcctctctaattctgtatcctaaactaccaaataaacctttgtgtcccaggctcatgttgccactggaaaggtctgaacagaaacattgccagagtgaagaagtcaacagcggcataaagaaaccccaaagcaagcaatttaacattgctgatcactggagaatgaagaacagtatgaccaatggaattgtatagtatctaaattcaaccaatggggcagggatgagagcaagggcaactgatagaacaaaggacagcacccaaagtcttgtctgtgacttccctgtaagatgaaacaaaaaaatccaataaatatcagttcatatatactctttaaagtagcaacttctacaaaatttatatagagaagtttacctaagatattaacaattgaaaaccatgagtacacataaactggagtcaaaatgtatttcatcatccagtgaacttggataaccttcctccaaatataaaaggtgtagtgtctattgtcagcaagaagatatggatgagcaatgctgcacaagaaaaggggtacatattaggagttggtaaacataagaaggcaaagtacatcatgctttaagaacaacaagaaagtgcagtcaaggaatttgagaaatatgtttgacaaacatgcttccacaccaaaatttcaagcattataaaattgtacataagctgttactctccagttagattcagtgttgtttttaacgaagtatgagtcagcattggaagatgcacctaaatgttcagcaggaagtacttttagcagtttctgggagaaaaataacacagaagagggaaagagataccaaacctgaataaatgtacagcaacaaggcttaaaccaagagccaccaaaattgcaaaagaactatatgttttgttctttctgcaccagtggaataggtctgatgctcgggtaggagtaaaatgccatggcaggagggcagcagctgacactagaccaaagtacaaaaactgtgcaaagtgtggtgaaacaacatgagcttccttagcacctgcatcactcaaagcacaagggtgtatgaagctttttgtagatcattctgtaagctgccagcgtacaaaggttgaaaggagctgacaaaaataagaaatatacctagcactatgccaccattccagactatgaatgccacaaacaccaaaagaaccattgcaaatggtataaaagcaattaaaacttcacactttgaattccataacttgaagatggcatcccatatttcctctgtaaaacctgcaaattaccaacagacatcagatatggcaacaaaatcattggacacgaaatttgagatcatatggatgcgtttaatttccacctctttttccaaaataatatttcatcgcattcagaatgaattcatatgattgataaagaactacagctagtgttctagcaatataaataaagaaattaccagtgaataacaaataatgtttagaccaaagcataataaaaatgtcaaaacgaagttaagcatgcaacctactgaatctcaaacatgaaatccaaatggttggagaaatataaatgcatctttttaattgacagagttggaatactcactggaatacataatgtttgattcagaaacaacttctctcttgtttatgggattattgtttcgccgccttctcaaacctggagcagtggttttattatccatgtgagatgcctctttgtttgacttatctgttagttcactgttctcgtaacaaacattgtccttgacataaagatattgtgcatgagcgatggctccattggcagcaaaaaatatcatccatattacattagtctgccggagaagtatagaaaaagcaccaaactgcaggcaaaaggaagcatttaattaatattgctaacagatttgtgatgaaaatcaataccatatcttaactcatgccaagaagtatggaaggacccatagaaaacctcaagatcaagattacatatttacatgaaagaatacatacaacagctataaagagttgttttcttctccaaaattatatcaattctggaactagaagaaccaccaacaagtatgctgtggaaaacagttatgaatgtacgactttctacaatctaaaaaaaaacttaagatgtgaagttgtgaacaaaacaaataaacaatagaacacttaatttaaatactcaccgctgcactgacccaaaattgtttcttcaagcagaaaaggtacatcgcaagaactgccgctaatgatgcaacatcagtataataaaggaaagtaaagaaccaatgaatagggtacaaagctactaaaatagcaaatgcagttgccttcctcttgccaatttttggcctgatgcacaaaagcaggtcatggactagaacaccacagatcatcgccatgataacattagtggatctcagaagtgctgtagtgcaaagggcatcaaatgcctctgctattctagtcacccatgcaccaggaaacaaggaagcaacatatgctagtgaaatgtagtacctataaaattgcagagaacaatccctcatcacaaggtaaaatttgagggtgaagtaatgaggagttttgagactcacaggccaggaggggtggtgatcatgggatcccatattaagaaatctccacggcaatagcgctgcacctggggaacatggaagatctcatcctaaacacaaagaaatgagttaagaagggtaatgaatgcttttttgtcgtgcttccaaatgctgcctacatttccaatgagaatgtggcaagatgtgacaataagtgcaaatttagtagagtaactcgaaagcaatacagggaaattgaaaatgctcaagaaattcaacacgcctgcttgccaaattttataacttccagagaagtccatttcctggacagtagagaactcatcaaactcattactacaaaccagatactaatgttctctccacatgaaaagaattattcaaatgctctacctgatacttttatagacacacatcaggcgatagcctagttgcaatttcagatccaagagtctagttcataagtttcatatgcggtttcttccaattcattctggactacatggaaatcaagtaagacattatgcagatctacccctgaaactgcactagccaagcactcgtggaggaggagaaaaaacgctcaccatgtaagggtcgggcacgatggaggcgaccagagcagcgagcgggatcgcccatgcggccactgccgcggcgacggtcagcctccccatcccccacccgtactggctcctccccgctgcgctgcgaaaccccgctccagatccagccccgcgcgccccgggagcacagagcttaccaccaaacgaaccctgagctcgtcacgacctcaccggaggcgctccggtaggccttggcgctggggctcgggagcagtttcccggagtcgactgacgaggtgcggtgcagcggcggcgcagtacaactccctcgccggagagagtctcgcctcggcgttcgttgcggttggtttcaggctaggctgggcattttgggccaggcctacgtacgaggcaggctgcgcaaactcgccggcccagcccagtagcccgaaaggaggaagagtcgaagagagtgcgagactacgcgagtctctccgatctctctcctctcccccttggctctgatctctcacccgagatccgagcacgaaggcggccgcgggcggatccggcgaactttccaacgccgtgaatcgccccctcccacggtgagcg

SEQ ID NO: 77495 - DNA, 8322 bp, Oryza sativa
cctgcaccccaaaaaagagagcggaaaaaattacatccaaaaaaattgacaatctttaaaatatgacaataccttaccttctgttcgccggaaagaaaagaagaaaccatacgaatgtacataaaaaagatagcaacaaaattacatccataaaaatcgacgatctttaaaatatgattttctaaaatatattacatcacaaatataaatatatatagttaaactaagatctataataataatattaaatatccaatcaatgttctttgaaccatcttttaaataatttttaaattatatatctaatttgtgattccatggtattcctttaattaaattataaaagttgtgttgcgatcctaaatatatcacaacacatgaggccgtcatataatagttagttgtttaatattttttaaaaaagttcagatcatattttggggtgtgaaatatcacttcacaaatatacaacaccattttaaatctacatatataaaaaattaaaaaaaagacaatttagttgtgttttttcaagtagatctgatttaattgtaatttgtttgagattaagattctcaaacttttttttgacattttcagaattattttattggtatttgagaagtgagcagcatacatagtacatagatatgaaaagaaatatcaaaaatagttccactcaatgatctttgctatgattcaaccccttaaatcatcatgtgatttatggtcatattttttctttgccaaatagttttgacacaaatgaacaatgaagtaacatgcacaataaactactcatgatatattttcttgtacttaaggaatttcaatatattagacataattgatggatatttatcataaactccactgacatgactgtaagtgtactccaataaattatttattgtaaataagtttagaaaaataaatatagtcttcaaattagtaaaagtgcctcgtgattatgaacaataggtgttgaaacaaactacgcgctaaactatagatatttgtcaaaatattaaaaataatattgtgctgcggaaattatcgtggtagtatgtctctttagcaataattcttttaaataatgttgaatgattaacctctctcattttcaaaagcgagttttctgtctttatcataaaattttgagtagtattgatcaacgccataaacaaactatgtctaaaaaaactattttgatcacttccatcttctctttgttcttccctaaagggcaacaaactgaaaactccaaaaatatgatattctaaatatttaaaacaaaacacacatagtataaatggaagatttttcactgcaacaaactccatagttatgacacaatattttgcacgattccaattttcagtttagaaattatgtgttgcaataattggaagaaaatcataaccaactttcgaagcaatcctaaacaagtttagaatatcgctacagaaaattgggaaagtcactcacacacaaagtttcataatagaaattcaaccattgttaaataatggtttgtttgggagatttatggagtatcaaccgaattattcgtaacacgcttcaaaattataatttgtgtaaaatactttcttaatcggtattgcttaagtaaccttttttaagctatttgttagtcgtatgctatactatgtaatgcacttcataatcaattatctatgttccacttcatcatctaaaagaaaagtagacatactttgttttgaaaatagataattgtaaattaaaagtaggttctttcgctttttaatggaatggccagggtctctagatctccttttcaaataatctcaaaactatattattgataatttatgttttacatcaagttagagcgctctctaattggttcggattgacataacttcaaacatacttgcatgtgaaattaaaaatacataggagcgacaaatatatatcgaccctactttatatgatgtgttggacccatattatttttttaagaaaaaaacatagacaacatcaagtttaatatgacgaatttttaaccaattatgtattgctacattagtgacttacatatataagacgtggattaaaacatatgccacttcatataatatagggaaaccattagcatctaagcacttaaaaatgatgcaatgtttatgataattggtgttccaattttggtgaaaaggaagaaccaaatttttatgagactactataagattttctttctaattggttcactttgctccccattggcattttctattttatattatacgttataaaagtgttacactgatagtgtaaaacaatgatagagtgttacaccaatgctccatgtgcgtgtgataatgaattaggcattaaaattatgctcctagctggtcttgaggggcaaggctatatcgctgcgggacccatgtttcaagacaatagagaaggaaattattggtgcctactatcggcttcacccattagactagcattcgtgttaactttaatggtgttatcctattaatggatagaagtggtggtatttttgtagtatttatacgtggatttagaaataagtgagacgaaaccaaagtacactacaagaaaagaaggaattctcaagagccaatccctgttgggactgatgctgttctcgttgggaatgttattttcaaggggatactcttgtaattggtgccttgggattaatggcctagctaatactatcatttgctaggaccccgttgagaatagcttctgcaagagctaaattcaagagctttccttggaaataatccgtcttggttgttgcatagaacactgacaatctcaagggttgctcgttgcaaataccttttcaattcagtttattaaaaaatctaattatttttatattattagttaattctcctatacaaagaaatacccttgggattgttttgatttatcatttttttattaattctaattaaccaggaatgatatttttaattattgttctttttatgcagtacgtagcaaataacatctgcattggatactgcatcacatgatgcaacaattatatttgctctgacagaaaagcgtcaaaggatttttaatgatcaatataaacagtagacaatatatttgcatttaatctaagacaggtctgtagacaataacacataaataaaatagtctcagaaggtaagttgatcaaactgattaatctagcaactataataggtctgataacatgatcctagattcctaatctctaatgcttgcaattcgacattagcacatcctagaaacgccagaggtcatcattctcacaagttcttccacaatgaccagcttgtggcgcttcttcagtagtgttcatcccattctgaaataaaattacaaaataagctacaaagttactgaaaaactataagggtaggtctaagtttgaacttatgaatgatacatagcagtccatttctaaattgaactcactaactggtatcgcaactaaagccataccattggcagaacatttttaaattgatctattgttgtccaagaaccaaatttttcataatgtttgttcaagagaataaataataaggatgtacagtagtaaaaagattgaagtcagtatataccatgagaagtgcatgaaggaactcagggacaacagaagaagatggtccatttgcatcctgtgatttgaaaaataataccagttagtatgttctttctaggtaacaaaaatagctttaatttatacttacatgggaatgagtttctgccttatccttatccactgtctgctctagcctttctatccttgatgctagttcttgatgagcattgttcacagcattagtgactgcctgctgaacaatgtcttgcacttgctgctgtgtgtatagtggctgtgtctccatgctaccagatggtgcacttgctgaattaccaacatggtttctatctataattcctgaaagaccataataccttccacgttttctacctttagtgagctgcacccaaacatgttgtttgttgacttgattgttttctccttccttgacacgatcattatacaccacctaattaagatatgtagtggcaccattgcatggttttagatgatttcactttttttgattgccaaacttgaaactagaaactagaataagcagaacacataccgctaactattcagctttcttgttggcatactgtcccttgccctttgcatgtcgatgtgtgcgttcaaagacatcaatatcatcaacatccgtccctgcattctcaattatctatccaaaagtacatatcatagtgagaagtcaaagtagtataaatcataataggaaaatcatttaactttggtaccatggcttgtttatgcatagcaacacttcgtgaaccacaagtatgatgaacaccacctccttccatccgatttttgctgttttgagctgacaccttctttacattttcatcagaccacaagtcacacaacatatcccaccacttttgctcaatccaataaggagggaatgccttccaaagttgaggttcatcaacatcaaaatcatcatgagaaggggcatctccatcctgttgtaactcagtcgcacgcatattttcgatatgcttctccaaagaacgttttgcttcagatttctcatgtgacaaagcttggctaaaacgttcaacagctttgcgataaaataatctagcacaatcctcttctctaccatcagcaaacttaaaacacagctgtaaaaggataaggtaggacgtcaatccattaaaagaacctaaatattctatgtgaatgctaacactgtaactcaccaaaaattccttcagaatagttatccttgtatgagcagaaaagttgtgataatgagcaatgacaactgcttcatcctcaggcacctgtttgccatgtttatccaaaggtctatatgtgccagggtagtgagcttttataagacatgtgatggtagatgaaacattcttcttcataggattcgtaatccaagcactagaaacaacatgccatttaccaagttaggtaatattagtgtaaaacaatgaaagtgataaaaaaatatgttcagccatcataatattggatttataggaactatgcatctgtatttcttaaaatttaacatggagtttacaacaagattttcaattattaacaacaatgatatacatattatatggagtgtgtgtttgtgtgtgtgatagacagtgtgtgttttaatataagcagaaatttagagtgtcaacttactctttattgagtggagttatcactgccctatctttctctggaactggtgccatcaaaacatttggaccacgaccacccttactttcttttgttgaagtaaccaaagaatttgaaggttcatcttgtgttgaatcctcaaaatggtcttcaacttcaggatccggataatgtcgatggcgtcttgacatagtacttaactagtaaaaacaagggttattttgcaagcaaatgtagtcattgaagaatagataacatagtaaatttgtaataatgccactgctcatgagaaaatgaaataataatatcacacacacacacacacacacatatatatatcaattgtttagtcactagaatcactatcattgtctgagtcattatctgattctattggcccttcatcttcactgctgcaatcactgtccatggcaacataactctctatgttctcatggctatttggtctatttaaaaaatccatatcttctggatcaacttgctcaacaatatttgattcatgaagcaagctttcatcaccaagctcctgtgaaatgtcagctccaagctgctctccctcttgataatattcagaaactacaggaggaagcgaatcatcaacttcatcgtccactgcaggaacgggtaaagtaccaattggatttgttttgaatgcaacccaccaatcttttctttcacgtggtggcgatggatatggtgtataatatacttggtccacttggtatgcaagcacaaaaggctcatattgttccaatcttgatgtatggttaacttcaactaggcctagtgctttgtcatacttcactcctttcttaggatcaaaccagacacacttaaatagagccacctttagatcactatcactgacatattccaactctattatctcctgaatagtgccatagtagtcaggcccttggttatcaaaccaatttgctgacacacaaactccactatttgtcattgtcctcgatgatttcttttgttcatatggttgtgtacgaaaacgaaacccctgaacatcacatcccttataacacttaaccatgtatcggggcccaatggaaagagcccttacttgttcttcaactgtttcatcttttccagcctgtagaatcaattttcatgaatcatgcattaaaataaataataatccatcagatattacatcatgtattcttaccaactcacgaacccaggttggaaaatctttctcatgcatctcttgtaattgagttgtagtgatgttcctgttttgttgtttcatccccctatcaaatttcctgacatttattgcaataacataaatgtaatatgtcatattcacaaaaatagagcccaagtaataaaataggaaaacagaataatatatacttacaagacatatttgtcaacttctgcacaattgagtaatgcatataccctagcagcctgccattcttctcttgataagttacatgatgtgctctttccaagagtgcgatatgggatagagaatatagacagccagtcagtaggtgctctgaaaccaccatcatcatgtctagggacgcgagtgtgctttgttcgcacatgatcagcaaagtacatagaaataaaattagagacctcctgtactctatacccctctacaattgaaccttcgacacgtgctttgtttcgaaccttcttgcgagcctcatgtaactccctatgaattgagcagaaaacataattatgaaattaatatacaaattcacactttagtacttaaccaaagaaacatacctttcaaatacatacatccagcggtaagctacaggccctccaattaaagcttcataagctagatgcaccaccaagtgttccatacaatcaaaaaatccaggaggaaaaatctgttcaagtttacacacaatgactggcacttccttttgtaggtgcttcatttgttctatatccacctcttttgcacatagttgcctaaagaagtagctcagttctgctaaacacttccagatgtgcttggggaggaaatcacgaaatgccacaggtagcaacctttccatgaagacatggcaatcatgactcttcattcctatgatcttgcctcgattaatatcaacaccctgtgctaaatttgatgcataaccatcagggaatttaagattcttaacccattgcagtaccaatttcttctgtgccttatctagactataacaagcttttggtttcacccatcgacctatagatttttgttgcatatgaagttctttgcgattgcatatattggctaaatcaaattgagccttgacattatctttagtcttctttgggatatccatcaaagtattccatatattgtcaaacacattcttttcaatgtgcatcacatcaaggttgtgccgtactaacaactcacgccagtaaggcaactcccaaaagatagatctttttacccaattatgctcctttccaaaaccctcaatctcttgatttcctgccttggtaccaaatgtaatttgagggagagatttaacacaatcatacacttctgaagatgatcgatgaataggtgggccatctttctcctccttattctggatgaacttgtcttttgcatgtctaaaagggtgtccctttggtaggaaacgcctatgacaatcaaaccaacatggcttgcctccaacttttagccaaaatgactttgtgtcttccatgcaaattggacaagctaattaaccgtgtgtgctccagccgcacaacatcccatatgcaggaaagtcacttactgtccccataagggcagctcgcatgacaaagttctggttttttgagcgatcatatgtcacaactccttctctccaaagttgcaaaagttcatcaattagtggatggaagaatacatctatgttctttccagggtgcgtaggccctggtataaccatggtaaggaaaatattatgtgccttcatgcataatgctgggggcaagttatatgggacaacaaaaacaggccaacaggagt

SEQ ID NO: 77496 - DNA, 2198 bp, Oryza sativa
cccgtgctggcgcaagggcttgtcattaggaagaggccaaggaagaaggaaccatgcttggggaggctcatggggggttataggaggaagcaagctaagctgctagatctagtgatgcctaaggagggtgaaaggggattgtagtttaggggccagatctaatgtgaatccaaaatgggcgagagtaaatgccgatagtagcatgaatacagcacattggctagttcagcttggcccttgacccaggaataattttgtggagtgatctaatgtggaaatggggttaaatgagcaacatcaaaccaatatttgtgttcaattgcagttggagagtaactagtccaagtgttggtggaaatggcaagcacggcgtgcttcgcgattgttagtaagaacgacatcccaatctatgaggcagaagtcggatctgcaccgaaagtatgtattccacgcctcattacttctatgaatttaattaattgcattatgttgctgtttatagtgccttgtgttcaggtcacaatgtcaacattttggttttgttgatataaaagcgacactaatatggaaatggataatcccctctctcaaaaagaaagaaagaaacaggtgttggttgaacataaatcatgttgaatcagactcttgattcccatgaagatgcccaatggaatagttgagttttgtataaaactggatatagatggtttgctacctttctacagcgtagtgatttttgttgttgccattgttttcctccctcccttgtctccattgttttctaggatattgattcatatgtaatagtgtaaagttgctaattgatattcagtaatataatggagccttcatgggatgagaatttttttccttaggtaacatcatactgaattactaatgtgcatgtctaatcttctgacattcacttactgtggcagaaagaagatctggcttatcagcaccagttcattctgcatgctgctttagatgttgttcaggacctagcatggtccacaaatgcaatgtgagtatttattgcttatacatgtttttttttccgtcaggtacacctgaacatgtgtattgtaatttggttgtaggatacatacaagatacgacaggccaaagatgcctttcgaaaacttttatatatatttcccttgcataattcctctacatattttattcaggttcctgaagtcggtcgacagattcaacgaccttgttgtgtctgtttatgtaactgcaggtcatatcctttgaaacgatttgttgttgttgtgtaacttgactgactatgtgaaacttgttaagttttacctgtacaacaatattgttttctttaacttgatgacacatgctagattcatgttgcttcatgattcacgtagtgaggatggaattaaaagcttttttcaagaggtccatgagctttatatcaaggtaaggcaattttgtgtcctttacaataaagtagtttgctaaaaagttatgaataacaaggatcctgtcagtgcatttcatatctaaatatgttgaatcagttatacgttcatatgccaattctcaaacatacatgatattagggtgtagcatgttctatgtatgggcatagtatccaaaatagttgttggctgacacagagttttgtagtttctgctgtccacaatagattctgagaataaacctataatcattgctttcgttacataattttcattagaaatgttcgttgtgcagatattcctcaatcccctctatctgcctggatctcgcatcacatcctctcattttgataccaaggtcagggctctcgcaaggaggtatctgtagggaacagtcatggaggtactataagcttcacagctaataatatagaagcatgcagagagaagacaaaatacactacttttttttcttccatttatttcctgctgtcattattcagactcctgagaaatgctgattgtttttctttgggctttctccagtgcttatgaaacatgatttcaattttcacccattttgttctgtacagggaaaatctataaaaatgtaccgtttcccttttaccgtatagcatggacacattgtattgatttcctgttttctgtggcgcgctaagacactcaaatttagtattgtgaattttactcctacctctcatttttgcattggttggtaagatcttacctttc

SEQ ID NO: 77497 - DNA, 7743 bp, Oryza sativa
ctttctagggtttagtgttacaggggattttacatggttgcccttatgaaagggacatttacatgggtatgcagtgtcatttgcacatataggcctttaatgggctgataggctgggcctggtctatggcaaacgggcttaaaaggccaggggcggcctgttgggcctccttgatgccgaactcgtcatggcgaagtctttgtagttcgccgaagatgccttcacccgagatgcctttactttcagaataccgacgcggctttccagccttcgccatcttcgcttatggctttcgccatagggcttcgcctgaatggccttgacatctttggcttgaatccttgctggtactatagtttcggcaggtccggtcgaagggcttcatggcatgcctccaacactaaacaacctagaatcacaattaatttgggatagaggtagtatgtgttaaattgttctaggctctcgcgtcacccacgcctaggcgactcagggacaaaaccctagcccccactgccgcaccttccccatccccccacctcgctgccgccggagcgtgtcgtcggagaaccgggcgatgagccaggatggcggtggaggggccttatcgtagaggcgccctgtctcgagcgtgggagaggcagcgtgacgagttgtgaaccggagacctggaggtggcagcggcacatcctccccggcgagggaggtggcagatccggcacttccgcgaccaaatctgatgctcctacggctggatctagtgcctccgcgtcggatctagctggggtcgagcagcggggggcgaaggcaatgagaggcacgatggtagctgctgggagggagaggctgggcacggatggcggtagcgggcgggcagtagcggtgcgggccatgcgtatagccaccaggagggagaggccggcgggaggacggagcagctagctgcagtggacggcagtgtgcgtgaggccgcgcgcgtgggtatcagtgggaggccgggggtgacggtgagctggaccctatggtggcggcacaaaattggcaacgacgatgggtctcccctctttgcctggcatgccccttcttcccctagtgctccccctcctttagccgttctgtctccagatacggtcgtggagagctctagcgtagagatggtggtggtgcctagcactggaggtgttctactcgcctccctcgttgcttcatgttgtagaattgggacggtcggcgtgcggaggagccgatgagggtcgtcggtgcagtggtgctcccggtgcgacgatggccagtcgacggaggggcatcagtgtggtagagagcacatgctagcagaggtctgacggtggcaggacgtcggtgtcataacaggaggaggagatcggctataggcgaaagccttgcttgacaccttgtctgggcaaacaacgacaatgtcttcaacgtttcaatccctcctaagggcgttgttgagaggcctacctctccctctagcaggacctcgggtgaaaaccaagtcctcttctggatgggcggctctgttgcctatccaacattcgatctttcagtcttcgacaacattcttggatgttgccatccggtttgctcgtgggaggagtggatcttcttctctctcgccctctcctttggcaacccttctacgtggcgatggctcagagcctatggggggatcttttggttggagttggcttaggaaggtcgtttgtgaccccttcgtggggctagcggcatccaatcatgcatagcggaggccggcttgatgctagatcctttccggggagtgtgtgcaggtgcagttggcatgtgttggtattgctttggtgttttttcccttttcctgattattgcctcccaaattggtaatcttgttaatataaaacttgcatcgtccggtgcaattcgttcaaaaaaaatatattaaattgttcttagacagctaaactagttctaatagttttttcttatactacttattcaacatctccggtgcaattaatcaaacaacatcctaaacatatgagtgagtttatagtctatgagaaggtaccgaaaaatatcatattttctactgtaaaatttggacctctcggtattaggaggtactaaatttacactaaatttttttatacctttcacggctataaaatttctttaaacatatacagacttaccatagctaaacaaccaaacaagtcacaattgtattctcacatctggttgatgctagcctgggcatttcttcttttgacccggtcttaccactatcaagcgaccaaacactcccaaaagaagggtaaataatttaggcatgcaagtatggattaaatctgctagaaatgcaggcaatcgatcgctattagatatgacttaatttaaattacctacaggtgaacaatgtcggcttcttcttcctaaaaccagcggtgaacgtgacaccggaggagctctccagtgtgatggcgggcaacctggagtcatgcttccacctaagccagctggtgcaccctctcctcaaggcctccggcaagggcaacatcgtcaatatctctggcatatcgactgttaccggattcccaactctccccatctgtgtcttctcaactgcaaaaggtaattaaagaataaaagatcactgagtatattcactctgcgtaccaacacaaatttagggttgaaacttttatacgtaggtgcttgatagtgtgcaattattattattattattttgttactttttgtaaagttggtggccacggcgattagcatttgaaatttgtctgaataggataggttgccattcataaatgcctttaagtgtaattccaaaataagtaggaaggtagcccgcgcaatgcgcgggcatgtatagcatgttgtgttttggaaacctatataagtggaatataaccagatgatacctgccatgcttcaaaagtacaatttcttcaaaaaatttcttcattagcatcgctcggtaatttttttccaaactatttggtaacttgaaattatttagtatttaattcatgcctataagaaatcatttgtaatctttctttctagctaggaaaaaggttggcatcttattttttattgatgaaaagaataataaaataaatcaacttgccatattcattgtagagtattatatattatcttataataaaaaaacatctataccgtctcaaaaatactagatcataagagtgtctcctaaatttaaaataaaaatcacttttctattgtcacctcttctcatgacaattgtattgttttagtggatacttattatcattatcattgattttgaaagttgagagtatatttaatagatcaaactacatcataccattacaataagattaatacattattagttaactaaaaaatcatctatgttatttagatgagtgtccatgtctcacttctttccaaatctatgtataaatattctaacaatacctcttctatcaattaataggataacaacgttaaattagataagaatattcgtgtagtgggtgaagttgaccgcgggcgccaaggctttcttccctgctgccgtgagatatgggtttctcatagccgtgcctctctagaccagcgtggagcataattttaatgcctaattaattataggtgccctcatagagaattgtctcctgggtaggaagttgagctctattgccaaaggtatcctctcattgagactatctcagcccactatatgtatgtcccagctatacttatgattgcatagcatgctctattatcatgcatgatgcccttcaaaaaaggacaaagagaagatgaaggtgatgaaaataaattgttttttatattctgagttgttttagggtatagtgtagacatagtttgtttatattgttaattaatattactcaaattttaatagtatagatacaatattctttttcgaaaatgagcgaggttaataattggatattgctggaaaatatagctaaagagaaataccgcactaataatctccaagattaacccctggtttgtttttaacacttattgttcaagacaaatttactaatttcaaaaatttgtttattttcccaaacgtatttgctgtaacttattcattggagtgcacttacagccacgttaatggggtgtataacatccatccatcaacaatgccctacatatgggaatttctcaactattagaaaatatattatgagtactttaatgtcaatgttacttgattgttcatttgttgccaacactattttggcaaatgaaacaaatttacatatacgaccataattattgtgatgttctaaggggtagtattatagtagctagaaacatttttgatattatttttcgtatctacaagaatgtatgcttctggattgtgaccatgtatgcttccgacttcatatctacaccagtcaaatagttttgaaaaattaaaaagctttcaaaattaaattagatctacttctaaaaagatgactaaattctattgtttttattttacatatgtagattcatattagtgtgtatacttgttaggtgatattttacaccataaaatatgatgtgaaattatttaaaagttattatgacaataattattatatgtcgacaccatgtgttatgatgtatttagcactacaaataactgttataatccgttaatagttcatttgatgataaaaaacttgacgatatataatttcaagtaacgacattaatttaatggccattaatttgatattttatctttgatgtagtttaactagtataattaatctttgatgtagtttagctgtgtttgattacggactaatgttatcttcaaatcatagaaaatcccagttttaaataccatttacttttccaaataatgctaagtgtgcacgtatcgtttttcgcatcgaatgtatatttgtttagtttatttctgtctaactctccatatatacatggggagttggatatttaatggcctaaaataccgtgtttaccactttaatgtttgtgaagtactcgttctggtttttaatggtttttaatgtatgacgtcattaaattttgatatgacatttcacaatttgcattaaaagaaacatataaatgatatttgttttatcatgacttgttttatcataaaaaaatctataatctcaatttataattttacatatttatatatttttaataagaagaatggtcaaatgttatagaaaaaaaaagaggaagtgatatattttagctttctctgagatgaaaaaaatactgttgaattttattttccaatcatactacgaaaaatatgtagcaacatggacaaatctaatgcgtttatttttggatccaatggtagttttaaggtttccactatgtatgtggtttatgtggtttgtaatatatatttttccatcatactataggtacgtaggtgggtttttttgctttggcctgtatagttttttctcccggtgaactctacctacgtggcgaactttatgtacatatgtattttctcacgtacatttttttctcgtgaactttacgaacgtaagcattttctgtcgtacttagacgaggataattaggatggaaagattacatttttaaaatggtgaactttacgaacttacgcattttctctcgtacgtggacggggattatgatggaaagattacatttttattttttcaaagtaagatctaatataatggtctaaaataatgggcccatcaatttaagtaaaaataaagactacattcattttttctgtgaatatctatgattttctctaattcgttagagtgtcacgtggtgcgtcacgtggtgacatagaagagtttgtagagtagcacgtgttgccttaggagtgttggtaggaagtttaatatagtttagtatgtaatactccctatgagttgataatacttgtcgttttgaacaagggcacggtctttaaaaaacaactttgaccattattttttattataatatgtataaaattgttagcaaatatatgatcttattaaagtactttttaagaataatctatacatgtagtcaccatatttgaaagacaaatattttaaaaatgattcataatcaaagattctaaagtttgacttcacccttatccaaaacgacaagtattatcagctcggagggagtagaaatctatggtttataatgtttgattttattttctatttcattgtctaaaagaaatttaatcttaaattttgagggggtggacggatagacggacgtaagtacgtacatacatacgtatatacgtggtggggagaggaggcccaggaggtggtggggtagggtggggtgggacttatggatgggtttttagattttgtttaaatatagatctgatggtgaaaaataatgggtctaccgtattaaatgagaataagggtgggatgttttgcttttttttcacaatttctttgatttctctaatttattagagcgccaagtgacgatctagtagcgtttgtaggaattttaatggacttttattatataatagatagattattatataatagatagatagattttatctatgtagtttttttgcttagttagaaatgtcttgtctagttagttagaaatattaatcgccagataatgctcttactaatctcaggagcaatgaatcaaattaccaagagcctagctgttgaatgggcaagcgacaagatccgtgtgaactgcatcgcgccgggcatcatcgatacaccccttggtgatgatgtacgtttaattctccacacatatgtacaccaatttattgcgaaggctggtgcttttgttaaattacatatatttgttccccggttttagattttattttcacatcaaagttctgagttattaattgaccctctacttttattatggatatatatttatttgtttcactcaagaacaattgttgatgctctcaaccacaggtcaagagcggcaataatcctcaccttcagggtgttagcgggacggacttcatacaagacgacatcgcacgaacgccgatgcggcgtgtaggcaagccggaggaggtctcatcgctggtggcgttcctctgcatgccagcggcggcatacatcaccggccaaatcatttgcgtcgacggtggccgcaccctatcttagcagagtatgtttaattgccctaaagccctaaaccatataaagaattagttcctacctcacgcgttgctacggaacaatcgtgttaattgaaggatataatttcagagctagcattgtgtatactctggctaaaacaaaattaaagagcatcatatatattgacgtgtcctttacaatttacgttattattatatactaaaagtctattaaattaagcttcctataaacgctcacgtggcactcctagaaacactcctaggccatcacaaggcattatctaatcttaccatcaattttcacttaaattagtggactcgttattttacatcattggattaaatctattattaaaaaataataactttctccttttatacgatacaagcgctattactgttgttatgtacgtacaagtttatacggtacaaactatgtccttctcccgtacgtatttacgtacatgaaaacaaaacaatagctttacataaaacgccggaataaaaagaaaaaaccatacgcatatacataaaaaagagagcaaaaa

SEQ ID NO: 77498 - DNA, 1816 bp, Oryza sativa
gataaacatcaacagcgatcgatgcgtgtgcggtgtgatggtgcgtacggccaacatcagtcgacagctgattggggggaggagaagatctcgggagcgattctgggagcacacatcctctgacgagcctatcgcagcctgtcaggttagtactaccaaaacaaaaaaaaagtctctcgagtttatctgaacccaatccagctctctgcgtgtgtgttaccaggtcaatcaggagatgagatgctacacgaccaagcacaccctagctaggctcatcactgtcacctgacctcactcactggactgagtctgaaactacgtggcctttacgccaggagggattgattgattaatcacccgggacacacacaccatctcccctgatcgattcggctaaactccagagctttggacagtgcaaagagagatcccagaaaaaagcgctcgccgcggccgccgtcaactgctaataataacaagggctctctcgcgctcggtgccgaatggtgtcactcgcatgcatgcccccgtcgccctctcgctttctcgagatcttgttatctagctcgatgagtacgtgcattatctcctcttcctcctccccctctcgccgcaagggacccgcccccggctactaccaccgccctgttgagtttgctaaaagaaaatttttagatatcacatcggatatttgaccggatgtcggaagaggttttcagacacagataaaaaactaatttcataactcgtctgaaaaccgcgagacgaatcttctgagcctaattaaaccatcattagcacatatggattactgtataggctaattatggattaattaggctaataaaattcgtttctcgatttccatgtaaattgtacaattattttttttatctatatttaatgctacatacatgtgtcaaagattcgacgtgatgtttttttaaaaaaaattaggaaccctacaactactactaccagcgaacgtatcgatcgatcgcactgagaaaacgctaggatcacacggcgtcccggccgttttttttttctctcttttctctcgcgcggggcggtgcttttcgagggctaagtcgctgttagtcaaatgctgccatgccatgccaactgccaaagccacttgaggccgaagagagcgaccagtccacccccgggctgtgtgtttgcagggagatatctcttgtagtagtgcagccaatcatgctggctaactttgacggatatgggtgcagcgtgggggcgagaggcagtcttaccggccggcacggtaagtgcgagggagtcgttaatgggacggtcgtcgatcgatcgatcgtcgtcgccgtcagtggcaatgggctttggaccattctagggagaattttagagcgttgttacgagggtagctataggatggtggaactaaacctttcgagcttttggatcataatatagttttagtgctagacgcgacttaagctagcttgagtcactgtagtactgtactgtatatgctaatggctatgtttgggaagcttctatcaacagcaaccttttgtagaatctccgactctcctaaacaaaggcgagtctagcatggaggtaatggagtctcgagtctctactactagcgtgaagaccataaaagctctgtaacaccctgaaaatttgaccaataaaaacaaaactctaaaaatatgggccttcgaaaaattttaaattaattgcatcatgccgatcttaatcgcctattttatttggatttgatttcaaagttcattaatcgtgagtaaagaatagttaattaggaataaaacct

SEQ ID NO: 77499 - DNA, 4608 bp, Oryza sativa
ttaactttttctttctgctttcattgttgcacctctctgattcaagcccatccttgtggtatgtcatgtgtgttgcagtgcctcgtgacatgtagagcctctgtaggcgtggaatgattgggaggtagcgagcaccttctgtggagtgcccttcttattctcagggagttctaacccttcaatataacgaggctcattacatgttatacatttccttttgttagcatgctccttatagtataacatgcaatcattcttacaaacatcaatcttttggacaggcatacctaaagcttcgacgactttcttgcatttgtaaaaactacctggcaaatttgcatctggaggcaacatttctttcataaccttgaccagctcatcaaagcaagctacagacatattatggtctgattttattgtcaacaaccgagagactgcagataattgagagtgttttccacacttctcccacaatggcttgtctgctgcatctaacatatcaaaaaatgaagctgcttcagcatttggaggctcttcaatattttgacaaaaattaggccctgcggcatccaacaccatctcatctatatgatctgactctccataggcattacctcctttattcatctcattgtcaatactgccttctggtgtctcactggtatcagctccactttcaccatgtctactccacacatggtaattttcagtaaatcctttattgcaaaggtgcatttgaactattcttttgtcatgcagctgcccattcttgcacttcgtacaagggcatctaacccttttctctgcctgaccttgtaactttgatacagcgtgtgacataaacctcttaactcctttcaaatactcatctgaaatgtatccattcactacccttttatacatccaactacggtcctcagccattaatctcacactaaacaagctattctgacatgcaaataatggctagccctacacttgaaattatatggtaaggatgcatattttgaaagattatgtaaaggaagtttatcaaaataagaagaggaaagattagatgtagactaatagcaaatcttcttttaaatacaaaaaataattgctcccagataaatcattattagtgataacttgaacatattaagtagtacatatttctctataatttgtttactctgtctacacttcaatacaccaaaagaataaacaacatgtgtcttagcttgtttaatttactgaatttttgcacacatgccaatggtttgctatcagattgcacaattattaacactcaaattccatcgtactttcagaagacctgaattttctaaccacttaaagcaatcctgagattgcacaattattaacattcaaattccaccgtactttcaggagacctgaattttctaaccacttaaaacaatcctgagatcagtaccaatcataaattaaactatgttaataattcctacctgtatattctaatccgaagaactgatgatagaatatatatctactagagatactcgtaatttttgggcaataaaaatatctagtagcgagcaactaaagaattagaaacacaagcatcgtcaggaacttgagtcatacatgtgcaagttagagagcaaattttagtgtgtattacttaaaccataaacaaattaatccaatatccaacatcctggagcaaggagagtagaagaaaccaaaaggatgatgaacattctttcaaaatcattagttgagatgctcatgggatacaatcacaaaagatgaaaatcacaggacatgacaaaattcttacaggggaattccatcgagcagctggtaggcacacattaatcaagatgttacctgaggaggaaggatcggggcacggcagagcggcacactccgacgaggtaggagtgctgggcctgggtgtcaggcaccgggctacaggaggtgccgcacctgatggctcggagtgcgacgggggtgccaacctgcgtcgaggcaagcgcgcggcaggggattgttagcgatcatgcgaggaagaaaacaaatgaagaaaattgggtgctacaaactcacggaggggcaaataaatctctccaatcagatgaggaaatcacaattagaccggcaaacatggggagtgggagagatgggataatgggggtcgatgattttggggggaatgccagaaaatcgcgggaaggaaaaagatggattgggacttgggggtttttttcatgagagctagagagcccttctttttctttttttttttgagttgacggggtttttctagagggctggcaggttttttttttaagtacgggaaaacatcctttttttcagggagtgggatgtggctgggtcaaaacaaactccagatattccctcattaaaaaactaactcaggataaaatattgcatcaaaaatttatacatggtaatattatttataaaatatatgaaatctcgtgttttctattatacaaaaattatgtaattattttcaaagttacatgagcataagagtaaaatataccgtctttaaatatagattttgcatcctttatttctagataatcaatctagaatttttttaattttttcaatttttataacgatcgttgctacgggagtagagccaccagtaataacataagtgtggtaggcgtgtacaataataccttcgattaagtggcggtcatggagcttgacgacgaagatagaacagtggcaacgctactcaacctgtcaaccatggagacagtgtatataagacctcggcaacgacaacagtggttataataatgtattaattagagggttggcgtgatggcgacaacaagtagtagctactagagtgttaggtagtagtgacaagcatgctagcatgggaaaatatccctttagagtagaggtgccaatgtactgataaatttttatacggcagatacaacggtgggcgccttctctcgtttgcatgacacttgttacatatggctaaaaaaatatatcatggcgttacaccattttattaatgtaatatttaaataaaacctatactaaaatataaccttagatgtgactcggtatctctactattaaaatattcgtgttattaaaagatcatgataattaatttatgtttttctattaatggaagacaaacagttatgcatgtcacacgcacatgccctgtttttatcatttgcaggcccttccgaatagttcatttatatttttttttatagtactggtaatgaggtcgcgtggtcgacattttatattaacacgtttcatacaatttttatcggttagctatactttaattagcaaactaaaacttagtaaatgtaaaagaagtttttgacagtacaggcacaatttcatttgcaattctttaattttgttttttatttagctatttatagagtttttttcacagaaatcaattaaatatatttttatttttagataatgtttaatctatttataaataaaaacaagctcacaagatccatgcatggctagcgtaatactagcaattaactaactgtataatttatattatgtaatttatattacaaagagatgctttatttcatacaatcccaaggaccatcgcatatgccttggggatgacgacattctacaagggtacgttcatgacccttgcaaataaacattattagcaaggaactagagtgatggtagcagataaggatcttctgcaaggctatactattgcaaggggaaatagtcttgacaataattacatttcttatagtggtagtggatatttttagtgtatcaatgatgtattaggcttattttattggtacatatgcaattcactcaacttttaaaacgtaataagtaatagtgagaatagtataatttatatgttactcgttcaaagtgttttttttaattttagagatattcttatcatttaatatcatttgaatagaaatggtgagatacgacttttttatcattgtttttataaaacaatcaataagacgcccgtgcatctgcgcaggctttgttcctagttgatatcaataattcaatattttatgacaacaaagaaaaagaagaaaattacacatcaaattattggtcgaataaaaggggatccacttgggtaatctggtccaacacgcaggacactatttacatgattaaaagggctataagatgtgattgttctaaatgtgatatcttttaacaacaaagataaaatgtggatacatagctgctaattgtatatgctgataacaatgaccatagtcttaaaaagtaactgtgaaaacatgaagcaggtaactattattcagaaaacgtgttcacattaatcacattatgtgtgaaatggaagaattatacagacaacattctgtgatctgcagtctaaataccatggagattttggcatgcacctttttgagaagctggtgatggtcaaatccgagagtaactgatccctcaatcctgttgatagtttgatatggtacgcaaacagagcaacagtagaagctgttacatttatatgctttggcatttatatgaaacttggtcataaacaaactcaaatcaaactatgat

SEQ ID NO: 77500 - DNA, 715 bp, Oryza sativa
cgatcgtgttcacatgttgatctagtaccggcgttcatgatctttcagcaaaagcgatcgaatacgatggatgttacagttcacgaccgtggtggtcgcgtcaaatgtgacaacgaactctcctcccgtcttgacatttgaagcttggaccagggcctacctgtcactcgccggcaatgtacattgggggcgagccctgttgctatccgtctctccatatgcttggaacccgtgggtttgcaagcaactagctagagagcaagtttactagtatagccaactattaattttaaataatctatagttaattaaatagacaattcacacaatagttatatataaacatatactacactattaatacatggtcccacctatcatatatacactatgtcttaagtccgtgctgtaactggttataaatctgtatcctactgccctcttctctcttctcttttatctcatcgatatatgtttatagctgatttatagtctgctattgtacccctcctagtactaatataaaacacatatgtagaatacctagtaatattatattccctctatttcatattataataactgctttaacctttttaagccaacgttcttaaaggttgaataattttaatagaaaaatatagtaatacttgtagcaccaaattattacatttaacattgaacatattttgatattttttgggctgcaggaatt

SEQ ID NO: 77501 - DNA, 583 bp, Oryza sativa
catatcattcatgccatggctagctacctcttgataatagtagaattgtcacgccccgaactagtcccgaccggaactagcccgtgacgctccaatttaacctgttaatcgataccagtcccaggaaatagtgctggtatgacagggagacagaatatcacagcaacagaggtctctttatttagagtagaggtacagtcatgttgggctgcggacagatcccgagctcacaactgcattacagaagggaaacggaagccaggacttggaccaaacaacacaggcgcgacttgggaactaggccgaaaccctaaaactcatcatagccggcttgctcctggaagaactcctcatcagcaggatccgcttcatcttcttcagcaactgggggggggggatatttatatagagcaagggtgagtacgggagtactcagcaagccagggaaataagtgtttaatgtaggcttcaaggaaaggctgttgttttcgtaattgattttatttgaactcttttctaaaaacaactaagtgagtgcttctcaaacgacacggatgagacagtgcgtctcgtccggtcggag

SEQ ID NO: 77502 - DNA, 1418 bp, Oryza sativa
cagccagagagatctaagaatcgaagtgcatggagactgcataagtagtcagcatcctcactgactccggggcagtatgataagttgagatattctagtctcttgagatccccaagtgttctgggcaagttccgaagtttctcacatctctgaaggttcaaatatgttagcttctgataagatccaatgaatgatggcagctcctcaaggtgtgattctgagaaatccaaagcctcaaggttttgtaagctactcatctggtttggtaatttacgaattcttaagccaaaaccagcaagatacctgagaagcttcaaatagccaatggatgctggcaattctagatcataacaacaggtaagatccaagatccgcagatgattcaatcttaagaatgcatctgcaagaagacagtttttgaatgatattgccctggccccggtgagaacatctttctgaagggttgagtgtcctgtgtgatttatcagcacagcgtaagtggaagagaccttttcagctgaagggccccttgatagctctctaccatcagaaattacaatgtcactaccagcaacatattttgcaaaagcatgcaccaagctattcacctggagtaatgtacgacgattggtaggactgattccagtggcctaaaaaacaaacatatcaatctcacaatttgctccaaaacaacatggttcaatttggactaaatgttgaaatgcttagcagtaagcactgacagagacaggcttctgcacaggaagctgcgtgtttgaatatcttccgcatttagctagcacatcaaaggtaattagtttaaacacccaaaaaaaatgtttctttctatgaaaaaaattagcaatatttgtttctcagcacattgagacaagtactaccaatttgcaatcacattaaaatatagtaacaaaatcatgatctgctatcatgtttaccatgtgaactgctatagtcatcaatcatcattagcaaactacagaagtatatataaaaacattcacatcattcatagtaaagactattactaaatgagcagagttagatagagtgatttactcgtagctacatgtttcagttacagaaggcccatagatgatgctgtaacgtcttatttttaaaggaaattagcacataatttacatgcagtgccttactttctgaccacacaccatgagcaaacataaaatgggaaaaacataaatgacaggataactaggataccatactgcatcagcaacatcgcaaagtttaactatgttaatgcttactaaatgtcaatttattggaaatataaatctccccttttttgtacagaataggtaatgtatttcacgaggggtctctgcctctgtaaatttactccaatgtaattagtattctgcctgacagaaggggtt

SEQ ID NO: 77503 - DNA, 5691 bp, Oryza sativa
agcccattccactccccttttaggtggagctgaaactgtttcgttgggctccaggtctaggaaaggtggagctggatatatatattagggggttaagagctccagagaaatagtttagagtagagtggatttctttcttcacttgctaaacccttcctcatcttttggtgttcatatatatattgtactgaaaagtgtatatgaaatgtgaagcctactcaaaagcaattctattaacttttgatggtggattccatggacatgtagcttgaggtcatgaatttctttcagagcgtgtgggggttggggtgtgtagagtactatcaccgccatgtccacgctcaccagcgcctgcagtatcgtgtagtcctcccccctcgccggcggccggaacatgcccttcacccacgacgtctccgccggcgccggggatgaaggccgcggcgaccgctccgtctctttcgacatttcgaggacggtgatggtgtgcggcggcggggcggcggcggcgagctcgaggcgctcgcggtggatcttgaactcctgcttgatgacgacgcagagcgggaggaagaggacgatgaggagcgcggcggcggcgcaggagtaggcggtgcgggagaaggcgaactgccgctgcacgacgatcatgacgaggaggtaggcggcgaggccgatggagatgtagaggaagcagaagaaggggtcgacgctggtctcctgcccgccgcggcggcgcgggtacggcatgatccgcaccgtgtggacgaacaccaccgacaccgccgccggcagccacgcgatgagcaggatcagcgacttggcgtcgtcgccgtagaacgccaggtacagctgcgtgtacacggcgccgctgagccccacgaaccccttgagtatcccgagcacgacgccgcggctctccgggaagttcttgacgcaggtgacgagcgcgccggtgttggcgaacgactgcgagttggcgccgacgaacacgtacaggcacaccagccacacgggcggcgccgccgtgcgcccggccacggcgaggtagaccatgaggtagccggagaggttcatggcggcgccgatggcgagcaccacccacggcggcgtgacctcgttgatgaggccggagagcacgccgaggttggcgccgaggtccttgaagaaggagacggtgttgagcgtgtgctggtcgtagccgagcgacgccttgagcgccggcgagtagatgccgaagatgtacgtcgcgcccgacgccgtcaggatcagcaggctcgcgaacaccgtgaaccaccgccccaccgccacctgccgcgcgaacgccgccgtcaggatcacgcggagagggttctgccacggcggcggcggggagggcgccgccggcgagccgccgccactgctgccggtgcccgcgtcgaacaccatggctgcgcttggggggctcgggttgggttggtgtgtgtttggttagcgaggtggtactattatttatttatagagaagtaaggagggtgaaaagagtgtggagagtcagggggctttttgaggctgcatctctatacacattgctttcttggaatggacttaacatgtgtgattttcatactaggctgcgtcgttctatcacctctcttttggatccatttttttagcgcacgtaaaataaaaaattattatcatataattaattaaggattaataattataaacttaaaaatggatttattcaaaatttttaaataacttttatatagaatttattttggcaaaaaaaatcttttctctttttttcttttttagaaaaacaatataaacacaggtgctcacaacatacgcacacacgcacgtcctattcatgtaagcatctccagaaaattgagccggcatcataaaattgacgaaatcaccattggtgccttattgtcgatagatatgtcatctgccataaagaataattagccgtaaatgcgagtattggtgtcaagtctaggacttagagtcaagtgggcttgttttatcacaagaaacctaatcagttaagttacgctcgcgttctaccaaaactctttttaactgaattgtaatgtatctttcgcaaagatattttaaaaaaagaaagtttaccgaggaaataggctacatattaggctcatgtttttccatctttatgtacctctatttctccgggaaagaaataaataacacaatggagatcacacataaaagtgttttcatccctcaaacaggcgtcgctcatctcttatatgtcacctaaatagatatcaatatttttaaagaaattaacaagatagatgaatatgagatatatcactccacaaatatgcatattcaaattcgacttctataggttataatattaattagtttcagtttaatttagtttttataacttgtagaagtcgaatttaataatgtacattgtaaagcgatatatcccatattaatgtgttctataaataaatttaaaaaaatctatttaggtgaatatactcgcgagaaataaaaatccatctccgagatcacacaacatggcaacattgtcgtacgtcaatggaccccccacctcttgttgtttcttgtgtaatggtcatcacacccttgtccccatgattgatcaatgacgcacaagcttgaccatatagtggcgtaacacaagatgatggcgagggagtggtgccggtgccatcacggttctttaatttactcgtcaaattaaacctataggaagttatattattaaatccgtcttcatttaccttatcactactgactcttactgttttcacttggaccattaataacttttaaatggttaaagtgaagtggatgtcaactgagtctagggatgaaaaagaatacggattacctttcggagtggataattatcatataattaggatatggatacgaatacggatattttctcttggatacgaatacggatattttctcttggatacgaatatgaatatggtatcagggtttctaacggatatccgcctaagtcataaaacatacccaatttgtttataactctatgacctttaatggtagtagtctcttaacactagttcacactattaatattattttaatttttaaatatttttataaattatactatattttatataaaacgagctaattatatatggagatatttgtttctattagaggttgaggtggttttcgtgttccaagaaaaaaatatttccgtattcgtgtccgatcatagtcagtccttattcatattcaagataattcgtatttgtttccgtatcagagctattcgtatgtatttgtttttgtatctggcaaaaaaaaatgaaaacgaatatggtatgagcattattcgtccgtatccactctatttcatccctaactgagcctacttgggttcaagttcttatcgggtgcttgtatttatggctaattattatttcagtagcaagacgtatacaataatgtcgtcaatattaagatatgttggactagttttttgaaaagtactcataggaatagcctaataggatgcatgtacgtatgtgcgttcataaatgagtgcgcccgttgtaagcatctgcgtttgtactatgcattcttaggaaaaaatactttttttggaaaggtaggaaatttgtttaaaatggttaaatagctaaatggaagttccgtgcttatgtttaagatacaacacacttcaaaaacacgacgcccttctaagcagttataaatttttaattaaataaaaaaaacatgagtgatactttgaaaatacgacgtccttttaagcggatatttgtaatcgaggtagtaaaacagtacacttttcacatacttagctgtacgttttcaccaatatatgtctcactgacacatggatccaaaacatcacatgccactctcacaagagcgacataaattgtcaacataaattagctagttattctctcctatctctttcagtgttttcattattattattagggaagaaagctacctatgaagcatgatgggccctaatatatggacgtgcaaagatgagcagctgcttgggcgtatggacacagtagggaggcgtcggcaggaggaaagcgcacgcattgtgtgtgaaccgggatacccggtcgtctttggttatatctggagactgaagagtagttttaatcagtgaaaatcttaaaagaaaattgtgtttgtgagtttttactcttccttttattaattagtagatctgttccaaaatgttgttatgtatagaatgagacataacttagtatctagatttgagtattctctgttcagattcgtaattaatactaggtgatgtctcatcaacaatattttaggacaggtagtatatataactatatacttttgttagaatagaaacaccaggttacctgtttatatttggggaacttgtgatcctgataaataggctaaccaatgaaaatctttagaaaattgtgttatgtcagtttttcctccggtttatttttttatttattagacagctacgtagtttctttaaaaatataaactgtttagagagttggagtcttggagattttaaaagaaactatagccgtaagatataagcttctcaaacaggatccggttacttggatgagccgtcgagaaacgttgggtctcgcccggttacttggatgagccaccaagaaatgttaagggatcttccaactagcttcataaggtgatgggctggatgatttgggtttaaagcctcacctcttctaattagttgatattaggtcctatcctgatattcacgtttacttggatgagccgtcggtcacttggctttgatgtgattttgtcatgtggtaattgccaaggttagcgagtgatttgagggcgtatgggtcatagtcaattccagtccaaacgagggcagcatgatagggatgattaggtgtccagtaggaagggttaattaataagctacctaactattccggactagctacagatcaagacggcagtgtctacactctacaggtggttaattggtcctttttattctgtagatagagatttcaggaccattatctaattaatcgactggccatcttgtgatttattacatttctttttcttttagatctttattgatgtgttgcattcaggtgggttcatcctgtttgatttccaatttaattagagaatttgtttccatgtacactgatgtagttgatgtgtgcgtcatacatgcatagaccttatcaggttatgatgtaatgtttacttcatctactaaaagtgagatcatgggtttaaatccccacataattaaccgcagtagatacctagcaaactaacgaattcctaggttttacttttcttcgcagcaagttaaaaacgagtcgtttcttatcatttgcttgttagtttattagccataattaaaatataaattttaaaacttaaattatgagttgattttaagtttttttcattgtagtctattttctaaccttaaatttttaaaccgccaatagtgcatataaacaagtttaagttttacttataaattatctttgttgcttggtttatttttcacggcttatcaaccatagtccaaacagcttatcactcagcatttcaactgtagatttggaggatacattataaccatgtgattaa

SEQ ID NO: 77504 - DNA, 722 bp, Oryza sativa
tcctgcagcccaggaagtctgagaggatggtggttcagatacagagtgaatgagccaaacatgtacaagatgatggctttttgcaggagcaacaaatgttgatctctgaaccattgtatattgctgatgtaaccatttggtctgggagtcctggtgtggcagctcacatttatttttatagctcaagtgaatcatgacatagtttcatctttttctttttttattgtcaaatttcactactatgactgtatttagttgtctctgtattgtcaagtgacctcaagctttgttgggtgatgcctccttgccttaaaccggatacaggccttgatgatactgcaatatttttgttttaatgattaatcaatgtgattttcgcgtaattgatgaggttactgcaatatttttttactgaagtgaatttcatcatgttgcacttttcacttatacaaaaatatcggtttgcaatatttttttgctattctaagctgccaacctgaaaatcaattttgctattctaaactcaatggacagcgtgcaacgttgaagcaggaaagcaccagtactccttctgttgttgctgttgcctattgctgccttgacacgggatttaagcaggcgcacaaagccaaaaccgaacaaacgttttgaagacagggattaggaaaatcaagggaattcatcccacagggattaagtgacatgggagggatccactcaat

SEQ ID NO: 77505 - DNA, 15887 bp, Oryza sativa
cgagatgacactattgctagagtaattggggtggagcacactcatagggttgatttgatgtcagctgatgtaggatgggagctgctttggaggagcatgaacatcaaccaagagaaacaagtgcaaaatctcaaggacataggtattgagattgttcgcaaatgtggtggccttcctcttgcaatcagagttattgctacagttttagcaagccaagaacaaacagagaatgaatggagacggatattggggaaaaatgcctggtccatgagcaaacttcctcgtgaattaagtggtgctttatatctgagttatgaagtgctgccgcaccaactgaagcaatgttttctttattgtgcacttttccctgaagatgaaaccattttgcgcgacattcttactaggatgtgggttgctgaaggctttatagatgaggaaaaaggacaattactagaagatacagcagagagatattattatgagctgatccatcggaacttgctccaaccagatggtttatattttgaccactggagctgtaagatgcatgacctcttaaggcagcttgcttgttatttgtctagagaagaatgttttgttggggacgtagagtcactagggactaatactatgtgcaaagtgcggcgtatttcagttgtcacagagaaggacatgatggtgttacctagcatcaataaggatcaatataaagtgcgaacgtatagaacctcctatcagaaggcactgcaagttgatagttcacttttcgagaaacttacatatcttcgtgttttggatttgactaactcacatgtacaaagaatcccaaattacattgaaaacatgattcatctgcgcttgcttgatcttgatgggacagacatttctcatctaccggagtccattggttccctgcaaaaccttcaaatattgaacttgcagaggtgtaaatctctgcaccgccttcctttggcaaccactcagctgtgcaatttgaggcgacttggtcttgctggtactccaataaaccaggttccaaaagggataggaagactgaaatttctcaatgatttagaaggatttcctatcggtggtggaaatgacaataccaaaatacaagatggatggaatttggaagagttggcttatcttccacagttgaggcagcttggtatgataaaattggagagaggtactccacgcagcagtacagacccatttctactaacagagaaaaagcatctcaaagttctgaatctagactgcactgaacagacagatgaagcatattcagaggaaaatgctagaaacattgaaaagatcttcgagaagctaacacctccacacaacttagaagatctttttggtgggaatttctttggttgtagattccccacctggcttggttgtacccatttgtcttcagtgaaatctgtgatcctcgtagattgcaaatcttgtgtgcatcttcccccaatcggacagctaccaaacttgaaatacctaagaattaatggagcaagtgcaatcaccaagattggacccgaatttgttggctgctgggagggtaatctcagatccacagaggcagttgctttccccaagctcgaaatgttgatcttcaaggagatgcccaactgggaggagtggtcctttgttgaagaagaagaagtgcaggaggaggaagcagctgcagcagccaaggaagggggagaggatggaattgctgcttcgaagcaaaagggggaggaagccccgtctccaactccaaggtcgtcgtggctgctgccttgtttgaagcagttgcaacttgtggagtgccccaagctgagggctctccctccacagcttggacagcaggccaccaacttgaagaaactctttataagagacacaagatacttgaagacggtggaagacctcccgttcctctctggttgccttttagttgaaagatgtgaaggcctggagaggatctccaaccttccccaagtaagagagctgcgtgcaggtggttgccccaatttgaggcatgttgaggagttgggtggttttggagcagctatggctgtcaaagaatatgcagaagatctcttcactgtgggtcccagggcttgaggagcaacatcgccagctccatggagatgagcataagttggaggtcaacgagtagttatggagacacttctagagactcatccagtcttattttcaatgacggaatagtctactgctaccaggtctttgaaagttttcttgaaactgcacctttgtcaggctactgcattttttttgtgatggaataattatgaaaacactttcagaggcacataaactctgtttctctgttggacgaacctgagttggaaaccagtttagtttgagctcatttcaaccccttctttcaccagaagcaattgggttaaacccaagcaccaatcattctcctgtcagtccttaatgacaagcctgcaggacaaggaaatcaatgaagatcactgaggcaaaaatatatttatcctcccatcatgatagaaactgattgtgctttgtgaattgtgatcgagaggagaggaaatggtggataaccttcctagtcattcctttgtactgacaatgtttcagtacttgaggaaatctcagtgatgatacctcgtattgacaatcaatacctgtgttaatagatggatacaacacatctttgactgaaatttgcatcggcaatgattgtgtccaaggctctttctccaccagctgctgcttatgtgggatggaacccatgtataacttgaggaagagaagtaaatccaccttttgtttatttcattgaattcatcctttttccttttgaacactgaaaataacagcttgtatgtctttaggattggttcaggaaaatgttattatgacagtgcactagcttttcaccttgttatcccattacattgttaaattaaccatggttttattgccttcgtattttctggacggggatgcaaaccagtgtcttcttggatacttgcatcttcctaactagcatggtggcccgcgcagattgcgcggctagcatcattatattttctatcatataatagcatatatgttttctcattatattattcaaatatattaaaatgacaacataattttaaattttgcaatatgtgtaatattcatattatattttatatacatgttagttattaattatttttaatatcaatttttagttatttgtaaattatatatattcctatatggactctagactcgtcttttaatatttcctttttttaattccgaattttctgtaaattgtatttctatatagactctatgctcttcttccaatattatttatttttatttctgaattttcatattatattttatatacatgttagttattaatatcaaattttagttatttgtaaattatatatatttctatatggactctagactcgtcttttaatatttcttttttaaattccgaactttttgtaaattgtatttctatatagactatgctttttttttcaatattattttttcaatattatttatttttatttctgaatttttattatttctaattgtatttctatgtggactctaaactcatctttcaatattcttcaatttttaatttcgaatttcagttactaataaattgtattcttatgttgaccttaaactcttcttcccatatttttcttaatttcgaattttagttatttgtaaattgtattttttatacagactctagactctacttttaattttattatgtttattccaaattttagttagttttaaattcctatatggactctatactctacttctagtatttcttttttaaattccgaatttctattttttttcttaattgtatttctatatggactctatcctctacttctaatattccttatttttaatttcaaatttatattatttcctaattgtatttctatatggactctatactctacttctaatatttcttgtttttaattccgaatttcagttatttcctaattgtatttctatatggactctatactctacttctaatattccttatttttaattccgaatttcagttattttctaattgtatttctatatggactctagtctcttcttctaatattccttatttttaaattccgaatttcagttatttcctaattgtatttctataaggactctagtctcctcttctaatattccttattttttaattccgaatttcagctatttctaaattgtatttctatatggactatgctttttctttttctccgattaatgtgagaatttctaagccatgagagcgaacgtggaagctcctttttctattcctttaattatataatagatgttccgtgtaagctgatttccttattttgcatagtgtaatgtgttctactagcaacgatagggtttgagatattcggttttgacatttcatttgatggcatttgatcattatgttcaaagatgctcactactgatgctgtagagctcactcccccaaatctgcaaccttctcatggactctgaaattagaatcgaggtttgtgttcattcatgtacacaattgagctattcagtttgaattttcatctgaatcattctgtgttcatctacaacggacaaattattcttatcgtgactgatcaaacgcagcacaaagcaaagcacagctatagcgcatccaccgatgagaagagaaagggggaggaaaacgaggggtcctctacctcggttgtgctcgaggttctccggcgccggcgacgtgggactcggcggcgatttacctcgtcggagcgctcactcgcttgccgtcgtcgcatcaacggcaatgtaaacatataatgtctccctgactcgtggggcccacttgagggcaagaacgcaagaacgacgcgtgtctctcctgcttgagaactaaccggcagccgctcgccggagctccctccggaaaccccaaatctcggcgcccgtatccagaggcggttcgtgtcccgttggttcttgggctcctatcctcgttcagatcagggaggctgttcagttcttgtttatccagcggggcgcagcgaaatttgcagaggaatctcaatctccaaactggtaggaagagagtttggtcgatagaagttgagttcttgtttgttcgttggtctgcagagttcactagttcagataatcatatcatcaacaccatgaattgaaagagatgctgcactgctgtttattgtgttcactgtttaattcatagcatccatcaaacctgtatctgtttgggagaatgttcgatcaatgctacagttggaatcaaattcaactcaggaccaaattcgtgttaggcaaatattcatgttcaatctgttaatacgtttaactgcagttctcaacatctcttgacgaggaagcagggctgctgctgcaattcggcctgcaattcaagtgcagcaatatgttgtgtgcaatttgtgcattagtgcacaagttgagaatggtaatattatttcactcggaagagatggaacagttgcgaaacgcagaaccactcggttcagaggagaatagtcctggacaaaaggacagaaaatggtccaatggtgagcattgatcatttttacagtgaatggtgagcaactgatcagcatcaaccatggtgaagctgaacctgataagtcgacagcactaggggtgatgatcctagccacccataaatcctttcttgtatgtttcctaacatatataagtcagcaagtcaaatgttcttatcgttttctttagtcgatggttcatcgattctgacatcaagacaagaagccaacatactgctagccatgttactttcctcttggctcacatacggccatttgaatggattagattcagaaataatactatatctcgtctttctttcttacttacatgagttgaaatattcttggcctttttttctctacttactagggcagaattaagattttgaagatgagctgcaccccaatccttaagagatactaggaggtactccctccgtttcatattataaaacgttctaacattgctcacattctagacacacacatatatatatattgattcattaatatatatatatatatgaatatgggcaatactagaaagtcttataatatgaaacggaagaagtaccatattttctaatgtaaaatttggtatttctcgataccttcggtattaggtctttctttctctatttactagggtggagtactctgaatgaatttcagtccaaatatctttcctgacatgggaatctttttagtagcacgatggagaaatttatatatgcagctgaaacatcttgttcatacatcagactgccatttgcacaatttgcaaacttgttcaaacatctttatctaagatggcttgtcttgttccgtgcaatttgcacactggaaaacaaactcctcatgcacagtgggacataaatggtgagacggataaaagagccattgtactatttgaacactgcataagagagccagcccatctagtccacgagacataatctcataatgggaacttgctcgttgtcttccttgtgaccggcgatgcctcggctgcacgcatcaaaggccttgctctcaggctcagctgagttttctctcacaacatagggtttgaacaattttctgcttgtcacgttaggagctagccaatcgaaacgttggctcgctcggtcatcatcttgcattccagaagacacccgcctgctccactgccgttcctgtcgatccgattcacttcagcctcagctcggctttcataccaagcaagttagctttgtcaacttgagcaaaattaacaccgcaatttgagccggttacttctttctcgtttgcctgttgatacaaagaagccaccgaaaggtaaaccccttaatgatttcagttcttcagcttcagtaatcagtatatacttgctcaaaacagattgcaaaataacttgctagctacaaagatactctgaaaccacttcaacttttgtccattttcagacggtattactcttgcatgatttaattggatatattgcttacgccaaaaaaaaaacttggatatattggagcatcaccctcgacgagtttctctatggcaaccatactggattctttgattggatcatgtgctaagaagttgcaagagatcattaccgaggaggcaatactaattttaggtgtaaaagaagatcttagagaactgcaggaaaaaatggaacaaatacgatgctttataagtgatgtggagcgaaggggcatggaagactcatcaatacacaattggatttctcgtctaaaagatgctatgtatgatgctgatgacattatcgatttggttagctttgaaggaagcaagctattaaatggccattcttgttcaccgagaaaaacaattgcatgtaatgggctttcacttctctcttgcttttccaacattcgggttcaccatgagattggtaataaaattagaagcctgaacagaaacctagaagaaatagcaaaggataaaatatttgtaacacttgagaatacacagtcatctcataaagattcaacatcagaattgagaaaaagttctcaaattgctgaatccaaccttgtggggaaagagatattacatgcttctagaaaattggtgagccaggttcttacacacaaggaaaagaagacttacaagcttgctattattggaacagggggaatcggaaagacaacacttgctcagaaagtattcaatgatgagaaattaaaacaaagcttcgacaaacatgcatggatctgtgtttctcaggactactccccagcctctgttttgggacaactacttagaaccatcgacgctcaatgcaaacaagaagaatcagttggcgagctacaaagcaagcttgaatcggctattaaagataagagttattttcttgtgttggatgatgtatggcagtctgatgtgtggaccaatctactacgaactccactgtatgctgcaacctcgggaatagttttgataactactaggcaagatactgtcgctagagaaattggggttgaggaaccacatcatatcgaccaaatgtcaccggctgttggttgggagctactctggaagagcattaacattgaggacgagaaagaagtgcaaaatctgcgagacatagtgattgagattgttcagaaatgtggtgggctacctcttgcaatcaaggttattgctagagttttggcaagcaaagataaaacagagaacgaatggaaaaagattttagctaattacgtttggtccatggataaacttcctaaggaaataagaggtgctctatatctaagctacgatgatttaccacagcatttaaagcaatgttttctttattgtattgtatatcctgaagactggaccattcaccgttattaccttatcaggttgtgggttgccgaaggctttgtagaagtgcacaaagatcaactactagaagatacagcagaagaatactactatgagctaataagtaggaatctcctccaaccggttgacacatcttttgatcagagcaaatgcaaaatgcatgatctcttaaggcaacttgcttgccatctatcaagagaagaatgttatattggagatccaacatcattggtggataataacatgtgtaaattgcgccgcattttagctatcaccgagaaagatatggtagtcatacctagcatgggtaaggaggagattaagttgagaacttttagaacccaaccaaatccactgggaattgagaaaacatttttcatgagattcacgtatcttcgtgttttggacttgactgacttacttgtggaagaaataccagattgtgttggatatttaattcatctacgtttacttgatcttagtggaaccaacatatcctgtcttccaaaatctattggtgctctaaaaaacctccagatgttacacttacagcggtgtgaatctttgtacagtttgcccagcatgatcactcggttatgcaatttaaggcggcttggtcttgatgattcaccaataaatcaggttccaagagggataggaagacttgaattcctcaatgatttagaaggatttcctgttggaggtggaagtgacaatactaaaatgcaagacggatggaacttgcaggagttagctcatctttcacagttacgccggcttgacttgaacaaattggaaagagcaactcctaggagcagtacagatgcattgttgctaacttacaaaaagcatcttaaaagtctacatctatgctgcactgaaccgactgatgaagcatactcagaggaaggcattagcaatgtcgagatgatctttgagcagctaagtcctccacgcaatttagaagatcttatgattgtattattctttgggcgaaggttccccacctggcttagtacatcccttttatcttcactgacatatttgaaactcaaagattgcaaatcttgtgtgcatcttccaccacacaatcggacagctaccaacttgaaataccttagaattgatggagcaagtgcaatcaccaagattggacccgaatttgttggctgctgggagggtaatctcatatccacagagacagttgctttccctaggcttgaattgttggctatcaaggatatgcccaactgggaggagtggtcctttgtcaaagaagaagagttgcaggaggagaaagcagctgcagcagcccatggaagggggaaaggatggaactgctgcttcgaagcaaaagggggaggaagccccgtctccaactccaaggtcgtcgtggctgctgccttgtttgaagcagttgcaacttgtggagtgccccaagctgagggctctcccaccacagcttggacagcaggccaccaacttgaaggagctcgatataagaagagcaagatgcttgaagatggtggaacacctcccattcctctctggtatactttttgttcaaagttgtcaaggcctggagataatctccaaccttccccaagtgagagagctacttgtaaatcattgcccgaatttgaggcatgttgagatgttgggtggtttggagcagctatggctgtcaaagaatatgcagaagatctcttcactgtgggtcccagggcttgaggagcaacatcgccagctccatggagatgagcataagttggaggtcaacgagtggttttaagagccaattaattagatggcacaaggtatgtacactgattggttgggttttttcactggaataaactaatcatagggttgtacattcatgctgctcctcagctcttcagttgtatgcagctattcttagcttttgatagtctccttagatgttcatgttgtgtgcattgactgattgtttgatgatctatatgatttagttctttttttcattagtgttgcatgtaaccatttcaccgtggttaatgttttcataaaatggtgtatacacatcaacaaattaattagatggccaaatcttttatcttctcatgatcttattaacatgcatcctgcacgtacggtgtattccagatgaatgtattgtcctatatgtactacaacatgatcgtatgcagtagtgttcctagctctgcacacagagatagagattactgctactccaaaagaaaattgtatgggttatattgtcaccaaacaatgctatgatggcattgatatattcactatatatatgccagtagttatatcacatatgcatatatccatccaaggacttggggacaacataaatggtttagcatttggtacacaggctgcataagttcacgactaaacataatggacttcgaagtaatccttaattcagctcttgaatgtgctagctatgattgactgtgtacatccttcaggatgtagaggtcggtttttatttaatccattatctaaaaatgtgctatatatgatgaagaccagctcacatgcatttagccttcaattctacaagtgtgttctatgtcatatcaatgtgcgcatttagcattcactatcttataaaaaaacacaaatacacatgaattttcgcaagacattaggcctatagagtagttttttagatttgacaaaaaaatatgtcaggcccaatgtttcagattccttgtagcctatgagcaggatattgaatatggaagtgttgtgcccaacatctgttcctagcgtagggctcctaattaaggtttgtttggtgaaaaacaaaagccacctaatgtctttgtattggttcaaattgattgatatttttgttcgtattacatctgttaaaataagcagtggatattgccaagcgacatgcctatgtatagtccatatgtgtattttccttatactttttgtaatgcacgtctgatgtttggtaagttcaattgcagaaaatatgattgttgtaaaacggatgtcacttgtattttcttttccttaattaagttatttaattaccaaattgcttatgtatatacatccatgattaattgtgtgcgcttatttgtattgtaggttaatcttgaaggatttgggctgcagtcacctgtaatctatatttttgtctttacctagttactggtctttaaaatattaaaaaaattaaaaaaatgaaaaatttaaaaaaacaaaaatatcaaaaaatgggaaaatgccaaaaaaatggttatattttctttagctcttgtaaaatacattgccgtgttttattaggtgtgtgtttcttttttaaatttttttttattgtaggtgtgtaggtaactccgcctatgtcatcctaggtttagtaaatgacatagccggtcccaagcccggaaaaaggaggggaacatcttgtatagatgttggttgaaatgatgctctccatccacatagtagatcgttgggatatttccacacttttatcagattaatttcattttcaatgatggaatagttatggaaacacttctggagactcatccagtcttattgctctgttggaaacatctgattcagaactatttaagcttgaccagaccaccagagttgagagttatgttgcgaattgagatagacaagtaggtaaaggaaattcagtgccagacatgacaagagacagggcaccccagacaagatgtgcaacgagacattcgagtctcagagcccagatatgcccgaagtcctaaacaacttgatacaattttgctacaagatcaaaccgtaacggctagatcaaggtacagttctatttttatgtcggtttggccgatctagctaatgaattgacaaaatataagtacagttacagacccactaatcaataaagacatcccatgctaaaacaagtatgaaagatgcgcatatccctccgtatctaaaagactatagttttaagttttaacctataaatgtatcccacaaagactatttttacagtgaggttcactagatctctttaatactactttatatttttattcttattttaaccagcaaattaaccagtaatactccctcttcctcgttttttctcctcattaataggatacagtagtcttttaatctatctttgatagctttaactaccttcttttagaaatggagggagtatgtgagtgacaggttacaacaatcactgtctgatgtgtgcttaggctgtgaactttatgtgttgcttcagtttgttgttccctattgttgtgttgctggctgctattcttgtcatcagttcctgtgatgttagaacccttatcaacagaacagcctctcgcaacaagaacacagaaatgtggaactcgaactagattgatagattatctcacgctcaaccgagcggagccgccgccgccatcgccaccttgccgagttccaagccaaccttccttctagctgttgccagcttacatatagttcttagttacttctctctctctctctctctctctctctctctctctctctctctcgttacatgaatttgggccgataacccacaaagcttagacggcccactcggaccccttatacttcatgttcactcgacgattacgcttttccttgacgaagacgccatcttgacgaccgcctccgtcctgttccccatccaccgtgttgccgtcatctcccgcgtactgtacctcttcagggttgctcctgctggtcctaacatcctcccttccttgagagccggcttgcccccaagccggtgcgaatggaaaatgagctagcgagccttcagatcttcttggtcctcccaagtcgcatcagcagctgcagtacctgaccagtgtgtgagcaattgagttacaacagcgttaccttttttagccactcgctgatccaagaactgcacaggaatttccaaggaccccaaagaagatggcaagctatgctgtagagcaggttggaaacccttggcagccttaagttgagatacatggaccacaggatggattaaacaggtattgggaagaaccagcttgtatgccacttgacccactttatgctgaatctcaaaaggaccaaaatacttgaaagatagcttatggttggctcttctagccactgatgtttgaacataaggctgaatcttcaagtaaacccagtcacccggctgaaactcccggaagcttctatttttatcagcataagccttcatctgttgctgagcacgatgcagatgctgctgtataagctgatgcataaattttctgtccctcagccattcctgtaaatcaggtactgcacaatcttccatggtaataccaaaatgagctggttgatggccataaatgacttcaaagggggtttgtttcacagctgagtgataagcattgttgtaccaaaattctgccaaatgcaaccatgctgcccacttagtaggagtggcatgaacaaaacatctcaagaacagctccacacactgattaactcgttcagtctgcccatcagattgggggtggtaggctgaactcatgtgtaactcagtaccagacttagtgagcaaatactcccagaattggctagtaaaaattttgtccctatcagatacaatcactctaggcataccatgcaacttatagatatttttcatgaaagcagtggctactgtctcagcagtgaatgggtgtgtcaggggaacaaaatgtgcatattttgaaaatttatccaccactaccaaaatgcaattgtacctttcagactttggaagaccctcaaggaaatccatggtaatcgtctgccatgctccttctggtaccggcaagggttgaagtaaccctggatatttgactctttctggtttggcttgaatgcaaacctggcaatgttgaagctgacatttaacttgctttttcattccaggccaagcaaacaatcttttaattcttctatatgtgacaggaaaacccgagtgccccccaatgggattgtgatgaagttcagcaattaacttgttctgtaggtctgtattgttgcctatccaaatccttcctttgtaacgaatgagcccatgcgccaatgtatagtgttccttggcaataaaattgatggctaattcagctagcaactggcttgtgtgagggtcctgctcatatccttttgttacttcctgtaaccaagtaggggtacttactgagatggctgataactgtcccccttccccaacttccctacgagatagagcatcagccacagcattgctgctacccttcctgtaaccgattttatactgtaagcccagtagcttagtaaaagccctctgctgccagggagtgtgcaatctttgatcatctaaatggaccaggctatgatagtcagttagaatcagaaactcttggtgctgcaagtaagacctccaatggtcgactgctaacaaaatagccatgcactccttctcatatgtcgacagtcccttggaccttggccccagggccttgctgagatatgctattgggtgtccttcctgtgacaacactgctccaataccagcatcactggcgtttgtctccacagtgaactgtttggaaaaatctggtaacccaagtacaggagcagaggttaaagcttgcttaagttgttggaaggcagcttcagcttcagatccccacctaaaagacactcccttccttaacaactgtgttaaaggtttgctgatgataccaaagttttttacaaactttctatagtagccagccaatcccaaaaatcccctcaatttcttaactgatataggagtcggccatgtaagtacatcctgaattttctttggttcagtggagaccccctgtgctccaatgatatggcccaagtaagacacttgaggttgggcaaaagaacacttgctcattttgacctgccaatgatcttgtctgagaagttgcaagacctgtttcaagtgggtcaaatgtgactgtagatctgggctatacaccaatatatcatcaaaaaacaccaaagcacatttccttaaaactgaagccagagttttgttcattactccctgaaatgtagctggagccccagttagtccaaaggacataactctgtactcatagtgactagaatgtgtctgaaaggcagttttgtgctcctcccctggtaccattctgatttggtggtaacctgccctgaggtctaattttgaaaaccacttgggtccagacaattcatccaacagttcctttattattggaactgggtacttgctcttgatagttaaagcattcaagtgtctgtaatcaacacagagtctccaagtcccatatttcttccttaccaacaaggcaggtgaagaccaagtactctggctaggttgaatga

SEQ ID NO: 77506 - DNA, 8106 bp, Oryza sativa
ctgggtacttgctcttgatagttaaagcattcaagtgtctgtaatcaacacagagtctccaagtcccatatttcttccttaccaacaaggcaggtgaagaccaagtactctggctaggttgaatgacccctgatgacaacatttcagcaacttgtctttcaatctcatccttgagctccggattgtatctataaggcctcaggttaactggttgggctccctctattaaaggaattctatgatcacaatatctggtagggggcaggcccctaggttcagcaaaaacacctgcaaattcttgtaaaatcttttgcactggagcaggtacattctgatgttcctctggtctgccttcagtcaattgaatcatatacatgatggaacccaacttgccatacccattaattgctccccagttatctcaaaacattgcttaggttgagaagatatacccagcaatctaatgagttgactattgtactgaaactctagccacttctaactccaatctatttgcattgggctgtgctgcacaagacaatccatacccaatattatatcataattgcccaaggttataagtgtgaaatcatttctgaaactatgcccctgcatccaccatgtgcaaccaggaattactggattgcacactatctgtcctccatcagctatttgtaccttcaaaggttgtttcagtatctccactctagatagttttctgccaatttgctcatctatgaaggaatgagtacttccggaatccaccagcattagcaattatgtaccctgaatccatccccttagtcgtatggacttgcttgattcagtaccattcagggcttgttgagaaatagcaagcagactcacttcttcctcaacaggtgtttccacttcaggacttgcttcattatcaatgttcatagcttccataagctcttgtactacatgtagttgtactgcattagcacacttatgatctctcccccaccggtccccacatataaaacaaagacccttagactttctatatgccttaagtgatgcaaccttgtcttccttagctctagtggcctctagggccgctgatgagttgaccttctgtggagaaggagagaacaaagttgtctgtgatgcagacctcggtactgacttgatataatttcccatctgttctgacttcttgtaacttccagccttcagtccttccagagcctcttcttgcagcatagctaaggaacaagcagtatcaaggtcttggggcctctgaaccaagataactgatcgaacctcttcctttaagccatcaatgaattttgtaacaaaatattcaatgggagcagaattttcataagcattcagttgatgcatgatgctatcaaacttctcaacatactctgcaacagaagtagtctgctgaaccctcaaccattgcctaatcaatgcttggtgtcgatctcgagtaaatctggcacacaccctttcacataagtcataccacgtcacccctatcagctgattcctcactgattgtaaccagaaggcagcgtttcccacaaaattcagagttgcaatcttaacccaattgttaggcggaattccataaacatcaaaataaacttcacaattagctctccacatctgggggttatctccattgaactgcgggcacgtcatcggtgacaagctgcttcccaaatttgtccttgcactacccgaccccggtgaagcaattggctcaaaattgaaattattcgcagaattcaaagtgggatctcgcataccttgaatctggaacgacgattggggcgtgaattgctcttccttcacatcagctggtttcttctccattcttccctgtttcagcagagtaccctccatgttttcgaccttcgtactcaaggatccgaccaccgaagcgacttcctccacacgcttctccactagcggcaacctcgcctcaaccaccttcttgagctccgctagatctgcacgagtccgctcctctgcttccgctctcttccgctcgttctcctccatcttcttcaacaagagatccaactttgtttcgtgcaccatggttgaccttccccaaatttctcagcgtggttttctggcgtccagatcccgcgaccgctccaaactcgaccaacccaatcgaggcaagttgccttttcgcgagacaccaccccaggaggtgagtctcaatccccgatcggtgattctacggtcgaatcaagagattaaggtcgcaaagctctaataccagattttgttagaacccttatcaacagaacagcctctcgcaacaagaacacagaaatgtggaactcgaactagattgatagattatctcacgctcaaccgagcggagccgccgccgccatcgccaccttgccgagttccaagccaaccttccttctagctgttgccagcttacatatagttcttagttacttctctctctctctctctctctctctctctctctctctcgttacatgaatttgggccgataacccacaaagcttagacggcccactcggaccccttatacttcatgttcactcgacgattacgcttttccttgacgaagacgccatcttgacgaccgcctccgtcctgttccccatccaccgtgttgccgtcatctcccgcatactgtacctcttcagggttgctcctgctggtcctaacatgtgatgaacgtggcggtctgaaactctgtaagcctgcaggtctcactctctgtctctcctcattcctgagtcctgacagcctatggcccatttccgcatttagtcctaattaatgaatttaccaagccagttgacaccatcaggaggggaaaatactgatgactctgtcaaccctgcaatctagtagtatacatgtttattcaaatgagcaaatctgcaactccctcatggactctgaaataagaatcgagttttgcattcatttcttgtgctcttcagttattcagttcagttctatatagtgtcaggactatcatctgaactgttttgggttcatgaacaataactcttaagtccatctaatatgttcagttattcttcttcccctgaatgactaatgcagcaaagcaaagcaatgctgaaaactatacaggtaccatgaaacgctacatcagtaacaaattcatgttaatcatgtaggcaacaggtgcaacaaattcacccttaacaaacagataaaagaaccgctaataattaattctttggtgatacaaatacaagtacagagttaaatacacactgatcaatgaatacatcatccatgtcatttttactcacagaagtacgtaggtgaaaattgttcatttttgacgggaaacaacagcggcgccggcgacgagggtggcggcgccggcgacgacaatggcggcggcgagcagggcatggcgatcaccgactgtcatggttcgggttcgggatgacggtgtccattgcgggacaatcggcaagtccctctcgctgtcccattcaatggtgcaagatgtccagtcctgaccaggcaacatggaattatcattaatgtctcagaaatatttatttatttggaaatgatcatgttgtaaataaacccttagatagttttccatggatatattgttacacagagcattttatagataaaagtcattactaagaattatttgtttgtactatgctactaagacaataattgttttaaaaatgattaccaaaggacatgtcaaaccaatgtattgtatgagggagatttgcaataatgacgctgcaaacattaatctttgctataataacattggacccacatttcatagacacattcaaaacagtgaaaccccaatatttgcaatcccaatattgcaattttcttattgttatgaggaccatcctaatgcagcgcaaccggcactagggccagtcctaaactattgggggactagggtgagacaaaaattagcggccaaaatgcaggcactaaaatatttccttgatctttgttttcatctcgtccaagaggcccaattgttcataactagcatacagtgtactatactgaaataatagtaatatatacttagtatgtctctacatacctggccttctttttcaagacgacaaactaactcgacgattgctcgcattctcttcacatattcatcacaaccagtatcactgcatacaattcataacattagctaaaaatccaagattttgtaaacattctgagccccaactattcattgtaattacatacctgtcatagagcccaggatgattgaaacaaaaagcttggtacatctgcttcagttcagagtaacccttattggtctcggagaacgccacgcccgccgccgtcgtcgccggcaagacctgcacgccgcagccaccgggggagaaggccgagcttacacaagccatggatgctggagctcgccggccgatgttcttcagcagccgcatcgccatggggtgggtgggtcgagccattttggaacgaaattcaggtatatgtgtacgacgagcttgttgattgttgatcagttgattaatcgtggttttgatcagctggtgtccatatcgagcttatataagttgtgaggaagaagaagacgacgacgacgatgacgcggaggaagaaccgaagaaggagatacaacgcgcatggataccgagtggagatctatggaaggaagacgagagggaaggtcttggtagcagcaacctaattagagcaagtttaatagtatagcccactactagctccaaatcatctatagtcaatgtaatagccaattcatacaatagttgcttactatactattaatatctggtcccacatgttatacacacattacgtcttaaagtctgtgttgcagctgtctacagatctgtaacccgttgctcttttctctcttcctttacctctttaaaatatgtttatagctggcttaattatagtctgctattgtacgtgttcttagaattacttagttaatgcaaaggttaatggtggtggtaggttttgatgaccgatcagtcgtagggtcaatctatgcaaggtcttaaattaactaaagatggatgggttagctagtgccaagcacgtatgcacggaaaagagagcactttttcttcttttgaagactgaaaagatttttaaagagagcaagttatgagcacacgattacacatgacacgacaacaaattggaatgcagaggcatgactaatttccgtcataaaaattaccaacaaaaatggtagcataccgtacatcgaccgagatgaacattgaacaatatgcaacaaaaacctgcaactatgcaacagaaacctagcttagtatatatatatgtatatttgttcaggattaggatagatgttatatagtttataaaaaaaaaaagatatatagatgctatgtatgtttataagaaaaaaaatcgagagtgcacgttttgtgatatttccactcattgcctctcatattagtataactaaaatggaaatttagatagttatcaacttactatatcataatgagtacatatgttcatgtatcatggtgcattaacttttgatgaggcaggtaaaactacttgtttgttagatagtatacattctcaagtgcaccttcttttcttttcagcaatcgcttgtacactttgttttttatattacccatatggtagccatatgtagcgggagtatgttgaatatgagacaacgcgtttatttccgcgtgcaaccataaccatgtttaccgagtcatgcgagctattgagttacgagtaggctacaatggcataaaacaaaagtttctaccgcgtaaaccaggaaccatgcgaagaaagagatcatggatcgtaaccactcgacgtgacgactagtggaagaagagtcggaacagattggttcaatgtagaacatgtcggtgtagcggaagtagttgactgcagcaacctgattgtctcctcctcgcacgagcatctcctcctcatgttcccaagccgatccgtgccgcaacgcagcaacgcctccaccggtatccaggaaaggaacggcgtgcgtggtcgtgctagcacctgtgcgtggctagggttagggtttggcttgtgatcaggaatggtggctagggtttcccacgtgtgatgtcgcttgcttcgtgtgctcctagaagtccaacttggatcctctttcgaattgaaccattattggatctccatttaattatcttgttccaaccaattaaatgtgcaaccccgtaggttcatacaaactcgttgcaacctgaaaatgcattttcggtccacgtgtcaacaacggctcttagcagaacgtattgaaccactgagtataccaaagatcatatcgactgaaccacttttagtttatttgtgtatgtctttctttttcatctttttttttaaaaaaatatcaaagtgatagtcgatcaggtttcacatcgtggaatgttgaagtaatttgatcacattgtcatgccctagctaatcgtggcaataggtgagtatgatatactatgaaaagccaagacaaagattcgtactaaatctgttaggtccattggcattagagtttctactttcatttaaaataggactacgtgagctgtaaataaataaatgcatttgggatttgtgtactctcttataggagcactacgggtgttccaacaatatataatttctgaaagataaaagcatacagtgattaacaaatgacagaacggatttcagtccaaatatttttgtaattcagacaacagagcgcacatcttttcccacatgcacaatgggacacaagtcaaacaagctagtgacatgccaacaaacaacatcactagtgtagtatcagtattctactctttgccactgcataagagctagccagcccatctatagtcgtcgcgattcatgaaatcaccagggaattgaacttgctcatcttcttcctcatggctaccgagatgtcgtggctgcacgcaccaagagcctcgctctggggtgtctggtgagtcttccctcgcaaactctgagccaagctcaaagatgaagggacgacactggaataggagcaagatggtcgctcggaatctcgccgtcaagtcggctttggacaccatcaagttcagtaagacgatgcagcgctgccgcctgcgcatcggcggtagtagcatcgcttgattgcttatggtcacaattctcgcaccaaattcagaatttgaacgaaatgttcagtaccaggttcgtgttagcagtgagatgaggtcatgttgtcagtaacttgggttagttgagtactcttccatgattgatggcattagcatttagccacttaattacctctttgattgtctgagatgctgcagcttatttgaaaatccagattgggggatttagaacaagaacacactctcctcttctgattatgaaatgaagaatcaattacaagcagaaacaggagactatctccaaatgctgattacaccaaaatatattggacacatttgaattggtataatttatttaataattcatcatcaagggcatttggtctagtggtatgattctcgcttagggtgcgagaggtcccgagttcaattctcggaatgcccctatttttttttcttttttttccactctcattgctactaatcaaataaaagctttgccagcaaaattctgaatcttctttttttgcgaaatttcctgtgctgataaagcttccccactcttacttatcaaacgacttttttattatgtgaaatttaatatgctgataaaaagcttctccattcttattattaatcaaacgaaagtttccctgcaaattctgggtttttttcccctgttgaaagaaacaaattctgaacaaaatttgtgtgtgtgtgtgaaactttgtttgctgattaatgttggcgcctataggaaattcctccccattgacaagttaactaatctgattaaccaagaatcccaagattaaaaaaggggatggatgtcataatcacaattcacaatttcgcaagtcataataatcaatcataatggaacagatacataatgcagtttcag

SEQ ID NO: 77507 - DNA, 22219 bp, Oryza sativa
ttgttccccagacgttttcccggcaaaatagggagcaaaggtgaccaacacccttctgtaaaaatcatgcgtttgccgtgaagaaaggatacaacagaacagacagacagacagacagatacaccctctttgtatatctttgcttttgccatttgattgtgctattgacatgtgggcccagactgcatgtggcaactgatttatgaaaggggaaaaagattcacattttactgggaagttggaattttaccactcgagcaaatgcatatttgttgctcgtcactcctcaaaaatgaatcagatagttataaaggattctgaaaaaggattcaacattgataactaagcaacttaaggtttacagactagagaaacttaaggtcatcctcttgctgctccaggacaattgttgccagtgctcgtcggtatgccgctgatcttgcattcctaacaaggacacagatgtctttgcgcttcagattttcatgtgtccattgctgccgcctcaacaccgcgagaagctttgcttcgcagaaggcaattgcaacagcatctcgcccactactgtaatatgtaaaacagattgcagttaaggtttattactcagaattgcgctggcatgtagcgagggggactggggataggcaagattaccttccatggacaaaacccgtcgtgacgaagcctatcggtgtcgaaactagatttcggcaataataaaagggggtggctatcaagctaggaaagtgtatgggtttggagacaaaggatttatacaggttcaggccttcttataaaagaagtaataccctactcctgtccggggatgaatccgccgagtgtattattgattgtgtgattcgggaaaaaccaacatatgcccctataggcgcccagaccccccttatatatgggaaggagtccgagttacaaaagataacctatatcccttacggaatatgaaaatataggtaagatacagtcgtaaccgactaagtttcagggtgtttccatgatacacaagttaagaaacaaacccaagatacaaataagatattctatctacgttaggtatcctgtacccagttcgaataccatcgccgtgtagatatgggatacccataatctccacagtagcccccgagtcctttgcagtcgaccatcgtagccttctcaaagatgataatccgagtacttcaaactcttcaagccaaaacctgccgagtggactgtaaagggcgaaaagaagaagaatatggtgcatcgaatagatgcacctaattaggtgtagcccccaactatgtgattagttaacaaactaaacatatagttgaaagacaaaataacaacacaattgtgcattatatgacaaaagcatatgcggcgccaaaataggcatgctaaccgactgctttttagccacaataaaagaaatccgagtggtttacactctaaaaggttcacgaatgaacacacttgacaggcatccgaataaaaattctaaagattacccatcaagtattataaagattatggtaataaataagtcgaatagcctaggccatgactatttaccatgaaaacaggcatataacacgccaaggaaatgattataataaaaacaagtcattcctagttaacccaaacagcttttgtagcctaaaaaagcttgcaaaaacagcataacgcctttctgtcgggcacctttttaatttgcattgcaataattccaaagaattatatgaccgcataaaaagggtttgatcagcattgggcaacactgttgtgcgcataatattgccaaagcaaaatatgcctaagtccctaaggaacacaatgggccacgctgttaaaagtattgggctgaagtactgttcaggcctaagcccattagcacctccgatacccttaactgaaaaatcctatatccaagcgacgcttcgtcttccccgccggaactctcgccattttccccactccctgctacagtgcgaagctgcgccggcgaactagggttcacaactccggccaaatccacctccgaaaagtgcatcaaaatccttcccgtgatccaccgcctcaattcctcacctctcccaagccatccctcgaatcaaatcagcacatttgagaaaaatcgatggcggaagagagagaaagcttcgaaagccaatgggtgccgtccgacgtgacggaggagaacctgaaggagatggtggcgcacggcgttctcccagccaaggagatcatcgggtggcggccagcgtgcggtgaggttttcccgacccctgatacacatgagatcgtagtcttctcgcatttcttctacggtggctttgctcttccgacctcaaaatttttccgcgggatcttgaatttctatggaatcagcttgcatcacctaaacccgaattccatagtgcatatcgccaacttcgtccatgtttgtgaagcctttttggggatcaaacctcacttcgccctattccgccggatcttcttcctcaaaccccaaccaaacaagaacaaaccgtgtgtagtcgggggggcaggattccaactaaggggaactctgagccaaaaatatttctcgatgcccttcaagacttcgaacaaaggatggcatgcaaactggttctatgttcagaatcccgagcctgctcttcccgggtactcttgtcttcctccagtgtgccaagatacttggaactctcttccaatcggagatgaagcagtacaagccttggagttgttggatcgtatgttaaatcttaaagaacaaggcttacagggagagcaaatcactcggcacttcatcaaatgccgactggcgccaatcaaggaaagatcccgcacagcattcgagttcgacggcaaacatgatcccaaccgtgaagaaccagactccctggatttcaaaatcatgaaggagaggatgtataaaatcttctcaaatgcaattgtagtcagctactctcaccaactgccagttgtgccatataatgcattcaatccgcctccacaggtatgcatcggaaaccctcaaaccgtgatcagaacataattttatcttcatgctgagttgactaactatggaagcatcttgtgcaggaatatgcattgatgaagtcagatccaccagtctctcagcgccggtctcctcgccaacacaccgctcagggaggtggagggccaacgatcagaccagatccgcaacctcagacctccaaattagctggtcaaacaggtcctcgcaagagaaagctggtacttgatgatgatgaaggcgacgatgataattctggggataagggctcgcctaataaacccccaaagcgtaccatgcccaggaaaaaactggctggccgtgcaatgccaaagatcagaacatcttccaggtattagatctctcgatatgattccgcttcggcatgttttgcccatgaaaatgatgctgaatactgaaagaacactttgcaggaaaccatctgatatagatccatctggaaaagaccccgatcctgccatgacagagcagaatatatccaaggaccccgagccgactgctgaaaaccagccgaccgctgaaagtcagccgactggcgcccatgcttcgggcgatagagccaatccgagtgacctgccgccgactggaaaccagtcggcaacaactgaaacggcaacaactcaagagcccccgactggaaaccagtcggacgcaggccctgatcaagagatccccgaagtagaagcgcagacgacgacttcgcaaggaccagaagctggtaacgactcgatagctgggtcgtcaggtaaagaacaaagatcacctcacgctcagctaggtacatcttcaggttagttgtcttctcaaacaatggcgatttaaataacctcagtgtatccgtctaatgtcttggaaacacatcaggaccatcaggtgatgacggagaagaaatccctcgcataaaggcgaccgacgactctcgtcctcctatcttgatcaaatggtgggatgagaactcacaagccgccggcatagtcataaaccgtcaaaaagaagatgaagaagtgtgccagctgaagaaagcgctcggagaagccactcgtattgtaaatgtaagtcttccgagtgacggccttcggtaactttgttttctttttagcagaactgaaccatgatccatcatgcagagaatccatcttcgcaatgaggccaagactacaactttggaaaagctggttcctcatttgggaactctagaagcagttagggaccagctgcatgaggccaaggagtgcgccaaaaagacggagaaggagttaagggaccgaatcgctcagctccaggattcaaactatgagctgagtggttcatcaaaaggtaatccctagatccgtttcattggtttaaactggcataactgtatcctcaaccatctgaatttcaaacagcgcaagccgccaggatggaacagatggcgaagcaaattgaagccctggagagagacaagacagaactggttgcgcaaagggactcagccttgaaggaagtcgaaggtaacgccagctgacaatctgagcttctctctttataatgcaataaatcctcatcataaatgtgttttgtagatcgcaaaataaaatcgcaagcccaattcgacgtcttggttggtaagatcaagaggcttgaaggagcaagggataacgtcgccaatgccgctgcaccaattatccaagccatgttcctcaataatggtggtccgagtgcactcgacgcaaccgaaatatttgacaagctgagtgttgctccggaagtatatttcaagaatatcaagaaagctggaagtatgggagctggcatggccttggcgatgacaaaatccttgtacccgagaattgaagtcgacaccattgatgggtttgcagacgggacaagtgaagaagctgcccttgatcttatcagcagtgcgcaaaatgcggctgacaaaattgcgagtgatgttgtagaacaatttcgcaacaacgacctccaaccgagtaatgaagactctgatgatgaaaggactgattctgactgagtttgaatgtaatacatggaggctcaatttgtacaatactggtgtatttatgctgtgcttgatgattcttgcgaagtttttgatttcttaaaagtttttgctaagctttgttgagcctaaaacccaaagaagctattaaaaactttcagtcctcgcaaactaagtagaaaaaccaaacaaggcaatgataaaccaagcaaactgaattgataaaaaatcacactccattattatgatgatagcccccgactgacaacttcaaggagaaaacttgatgtttgacagtcaaaatagggaaatacaatggtaaagttaagcgtagaaacgacgaagatgttcaatgttccaagagttgtcgacgagagtgccgtcttcgcgcttgagtcgatatgaacctggccgggtgacttcagagataataaatggcccttcccatagaggagataacttgtgccgatctcgtgtggtttgaattttccgtaaaaccaggtcgccgactagaaaggcacgagatcgaacattgcgattatgataacgtcgcaacccttgtaagtaccgagcggactgaatcaaagctgcttcgcggacctcttccagtcggtgcaagtcgtccactcggtcttcttcgtagcgttcttctcggaagttacggaagcgcaaagactcaaattcgacttcactcggcaacattgcttctgccccatagacaaggaaaaaaggtgactggcctgtggcccgactggatgtagttcgcaaagaccaaagtactgacggcagctgttgcacccatttaccggcatagggttttagccggtcaaaaacgcgcgctttaatcccttgaagtatcatgccattggctcgctccacctgtccattgctcatggggtgtgccactgaagcgtagcaaatcttaattccaaaatcctcacaaaagtctttgaaaactccgccggtgaattgtgtgccattatcggtgatgatccgattgggcactccgaatctgtgcacaatgttgatgaagaaatcgcgagcattatctgctgtaatcgtgacaacaggcttagcttcgatccacttggaaaatttgtcaatggccacgaagaggtgcgtgtaaccgccgactgcctttttaaacgggccaaccatgtcgagcccccaaaccgcaaacggccaagacagcgggatagtctgcaactcttgagctggtaagtgaatttgtctggcgaaaaattggcaaccttcacatgtgcgcacaattttgtcggcgtcggacactgcagtaggccagaaaaaaccctgccggtaagctttgccgacaatggtgcgcgcagcagcatggtttccgcatatcccagaatgtatatctttcagcaattgtctcccttcctctaaagatacgcagcgttgcagaattcctgaagggcttttcttgtataactcagattcgtgcataacataaagtttgctccgccttgaaatccgctcggcttcatctttatcttgagggagctcttgagaagttaaaaaccgtatgaggggctctcgccagtcggcttcaaccatagctacgtcatgagtgtccgcatcttgagtagtatctttatgaggcacggtcggtgtataaaggtgttcgacgaaaacatctgagggcgccggctcacgcttggatccaaaattggcaagtctgtcggcggcttcattgttgtgtcgaagaacgtgactgagctcgagtccatcaaatttgtcttccaatttgcgtacttcttgtcgatatgccatcatgttgtcgtcaaggcaggaccactctttcataacttggttaacaaccagctgtgaatcgcctcgaactattaaacgctttatccctagggaaattgcaatccgtagtccatgaaggagcgcctcatactcggcgacgttgtgagacgccgaaaaatgtatccaaagcacataacttagtctttctccagtcggggaaattaaaaccactccagctccagtgcccgaaagtctttttgacccgtcaaaatgcatggtccagtgctctattttctccacgggggtatcctcttggcgctcggtccactcggcgacaaaatcagccaacgcttgagacttgattgaagtgcggggcttgaatgatatgtccaaagacatcaactccaaagcccacttagcaatccgtccatttgcttcgcggttgtgcagtacatcgccgagtggaaacgatgtgaccaccgttaccgggtgaccttgaaagtaatgagacagcttcctggtagtaattaaaataccatataacagcttctgaacctgagggtacctcgttttggagtcggccaggacctcgctgacgaagtagattggtcgctgaactttctggacatggccttcttcctcacgctcgacaaccaagactgtgctcacgacctgggaggtggctgatacatacagcaacaacggctcctgcgggtgtggtgaagctaagaccggtggcttggtgaggagttgtttgaaatcttcgaaggccttctgtgcttcgggtccccattggaaattatctgttttcttcagtagcttgaagaagggcatccctcgctcgccaagtcttgaaacgaatcggctgagcgccgccatgcatcccgtcagcttctgaacatctttctgggtgcttggcggtttcatgttgaggatagcagtaactttctccgggttggcttggatgcccctatgagacaccataaaaccaagcagcttccctgacggtactccgaaggtgcacttttcagggttcaatttcatcctgaaagcacggatgctcgcaaaggtttcttctagatccgagatcaaatcatccttttgtttggtcttgacgactacatcatctacataggcttcgacgttgcggccaatttgtgttgagaagcatctctgaatcatacgttgataggttgctcctgcattttttaatccaaacggcatggtgacgtagcagtatgctccaaaaggcgtgatgaatgaagtcttcaggcagtcggattccttcagtcggatctgatgataccccgagtagcagtccaaaaaactgagaagctcacagccggcggttgagtcaactacctggtcaatgcgaggcaacccaaaaggatctttgggacaagacttgttgaggtcggtataatcaacacacatgcgccattgccctgttttcttccgaactagaaccgggtttgccagccagtcgggatgaaggacttctttgatgaagcctgctgctaacagcttggttaactcctccttgatcgcgtccttcctgtcttgtgcaaatcggcggagtcgttgtttaataggcttggcgtcttctttgacatgtaaggagtgctcaatcacctctctgggaataccgggcatatccgaaggtttccacgcaaagatatctttattattttgaagaaaggtgatgagcgcgctttcctatttacaatctaactcggcgcctattacagcagttttggtaggatcagaaggatctaagggaatctttttagtctcggcttcggtttctccactttttgaaatcttggcagcgggcacttctccttcgctcaccgtggttgcagccagtcggatttcctctcgggcagacgccatctcgcgggtttgggccatgtcgcaactctccttgtcgcatgtgacggcttgcttgatgtcgctccgtagggataggactccacggggaccaggcatcttcatcatcatgtaagtgtagtgcgggacggccatgaacttggctaacgccgggcgtccgagtatggcatggtatgctgtctcgaaatcggcgacttcaaagctgatgttctctgtgcggaaattttcccgagtgccaaaagtgactgggagggtgatctggccgagtggagttgcggataatcctggaattactccgtgaaaaggcgcattgcttggttttagctcagagcgaggaatctgcatatcatccagggtcttagcgaagaggatattgagtgcactgccaccatcaatgagggttctgcgaagcttgacattacggaccactgggtctagtaccagggggtaccgccccgggtggaccactcggtcaggatgatccgagcggtcaaacttgattgcaatctctgaccatcgaagatactggggcgtgtcgggctgaacagcattgatctcccgttcagtcaacttctgcttccgtttagactcataagccagggggccgccgaagatatggttgagctccttgcggtggtcttgaaatccaaccggggtgtcgccgtcgtccttcttccttgacgtgctttgttcctcgtcggagttcttccgagtagacttggtgtattgctccgcgaactgcttatagatgaagcactctttggccacgtggttggagtttggatgatgcgggcattgggagttcatgatcttgtcgaaggtgttgacgcgcgaacgctgtcgagaagagtgagcggcggttgcaacaagttcctcaggcttacgcttgcggtccttatgattgttacttccacctcctcccgtagccggcgtatttttcggcttccaactgggacccgactgcttcgatgcggtgacggcgtcttcggctttggcgtactcgttggctttttcaaacatgagcttgactgttctgggaggtttgcgcccaaatttgccgaccaattcttcgtggcgaatccctttggtgaatgcggcgatgatgacgtcgtcggtgatgtcggagatcttgttacgttgttcggaaaatcgtcggatatactctcgaagggattctccggatttctggataacgttgtaaagatcatattgtgtgccaggacgctcgaaggtgccttggaagttggcgatgaagtggtcgcgtaattcagcccaagatccgatcgtaccacggggcaatccatggagccaagatcgggcggaatctgctaaagccaccggtaaatagttcgccatggccttgttgtctcctcctgctgcgcggattgcgagaccgtagacggtaagccacgattcggggttagtggtgccgtcatacttctctattccagtcggtttgaagccggctggccaatccactcgacgcaggtcgtcggtgaaggctgcaactccgtcaaggtcgtcgtcgcggcgatccggcgagtgatggtagccgcgagctgctcggcgctgtatgattgtgtcgcgaagatcgatggggcggcgacgaggtggtgagcgaggtcgttccactcggcgctccctatgaaggtcgggaggtgagtgaacagaccgctcgtcgtgacccctgctcctgcggttggatcccgcgccggtgatgctgaggcttggatgacggtagtcgtgagatcggaagtggggaactcggctgccagtcggcgtgtggacgctttcggagttaactgggaccgaggccgcaatcatggtcttcgtctggttcaagatgttgacgacgtggtcggatcgattgagctcgttttggttgagtagggtgtcgagaagggtgatcgcggcaaccgcattctgttgaggggtgcggaaaaccggtgtcccttcgacatcttgttggccgatgagatcacgcgctcggcgccctgcttccaaagctcgctgacgtcgatcctcagcctccttggcgatccgctcacggtcctgctgctcacgccgtagccgttcttgttcttgtgcttgatgctcctcctccagtcggcgacgttcttcggtttcccgggcttggcgttgctcctccgtctcgttattggccatgaaaacgccaaagtagagaggagtgtagttgtcatctaggcttccgtcgaagtcgtcgaagtcgtcgaagtcgtcgaagtcgtggtagcgagagctgaactcatcgtactccacgatgtcagtaggacgtgagtcgacggtgggagagctgttgtagtcatctagctgatccgtcgaaaccgtgccgagtggttggaggatgacgccgacttccctgaagctaggcgaaatcggtgttgaagccgacttccgcctaggcctacgggatgaagacgctgtcgtggtgaagacggccgctaaatcgtcggggagcttcatcaggactggcgggtaagccccatcatcttgatctggtgtcgttggagaagatgcgatctctgccgagtggtttgaagccgactcgattgagatggtcttgaagtaagtttcagccgcgtttgggaatccaaacgggactgagatccggttctctcccgactggtccgattccgagtcaaggagagaaatcttgccgaagttgttggtgacgaagtcgaggctgccgaaccgaaacgtctgcccgggtgggaagacgaggtcgtcgatgccggaggaaggacccattgcactgatcggcgaaaagcttgacgctacccctacctggcgcgccaactgtcgaaactagatttcggcaataataaaagggggtggctatcaagctaggaaagtgtatgggtttggagacaaaggatttatacaggttcaggccttcttataaaagaagtaataccctactcctgtccggggatgaatccgccgagtgtattattgattgtgtgattcgggaaaaaccaacatatgcccctataggcgcccagaccccccttatatatgggaaggagtccgagttacaaaagataacctatatcccttacggaatatgaaaatataggtaagatacagtcgtaaccgactaagtttcagggtgtttccatgatacacaagttaagaaacaaacccacgatacaaataagatattctatctacgttaggtatcctgtacccagttcgaataccatcgccgtgtagatatgggatacccataatctccacaatcggccatctgaacgcctttcgtgtagaatcatcgtttggcagctgaagattgctggtgctaggatccagccaagagaaataagaagttacatgggattgagggagctggagttcccatttttctaggcgttcttcttcgtcctcttctgatctgttagatgcataaacagggatgagcttcgtcaattgatattctcagcactcatctcatacagaagaatacagtgggatacagaaaaaaaagatctgaacaaatagcagaatctagcaaatgaatatatttaaaacttaaaagccagaatcaacttaagaaattagatgataatcaatcggacagcaccattgatccaatgttgtaaagtcacttgcaagtgaaccaaaaaatttacagctaaatgaataatataccctcgtcatgaggtgctgaagaaataaattgtgagtactgacctggttttctggttccaggctgaaagatctgatgggagtggggcacaaacaacagcaccctcttcaaaagaaccttccttaaatgctctgatcagcacccttacaagacataatctgtttacagagcatcctgttttcacattatcaccagaaactagactggacttatcagtaactgcttccatgacagatgaacccaaatacttctcatgaaattctttcacatgatgtctcaacatatggatggttcttggcacgagtagttggaaggatgtaggagcatctatttgcgatgattctgcatcaccagagttggaatttactgggagactttcagataatgctgtagcgacgctctttaagtcatctacttcaagagtgctcactatgccatctcctttacgaaagttagcaatgatacaatgccacaaaggtgccacgaaagttagcaatgttagtgtgaacgcaaaatatgatcttgcggctaaacctaaagtcggcaaagagatattttgtttagggcgatcgctacagtgatcgatctctcatgaacatccctgatcgggggataaccgccataccctagtgtcggttccccctgtgtgcagtggctataaatagagatcaatacctaagtgttaaaccttaagagatttctctcgctacccgatcaagcaacccactgaaacacagggaagaaccaagacacgattctctctgtgcttccaaactagaagagaagaaagaagaacaaagacagagagatgggaactccaggagatcaaggtatgatccaatcccatttcaatttgtagtcccactttgtgccaaaccgatccaaagcaatccaacaagcaatgcatacaatggccaacgtcaaaggcaactgatacgtgggcgagaggcatccctgccaacttgagacttcagcggcaaccaacgtaggcagtggcgtcgctgctagtgacagtgtacgagcagcctgtcgaacttatcgtaggaagcgatgagccgatgaggctgtcaattgcctttattgttgagagtcgcttgcaggaaggtaatatcacacaattgaatgcatttcagagttagactgaaatccgcatacctttttttcaactgcgcataaggattgtgtatcttttatattaagactttagaaagtttgatgactttagtctttagaaaaaacatagtgatggctaaggaagacgcgggactgggcatcggctgctgattccacgaagcgcagtgaggcggccaagaccgacagtatcatcaaaatatatgattctctcgcagatcaagcgtcgcaactacggatgaagatggtgaacttgtaggcgacgcccgtctcccctccgccccggctgcgtcgacatccttcccatcttttgctaggaaactattctaaactatcgagaggacgtcatcttgttgtttgcatgttgcttaaaaaagtgtgggggagagagagtggtattttcacatgcgaacttgttaagaggctcgcttaggaaaattgattttttttgcatgcggtcctaatgtgcttggagagcatttttttttaggtgagagcagttatgacgcacctgcaacctaaaaaggtctcgtccagaaaaattatttatgcagcaatgaaagttgattttagtacatcgagttatttactacttattatttctttataaatgtgtatcacatctacaaataaattttggatatgcagcacggtgcatatccaaatctctactattataaaaattgaagatgtttttcctggtactttgatatgtcatccgtgtatgagtcggttttaagtccgttcgcttttgaaaatacagatccgtatttgactcgggttttaagttcgttcatttttggaaatacaaaagtagtcgtataagaaatctctttaaaaaattcgcatactaacttgagatgatcagacttttaattatagctcatgattttctagaaaaatatatatccaagcgaattctcttaactaaaccgtataacaataataaaattaaaataaccttcacccgttacaacgcatagtcatttttcctagtaaaaactaatttatcaaaaacagaaagaaaaaacagcttttgttttctgaaggaatacaaggcttaattaggaggccgtcctatcgatcggctgatgacggcggcgccacgagcgaagacaggacctcatcggtggtttaagccgctggtgaacccggcattcttctccggtgaaatgtgggccgccgccaagcccaagcccgcgtccgtgccaccgggtttctccaccttgccttcgggtttgttcttcacggtgcacttcgccgatgcgaggggcacggtggtggcggcgacggtgaggaggatgaggagggcggcgagggtgaggttcgccctcgtcgggatccttgaagacatgtttggggtaggggggtggtgtttgaaaatctgcaagggaggaagcaagtgaaggagatgtatttgaatagggaggggaaaggagagggctggctttatttggcgggaaatgagaggtcaggttgttcccggacaattttcccggcaaaatagggggcaatgctggccggtgacttgcaagttgcaaccaacaccccttcatgcatttgccgtgaagaaaggagaggacacaaccagacatgtgggcccagactccatgtgacaactgatttatgaagggataaaaaaggattcacattttactggggagttggaagtttgccaccctgttgcttctcactcctcgaacatgaatcagacagctgtaaaagattctgaacaaaaaattacaacattgataaataagcagcttaaggtttacagactagagaaacttaaggtcatcctcttgctgctccaggacaattgttgcgagtgctcgtcggtatgccgctgatcttgcattccttacaaggacacagatgtctttgcgcttcagactttcatgtgtcctccattgctgccgcctcaacaccgcgagaagctttgcttcgcagaaggcaactgcaacagcatcttgcccactactgtaatatgtaaagcggattgttcagttaaggtttattactcagtattgcatcgttggcatatagtgagggagactgggtgaggcaagattaccttccatggacaaaacccgtcgtgacgaagcctatcggccatctgaatgcctttcgtgtagaatcgccgtttggcagctggagattgctggtgctaggatccagccaagagaaataagaacttacatgggattgagggagctggagttcccatttttctagacattcttcttcctcctcttctgatctgttagatgtgtgaacagggatgagcttcttgaattgatatttcccagcactcatctcatacagaagaatgcagtgggatacaaaactaaaatgattcaagccagaatcaacttaagaaatcagatgacaatcaatcggacagcaacattgatccaatgttgtaaagtatcacttcagttgcatgtgaactaaaaaatttacagctacatgaataatataccctcatcatgaggtgctgaagaaataaattgtgagtactgacctggtcttccggttccaggctgaaagatctgatgggagtggggcacaaacaacagcaccctcttcaaaagaaccttccttaaatgctctaatcagcacccttacaagacataatctgtttatagagcatcccgttttcacattatcaccagaaactagactggacttgccagtaactgcttccatgtcagatgaattcaaatacttctcatcaatttttttcacatactgtctcaacacttggatggttcttggcacaagtagttggaaggatgtaggagcacttgttggtgatgattctgcatcaccagagttggaatttactgggatactttcagataatactgtagcgacgctctttaagtcatcttcaagattgctcagtatgccatctcctttacgaaaactagcaatgacacaatgccataaaggtggtacaggaacccttggaggtctcatggaagaagggcggcagttggtagctttatcgagaacagcagcctcttcagccataaataatgaataggctttgctgtctggataatcataagggaagcatggcatcttgagctgcaaatagagggatcagtgtattgctatagaacaaacttctcacaattaacaataaaacataaatcaaagctgcacaatcctcagcttccccaaggctgtaatcttactgttactttaactatatcaactatttcatactattgaatgaatacagatggcaatgttaaacatactactgcaccaggaggccaatcaccaatagtaataacataataaatttgcaaggatctaagattacatcattagcttgttttctggcgcattctatctttttatcaataacaatacctttgaggctatccaccgtctctctcttaagccaatagcatgtgcaccatgagatacaagataaaaccagaaaggttttacccaactcaaaggtagaataacagaccacctgtgaagtcaacaaaaatgaaacaagatagctgcacatcaggatgatgacataacaatagcatgtagagaatcctagcttttaggaatattatcgcacaatcctctcaaacaaatcattgccagtaaaaaattattcacaaatgcaccagaaagaaaacagatcattgttagccaatgttcaacaaataatcaagcaaaattagtgataacagatattgaataaactttttataagaagccaaagctaaaataacttaaaccaatatgagcatgatacactgaggtaggtctagttctcatgttaagacttatgatggttgcacttctattatgggaccatataagagctaacataaaagagcaggacagcaaatgtaacatgattgagaaaatgggccttaccctacagagatcagactgccttttgcatgtttcagaagaataacaggacaggatcgaccaatggaatccttctcttgacttgtttgtccttgatcatttccagaatcaaggcagaaaaacttcatacgtctgtggtgtttctccatacaaagaattttctcatccacaggaggatttatcttaaggctggaatcccacaattctctacagtctgaaagggccaaatcgtgatttcctgggttcagccatatcgatgacaaaatattcccaatccctgatggtgtctcatcagcatttggaacttggtattcctccatgagttggttattctggtccagggaaactgttttagaagaatctgttccctcgactgaattatctctggggtcatggactatcatggatagtatagcaccagactgaagaatgtcagcattatcaaaaacagatcttttcaaaagatgagagccagtagagcaatacagaggatcagttgatgtagtcacattatttttattaactagcttggtggatatacttggactgcattcattgaaaaaatataaattagcacagctcgacatcatctttttctccagccaggagtgaccactataattttctcagggaaagatgaacttacttgctaactggcttcaatatactcttaagagattgcatagcattgcttcccatgacttctaatcttgccattttcccctccagtgagcaacaactgattgtgtcaccagattcttgcatctgcaatgtaagaatgacattactgcacatagacgaacaaatgaagcaatatttctaaacaaatgtttatctcaaagctcaaaagctggaagctacatgtagcagaaaaaaaatacaaagaggactaacctgttgatgacaagcggctcttaatgtttcaagcccttcactgagagcagaagggtggatccatatccataattggcgccgtaaagaatttctttcatcagatataatttgagaattggacaaatctacatcttcagtctccaattcaccaccctcccttaaaaatggacgccacatgtatgtcaccggcccaacaatttcgaggtgaggacacccaacacggcaaagctggaaaatacaattaagtcacatttttcattccaaacaatcctctacctatgctgtctgtggtaaatgtataactaccatagcattctcatagcaaacacctcgcataacttgaccatgcagatgcttcaagccaggagttttatcttgaggagatggatgcagaaccattctgacaatcgataacagggagtcctacgtcagttagccagcaacataattagtttctttaagtataaaagaaataggagataagcaaggctaaaaaggaacatagagaaacttgtacctctggaccatctagctcaactggagtgaagtagctagcatcatgaacaactgttccatttttgagccacttcagaacagttcttgaaccccttcctctgcatgatagaatgtgaactgcattactcatttgaatttacatatatgataaaccttagcatgaaggtcatgaagatagcgtaagataaactacatgtaagacatcaacctctacattttgtacaagaatttattgcactctcctcaaggtgatgaaactgattaagaatttattgcacttacaagacgaatgttggtatgaagaacactagcttaatgctttcataatttgattgcccttcaaatcggtttaacttgctctgctagaattctagaactgcctaaacagtggtgcccatgttggactatgaacaaccagaacgagcatataactcttgcctttaatcctttctcactagagatgagctagtggaatacaaactcaccaaaaaaattacaaaatggaaagcaagtggaatgatgggaatttcttctagtataaatgagccccgccaatgcaatgattacaacccagtgagctcatttcaagcttgtagtacactcagatcaaatacaatctaacacagaaattcagtaaagttaatttaacacagaaaattcagtaacgctgtactatttcccctctccgtatgaaagtcaggtcagattatcatctactatcaaggatcttgtaatcataaactgaggattcgaggcgtacctcccatgggcaccgatgggcaagacgaatccccaccgcctctccatggagaacctcttggcgtgccacaggtgcgtgcgcagccgccgcgcgccgtcgccggcggcggagaacccctccgcggtgttgcccgcgagctcccgccgccgcctcaccctcctcgagggccttccctcctcctcctccgtaccgtcggccgcctcggcatcccggcttcggcggcggcggcgcttgttggagggaaggtggcccgtggtgcggcggcgcgcggagcggggctgcgtcaagcggccggcgaggcgggcggatacggattcgtggagggaacggagctcgccggctcgagccgccgcgaagcgccgcacgtcgagctgccgcggcggcgggggaacgccggccatcggagaggaattttctttttctttttttttttttggctagcgggagagagggttttggagagagattaagggtttattatggacacttatgcaattagccccttcactgttaataaaatttcattttggcctctttttcttagcaaaattttattctttatcatacacgagtctagagtctagattagtcgcgccggccgccacctctctccctctcccaccaccgccgtccccgctccgccaccggccacctctcttcccctctgccgctacaccagatcgagagaatcaggagagaagagaagagaaaaagaaaagaaaggagaaatatgggcccataccattttctctcatgtatatgtggggctcgtatattgattttaattattttgctgactaggatgctacatcagcgaaaccaggcatctatactgtatcgggacttttttgaacggttatatatagtttagtggtatacatttatgatattacggttataggacctcaacagactcgggtaaaaggacggccagtgaacttattcctaacgataactagaggtctgtgtaaggtgtaagttgcgaagtactagtacatattaggcctaatagaaagattgaggccctgggatgggccgggaactacaaggcctgcaaggagcatgtagtttggcttttctgacctatatatattcaataaatattaaagacttgatgtgttttctaacaatgaaaatggtttatatctttggtatatatctaccaatagacacaaaattaatgagtcaaaaaataaaaaaaataaaaatactactcaaagtttttttaaataatagaaatgttttacatcttatcttacatattgtggttgtacaacaacttgcataaaatgtaacatctctcttcttctagctatagggcaaagggcatgacggcttgtagctgccggaggggcgatcgatcgatcgactcaacgacgatatatataaccctagctatatctcgatctctggctccgtcgacgtgtatatatacgttcgccgacgacggcgagcgccgccgaagtaggcgtgaaagatccggtccaggtgagccgccgacgtcgccgaggcgacggagcacgccagctgccaccaccaacggatctctgctggtagtactagcagctgcgccggggaagaagaagaactcgcgagggtcgccgtggcggtggggcagcaaccgacggcggcgccgtcgtcgtttctcgcctcagacgtcgtcgtcgtcatggaaccagctagctagctgcagtgcccgtacgtcgccggtgagaatcaattctaaattaatttctactagtaatctaggagtatctagtagttagcttggtgtgtctattattctgggacttgtatactttaatcgcagtttaattatgtagaggtgagccgatcgatatttcctgggtctcagtctttgatagttagtgtaggactgtgaatcgacgatgatatcgattccgactacgtatgtatatactcgatcggccgatgaacgtatatacgttgagatatgaacgggaggcgaaccttacctcccgccaccgcgccctcctccctttcactccctcccctcatcgtcatcggagcgcatcgccggagaactgagcagccagctaggagggcggtggcgaggccaatccccccagggcgccacgcctctgtgcgaggagggcatcgaagacgatgcagggtgggcgcggcggatccaacatcgtcgtggacggatccggttacgctgcatgtggatctgccgctgccgcactagatctggtcagagcggtcgacagcaaggatgtcagcgtggcgatgaggctgcgagggcaaaggcagcgagagacccatgcagctgatggcaaggaggcgcagctagggtggcgcggtggtcgggcggctagcagctgggcatcgacgtcatctccgttggagctgacggtggtggtggcaccggcaccggcatagctcgagacctcgggcggcggccggattcgacgaggaaggcctggtgacagtgcgcaagagagaggcggcagaggaaaaggagttggtggcggtggttcgtcttcctcattgctggtcggcaccctattcctttctggagcttctcccctccttcgtgaggagtttttaggtcgggttgaggcagttgctggtcaacgagggaagctcaagttgccgaaccaatgt

SEQ ID NO: 77508 - DNA, 17440 bp, Oryza sativa
tcctttgactgttgggttgtcaacgctggatgagggttttctctgcttatttttggttgccccgttggaagattggcttggttcgttgatgaatttagagaataataaggatataataatcccactatttttagagtctaattgttgttgttaattatttgtgtgttttgatacgtgatatttgcgacattgatttgttataataaaaatggtaaagtgtctttccttttggagtagtgcatcatcgaaatttatctatttttttaaaaaaaaagaactgtctgtttatttcattattgtttttctaaactggaatatgtagctaccaagatttacaaaaccacacggttaccacttgcagtaacctttttagtttttaaaccacggtatgtctcgcggttttcgcggtaaccgcgtggttaccacggtaaccgtcttactgtgggggtgcggtaaccacgctaaaaacggtaaggagaactctggtagctactactattgatgtaggaatgagttttattgctatggtgatgattcgtggtaagagttctttaactcatagacatgggtataaaataatggtcgatggttaccgttcagttttgtttagttttgtaaaattagctatgtaattaatttatctaagagatgaaaactatagcacatatcatcttaagaaaaaaaattataaaactatgcattcgtataaaaactcggcaagtataggaggataccattttagctatctcaatacacttgttgtacaatcccaaagcatccactatactcatgatatatacctaaacgttataaattcgcaaataaaatctttctatcacatgctttttatcaataattaagaaccgaactagtatatgtgaaatacgtgtgtggctcaaatcgagattttgttcttggagagttagagttacaattcgtttgtgttttgtttcttgtgcgttcttttcacagtgtagtctcttcatgtctagtatagttgacaatcagccgagattcaatcatatattcattatatatctgttgactttagcatagtcaaagccaattgaagtttcttttattagtggtatttaattactacttttccctttcaaggctggtcaggtttgtccagttggatggatcagctacatacttgctgtcagggttatggatgccacatacccaatagtaatcaactaaactcggcggagcccactattgttaacagtgaaatttgataagcccggagtagtcatcggcttagagtcagcatcggcttcgaagtcctgagattagccgatgagagttatcaagtcgtcagttgtcggattcttgctatactcggttaaggaaattgatctactaaaggaaacttatccagaagagcccgagttcaaagagaatgcggcatggcaagttatctatgaatagtttgttagtttctttttatctttagtaaagtgtgtttagtgtcctataaggactttatcttttccttttatatttaggaaagtttctttcttgtccgacaaggacttgtatcaacccatgggtataaatgtgtacacccggggggttataaatgtgtacacccggggtctatgtaatatatcttcacgatcaatacaattcggcgcatcgccaccttttaccttttctactttattttatcgtccagcgggacttggcacctgacgtggggctgcatcggtgttcgatctctggctaaggggcaagtccaatgttccaccggcccaggcaattgtatcgtttacgtcggcgtcgttcaaggctgcatcagtacattcgacctcttggattgctctggtttggatgatatatttgcctacctatttatcatatgtctatgttaatctagtcttagcatatcgatttagctctatcggctgcttcttgttttagggtttctgccggtatcggctaaattgcattgctagattagattagcttagacatctaccaccctgaaaactcagtcaacggcttgattgtctagatattatgtttcttttcatacttagtgctgcatcagttaagtttgatctactaagtcgtgcttagaaccataatctctagcctgcttcttgattgccaataagggtttcatcggggtttcagccggtgagttatctggacgttgcatcggctcataagggttgcatatacatataagttggatttagccgatgacaacaaaggtttcactgtttaatctaatcttgtggatttcatggcatcggacctccagccgatgtgtgctttaaccttcggatcgatgcttatttatcatatcattgctagccggttggtttatattggattatattgttattttattatatcatcatcagtcgattgcctctatatcattatctacattggacatatagccgattgcttaaaccctatcgctatcggctggtatcggcatcggctattatcggctatcggctggaactactccatcggcttgtcagctgatcggctgttttgatctactatttgcatatcttgtcagttgcaggatcaaactaactggcacgcccgcatctcatcaacctttggacctgcactggagctaagcagatctcccaggccggtgtattcgattttttcgtcaacaactatataccaagtcttatacggaatcatacctcgtatatagaatgagtttcggataaggaaggacaagtagagttctatatggaaacaacaaggactacttggattatatccatattggtctccctaattctacttagacaaggggacttctataggtataaatacaagaccccctaagggaaagagatgacacaacaatagatagacacacaatacacaagccaacacatgccgccagacatcaacattaaggataagcctagacagaccccgtatggtgcctgtggaggccgacaagagggatctagtgtcatctttgatctcgatgaactcatactcgaggaggaagactaccatgtcatcgactacgtgttggttatccatgccgctaagtcgagatagctagataggttatctcaaatattgtacttgtgtgattcagataattaagagtaccaccggcttcggccaacaggagtagggttattacctatcagataaggggctcgaacctgtataaaatcattgtctccatctcttttacctcaatcttgcatataccctgatatcgacgatcctcataccatgcaaataccgtagtcaaacctaaaacgtccacacttgcctccaacactccttgttgtattggtaaagaaaatatcaatgattatatttaggctccttgttaatcgtgctactgttgatggctgttaactaccaaattaacaccatcaatacatgcataaaaccataaatataaaacatccaatgtagtggtagggtttatttctaaccactttcacgagcattggtgtatatttggatgcaggtggcaaacaaccaaagttgagacaaaatatacatagaggaggaggtgaattaaacttccatattgaagcctatggagttttggatccacaaacctaatgaaacacattcaaatgggccaattgcaagtacatttgggctgaggggttctccaccagagcccacgagaaaattcggagcaaaacatgccagcaagggtttggccgaacccgtagcttcgccgttcggccccaaattttacatgccggcaattaccgacttgttatgacggtttctaccgattttacctaaacaactgtcatcagctggacacatggcaagagtagagtgaagatgctatttagatgcttagcatcttcacaatcccaaggcatctctccacctataaataccccactctcgctcattcacaacacacacctacatatagagctgaattataagaggctctaagtatattttaggttctttatatgttttatagtatacttagaatagggagagagtgaagtagaagaagtcggagaaattccggaggtcatgttgatttaaaggagtgctcattcttgcaatttaaaatgcatgatcttgtcattcgcaattctagcacctaaagatagccataatgaagtgaatgtagctcaattgattatgtttcttaaggtgaaactagtttatccggatttaagttttagacttgataaatgtactcgtatttatagctaactattatttcagtggtaggcaacatatccatcgtcagcgagagcctgtgatgactttgtcaatctcaacatatattattccaattttttgaacgtactcatagcttaagcttttgtctcgaaccgaccatcgaattaacactagaaattggactagttgggcgcttgggctgggcccaactcatttcaggccaagaaagtaagaagtgcccctaccaaaatgacacaatgccatggcccatgggtcaaggcttgggatatacccaacaattttacaaggtgattgtaacatgtaacaatcaaaagtgtaggctcgtatatctgtcagaacaatccttcatatgtggcttccctttgccagggtcatctttgtgctcctctttggtgcatccgctgttcttgtattcactggagctatgcccttcatattcatccaatatgccgaggtggtgtccagggtcaccctcatcgtgggctgcttttgaggctggagtctactatggctcgctggtcacggcttctttggctcgctgatcactgttgctgccgccgtctataggatgcgctatttctggaaagaagatacgtgttgagcttatggcctcggcagggtgcaacgtctgtggcattgtttgttgggcgtttctgcatgcttggggctgtctaccatgtccaaggattatagggtgcggcagtagtatgttatagtagaggggcggccttgtgccgaggtggtgtccagggtcaccctcatcgtgggctgtttttgaggctggagtctactatggctcgctggtcacggcttctttggctcgctggtcattgctgctgccaccgtctatgggatgcgctatttctggaaagaagatacgtgttgagcttctggtctcggcagggtgcaacgtctgtggcattgtttgtcgggcgtttctgcatgcttggggctgtctaccatgtccgaggatttgagggtgcaacagtagtatgttagagtagaggggcggccttgtggtttgattactgatactttggtttcatgtcatgaccgctcacggcatgtaagttattctgtgacctgtcatgatagttggaggctgtgaacatgataagtggctgtcgacgtttgatgtcgcgattccagtatttgcatagtatggggatagttggtactaggatatatgcgagattgtagtaaaagagatggagacgaggatttttatataggttcgggcccctgaattgtcaggtaataaccctactcctgttggccgaagccggtcgttgctcttattcaccataatcacaccagtacaatatttggggtagcctatctaactgttgtcaacttggcggtctgaagtgctgacttgtagtcgacaacagggtagccttccttctcgaatccgcatccggcaagatcaaagacatcgctatgtctctcctatcagtatccgtagacaccgtaggggactagccatacttatctctgaagtcgatatctggtgtcttgttgttgacggtcgttatcgatcaatttcgaccgtcaatattactaaaacaggagagaactagtgatgcttgcaatgcatatgtttgttagaataataatattccactagtattaggtctactaaccttttgcagagaatgacaataaagtggaagagaatcgacatcaacacaaccgataaatcaatcggatgatgtcgagaaccagacttgtgtgtgaataggccaagaactcagaattgacacgatgaattgggccaaaattcacaagtctgaggagtggagcaatagaggaggccactagccgaaactgggctggattgggctagccccaggttcggccgaacctggttcggccgaaccaatcctggcaccgttggatccaggttttggcgtggacgtccaggattgcatcccaatgacggttggagggcacttcagacaattccccttccacaaccatcatacctacctctatataaggagctcactctcttcacttcaacacatacctcaagcaagaactctctcattcctctcaagtttagtttagtagtatctagctggtggaatagaattagaataggaatcaggagtccggaagccttcggaagagttcgggtatggctctagtagctttcctttcctcttttgtaagccttgtacttttattagaatactcttctaaatacatttctggtattggaatactttccgagtatatgagtacctactttacattatgttcatgttatactgaatatgctgctagcttatctgggagatgcgttggtgcaggtatagtgtttgcttatgcaattactctatgtcatgatgatgatattagagtagtatctggtagtttagacgtggtgtctagattacaggatattattatttggggttatatactgcagatgagaggtgggccgctgatggtgacagctcaatacggatattcctccgcgcctatatataatcctaagttaatttcctggggagggtattcctccgtatttagccccggttggatggtcatgacgggctgttgtaaggaactcggcagtcaggggtggcttctcgaagtaccaggagggcatcggatagagggtattagctagtataccagttaactagaatttatgtatactatgtatattggaagtataggaatagattctctttctcttttctttccacctagcttagattaattattatgaggatgagtagtaatgcttgtgtgtcactctacccttggatttatcttaacccctgcttagaatatgattatcacaattaatatataagttattagttgagttctctttacatgatcttcccacgggataaaataaatacgatacccttggaatactcttgggtgaaatgctacaatattatatccgtgcgcttgcggatgaactctgtaaccataatataccagaagtatttctgcgtcattgctgggaattatatttctaataatgtcgttaagaaataccaacacttgtcttgtcgtatgttggcttgcatgttgatcttgtgtcttgatctattgttccgtgtcccctctcctcctaaagggctttgtatttatacccataggtgtccccttgtccaagtagaactagggaaccaatatggatacaatccgagtagtccttgtcgtttccatgtagaactctattcatccttccttatgcggaactcctcctatattcgaaggttgtttccgtataagacatggtatgtggtgggtcctgccgagatttagtcaactactattaggtatgtggtatccataaccctgacagtagcccccgactttaatgcaaattaacgagttcatattctcaatccgaagacctcggaataactgttatcgagctcacatgaccgttcttggtaagttcagagataacgttagacttcccttatcagcctcgtgcgggcaccatatatgtcacgcccagaaattcacgaaccagaatttctaagctgaatgggtattaaacccctgtccaggaccagccagggtacacaaacgacaattgttgacatacagatccacgtcttacaaaaatataaaggattacaaatgcagcggaaaaggtaaaagcgagctaagcctgaagacttgactcctgcagcgggcgattccattccacgggcaacccttgacggcagcgacgaaaccaacctcttcaagacacctccaactgagaagaacttcaactctggtgtgggggaaaagagcaagactgagtactacccactgtactcagcaagtcataccggaagaggaggcatgatgcaggatataaccaaaggaggctacggggttcatttgcataaagcaggcatttaaaaccagtagttgaaagatttaaacagttgtaataattaattagtatcaactatccactgtccaacactaacccacgttgcgacaggcccaaccatccacctaaactatccaaattcaaaagattacactagggtgagactaatcacggtgaatctggttgaccgcccataaccgcgggcacggctattcgaatagttttactctgatcagaggtgtacaactgtactcacaagacacagccccacgacacgtttccgtgcgctgacatgccaccacgacatatcggaaagaggccgtgacaggacccttcgcataaccccctctagccaagcacaccacacctcaggtttcacccccatccccagtgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccagggcgtcccgcgaaccggtccttaactgccatgggtgcgaccagcaaaaccatgcacccacagcccaccatgtgatttattttaattaaccaacaccaaagcggtgtcactaatccaacaaaaccattagaaccaacagtctaaacattaataggattttccccaatgtgaactagttgaactaggcatggctaagcaatccctagtcctaactctaatcatgttagaaccccaagttgacaaagaaacatggtacatcaacagcatggctacggcaataggtaaacaacccatagtatcattctaaaaaatgcaatatttgaaagaaaacaatagagcatttgcaatataggatcaacatgttcaagtgacaagcatgacttgccttgctctcgcactgatggaaccacagcaacgtcttcgagaaaccacgaatcgacgaaacgggcgaaatctacgcgacaaacaaagcacacaagcaaaacatgctataagactactgaaacaggaaacaaaaccatttttaatggattctatacatttttatgaatttactgagacttgaatggacttaatcggagctcggatgaattagttatgatttttagaagattatctgtgtttttactaataaagaaaaacccttaatcaatttattgcgcaataattcatcccagggctgacgtcagcacaaggaggggtggcgccgacacgcaggccccactggtcagcggctcaagggggagggaggggtactggcaggcggggccctccgggcggcggctcctgggggaaggaggaaggtggcctggctcggctcggcttcaagccggccggccggttatggcgagggcggcggcagcaagcggccaccgacggcggcggccgacgacgcgggcgacggtgcatcgcggcgacgcgcatgtggggagcggcggcgcgcgcgggaggaagagagagggagttctcaccggggttcggccggcgcgggaggagacgacggcaaacggcgacggtgagcgaccgaagggcgacggcgaacggcggccgagctccgggacaccttaagagaggaagtgtgagaggttagagggagagagggtgcccacgacgagcgagagccatggccgacggcggcggctatggtggtactcaccggcgcgcggggagaagcgggccccgacggcgggattggatggggatgcggcggccggggtagcttttgcggcggcggattggctcggcggcggctccagcagcggcgagcggcggccggaggagtggaaaaggcggcggcggcgggtgtagcggcgcgggagcgatagagggcacgggagggagcggtggaaagaggaaaaggtggaggggagtggagggatggtttatatgggctcgggaggggcggacgagcccggaaaggtgcccggatttttcgccgacgtgcggaatggagagaaagagagagagagagagagggagagagagattcgaattcgaatccctccgttgcggggtgcacgcgcgagtggaaggagtggggatggtggccggcaacgtgggcacggggcgcggagtggggcccggaaggcgggggaggcggccggcgtgggcggctcggcggttgccggcttggggagcggcggcgggaggttagggaaagggctgacaggtgggccccacctgtcagcgcccgagagggagaaggaggccgggtgaacttcgggagtaggagggaggagcgggccggcgcgggaaaaaaatgggccggcggcccaagaaaaggaaaaaggagggaaaagaaaagataaaaaggaaaaaggattttcccagggatttactattgcactttgcttattttaattggttaaaattatttccaaggctctgaaaattccactaaaaatcctgttagcatattttgacacgtagaattcaagaaaaattccacatgtcgattccgattattatttgcatttattaattagggattcatctctaggttaaattaaacaatttcttcggacgatttattttatgaatttagagcaagggaggggaacttcagggcgtgacaatatagggtttatctgagtcaatctccgacatcaaccaagaaagtacagagcatacgactaagtctctcgtcttgctgcaatcgagaatttggattgaagtcaaaaaattttatctcggcgggtacaccatcttttcattctgtatttcttatcgagatccaccaaccgttctcgaatggtcgagaaggcgcagagtctgcgacgaagccttgtcaacatttgtcgcactcaccttagtcgatcttggtgtagaaccatagagatatggagtcttcgacaatgtcgaatagaattttcctgaaatcaatactcagaaaagaatattagatagaaatagcccccgagcgaacgctcaaagggtgacatgttataatatgtatggaaaactagaaatgaattaaatttacagaccaatgttttgtgtacgagcatcttctcttttatcgacttcgatcagtcagtttgttgagtcatacactctccctagcccccagcctttcatcggagataagttctcggaggagaatgctcttggaccgttgacctgccttggttgaaaaaacgcttaccctaacccccagccgtgaagttggaaaacccaatttccgaatatacggcggagggcacaacaccaccatggctccgatagtattctctaattaattcctcgacgactagctagctagcttgattcaattcactgaatggctagcgatcgagctggatcaacgatcactgatgcctggctgccatgttactactactcccatcgcgaaatctatttcgagagcgcttttggtttagctctatagcgcggcgtatctcagagccgtctaactgtgcacgtcgtcatgatgtcgatccacgtgggtgtctttttcctttcaaataaagttcacgtgggtgtctttttcctattcaaataaagtttcctctcaaattacttatccaatctacaatccgattacaccattgtgtacgttacaattaaatcttcacaacaagatcttacatgattatgttacgatgaaaaaaatatttatatttgtaaattacttttattatatacataagttacttttatcatatatatatatatatatatatatatatatatatagttacttttagatttgactaaattacttcttagacatataaaagtaaattcaataaagtctaaaagtaatttacatatattgtaaaagtaacttaaaacaaaacggaagtaactttgtcacgacattagaagtaaattcgttgtagggataaaatatgactttttagttagttccataatttgtgctgattaatttaatttttagatagagttatgtttttatctctacaatggatttattcaaatgacatgccaaagttaccttcgttttgttctaagttacttctataatatatataaattacttttagacttactgaatttacttttatagtttaagaagtaacttagtgaaatgtaaaagtaatttagacatatcataaaagtaatttgtgatttttcatcaaaatataatcatgtgagatcttgttgtaaagatttaatgcaacgaacacgacggcgtaatcggattataaatcggataagtaatttaagagaaacttctctaagaaggaaaaaaatatatagatattgagtgtactagtaactttttttttttggaaagaagggtgtctctctagcactatccagctagtactctcggtgtagtcgcgtcctactccaatacatataggatggagaagctagcttacagcgatccgcttaggagtcgaacgctactgatcgcttcggacttcgaccgtgtaccggatggacgtctactatatatacgcttggctcgtgtggtattcctcgactatagatggccataagacccgagacccgacccaagtatggcacggcatgattgctatcggacccgtgccggcgacggcgaggcccgacggcccagccgatgtcacagcacggtgggctggctcagcactgtacggtcaaagtaaaatagttgagggagccaaaataaacttaattaagctatataacggcatgggccaaagagtagagggatgcaaaaaagtcttatttatccatataagaaactcgccaaagagtgagaaaggaaaattagacttaatccataaagaagcacgatgggcagccgtgccttcgggccggcccgagtattattgggcttggctatgcccaacaattgtacaacacaatagaggtgattgttacatgtaacgatcgataagtttaggctcaaatctctgtcagaacgtgagaggtaggtgactaactggaccgactgtcacaaattcatcgtacctcgcttaacttgctaactggttgctatatgttcagacaacgatttcaaaatagcatgcacccagtgtgtgaaaaacaaggagaaaaacagtggccacatctctgaatttaacacatatgtgctgtacacaaaactttgacgattgatcgtattggaactgagagagacagattagaacttagcagagatcgagagggtcaaacacaaaggtattagacacacggcaagcaaccttcatgcatgcacgaaccaattcattatgatctgactcctctacgaacctgcgctgcatggagccaagtctcagaactatttacgaaatgtattttttttcttttgtgaaatttttatatgaactggtccagttccttgcaaatctctccaaaaattcctctgttccaacggatgtttgttttttttaacgaagaaaatataacttttggtctttttaccaacttcatcccggtgcaaaatttatggtttgtttagactatggtagctacgaatatggatgcacctgtttaaaattcctataaaatctatgaatttagacaaactagttattacaccaaatttcgtttaattgttcaacaagagtttgaccacgatggttttgcccactggcaggtgatagatagctcatccaaggagatgctctccagccaattgcatttttgtaagtaaaataaaagacaggtggcaccaaggaatagtggaagccatggagaggaccaaatcggaagcagtgagaagaggccggagagatgaaagggagatgtcagcattcagcaaaagagaccaatctccaaaagcaacccgtcttcttctcctccacagaagttgatgccctggagccccccaagcatctaccctcttgtgccttggatcttacatggacctagctcatggaccaaatgctgattagttgattttctcctttattccgcttaatttgctgtctatgcaatattgcaatatgcttgtggtttatatagtactccctctctctgtcccattttaagtgcagctataattttctatgcccaacttcaatcgtccgtcttatttgaaaattttttgaaaaaaaaattaaaaacataaatcacgtataaaaaactattcatgttttatcatcttataacaataaaaatacttattataaaaaaattcaaataagacagacgattaaaattaagcacggaaacttatagttgtacttaaaatgggacggagggagtacataagagatattacacttgtaaatttcctaataaccacatttaaaacttgtattattggacttgttgctaatgaaagtatggagcgtggattttcaaatacatcatcatatattgaggtactcgataacgctatgcagtgttgcacagtagcttacagcactgcaacaacttcgtaatcatgctagcacactgcaccagcacaacactgtatagcgcaaccgaacaagtcctatataggtgggtgaaaccatgtatgtttatcatatcgccaagctagttggctgctttggcaagtcactgataaaatctaacaagcgagcaattggcattagagaattggaattttctatagtacatgtgcatttagtacatgtattcctttaaaactttacagtttactgctcagcgcttaaaaactaagttaaaattctcataaatttgaaaattaaaccacatacacgtaaaatttagctaatttaacttgtgcctatgagcctatcactatatacatactttatcacttgtggagtttaacttgtacggttttctgaaaccttccatttaaccttgtccatagacagcgtccacccagcagattaagcaggttaacggccaagaagagtccccggcgtccccgcatctgaaaccaacgctcactcctccccctccactcgcccgcggaatcttccttcctccgattccctcctcctcttcttcttcccctcctccacctccgcgccctccacctgttcgacgaaatatcccacccaccctccccctctcgccgcgcaccgccgctacttatacccgccattttcacctcgcccccccgcgcttcccgccactaacattcactgacttagctcgtggtagtttgtagtttggagtcgtactgcgatgctcaaggcgctcaacacgccgacgccgccgctccggctccgcccggcatgccgcgtcgcctcgcagtgtggtgggcggccgagcacgaggcgcaggggggccggaggcgggccgcgcagggcggtgccgcagccgcccgtgcgccgaccgtccggggaccgcgcgtgcacgccgtggcgcggcggggtgggtgccgcggcaccggcgccggtgacacccgtcgccgcggcgggggcgagggatgagctggaggcgttcttggaggtggtgccggcgaggatgaggcgcgggctggcgcggcacccggaggtgagggagctggtggaggtcgtcatggacctcggccgccggccgctcgcgcggttcccgtccggggactgggtgatctccgagcaggccgtcaccgccgatgatctccaccaggccgtctcaaaggtgtggaggcaccaactaattcacaaagattttgtcaatcttgaaatgggcttgagctctacaagtctagatcaatgatcatgatgtatgataatacctcagtacctcagaatttgctagatagttaaggtcatatcaattgtgattttccccccttttgtgaatatgttgtgtttgctcattttgaagatcggtgattcttgcaggtaggcgacttctctgaagacaaccgatccgggatcaaccactcgttgcacaggatcagcgccatccggaaccgcaaggctcatataattggtctcacttgccgtgtgggccgggctatatctggaagtgcagagatgatccgtgatctggttgtgggaggcggttcaatattggtgattggacctccaggggttgggaagactactctgatcaggtatatcgctagttaatgctactaaaatcttgtagatcaggcagtttttgttgtcatgtaatttacatcataagctaatttggcactttagttggaaagttcgaaaataagttgatcagtgttgtgatatgatgctaacagtttgagatgctttcaacaatacagggaaatagctagaattttggctgatgagggtaagaaacgtgtgatcatagtggacacgtcaaatgaaataggaggtgatggggatgtgcctcattctggcatcgggcgttctaggagaatgcaagttcccaaagttagcatgcagcataacgtaagttttcaatattgttttatatgctttatattatcaaagaattccctgaaaatttttttgaataaagttatctcttattagtgaagtataatgatatataggaaactttctttctgtaggtaatgattgaagctgttgaaaatcacatgccggaagttattgttatcgatgagattggtactgagcttgaagcaatggcagccagcaccattgctcaaaggggtgttcaacttgttggaactgcacatggggtgacaattgagagcataattaaaaacccttgtttgcaagtgcttgttggtggaattgaggtacagttttttcatcaatgttatctattcactcattgtttgtattctgttgaagcatttactatcttctgcaacagagcattaaagcaccatttgtttcagttaatttgatagtgaaaataataatcataagttcattatacagagtgtgactcttggcgatgaggaggcgaaaaagcgtaaagttcagaaaacaattcttgagagaaaaggacctccaacattttcatgtgctgtggagatgatttcaaagactgagtgccgagtacaccacaagttagaggctactgttgatgctattcttgcaggtaatcatcgaactctttactctttagatgtataacactcctaaatcgacacctcttacatgaagtagaacatttatatatatgttcaggttttcatggccatcaattcattttttatttcacactattacagggaagcctcctaaatttgaagcacgtaagatggattacaaggctactgagtcaggaagatcgttggtgatacctgaaagagaatatgaaacagaacccttgccttcataccaggaacatcattttgccaaggcaatgccatccgaagataacttcgatgatgatttcagcacccggagaacagaaagcaagagtgtaccatcaaatgataatttcaacgatgattttggctctacaagaaaaacaaaaggcaaaacatctgtacctggaaaatctccagtccatgtgtacacgtaccaggtaagtctgggctgcaggaat

SEQ ID NO: 77509 - DNA, 1088 bp, Oryza sativa
cgcccactccgccctcattgccgtcctgagcgccggtggctgtgagcgccctattcgccgccgcccactccgccctcaccaccgtcctgagcgccgtggctgcgggagccctttcgccgcctcccacttcgccctcaccgccgtcccaagcgctggtggctgtgggccccttcttcgccgccgcccactccgcctgccatcgtcccgagttctactgcccccttcatcgccccgagctctgctcgttgtcatcctcgaggtaagggagggagaagagagaggattttggagagaaatagagaggtgagggtaaaagagtgtgagagactgacatgtggggcccactgatttaaaatgaaaagaattgttaactggactgtcacgtagaccaaaaccgcttgcaaagctgctcgagggctttttcatccggtatcgatagttgagagtgaaaaatgactagttttcaggtttagggtgtaattcatactcattcaatactccatgggggtaattcgtacttttttttcttttactgttaacttaattaactaattaaaagacatagtaatcctctctagccaatttattctagactgttgtccttggattgaatgctgattatagatcgttcctcgtgttcgatacccttagaatactctaaggggaagtgctataacggtgtggttaagtacttatctgtgatcttaagactaccaacaatacctaccctcattaactaactatatttatttctcaggccaatccaagtatgtacggattcactatgtggtccaacaatgccagtccgaattatcatggccaaaaaataactaaggctaaaacacacaaatagagtacatgcgaatgaagcagcaggaaatttcaatacgcgctgaagaacatagaaggggctggtaggcaagatcaggctcgagttgtcgtacagatatactcgtatcgttcatctatgagacattttagctctattatcatatccttctaatggtttctgctactgtatgggtcatgaatagaaaactaatgtatctattcattttccctcaattacctaatataatgatgtgatg

SEQ ID NO: 77510 - DNA, 509 bp, Oryza sativa
cgccaggcgccggagcagccgccgccacgcgcggtggccgcaccaccccgcggcggggctgacgtcgcgcaccacgagctgcaggctccggaccacggcggagccgcgccgcctgcccgtgccgccggcgccggacagagaaggccacgaggacggcaggcagcccgatgagccgccggagacgacgttggcggcggggtggcgcgccgcggttagctctgtggtggttgtggtggtggtgcccgctcccatggtggtttggagaggcgcgcaggaaggaagaagtgggagagagctctctcgtggcggttatacctgtggttatatgggaagcgagacgaataatagcagtattaggctgttagcatgtcgagatgagaaaacaatggtggttattgggctgcggagtagacaagtggtagagtgagatgagctcatgggtttttgtggtggttacttttggagatggaatggacatgcatgggagcttgtgctatttttagacacaa

SEQ ID NO: 77511 - DNA, 18643 bp, Oryza sativa
aaaaccaaagggcaaacatctgtacctggaaaatctccagtccatgttgtacacgtaccaggtaagtttgagataaagaacatgaagttctggattttacctttttattattgggtattgtattcatgtaaagacatattaaatacatcattgttatatgacctcagtaactaacagtcacatcctggttgggagctcaccactttgccttagatcggccttgttgtgggcttaggactggtgcaatgcccatggcagacatcaactgcatgttcttctatactgtttaaattctttcttaggttctatagttcgcagtatacatttttttaatcttgtttacaattgaatgctagccccttagaaaaaacataacttaggaaaatcttttatttgttttctagtactttggtgtccccaactattaatgttgaatgatatggttctcctatattttcttataacggatgtttgagttatactataatctggttcctgatttagtgagagataacaaagatctatttctattttcttctttcagatttcagaagctgatatcttgcaagtagcaacagtgatgggattcgatgatgaattagatgtgacggatgacattggagctgccaatgtgattcttgcatcgagttctgagatgaagcagaatcactggattcgcaatgtcgccaaataccacaagcttcccatatttgttgttaaggtcattgcttgatctttgtattttgtggtttcaagtgtcaaactctgttatgctcgttttaacatactcggttttacattggcacaacagacaaacacaatggctcagatagtaaaggctgttagaatgattgttgggagggataaactcaatgcaccaacacgcaagcagcctaaggttgtggtgggagagatagagattgaagatgatgctccaaagaggaagccatcattggaggaaattgatgctctggaggtaattactttgccatacattgtcttgaaaaataactaaaactatttcaggttccatgtaagaaaaactgatgccatgtagaagtactataacttattgaaagatgcagcctctgtagtacaggaattttcctaacaaccacatttcattcactacactcgcaggaggcccgcctcgcaatcgagtacattgtaatcccaggtggagagcccgtagaactcctcccaagatgttcagaaatagttgcccggcaactggagcttgttgagagctaccagctcctggccgaaacctttggaactgactccaactcgaggttgcagattcttccggtgaaaataaccaagaagagctcaagcaaaggcagtgcaggatcgatgcccaagcaaggcagctctgacctgatcgtcagcgacaacggaggcggctccagtttttctcggctgccctttctgccgaaatgaccattgctagattgacactctgatctgatcaccgttgcccccaaactgtacatcattcttctttcctctgcattgtttttttgttgtacataatacatacctgtgcagtgttgtaaatagtgtttgaatgttgaagaatcgaaagagcaaagctaattgtaattgccttccattcttttacagaaataaaaatatcacatttctggtgtcttagccagattaactcacagttgtaccctcatttttgtttggctgatgtttactaacgctctttgcatttcttttgtttggatacccggatgacaacgcacacactgttaggcctcctttggaacacaaaagttccccgcatcacagcagtcagcagtgacatcttcaatttcccaataaaacgaatattttacctttacgaaacccgtaaaacgaatatctcattatctaaaaaaaataaaacgaatatcagtattcttgtatatatgtatgtaagaagcaaaaaaaagaaaaaaaacttttttttcttaggaatgtctcaggagtctgcaggaacattgtttttttattctttggagaaattcaggaacattgtttatgtaaagtaggagagtaaacagtgtaagacctttgctacgaaagcaaaaaaaaaaaaaaggtttctcaaaaaaagaaaagaaaagaaaaactcaaagtagaaagaggtaacgtaccactcccgtgggccggaccaacactccttcccaaaaaagcccaaaaatatccaatcgtctcgtaaagggggctcaaaacaaaaaggcccacgaaccaatttcgcatgtgcgacccgtgcagcccatctcacgaccatctctctctatatatagaaagccccagatttttctcctctcctcctcctcgcctcattccatttcatcccctcctctctctctcaaaaccctaattccccgacccgagcaagccctaggtcgccgccgcgccgcgaggtaggtctcgcctcccgggagctcgcggaggcgcgaattggtgccctgattggttggtgcgcgtttcgggttctgaggggttatttggtttttttttggtggtttgtgtaggttggaggagttggatttgggtctgatttgattcggattgggcgtggtggagatggcggagaaggaggtcgggaggatcttcgtgggcgggctgtcgtgggacaccacggagcgcacgctcgagcgcgccttcagcgagtacggcaaggtcatcgagacgcaggtataatgattgaaataaattttgttcaagcggatgcgtgtgagcctcttttcgtgcgggaggattgttttgtagggtcgaggaacgaaggttctttttgcttaatttttgtccaattcttctgtctgtttatgcatcgcatggttcctaggcaattcctcatggatttcaattatggtttaacttataacctagaggtaacctcttgctaatttgtctcttttgatgaaaagatggtaagtgtggtagatccgctttttgttggcccgattatgtgataaacagagtcccggactataccttaacttgaatagagtatcgatgaaaaccgtttttagcaatcaattaatttttcattaataaggaaaaaaaagaagaaaagtagcagtggaaccatgtttattgagattcacgaaaaagggtaaactgttgcctacctgttggtaactgatatattaggttattaggtggatagctaataaagtcctatcgaattcacgattacaggaataaatgctctacgaagcttccaaagatggagcacagggtgtttattttgtttctgcttttagtaaatgctcttttggctttcttcattttcattctaatagcaattattgattttcagagcctgcagtcccttccagttctatattttaggaagttaatgaagttgaagggaaaagaaacacattaatcaattgggcccatggttatacattttcggggtgatgggttcagtaaaaatcaatttcaagtatccacaccgttagtcaattgacagctgtgctctgttttgtgggcagaagcagagatctgtctttgcgatgctagttctgataactgatgtcagcttaagattgcagcaaatgaattatcattgctattattaatgaattcaacagaattaaacatgactgcgagtgtggatgtgacatactgcaaaaaaattctgcataatggttctggatccgttttgataagaaaggcagaggcagatttgtttgaatcctatgattagtcaggtggtacagatgatgctgatgaatgagtgctatatgctcttacatgcttctcatttgcctggaagacaattatacggtgccttgacattgccacttccttgaaatggacatgcttaactgtgcacgacaaagaaacagcagaagataagaattaagaattagtttagatactgcaagtattttgccttgaaggtatatggcagacccaactaacatatgaccatgttcttattagaacttcatctgtaactcctttctttgcgtctgtagtgctggccaaatacttgatctttgtgtcagttagtttgatggtgagcttacctgttcctgcagcacataagacaaagaagcctacatgttgttttggcagtgtgcagtgcctaccgatatcctctagactctggcacatacttaaagttctgatctggagatcactagcatactgtaccattgggcagttaacagatttgaacttccatagggtgtttgagcagtggtaaaaggggatttgcctgttatcctttcagagttgtctgagatggtttgactggttgcatgcatgaaatttgcttcagctgttgtcacttcatgtgtcccaatttgtatgtgcatgccattgttagcgtttgattttttaggttcattatcattacagttgctatgtacccatcagttcactttcattgtatgtataggtcgtattggaaagagacacaggccgctcccgtggatttgggtttgttacattctcagaacctcgggctgtggatgctgcaattcggggaatgcataatggagaactagatggcagaaccatttctgtgaacaaggctcaacctaggatgaacactgatgatggctatggctatggtggtggtggtggtggtggtggtacttactcatctggtgctagaggtggatatcgtggtggaggtgatgcagttccctctgcaaatgatgactgcttcaaatgtggccgtgcgggacattgggctcgtgaatgtccttattccagtggaggtgggggtggtagaactggaaggtactcacccccttccagatatggcagtggaactggtggtggacgtggtgaccgctttggaggatcagaccgttttgctaaccgctatgttgatgaccgatatgatggtgggcgctatgttgatgatcgctatggtggtggtggacgtgatcgatatgccactgatcgctatccaccaactgccgatcgttttacaggtgacagatatggtggttctgatcgttatgcatcaagtggatttaccagggaaagaagctatgaaagagatggaggacggtccggtggaagttactatcgtgatgaacctagaggctctggtggttatgacaaaggtggcatgcgcatggggagtggtgacagatacgggaccggtggacctgctcgctttgctgggagttacagagataggcctgccccatatgatcgtcccagccgggcagcagcacgcacttatgatgaccgctactgatggaggttacttcggagcattgcagaagaccagaattacaaatatatgttccagttcgcagttcctactttatttgccttcctgtattagtacatcgactctttgagtgttgttcttccatgcagtttgtttaattactagtgagacaataaggcagttcttgaattgttagtatgttggcacattaagctccaggcagtgggtgattctgattccctgttatcgtggtactgtgtaattaccctccagtgtaataatcgtgttccgagtgtgctgtcttatataattttattctggatagcattgaagattactgtgacacatgtggtttctggaacctggatagatgttacatctgctggaaagaaaattcatactgttcttatctgaaatgctcatttggcatcaacattccgtagtccatactacatcagatttgctcttttctgatagatattatgggctgagtagaaatggtgttatcaggccttatttttgtgaagacagtggtaatcagtgaggaatgtatgtctgcttccagttttagatgagaacagttcgttgagatcagaaggagcaaacagaatcatgtacattcaagcatatgaaatgccacactgccaagcttcagcttcacgcatgcatcattgaagtagtgaagtatgcatcccgcaaaactgaatgaagaaaagcagaatatcatggtagaatttatttctagttgccaggttcacatactggagatgagtacatgtacatccgacaacagcacatccgaaactgttacagcacctgaaatttattaacttgctgggttggctacaatccagtgccgttctaactgtttattattgtaaatcagttgagtagtgaggcagtctctcccgcgatctctctgtccataatgactaacttcttcgcaatcaccatcttattctctcgaggattgtatttactgatttgtcttctgtagctcgtagtaacctgctggtatataaaatgaacgctggaatgattaaaaagcacgctattttgtgttggttggtagatggccgatgtaagaacaacggaagacttaccgtttccagctacaggacggactgtgggagaaccttgtaggggttcaggattgaatttgggtcgagcaacttcttgatggaagccatcagttgcacctggcaacattagaacattagttgcacaattaaatggcaatacatagctagagcttaatggagaattcaatgtcaaagttaggttggtcaagtaatgcacaatgaggattactctgaagaaaacaaacaaacaggccctaagcaggacgaacagcccttaattgaagtagtttgccaacataaataagcagtccatggtgacttattgttcactaagaaaaaaaacataaataagcagtccatgatgacttattgttcactaagaaaaaatgcagttcatgcttgcataaaattcttcgagacagaccttccacacaacgacttattggtggatgccaagttggaaggtaacacgtaaggacttactgcctcagatgacttgctgtagtgaatcttctcggctttcattagacccaatccatgctctgcactaatgctccctctctgtttggaggtccactcgtagacaaatggttcaatttgtgccagcatctaacattttcagtaaagcacccaaaataagcaggctgtccacaatcttgagataccgaactagcttgactacatctaaattaagttacgaaccacaccttgtcgctgtactttgttgataagatgttcagatgcaggttcccatcaccaaggtgcccatagcccaatacttgtcccatatcacctacaaaagaaaggtaatcagtagcttatacactattaatggcacaaccaagtagacaattaccaacacggctgcgcatttcttcaacaatatcatatagcttctctacgggtatggacaagtcatacttgtagacagccccaactttgacggatgcttttgatataccctacaacaaagacatactaatttcaatgatttttgcccattattagactgattacacgagcaatcttaaaaggtgaggacatttgatacaactaactttggacctgcattacaaggtggtaaggacgtaaggtttcatttgtttattagatgcttcaactaaagagaaaaattacacataaggctaaacatatgatcacctcacgaattctccaaaaattagaggcttggctaatatcttgtgctataactccatcagctaccaggccatcttccattgaacgcaacaaaaaagcttcaagtttggctctacaaaagaaatgcaacataatgactggatgatagcacctctgcgatgtggaaatctacataaattgttttccagcatagctgcatttatgttatttcaagtagaaatagtaaatgtcagttcataatgactgatatgttaaaaattcaaactagaatatgctccacggaccattggcttatacactcaggaccacatttttctcaaatcactttctttgcagcccaaaaagcactaaaagaagagaaaaaagacaccctacaccttgatgaaagtcttaaatagatcaaaacgtcacaggaagaaaacaaccaagttaaattgcagtagtgttctcctaaagataaaatcagtggtaacttagaattagcagtagcaactactgacattgttagtttattacggtaataaagaattagctacaagagcttacttacttatcatatgactcatcacttcctgtcgtctcgattagaacataaaaattgaacggtgatacaggtagaggattgtgaactccttccaaatatttcatagccttcaaaaccaaataaactatcaaaagccaatctatatacacaagcatacatgattagtgaaacgtatttcttatgtagagcaacacaataaagaagcgcaagtagtttcttctcgtctgctaattgcatgaataaggaacccaatatataataaattacattaaattgatcaaaattggtaatgaactcaccacttccctactttacagaaagtccacatggggccttaaaatgaatatataaacatatttgcatgtaatttcttctctatgaggggtctaagggttaaaatttgctcaggtaagtaccagattaatacaatgacgatccatgaactcaaatgcagagagaatctcaccccggctcctcctgggtgccagtaataatttctggatacacaaacagtaagaaatcactatcttcaagatcacatacacatgaagataaagggcaaacagagcctagaaacggaccgcctatccagacctgacagcttatgtagtcattgcaggaaagaaatgcaacattagttgatggtagctttgcaggagtaagtattgcaattttagtgacaattcctagtgagccttcacttccttgaacagctggaattagttagtgtattcattactaaccattgaaaataatcaatgtaagcatatagagaacagttgaaaatagttattgtatccaatactaaccaataaataagtgcttcagatcatatccagtgttgtctttccttaaagtagtaagcatatcgagaacagttccatcggccaagacaacttcaagacctgaataggacgaaataactcaaggatctcctcacagttgtctttaaaaaaaagataaacgtgcagaaattttatacttgcaaattgcaattcaaagtcttaggggatgggtggagggggttctctccaatcccatgctgccatgcatcaagaacttgtttcaattgtaaaataatttagaaaaggatatttctataagaataacagagagagagagagagagagagagagattatgaggaacataaaaacccctttcaaatggaacaaagggacagcaaaagttcaaaatacaactagcactaggaaaaaaaaaggaaggaactactttaacttaccaagtacacttccatgaagtgaaccgtaacgtatgaaacgtaggccaccggcgttagttgaaatgttgccacctatgtgacaactaccttttgctcccaggtcaagcggcataataaacctgaataagtgatagagtatcttgagttttctttccttgcaataaaaataatcatagatggatcttacaaaaacacatactggagtaacaagaatgacaaaggtactgacagtggcataccacaaccatcagttgactatgagcagactaatgagtatgtgtgagtattatgaaatccaacaactcaaaatagccaacaatatatttatgaacataagaaatccagtgaacataatttcaaacaaaataataatggaaataagacaggttaccccttattttccacataggagcttaaattctccaacacacaaccagcttcacaagtaagaataccatttacctacaacatataatagccatgctcagaacttgacagctgctacgtgaaatttttctgtgattgctcataacaatggatagataacatcaatctcaaaaaaccaatcgatgagcagatcacagaattcaacatattgaatacaaactgtaccaagtaccaacattgtcaaaggttattattttgtccataccaccaaggctgatgataacctgcaaacaaggggggagcacttgtgatctcagggcttaaacataagagcagtagtaaaacagagaatgcaattgaactgaaaaggaaacaaagatgtaattgatatgcatgttacatcgacaagtataataagagattctataaactggattgaattttgttatcaatgaagtaaagataatattaatcacaagaatggaaactgaatgagttcaaataatatatactgtgtttctaaaaatctaatagatcatgcaaaataaacagttcatcatgtgtcacagtacaggacaaagtaaaaagatcaccaaggcagcatcagcaactgaaagcaattcgatagaagtaggataaatcctagagaaacaagaaaactagctgaagcaaattcggacctaaaataattaccaaataatatatcttatcattaaacagagcttgtgctttatagttacctcatcataaacaggcacactgccacctacaagacctgtgttcccaccctgagggaccacagccaatcgtctggagttgcaataagaaaggatcttagaaacctggaatagaagaatggtttaataaacaatctgaacatgaattttgttgcgtctgaatcttaatacaaagatacgcaagtcttaagcatattcccccaaaaaagaagatttcttttattgtgtctaaccatgaatagaactgaactagaataagggagtgtttgaagagaaggggattgaggagattgggaagatacgcaaaacgaggtgagccattagctcatgattaattgagtattaactattttaaatttcaaaaatggattaatatgattttttaaagcaactttcctattgaaattttttgcaaaaaacgcaccgtttagtagtttgaaaagcgtgcgcgcggaaaacgagacacaatctctcctatctccacctaaagaacactccctaagtgagctggagaaaaaaggaaaaatacctccgcagtactttttggtaaaagcaataactgacttgaacccttgtatttacccatccaatccatatttgcaactgatactctgtcttcatcctgaaccacaccactatcacccaagatactcttaaagtaggagacatcatcagaattcagcactgaatatgcaggattcctctgaacgtgtgctgctgcagaactgaatgaacgcttctggacttcaaaattcatgcgtgcgctttgttgtgtgtcatctgtttccacattagtcctgaatccatacaaagagcgttgctgaccttgaatcgaatagaatctgctaaaagcatggtttgcggctccatattgtttaggatacatgcctagaaagcaacattgatcataatatttcaggtaaaagcatctcatgaagttgcaggtatcatccaatatatttattgcaactcaactttggagttttaacaaagcatggaaactagtgattttctgtctgataaaataaattataggaacaaaaatgctataaaaataattaaattgtacaagattatttaggaaatctcagaaaccttaatgctttcaccatgtcgaaaactagttgcgaacctacttcagctagaaagattggagcatggatagtgcaaacaaggatatgcgactgtttcaacatagaactatacaaaggcaatcgtacttgcattatttccaatggatgtgatgccatatatacacatttttaccaagacatttaaccagcgagaacaacctctccaagcccatatacacaaaattcgagctaataaaacacacattataatagtttctagtacacaatgtacacttaactacttccttataccaaactagaatccggtcgcaaactaaatcccatttaaaacaacaaaacacacccgagatttttctcctcgagactaaagtgaaatcatccgagatcaccaaccaccaactgctgtttcagatttacagcgtatgtgttgctgcaactcaaagttagtagttcacagcagttcacgaaccactaccactccccagtcctcacttccccgcaccacacacacagcgagcgagcggccatgaccgaccggatcgttcgaaccctagcagggagggggggagagcgagagggtcatgggcaggcgaagagcaaattaagccaatctcacctcgcgcctgcagtgtctcgccggcggcgaggggccccaggtggcggcggaggagccccgccgccgcgcgcctcgccatccgcgcgccctcggaaggaggagggagaggtggtggtggggggagcgagctcgagcgtcgagggcagcgcgcgcggcgtctctgcccctctctctctcgaagaagaaaacaaggaagtgaacgctgtggaagagagagagagaagaggcgtacggctttgtagcttgtccagctggcatgatctactagctattgtgtcattctgacgtgtaaagcccttatcattactactagtactactcttttctaatttgattgattctatagtttacccggggacagttggtctcaaaataaccaattcctatgtttttttaaaaaaatttacctactactactacataaaaaaacgaatttctagctataaacctagacacatgtgtgtctagtttcgtagatagaattagtttttttagacggatgggatacttattaattaattgtgcactatttaggtgcctaggaagggccccaaacaaacatggccttatttttattttatatatagagtatcttaagattaaagagtcgaaaatgacactccttccgttttatattacaagttgtttaattttcttctagtaaaacttctttaagtttggttaaatttatagaaaagtatattagtatttacaacacaaaatagacatattatcaaaatatattaaatgttgaatttaattaaactaatttaaaatttttaaatgttgttaattttttctataaacttgatcaaacttaacaaagtttgactagacaaaaagtcatacgacgtataatatgaaacataaatagtattaaactggttggcttatagtcatagccgaatttaaattttaaaattgttgattttgagtgtttttatagtagttagtttttttaacatttctttaattgctaatatcacacatcaaaagaattatctataaataattataagccatagtgcttattacaagcagttattataaactgcggtccgggttctaattgttttgccaacagaagattataatccgtttagtgcaaacaaataatttacgccactaataatgttttatgtgacatttgattatttatcttatcaaaaagtgttgcttattttgttgtgacttaccttatcattaaatgaactttatgcatgatttatatttttatatatttacactaaaatttcaaaaagatgaatgatttttttaaaaaaaaatcaacggcgtaagacaatccaaaaaataaactatttcctccgttttatattataagactttattggcatatatgcttagattcattaacatttatataaatatggacaatgctagaaagtcttataatctggaacggagggagtacgatgacaaatattgaaatcaatctgtacgagagctcggaatcgctgaagtccgtcgagctcgttcttgcgtggatccggccctgactcggaataagcgagatacacatatatattgcatctggtcgattgttttctaccttatatttcttcgtcttcctcttgatcgagagataacagtgtgtgagagcgtacgtactgtgaggcggcagcatgatgatgacgacccttatcgccccgataatcatcgccgccgcgactacgccgtcgtcggtgccatcattgtcgccgtcgtctacgcagctgccgccgccccaagttatcgccatcgccgtggcgccacccatttgtcacgttctatgggccgggcttcgagcactgggatttggtctaggcaaatagggtgcatacttttaaaagagaaggcaacagcaacagatggggcatcgataaagaaatcaacacaactgaagccaaggcttcttcctcctccaatttcctctcttctctttgttcttctaatcctaggctctgctctcttattcccagtcccctgcttctcttcccaatctacattgctaattccttccaattatatccaaattacttgagtgattaatgctgtgaattatcggttgcttccggtgttgggcattgatcggtgggtgggttgaggatcgtaacattatggtatcagccaccgatccgtgggattccaaacaaggacactatgtgggggacacgggatggaaggggcgacctctgggagcgggatttgagccatggaagtgttggtgctagtggtgcccgccaggtgttcggtgaaatgccgagctggctgggaggtggcgcaggcgctactcttcgtgtctaagtgagtcaagtcctttacccagtgaccggcgaggtactgcatcaaatttataacacctatggagcggtggtggtgcaggtcctcaccacgagctcttagggtgttgaggctttcgtgtggttccggtcatgctgtgatgcagagatgactctttctgtcaccaatggacgcaacatctatgatgggtgttacctgcttgatgtccagcacgtgcatcctttcaacgggaacggtgtcgacatgacgcccaccaagtgtttgacgttgggaccaagcagcatcaccactaggccagcagttgagagttctcttgctgcaccagaacatgtgtttccagccactatgaactcatccacaccctcaactaccgcagctgctattgcaacaccgtcaccatccatcaaaaccaacaaagccgagggcgacatggctcaagttgagatgaaaccaaaggatacattccaggagttgtgtgccaagattattgccacgctcaacaacatgcttgtgacatgccgcaacatcaagcttgagtcaatcacgagcgttggtatcaccagagtggtgacagctaaaagcaccaacactaaatctgtccccaacacattggaggtcagtgatgaggccaattcaatcagcttggttgatactaatgagttctacatggtgacaactaccaagtgtttgacgaaaggcaatgaacaaatgatcaatgatgatgacgatgacatggccaccgaggatttagttgagctcactaaagtgaattccaagttcacactactgcaaacaggtagctctccaccagtatcaccttggagagcggcaattccatggtacaaagctgagatgaccttaggttatcgtcctttaccatggcatgatccatggttgagtcaagacagcggaagcgtggtgatgacgaagctcttacatccccagcaaccaccttctcaagcagaagttaaagctgaagttggagcactacaattatttggctgtgtacactacaagaaattccattgaggttgattgtcaaggtgaggcttcaaagacaccgatttcagagaggacgtgttatattgagttgaggccatggccaccaccttatttcctgctaaatgaggtgatcaaggaagtattggagatatgtcatcaagtaaatatgaatgggatttccagctatgtatgggagaatattcaaggactattaatgctggatgatcaagtctttcaaagctcgacacagtggcaatctgctatgtataaggaaatgaactgcttggaattgttgattggattagagctattgcgtggacaaatacattcttgttggagggagatggctcagctgaaaataccatggacacctcctcttaatgcatgtgttgttacattacttgcgcatgctagagagagtttttcatgcaagtgcaagatcaaaggaagttatactatcgtggggttatggaagcatgagttctggcaggtaatcaggtgtcaacagaagagtgcaattcctctcttagctggcaaagtgcataattggtataacctcaagtattcttggtcgcgtggaacttttatagaggttcaggattcagttttcactctctggtctgcagagtataatgagctccaactaacaatacatgcactcaatccatccttttgctccagttcagtagttgtgccaatggtgtggttgtgtagcagattccttgaaatattgatggctttccatgacaaacgacaattcttattggtgaagactatggcattgtttggagatgctgcaatttggacattacaatgtgagtttctctctagtgcagtattgcaatgtctacagcctactgtgaagactagtgactggtatacaaagagttgcacatattcatgggtatcactgaactccaagttaattaatctgaatgaagtgattccagttgacatgttgcagctaccaacttcagatgaggagtttgtaatatggcccagacccattggatggtttgcaacaagtaatcagtttgccaatctcgggttgggctattcttcttatcatctagtcagggtaacaactaagattgtttcactgaagaaatcttggttgtgggaaattgttgaggagcattccaaaccaggaccacaggacaaacattggaaaggcaggataacaagctctgggagtcactgttgcttagtgatcctgatacactatgctccttgcaactaatatgggattctggaggcatcaaaggcatcggcttggggacaagctgaaactaaaggaagggagaatgtcacgttctatgggccgggccgagcactgggctttggtccaggcaaatagggtgcatgcctttaaaagagaaggcaacaacgatagatggggcatcgataaagaaatcaacagaactgaagccaaggcttcttcctcctccaatttcctctcttctctttgttcttccaatcctaggctctgctctcttattcccagtctcatgcttcttttcccaatctacattgctaattctttccaattgtatccaaattacttgagtgattactgctgtgaattattggttgcttccggtgttgggcattgatcggtgggtgggttgaggattgtaacaccgttgccgtcgatgatgaccatccaccggccgttccacgccggcaccgccggaagttgggcgagaagatacactcgctcctctgctgcgtctcaagcgcagcagcatgaactaaccatgaatacttcacttgttttctgtagcttagcaatagcatgctcagacaagctaggcgttaaccctacaatttgaattcagtgtttttgccatgctaatccattcgatttctcaatgaatccttgcaaaaaaaaaaaacctgaatgatgacagggcacaagtgttttttttttgttgttgttcagcctttcaagttcacataggcttggagtttgagctgctgtgttgtaattctaaaagattcaaagatattttcgggaaagtgatttcatccctcgaggggatatcccctcgtttcgtgcatgtaacctaaatagtcataaaaaatatgaaaaaaattggcaacatatattaatatgaaatatatcactccacaaacatacaaatttaaattcaacttctacaagttgtaacaaaaataacaaatatagttacgaatgtgcgatgactattttcagtttaatttgttatttttgttgcaacttgtagaagttgaatttaaatttgcatgtttgtagagtgatatatttcgtattaatctatgttgccaattttttttttcaaatcttttgataacatttagatggcatgcaaacaacaaggaatgtcctctggagagatgaaaatccacatccgatactctctatattagcctttttattttgctaggtcaaggttgcgcaagtgcccacctagatgtactacgtcaaacggtatattcataaaataaacctgctgtgttattggattcaaaaactgcaagccaacgtcatgatttattacgttcaaatatgtaatgtgtaaactttttcccattcacactttgattcatccatcacctcaattcattggtggagtccgggcgacgaaaagtgtttatgagcaattgaattttttttttgcatgtattgcccaaaaaaattagtgaatacactagcgacagagctaagaaggccgcctaactactagaaaaagcattttgcagatgtggggcttttttttcacaggcggacatgaccattggagccaaatgaccacctacaaaaaatataaaccgggctgaaactcgttatcctcctgcgaaaatagaaccacttaactggtccgcctataaaaataccctcttatgtagtctgcctgtgaaaattggcgtggaatataaatagaggcgacatcggccgattttttctaagtaccatttctcctctcatctcccgttcccacttccccctcccctccacctctcctctcctctcccctgccgccgaccggaggcggctactgggtggtggcggcgcactccggcgcggacggtggaaggggcggacgcggggtggccggcagcggctcccctccctccttccctccctcctagatctggccggaggggggagggggaggccggtgaccggcggcggggtgcgtcatgtgcttgtcggccggcggcggctcccctccctccctccaagatctggccgaggagggagggggaaggctggtggccggcggcgcgggggggg

SEQ ID NO: 77512 - DNA, 557 bp, Oryza sativa
gtttgatctcgaccgggtcttgtggttgctgaatgctgagcgatgtgcattcctttttcttcaccttcttcttctttttttccttttctctctcttttatttttgttctcttctctcttgcactccattgtcgatgatattggttgttgcagcagtgacttgaccaatagtcggtacgtaattttgtaatctgtacatagcaaggagataacataagtggaatttagccgaatttgcatgattcacatttttcatgttgtgatttatctgcgtggcaccaatgtgattcttctcgtcttttgataggtctcgatctgagcttaaataagccacttgttctccctatgcctattatcttgtgaaaaaaaaatactccattcgcgatggaatttggattgtaagatagacgaatttgactgttctcggttcatggattgaataattatgaatgacaggtagagatttcattactgttattcagatcaacaaggcgttaagtgttagcatttgccatacaaataatgatagccagaaaagaagggaaagagatcagcttt

SEQ ID NO: 77513 - DNA, 700 bp, Oryza sativa
gtgctcatttctcaattcattgatagatttgataccaaggtgatgaacttgcttgttaatataatggacaaatcagacactttagatggctccaatactgctatagctgctattgattctggctctgtagtgaatgatgatcctcctgctcctgctactcatgctgctggtccttacaatgttgttgctcctggtgctgtcggtgcttataatgttgatgctcctagtgttgttgctcatggtggtattgattgggatgaactaaacatccagccattgacagttgaaggtggatcctgtcatgttacatttgatgaggatgagatgtttgacatgctgggactaggtggttctgatattggagcagatgaggcaacaactagtcagtttccaccagttgacctagagcaaggaatgacagaagcagctattcctgtgaatgatgatgtgggtgttgagccaaacagggactgggacagagatgacccaatcatgaatgtagacactatttacccaaaatggctgtcaggcaatatgccatcaatgaagaatttgagcttggcactgagaagtctgaccctaccaggtttaggggattctgtacagcagatggttgtcaatggaggattgttggcagaactcaacatgataagactgttagggtataatccctgttgttaatttttgggtaactacttgt

SEQ ID NO: 77514 - DNA, 829 bp, Oryza sativa
actactagaaaaacgatttttcagggcgttggtctatgatttttgctggcggagaaatgccaaaaccgctagcaaagtcataacgagggggtggggggcaccgaccgccagcgaaaatggatcttcgctggcggccacgttataccggccgctagcgaagatatgttcattttcgctggcggttgggttatatagtctgataggaaagatacaattatttatactggcggcccacttaagcaaccgccagtgaaaatcgattttcgctggtggtagaacaacctccatattttagcaccacccatgtgtccttatccacccacctcgggattttggactatttgccattcacttagatgtagcattcccaaatgccatcttcccaaataacttagacaatttaccccaggtccccacaaaccagctctcctctgccattttacacccaattttaggtcccacggctgccacatcaccaaccaaggtggcactgagagcgtgaaatgtccatcttacccctgcccctctcactcataacacagcctcaccacagatccctctcttctctcgttttcagtcgacctggtctcactcctgcggcggcggcagcggcgctgtcgattcaccggcgacggagctgcgacagccaacgaggtgtgagataaatccgtttcccccttctctttttcagtttggcaacaatttgtctcagatttggttgtttttgttgcagattggattgtctagggtttggattttgggggttatggctccatctgagtgcccgccggggtaaggcacaaatctcatcctttagggctgcaggaat

SEQ ID NO: 77515 - DNA, 1116 bp, Oryza sativa
gtttttaggtcggggtgaggcagttgctggtcaacgagggaagctcaagttgccgaaccaatgtcgttcagcctcgagttctacttttgctgaacatggcaagaaggctagctagcggatggagggaccgagaaggcctaggccaactcttaggggaggagtggtaggataaagcgagctggtggtagggtactacggcaagttcggaagtcggccaacgaagggacgccggtgcagtatggtggagactacgcacggccaatgggcctgttggggatggggagcagccggatcagaaccagactggagtcggtgtctgcatgcctataaactaaggctgtgtttagatccaaaatttggatccaaacttcagtccttttccatcatatcaacctgtcatacacacacaacttttcagtcacatcatcttcaatttcaaccaaaatccaaacttccccctcaactaaacacagcctaaacagagtcgggctcgcccgacgcgactgcattgattttggactagattttcacttttggagctaatttgggttacagggacaagagagattgggatttggagtaacgtcaacctaaatgagtacgtcttgcacaaagctctctttcgacaatatttgccttttcccattcataagtattatagacttggtgtggtttttctaaaaaatgaaaatgatttacatcttcattatatatctaccaacagacacacaattagggctgtcaaaaagcttgaggctcgcgagctgctcgagctcggctcgagctccagacgagccgagcttgagcttccaacgagcttagtaatatatgatttttgttgttatttaataaattagaaggtcaaatatgttatttgtatatcttatattgacatcatatatttattttattcttttttcctcttctattaatatgatgaactagaaattaattatttttttaaagattatctttgaaatatatattgttttacttaagattcaagctcggtagccgagctcaagcctaggcagacgagctcgctcgagctcggctcgttgacagccctacacacaatcaatgagtgagtcggagaaagataaataaaaagactca

SEQ ID NO: 77516 - DNA, 1116 bp, Oryza sativa
ttttttcccggttgatgttatcaaccgggactacaaatagatctttagtctcggttggtaacaccaaccggtactaaagattgaaaagtatcctgtaacttttaaaccgggactaaagatatttttagtcccggtttttaatacaaccgggactattgtaaaatctggttgaccgaccaaagatggtttctccaccagtgtcatatcatttgattcattgttaaatatactttcatgtacacatatagttttacatattttacaaatttttttaaataagataaacggtcaaatatatgctaaaaagtcaacggtgtcaaacattttgaaacggagggagtagcatggatcagctgccggagggcgatcgacgaacgatataaccctatatccgtctggctctagcgacgacgtacgcacgacggcgacggccagccgcgccggcgtcgaggatccggcccaggtgatcgccgccgacgtcgtcgatgcgacggagcacgcgatccgccaccaccaacggaactccggtggtagtagcagcagcgcgacctgcgccggggaagaagtactcgcgaaggtcgccgccgtggcggtggcggtggtggtgcggcaaccgacggcggcgctgccgtttctcgccgcggacgtcgccgtcgtcgtcatggaacctgctaattaagctgcagtgcccgtaccgtacgtcgtcgccggtgagaatcaattctagtagtctagaggtagcttgttaatttgtgtctataatattctttggagcttgtgttttaattacaatttatgatccgataatcgtggatccgagtcttaatttgatagtttgttagtgtaggactccgaatcgacgatgatatcgactccgactgcgtacgtatatactgaccgatgactggaccagctggaaggcttatcaaaaggaaaaagtacaccgaaggtccctcaacttgtcatcgagttacaaaatagtccttgaaccgcaaaaccggatacaacacgtccctcaacttacaaaaccaatgcaaattactaggtccctcggcggtttttgactccggttttatctgacgtgacagttgactcagtgtgggacccacgtgggtc

SEQ ID NO: 77517 - DNA, 13106 bp, Oryza sativa
agtcaaaacccgccgaggacctagtttgtactggttttgtgagttgagggatacgttgtatctggttttgcggttcgaggacgattttgtaactcaatagcaagttaagggaccttgggtgtactttttccttatcaaaacggcaaggcccaactacgcgtgggctgtacgtggcccagtactcaagctaaactctttcgagactcgattatcatcatggtttaatttctttcttctcttatgctagctctgaatattttggtttttattttttgttgtgaatataggtcttacgcaatcatttgattttcgtagatgatcatattttggataattatatatgtcaggtttaattatccatcgaaacaaccatatgcatacttacgcttacttttggctctgggagatgatcaaatagatgctgacatttgatgcatgtctagatatataggagtaaagtttcatccagccgctaactataaacacttagtacctttataaggtagataagaatatgagataagtacacatagcgtgtactttggctttgtgttagttaattgcgtttacgcgacagatcatcggtcattgtcgactctcaacttaattttagtccgacgaaattattggcaagttgcagcctgatgtcgacatgagaggccaaaactatattattaaactggtggtcagcagctgtgtgatgtgttcgttttccagggcgtttattacgtcgccctcactttcttcacaacagttgaacttttgtttgtgtggctaattattattagtatttcctttaaaattataattataatgatggatgataaacttgtgggtcaaaaagacgcctaaagtccactgtaaatggagtaaatataaatactagctatcaatggtttttaataggtaattaaatttcaatttgtgctgatagtgtctgcttcatatgcttcctagctagctagttttctcataattagttttgctagtagttttataattcttccttttctgcttcagaggatatactcctaaatatttatgctttctttttagaactcacgtgtggctgactaaagtatctcctgttgactgaaagtgacctttttctgctcaaagagcataaatttctttagaaaaaggaggaggaatataattctttttttttggaccatggaggaggaatataattctttttttgtggaccatggaggaggaggaatatacagaactcattatatattatctataactaaagtgacttatatatattctgacgtacttattatatatgcagagagaaagaaatatgggattcatatccataactgacatgacttatgctagctctgaggtacaaataacagaagatttcgaccttgcaagttgagaagaataagacttttcgatcgactactgtttcatattccatatgaaaatagttaaggttgggtcaataatgctacaaacaagaggtttgaaaacacaaaacgtacgagcaccaaactatgacttctgagagaccaagttaattgcatgctgtatggccatatttcagagaaacgcacggactttttaaaaaaagcaccgggaaaatgtaacaatatcagaaatatgaatattttgattatacttaaaatatggtcaacaatttttatttccattgagcctttgacaatgtctattttgatcagacgcatcatgttgttttcaacatgcaaatttgaccaatgcttttatgtgaattcgctcactcaattaaaaaaatataaagttgatttataacaatatatttcattataataaatctagtattaaatttaaaatttactagaaaaaatgcccgtgcgttgcaacgggtgaaatctattttaatcttattattgtcatatggttttagttaagatgaaattcactgtgagagttcgcttggatatatatttttttagaaaatcataagctacagttaggagtccgatcgtctcaagttagtatgtgagtttttttaatcagattcttatatgatttcttctgtattaccaaaaatgaacgatctaaacaccgattcaaatacgaatatgtatttccaaaagcaaacgaacttaaaaaccggctcatacacgaatgatatagtagagatatagccattctgaatacttcatataggtcaaattctagtattttgcatcatccatcctaaaatacaaacaattatggtattttgcatgaaaattaagataaattggtcaaattaaattagaggtacttgtgattggttcatatgaagaagtaggaaaagaatctaaatgagaaataattacgattagttaagataaaagaatagttaaaagaattacttggatattttagacaaatgccaacactaaaagaagatctattttaagacaaaagagaatatatatagttttaacatttctatgctttttcacttacacatacagaagacaacaaagtggcagaccgcaggcgaacaaatcgatcggttggttatgtgaaaacaaaacgagagtcacagcaactgcgcccggatttgcgtgcgtttggacagacagacagatagacacacgagatccatcgagtagctgctgccgacaggcagcccaatgtactgttcataagagcaagtttaatagcatagccaactaatagctccaattcatctatagccaacctaatagcttatttatacaatagttacatactacactattaatatctggtctcacttatcatacacacagtgtgtcttggagtccgtgctacatctggcaacaaatctgtagcccgctgctcttctctcttattatttatctctttaaaatatatttacagctggtttatagcccgctattgtaacttctctaaggtgaggtgtcgagaggagaggagaaacaaagttttgggttccaaggaggaggcaacttgcactgcaaatcttcaatgcagacaaaaaaacacagtgccacagccacagatcctattcctagacagagggtcaggtgtattacaaacatccataaaaaacagtttcggacttttcaggccggatcgaaaatcataagccgtttataatttttaagttcacaaaactcatattgaattttaatactctttttttacaaagtttgttttttattgtttctttttcgtttatcaatgatttttatgaaatctgaatatacaactctcctcgtatttgcgagaaagtgtctgaatggttgagctcaactaataaaccataaaaatataaataaaacattaaaaattttatatgtgtataatttatgttttaaaagctaacgttgaaaaatatactattctgaaaaaaagccccaaaatcaactttccaaaaatttcattttggctacagctaataaaccaacaaacatgaaaatgatttatcatcaattttgtatatggagttagtaatatcacaccgagcgagtacatatataacttaaaaccaatatagtggataatggatataccagatacgaggagaaaattcagataagtgtagtgtggtgcaaaggtgcagtgagcattcaacacagatgtggcctaaaaaaccggtcagaactcaccaagttcccaccaacacaagcacatgaagaaaaagggcagccacagctgatgccaatcaacatcacatccagccaaaaaggagcacttttctaaataggagtatatactaccaagagcagcaataatctccaaaagatcatctctaggagtagttgaattcttctgaaccccaatattctaatgccaaatattcagaggccacttaatcaggcaaggagagtttagtcagggtgtgtcaatagatcaacggctttcccaagttggtgatggtgactgcaacaattggggcagattgatggagacagatggtgagaaggcaaaagctatccctgtttgagatcatccctgcaccaaaaatccaactcataaagaaattcatattttgcaagtgaaattgtgggaacaaaaggaaaaaaagcccaaagccaaaagccaaagccaaaggcaagacagattgtgacagattccatatattgttttgattgtttgctcctatctctaaggaactctccaacctgaaaggattccaacttgaaaccaaagcttgctgcttcttttctctcatttgtctgaaattcatccattttttcagtagacaaggcaagaaaaggcaagttgtgcaaagttttgttcttcagattagcttggaggcaggcaaaagaaaaaaataaggcgccaaactttgtgtgctcctggatcataggaagaaatatccaagagattggtaaaaaaaggcgccatttttgagagaaaggcgtttccttgcgatcaagctggtgatgtgatcgaagagtagaggcggccatggaggcggcggacctggtgaagaaaatacgggagctggaggagggccaggccgagctcaagcgggagatatccaggatcgtgccggagcgcggctatgcgcggcggccgcctactctgtccgcgcagcataggcgcaccgagctcccgcatgcggaggcggcggcaccgttgtctctgatcctgcagcgcgtggaccgcgcctgactccccgaccggcactacgtcaggatcctgcactcgctggggcaagccgtgcacgtcatctccctcgacggcaagctcatgtattggtgagcctttgttgcttgttttcttgctcatcaagtgcttgacgaaatgctagactagtttgatgcagagggttgaagcgaaatttactgaaattagtttgacggttgagctgtagttcgtgcaatcttgctgctgggaatggtgtattagtgcggtattcctggctaatgtgatggtacctgcattatgacggtgtatagagaaaaatggaggtttagtgggatgaactctgttgctaaattcagaatggagaaatacttttctgtagatgccaggtctttaatttcagtgacatcctctagagttttattaaattagataatgagtatggaagtaaattaatagtggaataattgatcaagtgcctactgtgaatagctatgagtgcaagcaactccaagtatctattccttcttgtattactgtacagagaattgcacttgttttctggaaaaactattagaatgtatggtgcaggacctgaagagacatgttgcaagaataatggttgtagtttcctatttccttatatgaatatacatctggaatacttttaaggtaactaaatacatagcattgttcaatgcatgtaactatatcagatctcatgcacaatcttatcattaacctgcctcagcaggcatgtttgctctaaatttcattttaccacagtttgatgcaacaagtacaacattccttaccagatatttctatttttacttcaacccaggaaccggtacgcggagcatctgtacggctattctgttcctgaagcagttggtcagaatgcccttgaattaattgttcatcctagtgactatggtgcagcaaacgacatcatacagaatatattcatggggaagtgttggagagggaaatttccagttaaacacaagtcaggggagcgtttcaacatcgtcgccagtaacacgcctttgtatgatgatgatggtagcttggtaggcctcatctgtctctcaactgatacgcggacattggaggagatacttggccattcaacctcagggaaagtgtatccgagttcagcaaagccgcgcgttcaactcaatgggtccaaaagtggtttgctaaacaaagtttcttgtgactcccagcaacctcttcaatctgctatcacctccaggataacaaatttggtaagtcatacctctgagcaaacaaaataattgactataatagaaagtctcttctggtatttcttcatgatttattttgtagtgtatactttgatttttagagtaacaaacacaggctaccagggttacaaatagagttcgctctcgggtcaagacgggtcagaattgcgatgatcagttcggtggtgcctgtgagagccattattctgaacatgatgccagagaagagcagacatctagtgaaggaagcaccccaagtggggatgttcttcatggggcctttgttagtgaagacaattactctgggaagtcaagcaaaacaaacagtgatgactcaggagaaggaaaactggggcttcacaaaattcttagctcaacagcagaggcactgtgggccaacaggggaattccatggccttggagaggtcatggaaatgatgatgctgggaagaatcgaacgaacttgccacagttccatgaaattcaagagaatggacagagccataaggaagttccagagccaatcatactaccagactgccaagatactgaatttgtccaggaagtcaaatatgaggtttcaggttcctggtggtctttcaatgccagcacaagtagtatgagcagtactggaagcactaatagcagtgctatcgagagagcagatcgtgaagcagactgcctggattttgaaattctgtgggaagacctggcaattggagaacaagttggtcaaggtagttatttctcacttggtaaattttctgtgtacacatgtagaaacacatttacttcaacacattcgtactcaagcataatcactttagttggtttcatgatctctcaatggtcatggtaccatgactagtcttgcatatcaagacaggctacacggatggcactttgcctccatatggttttttttcgataatggaagctttattaaaactcagtcaaatacaccaagatgatacatttcaactgagcccactcccggcctctgcataaaatgcacacaaccacacacaaagaaagacctatgaagacccctctcacaaaacagaaatattagtggctatcaatccgtagactagatcgccaaccatgctcctgggtaaaaaaaactcctgtgccaccttgtccaaacgtcgcgataccaccacaatagtatcctgaagacccggtttgtggaggatagctcaggtgcgaagccaccgggtgactaaagtaataacctctagatcgtgaattccaagcccaccttaatctttgggacgacaaataatgtcccacttagcaagccgatattttttcttatgtccatccccttgccaatagaacctagatcgaaagtagtcaagtttcttacataccccgctaggtattgcaaggaaagacatcatatacatttgttctccaaagagcaaatgtatatagcctccatatggttatatctgaaagttaatggaacttccttttgtttacttacgaatgttcatgtgcataattagaaaaaaaatgagggagaaataatctattaattgcctgaattgcctgctatatgcatacgggcactgttctgtttttctaatagatatacttctttccatgtttgaccaaacaggttcttgtggaacagtgtatcatgctctgtggtatggttcggtatgtatgccccattatgtgattattgaagtaacagttaacaataaatcctgaatatttatcatgtcctactccttgtaggatgtggcagttaaagtattctccaaatatgaatactcagaagacatgatactcaccttcaggcaagaggtagatatttactgtcctattgagtcaaataattaggactgcaatttctttttcagattgcacacactagagttcacagggctcatagtagttatgtctttctttttttctatgtattgacacggtcatatagacaaacatgaaaaataagggtgagctgctgagagacagaatattttttttatcttgtgaattgttttaggccgtaatgccatagagatcaataatatgctcttagctttgtttatcctattattatgatttataatctgtaattatatacatagcccatatttccatctttcatttgtctaggtagcattgatgaagaaactacgccaccccaatgtgatactcttcatgggtgcagttgcgtctctccaacgactttgcattgttacggagtttctgccacggtatgcttcatatctccttcgactgaaagaatcaagacactgtaaaaaattgtgtacatatttccctctggttgtgaatttcttctttattgttgtaagagagggtgtgtattttgaaaaaggtatatggcttaattatgatgatacagataacagcaaaatttaaatatttattgaggattctcgatgatctatgtcacagtatgaaatctaagtagtacccaacatttgtttttttgtttccactcttcgcaagccagggtgatttgaaggacactttcctgtttaagaagttaacatctaagactgaactttcctgtatacatatattttgaaaagctctgtaaaatttccaatccatagattatgtacctgtgagatgattggagtggggccataaaatgatgaacctgaagtcttgatggttacagacatagtgatgtataatgtattattaacattagttgtgtagtaagtgaaccttttctttatggaacttgaagtattactgcggatttacttgtgttattcttatgtaattgtttctatgctcataagaggccaaagctttctttcttctttcttttttttgcctacctttactttacaccaaaaactgtaccacataatgcagagggagtttgtttcgcttacttcaaaagaatgctggcaagctggatccaagacggcgagttcacatggctatagacattgtgagtgcattttctcttaaaagctcgttctaaaaatggccagtacattatgttctgcggaacatctgtggcatgagcagattgtaacaaaaactggatgaacattcttcacctgaagaaatcaagagaagttttttactgttatggaattattttcacaaatgtgtagaaaaaaaagctgaattgtgtgtgactaaaccatgtctttaagattcagcatgtgaaatgatgaaatgcaaaaaataaaatgatatcatatatgttccatctaacaaagttgcttcttctatttccccgcaaaaaaggctgcttgttctatattatacattccattactatgatttaactgaggattctatcactgaaatccaatcaataattgaactgatatgattatgatgtgaattattgttgttccaaccaacttttgtatcattcttattcttgttgaggctttggaactacaggaataatatattgtgactccaaattttgttcaataattacatattttgcctgtgtagaaacttcgattaccatgttgtgtttcagaacataacttatatatttctgcaggcaagaggcatgaattatctccacaattccagcccacctattgtccatcgtgatttaaaatcatcaaaccttttggtcgataagaactggactgttaaggtaaatccgaaagttagttctttcttcatatcttttatgtattaattatcttctcattgtttttaattttatcaggttgcggactttggtctttcacgtctcaaactcgaaacatttctgacaacaaaaactggaaaaggaacagtaagtgcaagcaagctctacttaatttcacatggattctccggactgacaagacttagataaattttaaatttgtgctaatgttttctgtttattgcaaaatatcttgtttttgttttgatattcagccacaatggatggctccagaggtattacgtaatgaaccttcaaatgaaaagtaagttcaccgttcagaattgctcaacataatttctctgactatccataggtggtttgctcaattttgttttccttttcataaagcataggtctgatgtgtacagctacggagttatcctatgggaaattgctactcagaagataccatgggataatctcaatacaatgcaggtacattttggcaatgtatttgtctgttggttagtttattcatcagagtttttttatcatattattcgttgaaaaactatgcagttgtgaattcgatagcataatttacttatagcatataaaaaaagcaaacctcaataatataattgtgtactggtggtgatattaggacttaacagccgtttgcaagttgcaacaacatatatctttcatcatgtgtttgggtgcactggtcattgtctaaatttatctgcacatagttttcctgtttcagactatgcttgtcagtttgctgttgctaaaaaaaaaagaccatattatcttgtcaaaatggtcctcattgtcaggataggataggagaagtccataaataccatctctgcaatttatacataagtattagcaatgtgtctaattgaactgttggtaaagcattactagaacatgaaagattcctaacagtgtgatcccaaatgttgcaggttgttggagcagtggggttcatggaccacaggttggacattccaagcgatgttgatcctcattgggcgtcgatgatcgagagttgctgggacaggtgcacatactatatatattttttcgacatttcaacatactacttctttgcaaattccgaagaaacaactgttctcaatgtaaaacaactgatcctagtattcaacaaacctatcctttctgcgagcagtgacccgcagcgtcgcccttcgttccaagaactgctagatcagctccgagatctgcagaagcaatacaacttgcaggctcaactgcagcgaactgcagctgccaagatgagtgttgacgattgctaacttcaaaatctgaatggtccatgttcagcttgttgccaatatgaggtcccagcaggccagcaaaatgggattcgttaggagtccagtctaaccaaaaagggttctgaattctgaacattttgctacttttctgaagaagctgtggcagcaattgagtttgtgccagaaaaagatggtgcattcgatctgaagcctgaagctctgcaactgcaattcaatcaatcttccagcagtgatgaccgatgaaatttcggcagtcatcgaatacaatgctgtattcaccctattaaccatgtacatgattttttttaaaaagaaaaggttgttgttggtattctgcaatgtactagtacttgagattatcgccgagttaatcagtgtcagaaaaaaagaaaagaaaattcacagagcaagtgatcaatgctgtcaattatagagggagtatgttacgtgtcaaatactttaacattcgaaattctaaactctaaggtatccaaaatgatagagcacggggaatttactatctcgcaataattacatataattacccttcaaaaataacaacaataaggtgaaagcattgatacgatggtggagtcgtggggtgcataacttctttcaccaagttcaaatcctggtgcctataaatattacgtactctatataagtggactttcaatattgagaaaatttgattcatagcataggaaaaaaagcggtaccaacaaatagcacaagaatttttcgctttcgatcaaaagcacaggccaccgttttttcttcgccccatagcacttccgtcaggtttggagctaacagagttaggttgaagtatataaaaattttgttggacccatttgtccttcgtcttcctcgctgtaatctcccatcctgtgtcatctcgtcctctcgggttagtgcccacgacgacggcgtcggcaccgtcgccaatcagtgacgcagcgacgatccccgtccccaggcgcgccaccgccgtccccatccccaaccgcactgccaagccgaaccacacatcttcaccattctctgtccctgccggctcccgtggcgatgactgcagcagctgtaggagccctagctggtttccatcgggccctaccaccgcggccgagacgagctccgtgccacaaagcaacacaagtggcgcttcctccgccgtttcctccagcgagcaccaaccgtcccgctctcttacttcgtggacgcggtttgggctgttgagcagtgcgctcgatgctgctacagtgagagcgcgaccatcttcgacggcgacggcgacggcaatgactttgcggagatgctgctcctcaacagctgctttatcctcgagttcttggcaaaagctgagccgcgccaatcgagggacgaaacaacgctgtcgaggaactctggatggctcatatgaatcaggacaatatggtctttctaactcttgactaacagctaaactgttcattggaacgatgaccacgacgaaagtgctacggggcgaagaaaaatcggtggcctgtccttctgatcgaaagcgaacaattcttgtgctatttttttattaccgtttttcttcttcttatgctatggatcgaattttctcttcaaaattcatctcttagcgaatgagttaggggacggacgtgcgatatgtgtttgctgtcaactcgccaaaagaaaattaacatcaataataataattatagcccttaaaaaaataataacagcaacaataatccctatgccaattggggcccaccaagagtccaggatatgtatagcatgtgcggtgtgtgagtgtgagccaagctttggtacgcgcagcacttcttctcatcccttccccgaactcacgaacgcacgccgccaccaccgcccaccgtcgtctcgtcggagatggcctcctccgcctcatggccggcgttcggagtgtaatgtgccttctcctcctcctcctctttctcagctgtacaggagcttgattcgttatcacgtcgtttccttagatcgatatagaccccccaacatttttggtggcttgttgctttggttcgaatctctcgccttcgatttcctacttgtagatgatggataacatggaggaatgcttgtgattttgaggattttttttaatgcctactttgtttgtccccccttccttattctaatgggttttagggttaagaatttgtagatctgaacatgatcttgcatgattaaaatatgggtaaagtagcattgaagcatttgttgcatctgggtaccgagctcgaattcgccctatag

SEQ ID NO: 77518 - DNA, 11851 bp, Oryza sativa
ggtagcttgaatggcagtacattccttgctgtggcataaacccatctaaaatcctagatttctgatgtaatggggtttacaccaagaatgtgtggatctggatgcgaaatatctgatgctatgagactaaaattccttcagtaattaccgttcttatgaaaattattaggttgcttatatatactgcacttgctcgtagatctgtgggattataattggttttagttaataatttgcagattttggacatgaatatgaatggttaaaatttggtttaagcaactgatgtattttgagggtaccaccgatggcagtatattctttgtggtagcattttttgtagtgaaaaatcttaggggtggcataaattcaccaaaagtctagatttctgatattctaatggggtttatgtcaagaatttatagattagaaacaaaatctgatgctaatatttcaccaccgattgacacacttaaattcctcatcattcttgaaaacagaaaactattctaactagcctgtaccattctttgattgcttacaattcattcgctagtaaatcaattcctaacctacctactcttgcttgctattatctccagaagcccagaggaagcagggaagggtaaatggtacatcgcaactgctgctaccaaccacatgaccaatgacaagagcctcatctccgacctcaagcctgtcgccgatggccgtaatatcattgctgatggcaatggtgcagggttgaaggtgcagggcaggggagctgtgaacacagaaactgtggttctccctgcagaagtgtggtatgtgccggagattgatgaaaacttggtttctgttgaccagctcaatgaacttggcctcagtatttcgattggccgaggtgtatgcaccgtcactagagttagtgatggatctgtagttggcaaagcgcgtagatcaggtggagtctatgaggtggaattcctcaaggttccccttaattagcaccagaaattccttgctgcagtatcagttggggtagtcagactcgtatgatgatattgcctactatatgcaatgcttgttgggttggaacttaagttggatctttcagtagttaagggatctggagttttctctgaatgtaaaaactaaaaagtgaaagaaggagctgcctgtgagcagaactgaggattttaccatgttggtttgaccttgtcttttaccactgtttttaagttcctgtagcctgttgagctgttcatatccatcgacttgcaattgccatttcagtttcagtgttcctgccctgctgatttattggtgatcattttcaatcttgtgctgtaacctgtaacttcagtatgtcaatgattatctttgcaaggttctctcttgtcgaccaattttccatgcatgatgttacacgttacagcaaagctctttaggctgtgtgtggaggttggcgcacgcaaaatgatgggatagattagcgtatataattaataacaatgggatagattagcatatacttcctccgtcagggcatttgcaaatttgccaccgtttttttcaattttgcaaggatgctattcgaatgacagttctagtggtatttttgcaattttctagtggtagtcttgcaataacaattcaaagtagtggtaaatttgcaattgctcatcctccgttttatattataagactttctagcattgcccctgaattttagaggtagtaattaatttcatacttaattttttttgaaaaagaattagtatgaaattttaaaaacaactttcctataaaaacatttttataaaaaatataccgtttgacggtttaagaaatgtgcacgaaaaacgagagaaaaagtaggacacattgacaaaataacacaacttatacctccattcatgacaaatttggttcagaaaaatagtaattactctaaaataataatagcaatctcataatatttgccgttcaaaaaaaacaatagcaataatattagtaataataacccttcaaaataattaataatagcaataatactccctatgacaaccggggcccaccaggagtcgactagtcgaggatactggatactcctacatatatgcggtgtgcgaaccagcttgtgtgtacacgtagcagtttctctcgtcttctccccgagctctcgccgcctcgccgcctcgggcctcgccaccgcccgccgactcgtcggagatggcctcctacccggtgttccaagtgtaatgtgccgtctttcccctcccatctcctccccctgcacacgtgctctgtacatatgggtttgattccttgtcgcgcgtgcgtcgtttctttggatcgatctggaggaccccatcctttttttggtgggttgtgctttgtttcaagtcttccatgttcagatttcatttgttggaagatgttgtgcaagatggaggaatgctttgggatttgatgatttcttgggaatacctactactttgtttgtttccccttttatattctagtgggttttaggtttaagaatttgtaggtttggacatggtcttacatgattaaaatatgggtaaagtagcatggaagcatttggtatacctttggtgtggcattgcattctttatagtggcacttctaaagtttcaatttttttttttgggggggggggggtgattgttgtagcaaagccctagatttgtgagatttttaggggttttatgccacgaatttgtagatctgatcattacccagaaccacgaagccctagatttgtgtgtattgaatggtctttacttataaacttgcagatctggacatgaacaggaataatgaatttgggaaaagtattgcatttttgcctatttctatggtagcttgaatggcagtgtattccttgctgtggcataaatccatccataaccctagtttcaagtgttgtattttcagggtagcatgaattgcagtacattctttgttgtatcaaattgtacgaatgctcagaacctagtttctgagatttagtggggtttatgccaagaatttgtagttctggatgcgaaaaatctgattctgatggttgcgatctaatctaagctagccttcatcattcatagatttcttgcgctgcattcgctcctagatttgtgggattttaatgggtttttagttaataatttcgaaattgagacatgaacatgattgaaaattaggtaaagtagcaagtgatgtgcttttagggtagcatcaatggtgtacattctttgcaatttcattttttaaatcttgggagagaataaagccacccataagcctagatttatgagactgcaatggcgtttatgtcaagaatctgtagattaagaagtgaaaatctgatgctaatgttttgccaacagtctaaatttccttcagtgattaacgattattgtttttgtgcactaatgtagctagcctgtaccttcttgattgacattcattcctgaatcaagtcctaacctgctactgttgcttgttactatctccagaagcccagaggaagcagcgaagggtaaatggtacatggcaactgctgctaccaaccacatgactcgcgaccagagcctcatctccgacctcaagcctgtgaccggccgtgtcgttagccgtggcaatggcgcagggttgaaggtgcatggcagtggagctgtgaacacagagacggtggcgatcccagacgtgtggcatgtgccggggatcaacgcgaacctggtttctgttccccagctctctctacttgggctcaacatttcgttcgaccgtggtggctgcactgtcactagagctagtgatggatctgtagttggcaaagcgcgtagatcaggtgcgatctatgaggtggaattcctcaaagttccgcttaattagcaccagaaattcctcgctgcagtatcagttgtggtagtcagactcatatggtggctaatatcgcgtactgtttccaatgcttgttgggttagaacttaagtgggatctttcagttgttagttaaggatctggaggtttttctgaatgtaaaaagtgaaagaaggatgatgttggttatgtcgctggctatgagcagaactgatgagtttaccatgttggattgaccttgtcttttaccactgttgttaagttcctgtagcccgttgggctgttcatatccatcgacttgcaattgttattccagtttcagtcttcctgcatcgctgaattatgtctgattatctttgcaagattctcttccgtcgaccaaatctccattcatgttgcatggtagtatggtacatgatagagttccatcggtagtcctaaaatgaataagctaaagccaaaatttaaattttaaaatttaattttgaagttggatttaaggtatttttaacataatttttttagctttggcttttaagttgctaagattatttatacatataagttttagatgcaaaattacctttttttttatctctaataaactgtcactcctgtctcaattctccacgtttggggtaaaaatgggacgtgtatttttcgtccgtccacctatatcaattattcaattcatggcaaaatttggtcagaggaaaacactaattactcccaaaaataaaaggaataataattgcccttcaaaagttactccgtaatactggagtaatagcaataataacccttcaaaaaaattaataatagcaataatactccctatgccaaccggggcccaccaggaggagtccacgaaccacgatacatagggacccgatacatatgtgtgttgcggtgtgaaccagcttgtgtgcgcgtagcactttctctcatcttctcccggagctcacgccctcgccgcctcggcctcgccaccgccgccgactcgtcggagatggcctcctacccggcgttccaagtgtaatgtgccctctctcctccccctcctcctcctagctcaacccctgaacacgtgctctgtacatatgagcttgattctttatcgcgtcgttttctttgatcgatctggacccatctttgtttggtggattgtgctctggtttcatgttcaatttcatttcttggaagatgctgtgcaagatggaggaatggtttgggatttgaggatttcttgggaacacctccctactttgtttatttccccttcatattataatgggttttaggtttaagaatttttagatctggacatgatcttatatgattaaaatatgggcaaatagcacagaagcatttggtgcatctttgttgtggcacatgaggcattgcattatttgtagtagcactttcaaggtttcaatttttaggggtaactacaccattaaaaccctagatttgtgatattttaaggcgttttatgccacgaatttgtagatctgatcatttacacaaaaccacataaccctagatctgtgagtcttattgggttttagtttgttgtggcacatgaggcattgcattatttgtagtagcactttcaaggtttcaatttttaggggtaactacaccattaaaaccctagatttgtgatattttaaggcgttttatgccacgaatttgtagatctgatcatttacacaaaaccacataaccctagatttgtgagtcttattgggttttagttaataatttgaacatctggatatgaacagcaataattaaaatttgggcaaagtagaaagtgttgtactttgcctatttttagggtagcttgaatggcagcacattcctttggtgttgcataaacccaaccaaaaccatagattgctgatactctaatggggttcacatcaagagtttttagatctggatgtgaaaaatctgatgctaatgttttgccaacacccctgaccgtttgacactaaaatttcttcagtggttaccgttcttctgaaataatctagctagcatgtgccattcttagattgcttacactgcatttgcttgtagatttgtcggattctgatgagctatggttaataatttctgaatctgtacatgaacatgaagggttgaaatttatgtaaagtagcaagggatgtattttttgggcagcatcaatggtggtacattctttgcggtagaatttatcaaaacgtcaactcttaggagtgcataaagccacccaaaagcctatatttctgacgctgtaatggtgtttatgtcaacaatttgttgattaagaagtgaaatctgatgctaatgttttgccaacagtctaccgattgacactaaattccttcagcgattaacgatcattgttttgcaaactaatgtagctaaaccttgtaccttcttcattggcattcactcctaaatcaagtcctaacctgctactgttgctttgctactatctccagaagcccggaggaagcagcgaagggtaaatggtacattgcgactgctgctaccaaccacatgacccgcgaccagagcgtcatctccaacctcaagcccgtgactggccgtgtcgttggtggtggcaacggctcaggattgcaagtgcatggcagtggagctgtgaacacagagacggtggcgatcccagacgtgtggtatgtgccggggatcaattgcaacttggtttctgttggccagctctgtcaactcgggcttgaagtttcgattttccgaggtgtctgcaccgtcactagagctagtgatggatccgtagttggcaaagcgcatagatcaggtgcagtctatgaggtggaattcctcaaagttccgcttaattagcactggaaattcctcgctgcagtatcagttgtggtagtcagactcatatggtggctaatatcgcctactctatcgaatgcttgttgggttagaacttaaatggcacctttcagtagttagttaagaatctggaggttttctgaatgtaattgaatgaatgatgctggttatgttgctgcctatgaccatgagcacagaactgaagaaatgcttaccatgttggtttgaccatgtcttttaccttcctagcttgttaaaattgttaccatctttgttcgaccttatgttttttaccatccttgttaagttcctgtagccttgtgggctgtttatatctgtagccttttcgacgagggaagattgccaactttcgaaagcgccaagaaaaataaccttgtcggtttggaccgacaaaaaatatacctttacttggcggcaatgaaaccgcaaagaatacttattcttggcagtcggaaccccgccaaggaaatttctttggctgttttttttggccgccaaagaaatcactttgccgccggaattttttgctgaattgaagttattttcaagagcatcgtgtactctcgtgaacaaattaaagctgaaaaaagattgtttaccatcagttgatttatgaggttttaaaccggcgatcaaagcggaattagtttggaggaatgagatccactagcagcaattaatgggataagagtattgggatcgggacagggaaatggatgaagggctatgatgaaatgagggagggataatagatggctaggattagaagaaactctttggtgggtgggaaaatatttccccaacccattagccaaacaggccctatatatgtgtgtatatatatatatatgtatatgtatatatatatatatgtatatatgtatatgtatatgtatatatatatatgtatatgtatatatatatatatatatgtgtgtgtgtgtacgcgtcaaacaactaatttggagcgtatttggtggctaactccctttttatgagaacagctgatccgaactaactcgatcgatccagttggcttgcgtcgtcgtacgcgtcgatagtcttcgtcgtcggagatcgatcatggcacctcgcaaaaggtcgcatcctagaaggtaattaacgtgccttaattaattctcctcctcatcctcatcttcatgttcaatgatgcatatatacgtacgtgctctgtatctttagtgctagattgattgcatttaatttgggtttatattagatctcggctactcatttgtttggaggattattgtgccttggttcgaatcttttttgttcttttgtatttaatttgtagtcaaacgctactttgtagctgatttgtgatttctgacatacatgttggaaatgcttgagattggaggctttccagtgaatatacctaggttgtttgtttccttctctttttttttcatgtatattctcagaacttgaacagagaaccctagatttgtgatattataataagttttagtcaagaatttgtagatattgcgcgccatggacatgattgattgaaataatatgggtaaagtagcagctaggtggcatattattttttgggtggcatcaatggtactgcattcttttcggtagcatttctgcacatgtcaattatctatcagttgtggcataacccttaaaggcgcttactccctccgtcccaaaaaaaacgaatataagattggatatgacaaattctagtataacgaatctggacataggtgtgttcaaatctatagtactaggtgtgtcacatccagtactaggttggttttttatgggacggagggagtagacttttttttttttgtcaagaattcaaagatttggacatgaaaaccagatgcaaatattccttcagtaattttaatttgttcttgtaacaattaacctaatccagcctctatcatctcttgattgctatactgcgttcattccaaatccaaatcctaacctgcaactactgtcacttgccatcatctccagaaaaccagaggaaagagcaaatgtcaatgtcagcagtctcaacaacatcttcataagtgcagagcccggagcaacatttcctagatggttcatcacagaagctgctacaaaccacatgaccagcgacaagagcatcttctccgacctcaagcctatggccggccttgtcatcgacgaccgtgccggcgccggcgcagggttgccgatgcacggcattggagctgtgtactcatgggaggtggcgctccaagatgtgtggtatgtgccggggatgagtgcctacattggcttagtttctgctggtcagctcactgcaattggtctcaaaactgagattgcaggagatgtctgcaccatcactagtgctgatggatctgaagttggcaaagggcgtatggttagtgataaaatctttcaggtggatttcctccgagttccgtttaattagttcctgaaatttcattccttggaaaaaaataacttggaatagtttttatgtagtaatttttagtttggagtagttgaaggatctggatgttttttcttctgaatggaattgaagcaacgatgatgattttgtcactgaacaaaaaagttatctagaatggtcttatttggcctctatgagtagaactgaagaactgtttaccatcttgttctggcttgtgttggcttgtgttttaccatcctagcttgtactgcaggttgttaatggctatcattttgcaattgctacggaaagtaatttatctgcttggggggggggggggggggacgtcttccccagctccgcaccacacgatatgcgcagcgattcgtgcgtacacccgaccacagcagggtatttccccgcttgcccgcgtttaacccattttctagctgaccatggaaatacgccttttatacgtgggacccaccttgcagttgtcgctcacgggggagcacttcttcctcctcctccgccggccaacgcctccaccccaatcccattaccatccaagctacatcttcccaacccagggcatgatcactttaatgccaaaaaaaaccttattaaaatttactaaaattttgccaaaattttgtcaggattttttatatagttacaaaaatttggcagcaaattaaatgtagccacttttttgataacttaaccaaaatttggtaaggttgaaaatggcatcaaagtgaacaaacccccagacagctgcggaacgccggctaggaacaacacagccctagccatggcattgtggaaggagatgatagaagagagatggaagtcctgacatgtgggcattgtggaaggagatgatagaagagagatggaagacctgacatgtgggcccaaggcattttagaacttttataccatttctctcctcttcaaccagaaattattattttaatggatgtagtgtccaccaacaaatatctaacttttgagagtgtttttccccaaaagtcacttcgcacgatgtattatagctaaaaccacaaagtcacaatgcggcttccctgttcctatgttgtgttcccctccctgtcactgccagatgtcctccctctattggctgcggcttttctagtggacccaggccattcgctcgttttctttttttaacgcaaacaacgttaacatctggaatggctcgttcctaatcggtgcctaggttgccgaccaatgttccacgcgccaaaggtaggctgtgacatggaagaagcgccggagtggccgacgccgccggaggccgcggtgaccatgacattcaatctgggcagggtgtccagggcggcgctcatcgccttgagcgagcgcggtgacagcctggagagcggcagggatgcacccaccgccgctatggatccatgaagtaaaaaaaaatcttagcgcccaggaaatttcgaagacgctgactccaccgccgaacgcccgaactacatgacttcttcggcgagatcacttgctcatgtgattcttttagcttcctagcacatatcatcttaaattcttaagtattacctgaaatttatgggaacttcctaggcatgcaggaatggccggaccatgcccgaccacccttgtcttcctcattgttctctccaacaaggagatcctcctcatcaacaaatcaacaatggcaagcagctgtcctgtgcttcaacttcttcaccggtaagcagctgtcctgcacgcgcatattgtccatcgatggcaatggcaagcactgaaattgccttgcctgcctaattgccccgcctagggcacgccacagcagtgtaagggaaagaaaacggagattgctgccgtttgcttcaaaaaagaaacggagaggttaagccgtttagatgaaaaaaaggagcgtaaggccctgggcccgctggagaagtgatcgccaatagagcgaggacatctggcaggggacatagatagaaacacagcgtcggaacagggaagccgcatccgtgtccaccaataaatatctaacttttgagagtgtttttcctcaaaagtcacttcgcacgatgtattatagctaaaaccacaaagtcacaatgtcctgtagcaaaatttgatatataagtagtatgtatctcactattcatacatcaatagctaaggtgctagttttgttggcttgttgcactagcacgccctcgagtgtttagttttttttccttcttccacacacgaatcttaaagcgtatccggtggcccaaaatgtgaatgacttcatctcttatttctgtcacgagatatacagaatatgagaataaatatcctctttcggatgtgcatgattttcgaaaagaaatttagatgtgcaagttaaatacacgtgctcttgcacacacggagtttcctgtttcccgtagtttataatccaccaacaaattatctatagaaattactttggttaacccgtagtttttcgtagtttcctaattaacaatgtatttaataatcgaaaatgtcagggataattttttttcgaattctctttgctctaaaataattaacaagacttaaggcggaatattcagagcatcgcaa

SEQ ID NO: 77519 - DNA, 11782 bp, Oryza sativa
aagacttaaggcggaatattcagagcatcgcaattaatgttgctaatttaaattgtcaggatttgaattaataatattttttctctcccgcctttggtcatgaatcatgcctgattcactcctctcttcgttcgcggtttcgttttgcatgacgagccgagtccgagtcagtttccggttccagttccgttcttttcctaaaacagcaccgcatttcttttccggtttggtgaagtcctaatcctaatccagctccctccccctccctttcggccgcgccctccccctctccccctccgagtcggccccctttcccctcctaatccaactccccaccggtcctgccttccctcctattttccctctcatatatatgtcctagtcccccacctttttctaatcttttttttgagccgcaagccgcctccgccctaaaccttagcgccgccgccgccgcttgctgtcccgctgccgtcgccgttgcatcgccggtactccgttctccctctctattggtgcgcttgccgctgcaaccatcaatttatctaatctattccatttgtttctcatctagcgtcgccgtcgtcttcgtgtgttgccgccggaccgccgtcatcatctcctcctcgccggtcgtctcggtttggtgaggaccattcccgtgatctcctggtttaggctttattttttcctagcgttatcgtcgtaaccctaattatttagtcatgctaaaccctagtgttgccgcttcgctgccctagctgcgctgcctctgccgtgcgcctagccaccgcctagccgaggcaccgcagccgccgccttagctgtcgccgccgccgctctcccgcatcgttttcatggttggttcgctgcccatagctcggtagccgagtcgcaaagccgtaggtgcatccctaaactcctaccggcctttcgtttgtcgtaccgagtctttgtcgtaaaccgtgtctagtttactggtttagccgtaatcgttctaagccaccggttccgttcgccggttcggttgaccatttggatggtcctgtgtcatgaagtattggcttgttgagtctttaattcatgagtcatgcttaccggtgatatatttcctttgttctatttatctatgggcaataatatgtaataaatgattaagttttttcagctattactaataaagcagctcatattgtaaaattcataactaaataatccgagctccgttttaatccattcaagttacagtgaatccattaaaatgtatagaatccattaaaattggtttattttgctgtttcagtagccttattgcttgtatttcttgtgtgttttgtttgtcgtttagattccgtcagttccggtgatccagtttattttgaagtggttgccaaggtttcatcagctcaagagcaaggcaagtcatacatacaacattgatcatgttgaacctattttacaaaatcccttgctttctattaaattgcattattttagaatgggatggatgcctatcgtactctacttgttgaatattttatgccattgataaattgggttataattgactagatgattgggttaggaatgcttagccatgcttagattaattagctcacaattggattcattataatttagtccttaattatattatgatgtaccaccatggttatggtttaattaaactaaaatatactttaatggtgggttgtgggtacatgcatgattttggaagtcgtgcccataacaattaaggaccggttctcaagaatccctggaagatatactcgtacttaccacatgccagcgtgggctccatgctaaatctagagtataacttaaactagctgacatatcatggcaagggtagaggcgatggtgcagttcggacctgtattttggtctttgttgcttccgaatttacctatgcatgagaggggactgcccgacttggcacaaggagagggtgaaacctgaggtggttatgttcggttagggaaggttatatgacggtttttgtcacggtttcccctttgcagtatcgtggcggtacttcggggcatggtaacatgtgtggaattatgtcttgtgggtaaaattgtacacctctgattagagttaaaactattcgaatagccgttcccgcggttgttgggcggtcaaccagctcaccatgattagtttcactataataatttgacctatagaactggtgtagttcaggtagtttggttgggcctgttgcaacgtggttttagcattggacaatgatgatttaatatttcttaattatatacttcccccgtcccataaaaaaccaacctagcactggatgtgacatatcctagtacaacgaatctggacgaggaggggggggtaatgttttacttattcaaaatatgatttataaatgctgcttttactgcaaatatccaatgagccattcctttgagaataccttgcatcatgccttcccgttggtatgacttgttgagtatggtggttggtactcagtcttgctttatcccccccccacagaagcagagattggttcagatggtgagttctattaggattgagcttgttcaggacgtcgaggatttcctgtggtttatggaggaagcttcttttggttgtgaagattaagtctagtttttttcttgtttttccgctgcgtttgtgagttttattttattatttttgtaagatgtggaactgtttatcaaattgtcatttgtatactctggctagtcttggatagagatttagggtgtgtttagttcgtgaaaagaaaatttttgggtgtcacatcggatgtttgactagatgttggaaggggtttttggacacgaatgaaaaaactaatttcataactcgtctggaaaccgcgaaacgaatcttttgagcctaattaaactgtcattagcacatatgggttactatagcactttgttgacggtcgttacagacaaatttcgaccaccaatataactaaaatgatagagaattagctatgcttacaatgcatgtttgttttcaaataatatagttccacttgtacttggagaataacatattgcaggaatttatcaaagaaaataaagagaaagtgaagaaacctcactcctacgcaagcaaatggataagatgggcccacaagtcaggtgtaaccgtcggaaaccgaccttaactgccacaaccgcctaaaggactcatctgtcagccactgtaccgaagctggaggcctgttgggccagcataggttcggccaaacccgagggttgcccaatcagcctggccctccacgtgtgtgctccggatgcactctcaatgatggttgtgagggtaaaatggacatttcgcatggctacaaccgtcatactgaccctataaaaggaggagctcacttcacttatcaacacactcaagcaagctcaattcctcttcatactttagtagtagtagtagtatagtgctaagtggagtagtatagaatagtgttcagaagtcctcggagtcttcggaagaatttcggtatggctgtggtagctcttgtaatctcttatgtaatactttccgaattaatgaaacactcttctttatatatcttcggtactttgcttagtttgagtactggtcttactttatatcatcattatattaattgtatgggtagcataccagagagctgtaatggtgtaggtttaatgtctgatttattagttgctctatgtcgggtgcacaggtatagagtagtgtttagtaatgtaagcatggtgcttagattattaaatatcattaattgagcatatatgttgtgggacagtagagatgggccgctgatggtgacagctcagtacgggtattcctccacgttagtatatattcctaagacaaatttctggggagggcattccttcgtatttagccccggttggacggccatgataggttgtcgtaagaaactcagcaacccagggtggtctctcgaagtatcaggacactgttagaggatattggccacatgattgtatattagcatatgtaaactaggatttgagtatatactagaagtataggaattgaatgctttctatttcttcttccacttagttagacttatttgattatgaggatttgatcagctttgcttcgtgtcactctacccttatattgcacttaacccatgtttaggctttgatgattataagtaatatatgtataaagtgcattagcaaacttcactcttattatcctcccttgggattaaaaatacgatacctcaaaatacttccgggtgaaatgctacaatgatatatccgtgcgcttgcggattacttctgtaactataaatataccatgactatttccggcgccattgctgggaatgaagatttctagtaatatcgttaagaaataccaacacacttatggctaatcatggactaattaggctcaaaaaattcgtctcgcgatttccatgtaaactgtgcaattattttttatttttatctatatttaatgctctatgcatgtgtctaaagatttgatatgatgtttttggaaaaaaaatatttgggaactaaaccatgccttaatacacatcctacttgaaattcgggttagtgaatttctaggcgtgacatggtcttcctgaataaacaatgcatcagattgtttgcgttaaatcacctccaaagattaagacatggtctttctgaattaacacataagcaggcagtttaatctggactcgaccggcaatgtaaggctcttcttgaaattttgaacagttcacattagtgttaatatatttatgtcagtttgaataagagaagcaaaccaaggatgcagatcagttgagctgacatgtgacgctgagctgtgcaaggccatgtgccagacgctccaataagattaggtccaacttatcaataattagctaggttgttgagttaattaatcctatcttacttagagttataacccaataatcctaaaactcaagtactcgacatgcaaacatgctacttcatcattcactggcaacctaaaacttaatatgcaaacatgccatctcatcatccactagcaataattacatagaaaacttatgcaagcatgcaacatcatctataattcattgaattctacaaatcaacatccaatcatcttcattcacattatttttcataatatttttaacatatatatatatatctatcataattaaagtgcgggatattatatttcatctacaatctcatatagagttactaaatgtattgtatttctctctgaacatagttttataaatcagttttatttgttgttaataactaatataattttttatttttagctcgatatattattaaaaaaattaaaagttatttagaaatttccatagcaaaacgcggggaatcacctagttatttaagttgctcttcccgatggactgccacaacggacttgcctaggaagacttacaatacgatatgactcgaagctttggtagtgtatatagggtctctttggatcccaccctaaaattttacaccctatcacatcgaacgcttgaacacctgcatgaagtattaaatataggctaaaacaataactaattgcaccgattgcgactactttgcgagatgaatcttttaagcctaattgttctatgatttgacaatgtggtgctgcagtaaacatgtgctaatgacagattaattagacttaataaattcgtctcgcggtttactggcggatactgtaattagtttttttattagtgtccgaacaacccatgtgacatcctatataatacccgatgtgatacgccaaactttacacactgatctaaataccccctatacggttgtgactatgttttaagttatagtggctataaatatttcttcctccgatttcataactgtatattttagacaaagacacgatttacaaaaatttctttgactatgatatatataaagtaagtaaatgtttattttattaaaatgattttttaagactaatctatacatcttggtttagtgaatttaaaaatatttaagtcattgatagttaaagttttaattgtttgacctcggaagctgcatggaagacacgtgaggctatgaagaggacagacagctgcaccgaatataagaagtgtttgcggaagctgcatttaaggcaataattagtggttaggtgacgagaggtcccaacacaacacttcaactcttattagttctgaaacttgattctggacttcatctttcagaaagagaaaggcatgaaaattttgagagttttgaggcctcataggattctcacatagatatgcctttgctcttgaagttctttcttcctgaagttctgtttcgtcacagacatgagtaaaagggcgtaagagttatttccagctggcctctagtgtgaacatgcctattcggttttgagaaatttcacaggaatttttaaggaattgaactatttcctacgaaaatcttgtaaaattcatgtattccgaaggaggcttcaacattctagggatggccaagaagtaagcaatacaagttttgctaaccatcatgacatggattgattatccaatatacaccgacaggtatgcaaactaaaccaatcgtgaatcgtctttcctaacatagagttgcaagtttgtattcgtacttctcacttctttttccttctgaagtgagtttcttttttttttcttcttaagtgagttatatctgttggtgatgctcttatggtcaatcttaggattgtaacctatatgttggtgatgctcttatggtcaatcttccagtctagatgttttttttccctggggatttcagtgctaacttgaggtttcctcccatccttagaaggtatataccttcttaccacctatatatggtagttatattttcagctcaagctagctttgcataaatatttccttgcaacacatggtaggagtatttgtgactgcgaattaatacactatacttgttcttatcctataatctcgtcctattgtagaaccagactcaaagtgctagcaattgcaattaatggctgaggctgtgattcttctaaccgtgaagaagattggtgttgccctggggaatgaagcaataaaccaagccacatcatatttcaaaaaatctgtcacacagctgacagagcttcaaggtagcatggggcgcatcaggagggaactccggcttatgcatgagtttttttccggaatggatgttcgtaatcgcaacaaccggaagtatgaaatctgggtggaggaggtgaggatgctagtctatcagatcgaggacattgtggataattacttgcatcttgttggccacaagcatcacattggatggggtacctatctgaagaaaggattcaggagaccaaatgttctgctctctttgaacaagatagcgtcattggttaaggacgtggaggccagtttagtgcacttgttccaggccaaagaacgatgggtgtttatggatgtcggtgcggctactggtggtgaaagctcaagctacattgttgttgagaagtcccggcatctagctagcatttcacgctccctcgatgaagaagatcttgtgggggtggatgaaaacaaaaaaaaactccacgagtggctgtcaagtaatgagttgcaacgtgatgtgatagtggtgcatgggatgggaggtctgggtaaaacagctttggcagcaaatgtacagaagtgaaaaagagaagtttgaatgccatgcctgggtctccatctctcaaacttactccatcaaggccgttctaaaatgtttgatcaatgaactagatgagaaaaagagtattcggggtaacattagcgacatggataccggaggtcttcaagatgaactaaagaaattcttaaaggatcagaaatatttgatcgtattggatgatgtttgggtaccagaagcagtcaatgacttgttcggagcacttgtctcaaatctcagcaggagcagagttcttgtgacaacacgcattgatggtgttgctcaccttgctttcccagacaagaggataacactaaagccgctatcagaacaagaatcatgggaactcttctgtaggacggcttttccaagagacaaagacaatgagtgccccgcagagctgatgacattagcaaaacaaatagttagcaaatgccaagggatacctcttgcaattgtttctgttggaagggttctgtttgtgtgtgaaaagactgaagaggaattcaagcgcatacataaccagcttgactgggagctagtcaacaacccaagccttgaacacgtcaggaatatcctttacttgagctacatctatcttccgacacatctgaaaagttgcttcttgtattgtagtttgtttccggaggactatctttttacaagaaagaggcttgtaagatggtggatagcagaggggttcgtggagaagaggggcataagcacaatggaggaagtggcagaagggtatatcaaggaattggtttacaggaacatgctacagcttgttcagaagaactcatttggtaggatgaaatcattcagaatgcatgatatcttacatgagttggcagttgatttgtgccgaagagagtgtttcggtcattcatacaattccaagaataaacatgaagagtttcttgagaaggatgaacgccggatggtaatacacaaattagacaaggatgttaaccaagccatttcaagtgaatggagcagacttcggtctttcgtcacattggaaagaaatatgtcatcacccaacttgctaactctggtagcgggcaagtgcagatatatgtcagtactagagttaattgggctgcccaaagacaacattccaaatgtcatcggtgatctgtttaacctcaaacatcttagcttgcgggattccatggtgaaattcctcccaaattctattgagaagctttccaacttgatgacactagacctttgtaaatcggaaatacaagagctacctggcgggatagttaagctaaagaaacttcgacacttgtttgctgagaaattgaacggtaagttttggcgagatttccagtggagcactggtgtacgcatccacaggggactggagatgctaagcgagctacagacgctgcaagcactggaggtgcaagatgaacgatctgtgaggagcttaagggagctgaggcagatgagaagcattaggatattgggtgttaagggaaggtactttgaagacctctgcgagtccctatgtcagatggaatatctttccttgttaaacatcgcagcaagtgatgaggaagaggtcctccaattgaatggtctgaagtggttgcatccaaacgttaaaaagctaagattgattgggcgattggcacaaacaggactgctgtcgtgtgcacctgaagcagggagtcactcattgtgttcattatgtctattttggtcacagttagcagaggacccactgccatccctgtctcggtggtcgaatttgacggactttaggctgacgagagcatatctcgttgaacatgtggttttcctcccaggatggttccctaggctcaagacactctatttggtagacatgcctaatctgaagaggctgaagatacaccaaggctccataacaagcctggaggaactacatctaataaacctccgtggcatgacagaggtcccatctgacatcatcttcctcctgcccaccctcaagtatctgtacttcctggagatcacttgggacttcttcatggcgttgcgccgctctagaattggcagtatccgatggcgatacagtctagcttctgatgcgcgcctctgatgcatgaatggatgaggggatgataaatggatagatgcaggccgcgtgcatcgaaccgttaggagtgcctcacctcatcgaccgaccgtggttgcatctgctgcctgcatgcatgtgagcttattcaactcgtattgcctactttattatggcttaatttgctatcgttttaattacaactacgtacctctactactagttcagtggctcagtgcttgcaaaaatatttccattgtgattactagacattcctgtgattgaatctatttcgttcctgcccaagtttaactgtaatattcagtaatagtacaactcacactgtataagcatgcatttaatttctcacacatttatgcagtgtagctagctgttgctagctagtagaaataaaaggaaccaatttttttagagcaattttatattctttgaagaggtaccataagctactaaaaatttagtgtaaaatttagtacctcatagtatcaaggggtaccaaatatagtaccagatcgtatcgtcttctttccctgctttgttcttgttctacggtttgaacgttttaccggaaggagatagagggaaaagtgtaggtatggttgagggttgaataggagactagatcacatggtcgacgatataaatctcttgctggaaataaaatataaatttcaacagaattaaggtaggagtttttacgtattcgttggaataaaatgtaaatgtagaaaaaaatcacataattaggccaataatgtgttataataacacaatgtaaatctagactccaatacaacataaatctataataaaccacgcaaaacagaaaattaaaccctagtgccgtggtaaacgtacaacataaatctacaagaaaccacgcaaaataggaaattaaaccatgcagagagaggttttacaatgttaatgcgtaccgttatacctatgcggtaccttttataatttgggagacaattctaccatttttctctctactagcataatttctactagcaaaattttgtttttacccttagtacctaagtacctatattaatacttaaataccttaacatggtaccggtgattgaggagcgttggatctttacctttttggaatgcaaacaccgtaaaacctctcattgctcaatatacaatagaaaaagggcaaaatttgtcacaggacacgcaaaaaacgtgtaattggctgagagacaccgcgaaaatgtgacacggctcatggacactaaaaaaacgtgtaattggccgtaggacaccggtcgtattattttattatttccgggtaaaaaaaggtgagatatttatctaaatgcctagattgccctttctcttaccttctttaaataccggtgggtcccacatgtcatggatagcgtatgtttaatctaatttttaataggtttttaaccacctgggcccacgagtcatggactaatttattcgtaattagtagggtgattactatttgctaatcataagtggggtccacatctctcttctatcctcttcttcctcacgcacgaggcggagcggaggaacgacgcgacggcccgagccgggacggctcggcgcgcagcggaaaaagcggcggcgctctgctagggtctcaccgccggcgatggcgaggcgcgacggccaccatacgcacggcgcgacggacaggtgcgttgttgtaacaccctgaaaattcgaccaacaaaaatcaaagttccaaaaatatgggccttcaaaaactttttaaataaattgcatcatgccgattttgttcgattattttattggattttgatttcggagtatgttgatcgcgaataaagaatagttaattaggaataaaccctggaagtaaattggtaaaataaatataatttaaaataaatattaggtgtgg

SEQ ID NO: 77520 - DNA, 5752 bp, Oryza sativa
agggagattaaaaaggtctagaaaatttaaaataattagaatttaattatagattaattatagtcgtagaattgcaaagtttcatataaattatggattattgttgggtaatctctataagtaatcgattcacggtagaaattcggatttaattactagggattttagccgtgtaatatatttaatcatttagtcatagactaaattaaatcgtataatatttctaggattttgtccgatttttagctcgcgatagaaatttctaacctattatatggatataatgctcgagtagattaaattaaaaacttatgacaacaaatatttatacccgcaaaatagtttaattcgaaattgggtttgccttagttcgcgaatagtaaagttaatataaaggaattgactttcgcattcgactttcatttggatttatttggatttttatttgaattctaaccgaattcaaatcaattttcgcacgtaactatagagcccgagggagccgcggatctaggtgaaggccaagactcgcaagacctcgagcaaggcaagtcaacactattctttgaacatgttgatcccaattgcgaaattgttttgtttacaaataaaattgcatgcaattatgaacatcctacttgtgattataccatgccttgattattgttcacctttaaatctttgtaaccatagatacgtacgagtccctagtcaactatgacacttgcttagaaatgctattttagattcatgcatactcatatttatcaaatgctatatgcttgggcaattacctttgggaaggtaattgagatgcggcatgtggagacatgagcgccacattgccatgatattgatgacatgatttgtgaaaggaaaataaagtaaaacaactgttttcgactggggcggttggaggacttgggtggtatccggaaaaggctagtgtcgtccctggtcaattaaggaccgagccatgaagttaagcatgaaacgacccccgtacaaccgcacttctcgtatgggtatagacctagcggagtagatagctgagcggaggcagtatccatgcatagtggtttcttgatgtgtgaggcaggggctctacgatggggcagccattggtaggaccgcaaggcgggtgtctacagtggtgtcgccatcggtaggactgccatgtgagaatctaaaacataattataacttaatgcatgtgtgagtcttctcttcccgggtgcgccagaactcctctcactgctagaaaccgtgtacgcctagagtgcatgaggatgaaaagttcatagagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagaatctaaattcttaacttgtgtgggaggggatattgcatgatgaattttatactgttggagccacttcctgagaggcgggaacgtggacgtcctcagaaaaccatgacgaatcaatggcgggaagctatccttgggatcacaatggatggtggacagaaccgtcgttgtttaaatacaaactctggtactaaaatttgatcagtcaatgctaggtcttaggcttgtgaaaagaattacaaaacttgctttgtgcaaaagaactatggccatcctttgaactccccctttcatatgcattgttgctgtggtggcttgttgagtacggttggtactcacccttgcaaatataaaattaatcagaagcgggcgatgaagctacggaggatccctatgcctactaccaggagggagacgaagacgatggtgcccagtaggtcttagtacggtcgttgcctgtggcaatggcatgccgctgcctaaattccactgccttatctaaactctgcttttggttgtattccagaccgctcggtctgatgatttaagacaatgcctgcgggcttatgttgtaataattcgtactagactctcgtatatgagcatttggtattccagctatgaattcgtgtgtaccagactacttgatccagggaaatggtacggtttacacgattgattcctgttataaaaacgggggtccacagtcgtggcggacaggtgcgcggcggcggcgggcagctgctggtgcggctacggcgtcggtggcgcagacttggccaagctctgcggcggcggcggcgttgcagagcggctgcagcagcgggtggtggtggcgagcggctccatcgccattgtgatttgtgcattgcatttgatcgatttgttgccgttgattggtttcttgttgatgtgtgtgcaggtttgaggtggatccatggcgacgggtcggtggagaacaggagctgcagaccgtggcctgcggcggcagcgacggcgccgtggggctcagcttcgagacgcaccacggcggcggcgtggcaccttcgccggagttcgcggcgtgcgcggcgagctcctgcagcgcggaaatcatggtgttgctgctcttgcagcgcggcgagctcctggtgcaccatgaccggccgagccatcaccaccgccgtcgcttcccaacgccgcaaccagccgaagccgccgccgcagttgaagttggatggggatttcaggtactgaggctgagggcattttcgtccttttgaaatttctctctcctctttttcaccgaaaataataaaatattgtctcgggtgtcctacagctaattacacaaattttgtagtatccattggcagtgtcgcgttttttgagtgtcttctagctaattacatgatttttggatatcctgtggcaaattttgtctagaaaaagtggtacctcatggtagctttttaaggacggtaaaattactcaaagctgaagtacagctgatccttgacaaattagcaaagaaagttgctggctgaaaaccaaagatgctatccatctacggcagactttgtttgatcaaaacagtgctcatgtatgcatgtatgtgctcagattcctcaaggtccttgtgtaatcgtcattacaaatgacgtatgggctcgatcgagaactacatgcgtacattttttttaggattagcagcgatagactgcatttatttcttcagactttgggatttaacttgacgggcaccatgagaatgatagtgcagtcgtaaggggtgatggttttaaccccgagatcacgtgtttaattcgttggatggtaaaattactctaaatcctaatgctgcatgtcccctgcctctctgaatggttttcttctacatgcattaatgaatcgactgttgattcttacagttacagtttgccattgaccattgtaattgtaatgcttaaatgcaggagattcagtgatcggtgcctttgtctgcagtttgttcacgagagaaaaaaagagcaaacaatcatgggcactgttcaatccctgaggtaaatcaagtgattcagattgactttgagcatcagcgtcagagagccacagatgaggcaaccttcgccttctattgatcctctgtctgttgcagcgattcagacttgacagtttcagactttcagagtctttttggatgcgtaaatataattaccagcacaagctttcttcgttgctacatgaacgagaacgggctgtgtttcatgctgaattgctggagattcagacattgaacatgtcacgtaacgtacgtcggaagcaacaaggcaaaagaacacgtacgtttcagattgcattggaaagctcttctctgctgcctctagtacgcaatcatggagtagttaactggaggggaacactttgtgcaacaatactagcacaaagccaattcagtaaccgcgtttattaacaaacccaaattatgtatgcatgtttatttattgagttggcaccaaactccaaacatatcgacgaactttacatggaacatgatcaattataactaattaagaagcgtatcgccgttttgattcttgacaccactgggaactgatgctgtgacgttcatacagcagcataccgtaggggtgacgcctggcttgcagtagtattctaatctgtctccgtatatcttcttgcacgtctcgtcagtgcacgctaaatctcctaggtcattgcacgtttgtctagctgcaaaaacgcaattcagttcaaccatccatgattcatgagccactaattgcaaactaaattaaaagaggggggaaaaaggcatatcatgaacccctcaaattatacagagaaaacatattcagtgtagtttggatattttttaaaaaatgcagagtaaaattaatagctttgctgcatacgtgttaatgcatagcaggatgagaaggtggaatctgccacgatcagaagaagcatgaagaaaaccacagagatggaggacaccatcctccttgcaactgccattattaagaagataattaagttctcctcctatatgtatttatgattttccactcttcaagttcactgtgctcgttgccatggccctctgctcatgtttatatatatgcacaaccaacttaatcttggagatgtactgatggtttcttgcatttatgccatctcctgcacaatttattgtttttgttccatttacatattattgttgtagttttagatagattaaacatcccaaatctttacacattttattgttttttccatttacatattattgttgtagttttagatatatgttccaacattaaatgacataacttccttaagaaacattaaatgactttatatcttgtataatttattgctgtcatatcgttctatacatatatttgtatacgacaataatatttttggtggatgtgctaaatctgcaaaacatttgtatatgtacaaatacatgcttgttgccctcaaggttccataaaactgacaaaaaccattcggttttcacgaaatattgaggtttcaaaccagcttgagtaacaaaccgcttggttttcacaaatttttgagatttcgagcctacttgggttgacaaaccgctcaataaacagccaaattgaaaaaaattaaatcaaactagattccactttttttaaaaaaaaatctataactctggttttcacttttttcgcgaacatgtaaaagaattgcacgtcaatatatttgaagaaaaacaatgtttttgttacacaacgcaatgcaaccgcccaggcggccagcccgagggcaaggaaacaagagaattgaaaaaaacaaagactgctagtgtaaagagagcgttgctcctgtatagaggagaagttttacggtatttgcattccagaaatagtaaaaatccaacgctccataataaaaggtatcatacaaaaagtatttaagtattaatataggtacttaggtagaaagggtaaaatgataatttgctagaagatgaaaaatggtagaattgtctatagtattagttgtaggtacataggtaccgcatcagtagttcatcaccaaatatgcggtaagtcatctccatcgcctctaattttccattatattatttgcattgtatttttttatatttgcatattgtcgtgcccttttcccgtggctgtctctaccagttttaattttttttcttagtagcgacaaaataatgaaaatgtagatgagcctatactatgtaaat

SEQ ID NO: 77521 - DNA, 29670 bp, Oryza sativa
ggggggttgcgtctgtgcggcggcgacggcgaggagggtggaggcggtggcatctcccctccctcctagattcggcggcacggaggacgatcgcggcggcagctactggcggtgacggtgaggagggtggaggcggcggggtttgttttgattttcaaagttaatttgtgatgcgtttgatatgattgtaaactactatgatgtttctatgttaatttgtgatggttttgtgaatttgatttggtttgacggggaatgaaaactggattggatggggaatgggaggagaatgagaagctgctagtaccggccgaaacggtggtgggcggtggctgccctttttttttaatgctggaagctattttcgcaggcgaactagttgcccgccgcaggcgtttttttgcaggcggacaatagtccgcctgcgaaaacctgtttagtccggaaaaaaaaaagctttttctagtggtggtaattgaccagccccggaggtggctccaccgttgccttgattcaacaacgaatttcatttgttcttggttctattatcctccatcagacgtgcatcatcgtatttgtaaattatgacgaaaacgtatcaatggctcaatgccaccaaacaaaactctagatcccatcagcgcgtcccctctcatcgcaattctcttaccccctcttattctctctggctagattttagtactgcgacatcatcaaataactctccctctctccttctgcgccacgacctcgctcggccgtctgtggaccatgttctgtgttcctcaactttcttgcattttcttctcttctcaatcatattcaatgtggaaggtcgtgctaaatggatataaggcactaaaatggacagtgagtgaaaattgatgttatgccccaccagtccctttcaattgggtgtgagagagtttttttttactacaaaacattagtatatgttaaacctaccttgctatatttatggcaccatattttttaacaaaaaatagtcggcatatatttacattgtaagttactaaattacatgtaattttagtatatttacaatgtaagtctcaaaatttataggtgtaattattgtgtaagtgaggtgtaagtgtggtgtaattggtgtgtaagtgtgatgtatgtgaggtgtagatctgtataaaaatacaattagagaaacaaagtcatccattgctcttaaccaacgtgagcttttgcttcagatagcggcagccatgcttggcttgggtaacgagcaagtaaagcacagcgaggagaggaccaactggtgccgaccatctgtgtccaaggttggaaatctcgatcatttcggttacttccgatacgatattacttcagtcgaattttttttaactttttcataaattttggtaatatttattcaaattcaactaaattttgttcaaaattttggaccgaaattttggtatttcgatgaggcccgatcaaatcggcctaaccgataggattaaccctgtctgtgtcagcctcggtcaacagcacgcatctgagcgtcaatttaatgggtctcgtaccacttcggtcgatagcacatatcttaacacaaagatccaacgcaccaaaatttgactgaaatcacgtaaaaaagatgccgacataattttagcaaagctgtatatatatttaaagaaacatagtataaaaataaagctcatatacacgtgcgcacacatgcacaccctatatccctatccctataagaatctccgtatgactattggggtggatcgaatatcccattgtcacgcacgggcaatatggctagtaaaaagaataattaaatcctataaaaaaagaataattaaacaaatcaatttgctcacccccggctctcacacacgtacatgggcctttggttcatccacaacatgtctcatatataccagcgacaggtaggccgcctcggcacaggcaaataccaggaagatcaagaggaaaacccattccaacgatgcagcaggaagcatcatcgaaatacggagcagaaaggagacgagaacgaacgccacggccatcaccattcccctcttctgcaccttggttacggcgagtttacgggcggccggtgccaggatggagaagatggagagagcgaggctcgtgagcaggccgaggcaaatcaatgccaggtttacactataaagtgcgccgccggcgggcaatcgcggcggcggcggtgtcgtcgtcggtgctttgcccgccgccgtgaggttggcgaagagcagaagcgacgccgacgccgcgaagagggacaccgtctgcacgctcttggaaacgcgcttcgcgtcggcgtcggcgtcgtcgtcgtcgcgcgccacctggtgatcaccagctgcggctgcctcgatgtctagcgctttattgccgctggatgtggccgtcgctgctgcgcgtgcctgtggacgagatgcggacgaggatgatgatgcccggcccctgcttcgttcagcttggtctggttcccgaaggagacgaagaagctgatgacgacgcagagcctgcagctagcgtaggttattcgagaggaaattgaaagctagcatagcttggtccggactttttagctgcgtgcctataaacagaggtcggagatgtaacccatttccattatctaaaaaaagagacaattgaaaacgtaagatcggaaaaatgatacacccatatatagaggggtgtgtagccagaatttcttaagcttagagctaaactaatctttatcttacatattctgaggttttaaaatgtaatttgtaatggatatataggctcaggagtcaggagcaggactaccctactcctgtttcctccactgcatatatatcacttatccatgacaataagactggttcttctgtatatatgatgggagtatatatcacatatccatggcagcaaggccggtcctgaacatacggggcctaggcgagataaaattcgaggctctgtatttgaatgtatgtatgcactaataatggttttattctagtggaaaaagtattgcttcatgaaacttgaactgcatatgctaatcatgggaatattatagttccttaattaaaattttctgaggaaaatataacacactagcttagctaaaaggaaaaaagagctgtagatcatgttagtgtatgacattagctaaagacagcattttcgcacgaataattaatagtataagatttggtaggagtaactaaagaacaaaggcacacctggatgctcatggttatgtagaaatcaaaatagtacaaagaagaatatgtacctagaagccaaatcctcaatcttaaataatctgtgagagaagtaacaaatattacaaagaaaaaaaggtgcattaccttgagaaaattagtgcagaggagaattacaagaaacttttggatcgaatctctggggttggtcttaccttggagaattattaaccatgaagataagaaggaattactggtgttgatcgtgcaaaattgacagaacaaaaggcccttcaacggaaacgcgggtggaaaggaagtattgacccatctcccaacatgaacgcttcttaaaaacaaaatatatagaaaaaaaaatggagcttctttgcgacgggagagttaaattattcatatgatctttttctttttgtgtcataaattggataaggggttgcgatcgcatggacgacgtaccatacgccgttgaagtcgtcggagcctcgtagcaagggcgagaggcgcagcaccgccgggacggggttcagcagcgccgaccgcagcgctccggcctccggcgcgccgcgatggattgatgcccgtcgtgttgggcatcttcggcgacgaccctgagatggcgggtgacgatgagctggccatggatcgagtcatcgaaacgcgcagcaggtgtgtgcgggtctagggaagggatgctttggcctttttatagaagcagtactctgctctctctgtgttccttctgaagtccgcgcgccgtttcgtctctttctgaggtactccgggactgctcatattgcagtcaaaataaatcttaccaattttagtaagatggtactattgttaaaattttaacaggatttcttatgtatttattaaatttggcaacaaagtaaacgcagacatttttttgaaaactttaaaaaaatggtatggttgaaaatgacatcaatctgaacagcccctccctccgtttcgtctgattttttttatcaaatattttgaagtttgattaagcttatagtaaaatatagtaacatttttaacacaaaataaatattgtatcaaaaatatattcaatgttaaattgtagtaaaatacagtagcatttttaatataaaataaatattacatccctaaaaatatattcaatgttaaatttaatgatactaattaaatatcatagatgttactattttttctataaacttaatcaaatctaaaatttttaactaattaaaaaaatctgacaacttctaatataaaacggatatagtatttataaggaaaaaagaatgctaagagacacgtagacacagctgggtcccaaaaaaccgatgtacacactgcaatcacactcagaaaaatcgatgcacatcttacatcgatttatggatatcatatatgagagcagctccagtgtcaacccaaaatcgatttcggtcagcaccaaaaaccgaaccgtgcacattgtggggggcgaccagggtttgttttaccgccaaccgcacggttaccgtggttaccgggcttaccgcggggtacggtaatataaatgccacggtaacctccttaaatttaaataaattgaaaaaataatttaaatttttgataaattttatacggtttttcacggttaccgcggttatcacgtggtaaccctggctctggcagtttgggaaacttgtgggcgactggttcgtgtcagatgaaaaatcgagttcaaacgagaggtcgaacacagaccataaaaaaatatttgttgctaccggatgtgagagcgagaggaaaggtgagatcgagtttattttttctgtgggtcccagaaacatcaaactgtgagacataataatcgaatcataccactgcagccaccgaaccctgttgtctgacaaccaggagccaactcaggtcgagttagttctaaaatttttcttccaacttttaacttttctatcacatcacaacttttctatacacataaacttttagctttttcatcgcatcgttctaattttaaccaaatttttaattttgatgtaaactaaacatatctcggttcgaaccaatcaaataaaaatatacttcctccgtcccagaatatagcaacttatgatgggtctcccatatggaatactaccatatggaataaataagtattatctatctctaattatctctcttttcctaatattacattgtatctttatacattatagcacatgtatgtaggtctaatctatatggtttactttgggggggcctaatgggcgatcgatcgccaggggatcgcccaagcgatcagatccgccccctcccctatactactcgatacactcctccctcctctccccccttcgtcctccccttcttctctttctactacagtacaccacataaaaaaattttaaaaaacaaaaagttaaaaaaatttatgtatagaaatactatatataaaaaatttgaattcaaattcaaatttgaatcgggtatgtaaacttttgacttataaactttgggtctatagactttaggtgtataaactttagatgtatagaaatactatatatagaaaatatttgaattcaaattcaaatttgaatcggatataattcaaattcaaatttgaatcgggtatgtaaacttttgacttataaactttgggtctataaactttaggtgtataaactatagatgcgtaaaaatactatatatagaaaatatttgaattcaaattcaaatttgagtcagatataatttaaattcaaatatgaatcgggtatgtaaacttttgacttataaactttgtgtttataaactttaggtctataaactttagatgtatagaaatactatatataaaaaaatatttgaatcggatatataaacttttgacttataaactttgggtctctaaactttaaatgtgtaaacttgaagtgtataaactttagatgtgtaaacttgaggtgtataaactttaggtatataaatttactaaaataggaaagtaatacggtgccaaaaaaggaaaccaggtggatggagagagggggattgattgctacccctgtccccaggcgatcgatcgccgattaacacttccggtttacttttactatatatatattggtgatgctctacttcttacatcctactaaatataagagattttgaacggataagatgctctgtttagattcgtagtagtagaaggtatcttatctgttcaaaataacttatattttaggacggagaaaataaatgtatcagcatgcaagggaacccctataaccctctaggggcatccacaatgtggtgaaaaattcagccagctagttctattgtgcacctagtccatatgaaaaaaaatatacacataaactacctatatgaaataaataatattatctatctctacttctcttttcttctagtgttatcttgtagtatctatatacattgtagaaattgctattgttaaagtttatatatatgcgatctcatctatataagatcattttttgcattaacgatgtccttaccgtccgattgctccatcaaaatacctctcatctgggtgagggtggtcgtgtgtcagataatgcgatttgaatattcgagcacacagcgtaaactattcgagctctactgcctctataaatttttatcagcatgagggacggagccacagatcatccgaacttaccgaagaaaactctattaaatttttatgttgttgaattaattgatgataaattttttttagtaaatactaattatagtgaagtttgcacatattcaaatatccactgtctacacagtacgtactaggcataacgaaattaatcggcctcgttgccaacccaaccgatggaacatggaagtacacggtttgctacgcgctcttgcttttttttttattcttttggttgcagagcccgtccgtctttccccatctctgtttggttcggtacttcggttgctaaagtggatgcgcggcacgccggcacacgacacattgcttcgcgtcgcgtgcaactgcacacgagggaccgcgttaaactcactggccattgttgaccaagggtgagtttgagaggaggggaaaagagaagattgggaagatacgtaaaacgaggtgagccattaacatatgattaattgagtataaactattttaaattttaaaaatggattaatatgattttttaaagcaattttcgtatataaattttttgcaaaaaacacaccgtttagtagttagggaagcgtgcgtgcggaaaacgaaacaatctaactcacaaactcctcctgccgaacgctccccaaatgttcatcaggtttcatttaggttaataaaatatatctacacatatcataatttttaggattagaaaccagtattaagaaagtaggtataattaaataggataatgttatgattggttgaaaagtgaagacatgtgagaaaatgaatggtacatggtcataattgtagagaagagaacgttggtgaaaaagctattatattttaagacaaatcttatgagctagaagttgttatattttggagttgttatattttggaacggagagagtatataagtaaaaactagcatggtgaccgacgcaatttacgcggctagcatctttatatttttttcctcacatattagcatatatattttcactttttaattttgaattttagttctttctaagtggtatttttatatagattcgaacctctactcgtagtttccttattatttaattgcgaatttcaattagctctaaattctatacttttatggacatctactatttcaatattctttattttttaaatttgtaatttaaattatttttaaattatatttctatatggactttattttctttttttctatgaatatgagaatttctatgacgagagaaagagagtgaatgtggaagttttttttctgttactttaataagttgatagattagaatcgtgcatattaacatcattgttggcggatggcatgaggcccttcgactaaatctgccgaaacccgtggcgaaggctatggagtaagaacggcgtgaggcgaagagtcgtacgagtgccttgccaggccagaggcgtttcaggcgaagggtgcaaggcgaagactacctgccgaaggaagacgacttcgccatggcaagttcgcccccgcgagggccgaggaagcctttccggcccatcaagcctaagggctatagggccggcgatcgctagacgacccatcaggggcccatgagcccctgtaacattatgtacccctataaatgtccctttcgtaagggtaatcatgtaaattcccctgtacaacctaaaccctagtagcaagaacctgtaatagggctataaatagtcccctagggccatgtaatggggggatccccaagtgaaattcgaaatttaatacacttagtttttccaaccactgttgagtaaccacgtctttcgatgtatgcggttgtcgtttcgacaacagctggcgccgaccgtggggacctccgagcgaaaccactaagagcgaatgccaccgaagagggtcgtgaaggagaaggttaccaggcggaaggaaagcgacgccggaccggacatggccgccgaggaaggagcagagccttcggcgcccgtggctgaagatggaggaggacaagcgccatcacaaccgccttcggcccctgcaacctctatgcaagtgccgaacgcggtcgacgtggtgaaggcggctgcggcggcaagggcactccagaccagggcggagatcctttcgacaagccaaccggtggtgccccaagccactccatcgcagccggcagtggccccaattgcgctcgccgttgtgcaggcccaagtcagccctgaccccgaagcacaagccgaagccgacatggaagccatgcgacagaacatgacacggctccaagacatgcttcgccaaatgcaaaaacaacaacaagcatacgaggcggcaagacggaccaaggccacgtcggctccaatccttcagtattcggcaggttatgtcccacctcaagtccatccgcaagtgacgacccagccctttccgccacaagccgctcaagcgccggtgtacttcgccgggcagcaaccggccgtagctgtgcatctggcccctcacgtgcaactgcaagctcaactagtcgctgcccaagtacaccatcaaccacctggccaagcgccacaaacagtggtggaaggggcttcggctctgcaggcgcaactccaagctttccttcagcgactcaaccaaccccactgcatttcaactacaaccccatcggcccacccggaggggaatacaagtcaaggtacgcctaattggttgccactgattcagccgggcctgggagtttcgccgtggaatcaaggaccgcagttcgacttcgtcaacgctgctcaagcgccaaccgttcggcagcaagctccgactccaggcttcggaacaaaccaagcaccaatccaagctgccatgacgtggtcacagccgatttttgacccatccatggcggctcaacaagtacctccagttggtgccgggcagccgaatgccatggcccaacctcacgcacaagctacgatttcgcccttcgccacaccgtacccgcagcaaggtgcggtaaacagggcgggaggcgaaaaggggctaccgctgagtgggggaatcaagactcgtccaatcccaccccagttcaagtttccacccgtaccgcgctattcgggcgaaaccgacccgaaggagttcctctccatctatgagtcagcgatcgaagcggctcatggtgacgaaaataccaaggcaacggtaatacatctcgctctagacggcatcgcccgttcttggtatttcaatttaccagccaatagcatttactcatgggagcaattgcgcgatgtttttgtccttaactttcgaggcacctatgaggagccgaagacgcagcaacacctcctcgtcattcgccaaaggccgggggagtcgataagggagtacatgcgtcgcttctcgcaagcccggtgccaagttcaagacataaccgaggcgtcggttataaacgccgcatcggccggtctgctcgagggcaaactcacaagaaaaatcgccaacaaggagccacagacgctcgagcacctacttcgcatcattgacgggttcgcaaggggcgaggaggattccaagcgacgacaagctatacaagctgagtacgacaaagcctccctcgtcgctgctcaagctaaagcacaagttcaagttgccaaaccacctcccctctctgttcgccagtctcagccggcgatcaaaggatagccgccaaggcaaggccaggcccccataacttggagaaagttcagaacagaccgtgcgggcaaagctgtgatggtggtcgaagaagtgcaagccctccgcaaggagttcgatgcccagcaagcgagcaaccatcagcagccagctcgcaagaaggtccgaaaagacctctactgcgcctttcacggacgctcttcgcacaccacggagcaatgctgaaacattaggcaatgtggcaacgcgcaagacccaaggccgcagcagggaacaactgtcgaagcaccctgcgaagcagttcatgagcaaacacccccagccgaacaacgccaagatgtacagcaaagggtaatccaagtgattacaagagctgacccgccaagccagttgtccaaacggcagaagaagatgcagacccgtatggtccacagcatcacttcggcgggtgaaggggcgccgcagtatctgaaccaactaatttcttttgggccggaagacgcagaaggagttatgttcctgcatcaagatcccctggtaatctcagctgagatagctggtttcgaagtccgatgaattctggtcaacggagggagttcggccaatgttatcttcgccgaagcatacgccaagatagggttgcctacccaagcccttaccccagcaccagcatcgctccgcggtttcggcggcgaagcagttcaagttctcggccaagcacttttgctgatagcctttggcttgagggagaacagacgcgaagagcaaatactgttcgacgtcgtcgacatcccgtataactacaacgccatcttcggccgtgcaaccctgaacaagttcgaagccatttcccaccacaattatctcaagctcaagatgcccggcccgacaggggtgatagtagtcaaggggcttcagccttcggccgcttcaaaaggcgatctagccataatcaacagagcagtgcacagtgttgagaccgaactgcatgaacggccgaagcacacgccaaagcccacccctcacggcaagataccaaaatgcagattgatgatgccgaccccacgaagctcgtatcactggggggcgacatgggcgaagaggaagttgagagtatcctagaggtgctcaaaaagaacatcgatatcttcgcctggagccctgacgaggtggggggtgtcccggcggatctcatgatgcatcacctagcagtcaacccggacattaagctaagaaaacaaaagttgcgcaagatgtctgccgatcgccaagaagcggcgaaagccgaagtacaaaaattgctcagggcgggggttatctaagagattgaccatctggagtggttggtgaatctagtgctggtgcggaagtcgaacgacaaatggcgcatgtgtgtcgatttcacagacctgaacaaagcgtgtccaaaagacgacttccccttgccgcgaatcgaccagctcgtggattcaacagctggatgcgagctcatgagtttcctggatgcatattccggttaccaccagatccacatgaacccgctcgacatccccaaaacatccttcatcactccattcggcacattttgtcacctcaggatgcctttcggcttaaggaacgcaggagcaactttcgccaggctggtgtacaaggtccttggcaagaagttggggcggaatgtggaagcttacgtcgacgacatcgtcgtaaaaagccgcaaggctttcgaccatgcgatcgacctacataagacattcgacagcttgcgcgcggcaggcataaagctgaatccggagaagtgcgttttcggcgtccgcgcaggcaagttgttgggtttccttgtttccgaaagaggcatcgaagcgaatcccgagaaaatcgatgccatccagcaaatgaagcctccgtcaagcgtacatgaagtacaaaagcttgcaggccgaattgcggcactcagtcgattcctctcaaaggcggccgaaagaggtttgcccttcttcaagaccctccggggcgcgggaaagtttaattggacaccagagtgccaagcagcattcgacgagctaaagcaatacttgcaaagcccgccagttctgataagcccacccccaggaagcgaactgctattatacttagcagcttcgccggtggcggtcagtgctgcactcgtccaagaaacagagttcggacagaaaccggtctacttcgtctccgaagcactgcaaggagcgaagacaagatacactgaaatggaaaagctcgcttacgccctagtgatggcttcgcgcaagcttaagcactacttccaggcccacaaagtcatagtgccatcacagtaccccttgggcgaaatactctgaggcaaggaggtcactggccggctcagcaagtgggcggcagagctatccccgttcgacttacattttgttgcacgctctgccatcaagtctcaagtgctagccgacttcgtagccgaatggacaccggtacttgcccccgaccccgagcccgccgaacaattctgggtgatgtgctctgacggctcgtggtcgcacaagggagcaggcattgcggcagttctattttcgccgaatggtgtgccgatttggtacgcagcaagactgcagttcgacacaaccaacaacgcagcagaatacgaagccattctcctgggcctaagaaaggcgaaagcactgggagtccggcgcctgctaattcgaactgactccaagttggtagcaggccatgttgacaaatccttcgaggcaaaagaagagggaatgaagaggtatctggaggctgttcggtccatggaaaaatgcttcaccggcataacggttgaacacttgcctagagaccagaacgaggaagtagacgccttggcgaaatccgctgcttgtggtggcccacattcgcctggcatctttttcgaagtcctacatgctccaagtgtgccgatggacagctccgaagtcatggcaatcgaccaggagaaactgggcaaagacccatatgactggcgaaccccatttgtgaaacaccttgaaactggctggcttccggtagacgaagcagaagcgaagcgtttacaactcagagccacgaagtataagatggtctcgggtcagctttaccgctccggggtacttcaacctttacttccttgcatctcttttgccgaaggcgaagaaatggcaaaagagatacaccaggggctatgtggcacgcaccaggctgcaagaacagtggcctccaaagtatttacacaaggagtttattggcccactgtgttgaaagtctgtgttgagcaagtaaagaagtgcgaaagttgccagcgtcatggctgaagccaagccgcgccccagtatgatctgtagcccattgcgccaatatggcccttcgccagatggggactggacatcatcgggccgttcccggtggcgcgaaacgggtataaattcgcaattgtagctgtggaatctttctctcgatggattgaagccgaaccccttggggcaatcacttcggcagcagtacagaagtttgtatggaaaaacatcgtttgtcgtttcgaagtaccaaaagagttcattaccgacaacggcaagcagtttgactctgataagttcagagaaatgtgcgaagggcttaacctggaaatcaggttcgcgtcggtcgcacacccgcagtagaatggggcggccgaacgtacaaatggcaagatcctagaagcactaaagaaaagactcgagggggcagcgaaaggcaaatggccagaggaattgctatcggttctctgggccctttggacgacccccacaagacctaccaagtttagtccgtttatgcttctttatggcgatgaggcaatgacccccagcagagctaggggctaactcaccaagggtgatgttctctgggggcgaagagggacgtgaagtatcgctcgaactcttggaaggagtaagagtcgaagtgcttgagcacatgcacaagtacgccacaagcacttcggcaacttacaacaaaaaagttcgacccacggagctgatgcccggtcatctcgtcctaaggaagaaggcgaacccagtagcggttggcaagcttgaatcaaagtgggaaggaccatacctcatcaaacacaagtccaggacgggatcttttcgcctagcgacactcgaaggcgaggagttcgaccattcctggaacgccgcctctctcaagcgcttctatgtctagaatgggtgtcacccaaatcgccaaattgtaaaaatgtacatactgtcatgtaagcccttcggcactatgtaagcccttcggcactatgaaagcctttcggcaagaaaaaaaaagaaaaaaagaagaagaaagagagaaaaaagaaaaaagaaaactggatgtagggctattatccaacatggaggcccgaaccagtataaaatctctgtgtcctccgccttctttttatttttcgtgtgattgataatttgtggaaaaacctcaaggcaaacgcctgatcagcgaaaaaggccaggggggcgaaacgaatcggccaaagcattgctcgccgaacgttgaaaccgcaacagcttgtctcggaaaataaatagccgaacgacgttacgtccaatcagcataaaagctacagatcaaaaacgaacgacgaaaagctgaaaagtcagtacacctatttcgctaatatatgcaaaggggccggcatgttccgacctaacaaaagcacaaaaagtgacgatgcaaacaatagcgaaaaggaaataaaacacgtctttattaacttcgaaaaaaaataatcgaagaatagaagtttcacaacacgatacaattcaagtaaattacatcttcatccccataatcactatccctccctaaggaatgataaggcgaactaggttcgtcatcactactaatattgtacacaaccttaagaggagtagggggcgaaacacagactaaactgtaacgacgctgaaagatcgtttcctgacgtttagtcttctgatggtttcgccaaaagcgagccatatcctccaaacgtcttgaatgaacaaggtcgtaatcttctaaggttcgcccggggtgcgcccgcagccagtcggcaaccttgaaaaccttatagctgcgaccgtttatctccatttcgcaataaataggccgaaatggacatcgcaccttcggcaggtccttcaatgccacaaatttctcgttttgacttcgccagctcccggaagggggccgaatgcacaactttcggcgaaccccctgatagacagcgcagaaaaagcaaaacacagcttacatagtaagaataggcggaagaagggggaggtatggcataatgcgagatgagcgaaaaaaataatatgccaaagacctcgatcatcaaaaagcaattaagattgtgtcatatattccaaatgtacaaaaaaaccttttttaaggttcagcggcagcctgctgaatgtacatcattcgcctctccaggcaaacgcaaaagagggaggaaaactacaaaaatccaaggaaagggcggagggcctcacacctctgggtgatcctgggcatcgcctccagcctcttcgcctgccgcgccctctccttcgccccgatctgccgcctccgccttcgtcagttgctccagaaggcgcgctttggcagcggaccggccatccttctgccagaactgttttcgccacgcgcgaagagcgggcgaaatgttctgcgcactaatctcccagtcccccttcgcataggtagggaactcggcgacgtgctcgcagccgaactgttgcaaaaggcctaaggtaaaggccgccgatacgcgcgcacagcaattgccgtacgtggtggcacagtccgaaaccgatccgccagcctgctgggtccactcagagaagtcgaaggctgaggcatactcggcagggaccccccgcaccttcgcgcccatgtcggtaagggcgaggcggagcgtttggcaagccgttctcgtggattcggcggtgttcgccatctcccgtgaaaaccgctgcgactcctccgcggcgctcgcttcgaccctgctagccttctggcgaagagcctccatcttcggctcagtaaggttgtagtaatcgatgagcaccgccgaatggtccttctccttctccagttcggccttgaggcgatcaacctcggcccaggcctctttccccttgtccaattcggaatgaggcgtttgacttcagttttcgcctccttgagggtatgggccagggactccacctccaggttcttacggcttatttcatcatccttggctcgaagacggctcttaaaaccgtcaaaacgggcccgcacggttcgctctgtcgaacagtgagccgcaagaatctagatgaaagataggagcgggcgaaaagaacaaaaggttaattgcgagacgtaaaaaaaaagagagggaagaggaaaacgaagaaagaagaaaaggcatacccgaaccgccaaacttttaatggtggaacacccctcgtcgaactcgttaagttcggtgaacaggctcggggtgccgacgggcaagacaagattgcttactccctccacaaagagaataaggtctgcccgggtctcgaagtcaccaggggcgaagtggggcgccgcaagggaatactccgaggcagatgcttcgacggccgtacacttccctttcgccttgaccagcggcgaaatggctggctcgcgcacagggctcccgaaaaccctcgccacagccgacacgatccgttcggcggaggtggcagcttcggcggcggcgctaccgcctgccccagcaacgccgagcagagcaaggggagcagtcgaaaggtccaaactgcggccagcaggtgaagtcggagtctcgacagaagactcgtcgtcgctgaaaacgcgagcgatgtcgacgagtcccttcttctttgagatcttcttgaccagacctcctttcgccgccttgcccgacgagaacgcaactagggccttcgccccttccaaatcctttcggcgaaggggagagctgttcgactccaccccggtctcgttgtgacctggacttggggtaggagtgtagccgggggtgttgacgcggtcttctatcgccttgttcgcggccttatcagccacagcctccacctcctcttcttcctctccttcctcctcccgtcacgttcttcggcatcatcctcgtcgtcggcgtcggagtccgacgaagcaggaacccttcgcttcctgggggcaagcttcacttgtccacgcatccgctttcgcgaaggccctacatcgtcgtcggctttttggggattcgcccggggaggcagttcgccgttgtaaacccggttcgcccgcccagctgcttgtcgtgttagcagctggctatactcgacgaccgaaacgtcgccgatcatcctgcgggctttggcttcagcctggtcgagggtcgacactgcaaaagtaaagggtgtagctgcgttaaaggtcagacaaggcaaaataacaaagcacaggagtgtatagcaaaagaacggtcttactgttcgtcccctcaggaagaaccaagttcggcaaaccgttagcctcttcgcattgctcgaccgtgacttgccatgactgggagaggggaaagatgcgaagcatacagaactcctccaccaagtcacggcagctaaggcgggagcaaaccttgcgcagcaggacgaaccgcgcctccatagccccgtccacggcgatcttgggtttccggttcggcgcaatcgccctacgccggcaccgaagagcttttgccgagtcagaaccagccgcgaaggggatggtgtgatagaaccacctcgccatccaatggcggtcccacttcgacatggcagcgttcaccggccagagatcagaccgctcggggcgaacgttaaagttcatgctcccgaacactgtcttcttcgttccagccggggtaatcaccgtcttcgagttcatgatggcgaaaaatatggcgtcgaagagctcggcgctggactcaaacccggaagtccggcacgcccagtcaaagatggagatccgaactagcgccgatgggctcaactgcggaagctccacctggaaaaggcgaaggatctccggcaacaacacgttgcacggaaactgtagccccgcctcaaaaaagacggcgaacaccaccgtccgattgtcgacaagcttcggcaccacggctttccccggggcgaaagcctgcccctcaaccaacgccccagagctgaccaacttcgccagttcgacgtcgtccacgagagaaacccccaaaaaggcggtgctgtcatcatcgacccggccgggatccggtccttttgccgaagctgggtttggcttgcgaggggccatggcaaacggcgtgtatgcagtggcgaaggaagataatgggtgaaacacctgaggggtcaagaaatgctgtggaagaggggaacagaagaagagagcgcacgcagtaaaaatggcaagtgtaccagtgaaaagaaaagaggggtgggaatatatagctcacccgagcgaccgttcgcctacccaccagtaataaagcgccacgtgtcgcaaggataggcgaaacggtaaattcccaccgtctgagcagcacagtaaaaagcccacgatgggaaggcccaatactgtttcgttcggcccgagaaaagaaaatatatataaccaccaatcgcaggaggcgaagcgcggcaaaataataccagccgcacaagtaacaaacttcattcgtaggaataatgtaggtttcggcaggagcatcggtcgaaagggggcgccgcataccataccacatggtttgcacggtctcggccgaagctccaatctcacccttgcccgtgaggggcttgttggcggatggcatgaggcccttcgactaaatctgccgaaacccgtggcgaaggctatggagcaagaacggcgtgaggcgaagagtcgtacgagtgccttgccaggccagaggcgtctcaggcgaagggtgcaaggcgaagactacctgccgaaggaagacgacttcgccatggcaagttcgcccccgcgagggccgaggaagcctttccggcccatcaagcctaagggctatagggccggcgatcgccagatggcccatcaggggcccatgagcccctataacattatgtacccctgtaaatgtccctttcgtaagggtaatcatgtaaattcccctgtacaacctaaaccctagtagcaagaacctgtaatggggctataaatagtcccctagggccatgtaatggggggatccccaagtgaaattcgaaatttaatacacttattgagtaaccacgtctttcgacgtatgcggttgtcgtttcgacaacaatcatgatcacgaatggcccttcttaacaaagaagttctttaattaaattagtaaactcgtggagtatggactaaaaagttgggcagcaaaacatgggagtgtgttgtagttcaagcttagtgttgtagttcaagctgagctaggcgcctaggtgaggtccgtgcaattctctacattgcatatcttgcagtcgcgacatgcgaagcatgatatttctttcaaataagtgtcactgagagggatgaaaatccacattcctttaaaaaaggaaagtgatttcatccctcaatgggatatccactcgtttcgtgcatgtctcctaaatatttataaaaaaataaaaaaaattgacaacatagattaatataaaatatatcactacacaaacatagaagaccaaattcaacttctacaagttacaacaaaaagaataaattaagctgaaaatagttatcgtacattcacaactatatttgttatttttgttataacttgtagaatttgaatgtaaacttgtaagtttgtggagtgatatattttatattaatctatgttgtcaattttttaaaaaaaatttaataactatttagatgacatgcaaacaaccagggaatgtccctttgagagatgaaaatccacatatccctctcagaagtatacattatttgttgcgaaatctatatctatatacctaataaaaaatacttaaggttttcgttgtattttttccttcggtgtttggttctgattcctatttcgtcgctgatccgggcaatacaaaattgggacacacgtgaccaaaaaaaaaaaaaggaaagctagctagcaactagctaaagcagcagtaggccagcccagcaaaaagcactcggagcccagcagcaagccaacatagcccctgtttggagaactagtctagagttattttaagagttattttttagcacaagaaaatagtcctccaataaaatagccctaagttgtttggatccaagggctattttgaaagctatttggcttttaatgtaccttctcatggagagagatagagataaaagacactttttcagtgggccgcacctgaaatagccccaattagcaccctttgggtgggatagttttttttgggtgggctatttccaaatagccttcaaatagctcacccttttggatctttttgagctattttgactatttgagggagggctaaaaaatatcctttggatccaaacaggaccatagcagaggagcagtagcccaacacagtactgcacgacactgtagcaacttaggaattttttacattcttttattaaaatatttaaaaaataattttttttcaaaattttacaaatctaaatgcctctcgctctttgggagggcgtttttaaaaatcgcccttccaaagggcattaagggacctaaatgcaatttttttatttgagttcaaacccttcctttttagtgttttaattgcttaaaaagttttttttgacggcaggcaaataaacttaaaaactaattaataatgcttattcgacactctagataatgttaaatagaaaattaataaactctaaaattgtagatctcattgagatctataacttttatataaagttctagaataccctatatagtttgctatatattggaacggatggagcattttacgtgtgttcttttggagtattttgcctccttaagtaaaacaaagagacggattaatatatgattaattaaataatagcttaaaaattaaaaaaataattaatatgattttttacagtaacattttataaaatatttttaaaaaacgcattgttgtgtagtttggaaaacgtgcgtgacaagaggaagtgaattgggaactatgagttaaaaaagaacacagccgaattcatcgtcttcctctcgatcggctggcgagcgaacggacgtgtgaggcggcagcatgatgctgacgatgaccttcgtagccccgataatcgccgccgccgcagccgccacgcctgtgccatcggccaatcgtcgccgtcgtctaagccgccgccgccaccaacgccaccgccgtggcgccacccgtcgggtcagagatgaacaaggaggaggagggcaacgtacgtcggtgaccattcaccggccgtcccacgccgccgccggatgttgggcgagaagataccgctcactcctggagaaaaccagtaaaacaaaattttcatctcccacgtcctgttctaccgggcacactcgtcctgcgtcttcttcatgtgtctcgtcttctgaaccatcttcttccgccgacgatgtgccctcccggccggactgggcccaacgcacctctcttcccgacggggccttccattgtttcgccctacatccaaggagaaaatggtcgatgaaaaaccatagaaactattggcgaacccataaaacaattcatcctttcttccattgttctagatctactagttcttctcggctgcaactgcaatgtgggtgtggatggaacgaaggaagccgaatctcttacctggggtggggtgggcagcgccgtcgcggagcgccgggatacgtcgttctccaccggcggcaacccgtcggcgcttcttgttcggtttggcacggccgcggaacgtccggtggaatggggaaagtggaagtgaaaggggtagggaccgtcgggagcacaaccttgctggcttggtggagtgggctccacgcgtggggccaggccagtgtatttctcgtatgcgctggggaaagtatggaatacagcagatattcgctgatatacctcgtccgtatagagtgtacgcacgaatcttggagccatctaatggcggtgagcctaggtgcagctgcacctaggttcagaaaagactttcccgctcactcctttcttgtctcaagcgcggcagcatgaatattgaatgcttcacttagttttgtgtagctaccagcatactcagacaagggcattcatgcatgcatgcagagcaagatggtcttatagcaaaatggatatatatattatgcactgcatgttatatactgcaaattaatctgatcattatgtaataatcattttctgcgagggcgctaaccctacaaattcagtgtgtttgccatactaatccattcagttctgaatgaatggatccttgcaaataataaaaagaaaatcctgaataatgacagggcacaagtgttcttttgttgtaattcagcctttgaagttcacatatgactgggggaagcatcagtgatgtggtggtgaatttgtggatgcatgactccaccaaccagggtacaaatcctgatgcccacgaatattacacatatgtagatgggctttcaataggattttagtgaaatcagggatgtgcgctggttttcgtctcttagagcatgtgtgaggggacgtattcgcgggggtgtgagtgtggtgttgcgtgtatagtggagtgtgtgtgcatctgctgtgtaatctcaaaaagaaaaaaaaaagttcacatatgactggagtttgagctgccgtgttgtaattctaagagattcagagctactatagttattagtattactctctattccgcataatgggtcagaataattttcatttcacaggtttcgcaaaataaacctccagtgttattggattcaagaactgccactattgcagtgtgtggcataaattagatgacccttcaaaattgcattaaaacagattaagacaacattttttcttaagaaagcctccaatccgatccaatcatgaaatttcatacacagtttatcatgcttgtgagggtagcagcgcgatcacgggtctccgatgtaggggatgtgccgaacaatccaccgatcgattccctctaacctcctgtggaactcttcaggcatcaatgatccaatgcacagctgctggagtgacctaagatgcacaaagccctgtggcacagatgttaagcttttcaagctccaaagctcaagtctccacaagcttctcatggcgccatcctcaacctcaacctccctgagctcattcatggagctcaggtacaggtgtttcaggttagggaaccatccagcgcgaaatgtcagtttcgccccgtcgaagcaccggtaaaggttaagatggcctagattctggaacatggcagcaaaagaagcgagcggatcttcatgaagaccagagaagcagaggctcaagcttctcagtttggtgaagctggcaaaaacgggaggaattgctcctttgtgtagcctgccacttatcatcagcttctccaggtgagataaaggttttaagttgccgagatcaagggcgtatcgatcacgatcttctgcgagaacagacaatgaattcagagatgtcatcttgctgattgaggtccatagatcagtgttgtgggactccagcaccttcatgataccgacacttctcatccttgtcaagcatccaaggtttttcactatgtagctattggcttctatgcttctcagagtctgtagatgttccaggcaacttattttgctactcgctgacttcccaaaccgcccgacatctataagtagatggtgaagcttagttaacattgtggtctcactgggtaactccagcacagaaccattgagataaagcgtttgcagattgctaagcttccctatcgaactcggtatctctttcagttttgtgtatcccaagtctaggtagtgcaagttaaacagctgagaaacagaatctggtaccttgtgaacattgcaatttctcaggcacaagacccttagcaatctaaagctttggtagcaatctgtgaaccaagacaacgatatttcctctgtaaacatgagcatggaccgaagctgagatgaacattttgctgcttggactaaattgccatccttttgtaaagaaacacgccgtgatccatcggtaactccatctgagttaggacagtcccatgtagtagcaaatttttccttcttagatatggttagggatatttccctaacaagatcatgcatctggaatctctttggccttccatattcattcctattcacaacctgaagcaatgatcgactagcaagttccttcaggtaacatgcagctacatctgtcaatgttgtctcaggtcctctatcctgaacaaatccttcggctatccacaatctgattaaccgttttctctcaattcgataatcttcagggaacaggccgcagtaaagaaagcaattctttagataactagggagatcattgtaactgagattcagaacactagcgacccagctcagctctggattgttactgagctgccacctaagttgattatagaacaactcccactcatgctcatccatttctttgtacgataaaaggctccctatagctacaagagccagtggcaaaccttggcatttctccacgattctttcagcgacggtcttcagattatgggggcaacttctgtcatctaatcttgagaaagccttttgacagaaaagagtccaggcttcctgctttggtagaagtgtaagcttcagttcatagtttgcatctgctagagatgctaccgtttcgattcgagttgtgataactactcggctgccattgttgttcttaacaaatgcattatctagtaaaggccaggcctccctactccatacatcatccagaacaattaagtatctcctcccttttagatatctttgaagttgttccacaagactcacacaatccatggtatcagccccatccataatattttcagttttgctcatgagttggactaagatctttttcaggagatttttaacaccgtgattttgtgagacagtgatccatgcacggcaaataaatgttcttttaatttcttccttcttgtaaatgctactagcaagagttgtcttgcccaaccctcccattccacatatggagattacactgcgatctttttttgcatcacataaccattctattaatcgcttcatctcttctgcattaccaactaaatcatcatcatcattcaagtatgaatattcagataaatgatggtgcctacttggataactcgctgtattctctcttccactgcttgcaaatgagatatcaaatctatttttcgcttcagaaatcttttgtagacgatcctctactagttttgcctgagctgaaagcttgcgccatttcttaacttcgattgcttggttgaatgctttctttaggaaactgccagtcccttccgtttggccaacaagataagtgtattcatcgacaatgtcctcagcttcatgcgctgctagccttacctgttccatccaggcctcaagtaccatatcattggacctgtccacagccacttgagctatgaatgcttgcaacattgagaagtcgctttgaagtagtctcattttattggttacttcaagaaggtcaggtgcttgcttcttcaacttagaagcaagtatcttcgatccttcttctgcaagtgccgatgaaatcttttgaacaactgctatgaccaaagcttctaccatgttcaaattttagctttaaacctataactggaagtctggaaccttggctatccttttgcgggtttaatcctgcaaccagagaaaaccaatttacatgagtaaatgttgagaataggaggcattccatagctggacattgtggattatggaaaagccagcacccttatggacttatgcttgcttgaacaagtattccttacctaagattggaccctgagaaaacacaactaatactaggttggcttttttttcttaagactaatattagattgacataacctagatagtgaaacactgccattaactcatcacataaacacaactgacatcgacaccgaacgagatagtctcagcaggtgtatcatccacaacactgatcatcaccgcaatactccgatctccactgaaatgcatgtgaagcaccaacaaaggactcttcatgtagcctagtggttgcagtgacctgaatagcacctcaaggtcctgagttcaaatctctataggagtgaatttcagattgggttatttgagggctagttccttgttcgataggctaagttcctattagaaaaaaggctgcatatatccggttggatatagaggccgggtaaaaaatactcttctctaaaaaaaaaaaaggactcttccaatttgtgtttcagcatcaataacaactccacaggaataaaaattactcatctacaggtgattctttaagccccagcatgccataaattgcatagaaacaagaatcaacatcgccaagccgatacaactctccctgcaacaggaggatctccagtgagatccctgaatcaaacccttcactcactaggatccaccaagtggaagccaagaaattaaaacccaaacaatcttttctctaccagccactcactaccaattatcccactaataacaggcaatccgcaagatctgatctggttcttgagatcatctcgaggacaagtacggccacaaaatttgacaaccgttcaacagatgcaaccaaggagaggtggggaaccaaccaacaaaatctctatacctgacgctgcagcttccgttgcctgtacgtgctaccggcggcggcggcggcgacggcggacctcgccggagccatccacgcgaagggcgggggattgagtagacgacactacagcagtgtggctgcactgcagctgtcatctctgacttgcagaaaagtaatcgcgaaatgtcggcttaattgaatttccggacataatttgggtcaacctaacagttaacacagatcgaatttttttcgtttttagatttttttttaatatttacataaataatctatcggccaaaaaaaatcgcaaaaatagaccgtgctgccccaatggtgggcggcaagctgacgtggcagacggtgggtcgaccgcgccgtctgccgccatcggccaaaattgcgattaggcccttgccgcccatacagaggccggcaaggggctaattacaattttggccgcccataaagagcttgcggccgtactttttgcatctgggtcccttgccgccccagtaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtacctcattcgacgtattagtactcggataattaatataggcctatcgcaatctcggtcgtagaaacattatatggacttaaacaaggagaattatgtaacatgaagaaatagtagtacaatttgaacatgatacaactattttcattacggttacatagatgatattagatttgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctgtattgttctggtagttcaaactgcacaacacggctaggtggagttagaacccttctggtgtctatccattctctgtattgacatctccttggtggttcctgggaggaaagaatagatgtaaagcgagtaaagttagtaaatgttgtgagaaaataaggattcatgtaatcaaaatattcttaccatgaaatcgtcgtcaagaatatttggacaaacaaagaaccttcgatccaatgttgtaggatttatggaacgaagaacctgacaacgatcactacacctgcatcttggacgggcttcccatggagggagtgccgtagttagcacccgccagtcgctctgttgttcacgacattgtcgttcataagccgcttttctctgtaagtattgctcagtactttcggatgcgaaataccagcgaccttgtaaacaagtggttaggtcgagaacgggattttctgtatcgacccactcgatgtatgcgcaagccgtagactataacattgattgttatgtcacttgtctgtggatcaactctcaagcccctcattaaccatccttttatagaaggtacactcctctcagccggtctatcaattcccctttctgatacaataaaatctgacagatctaccccagttggcccgtaacggacgtttcctggtccatggtaaacttggaatatttgtttgttcgacatatctgtcaacgaattaactagatcatattactctttcatgcaataaacatctacaacgtaatatcttcttgtgtaagccaatgcaacggtaatgtattgattccaaactagcagatgtacgtagttaccgatatctacaatacgcacttctagattagtacaactaaaaccctaaaaatataatgcatttattcaaacaaattttttaaaaaatacacactatttaactcaatagtcacatataggatctatgaatattacctgaaattggcgtctgaatccggcagggcttcgccccttcttctcttctcctcccctctcttcttttattttcactggatttgaggggggaggaatgagggctgggggctggg

SEQ ID NO: 77522 - DNA, 14815 bp, Oryza sativa
tttcttcttcttttattctttttttttaaaaaaaaagaacagggagcatatctccggcttcaattgaaagtatataaagttcacggccgggcatgccctctttgtaaatattcaacaaaatgggagaagaaggttaacaccttaattcatcgatttcacaaaattcctactaaaatgtattcacatttgcatgttcaaacctcaagccgggcttcagggcgggcaagaaaaagcccggataaaaggctaggcccaaattcgacccgagaaataggctttcctaggatgggatcttgctggattttcatgattttgggttgtgaaatctgggcccgagcctagctagcccagtgcattatcaggttggaccgggcttaacatttttaggctgggccgggtccagtttgaataggccaacccataaacaccccccacacagggatgcatactactaacatggtgccatatttcagaatgcaagtaccgaaatttctggatttccccagccccaattttataattaagcaaaatttgttcaaatatcaaactatttctgtcctaattttctgaaattttgcttctatcagctaccccaaagtttttattattatttccgtggtatataacccttactactgttggttgatttttcatatactccctccatttcacaatataagtcattctagcatttcccacatttatattgatgttaatgaatctagacatatatatttatctagattcattaatatcaatatgaatgtggaaaatgctagaatgacttacattgtgaaacggatgaagtatttgcatttttcccttttcaattttaaaaaaagggtaaactctacgcttgatttgatttctactatttaattaatttatacacggatagtgggagttcctatgtgaaatttgctctgttttcttcagcttcagtgaacacattgatgattggtgttggatattcaactgtcttaatcttggacggctgaaaagtccagctcttaactattccttgtctctattgttcaatccattaattttgcttgctgtttcctcacatgatgctatcatcagcaggattattttgacttccctgcagacattggcagcgactagatcacatagcttagccagtgcagtttttatcagggcagggatttgtgggtcttaatcacctaaaatctctctctgtaaccatatccatgctctgacttttgaaagtaaaaactgaccatgtcatgcagtgatgtgtgtgcttctgtctcaagttatccagaagcaagcagtgtaaacgatacgaattttcttcctttttcttgttctttgtgtgatgatagaaaaatggtaggaagtattggaatttcctggttttgttttgttcgtcgttgaatgattgaatcccaagccgtttgaatggtacatgttcaaaagtgcaaaaggaatttggtaaaattcagacatctacgatccttagaccttaggtgtacgttaatgttgtcacacaaggaattcagacacaatggtccaagaggtcaaaacttcatttttctgaatgtttgacaaaaattagaatttcttgtatgcttacttacaagtaggatgctttctacaaggactactttacaccatgatcagatgaaagaacttttaactgaaaaaatgaagtacatcttggaatgaacaaaaatgtcaagattgtccttcagaccattgttacctggcctgtactccactcactgaaagctggtttagcgagaagggggacttgtctgagcttgacttcaaagacgaagaacccgagctgtcgctcttcgcattcgacccctttatgttgatgaatgggggctgggtaggccgaggaagctcattgttcctactacccaacatctcgaccaccttccacatcggtggcctaaggttcggtgaagcttgcgcacatagtagtccaacatggaacaccttgagagctccctcctccgtgcattgctcttggaggtttgggtccaatagttccatcagggtgccttcattgtagtgcttccatatctgaagaatgcaagaagcagtagagtaacttcattaggtttttcgggaatgctacagtgctagtactttgcaataggatggaaatttagcaaaattaccagtgacatgagggaatgcccttctgctgatgaagcaaccgagttgaggctcttccgaccggtgatgatctcgaggactagcacaccgtagctgtagatgtcagccttctctgtcagttgcccatggacaatgtattcaggagccatatatccactgtacaaataaaaatgcatggtcagtaccattttttcagacaaattgcacaatttgatgacaaaaaattcttgttccatccaattaaatacaaaaattcactacatttttaaatgatacgacttacaaagttcccgcgaggccagtgctgaggtgactttgatcttccatgaagttcctcgccaaaccgaaatcggcaatcttaggcctgaacctctcgtccaacagtacgttacttgcctttatgtcccgatgtatgatcctgatctcagaagcattgtggagatatgacagaccctctgcagtcccaaggatgatctcgaaccgccgttcccaatccaatgcggtcttcttgaatgcatctgcaacatcaaccatgaaagatctgaatctatctacattgtcaagtatggcaagttcaaaaattcagaatgcaggaattcttcttcagtgttctagcttagtaccaaacaagtagtgatcaaggctggtgttgcagaggtactcatagaccaggaggctctccggtccctcgatgctgcatccgagcagcttgacaagattcttgtgctgcacctgactgacaaggcgcacctcgttgaagaactgatcggcccactcccgcgtgttgaagaagaggcgctttacggcaatctcccggccgtctagtagcacaccctagcatcatgtcaggagcaaattcaagccgatgcaatcaaattactgttgtacatctgaacatctgatctgatcatcaccgtttcatacatacatgcacacaatctgatcaacagttcaggaagaacctaataaagatcattgtatcaatgttgtttcagaattcagatatagtatatgacattgtaccttgtagactgatccatatccaccctggccaagcttgttgatctgattaaagtcgtcggtcgccttgcacaattcttcatacttgaaactgagctgcgatgcggcgatggtgcggatgatctcactagaaccatccatgtctgaaaatcccaaaattacacaacagagttaaagacttccatcagagattcagacttcagtgtgtaaaaatgtaatagcatcatgttgaagttcacatatgtaccatcatggtgatcatttcttctgttcctcatttttgcccagaccaatgctatgccgatgacagccagtgcacagaagactgaggcgatcaccacgataactatgtgccgtgctgcatgcaaagaaagtttcagaaataaaacgtcagattctttacaatttgttcgaaatggacaatgtttttctacggaatttgcatcttcacaatctgacaacaccaattttcttttctgtttacaattaaattcccatcaacagaagcttttttctgaaaaaaaattgagatgaataattgagcagatcctgttgctatctccaaaattcagacacggcacgcacctcgccggccgtcaaagtttatctccttttttgacagattccccgtgaacattcatgagcaaattgccacgataaagaccaaatttgacaacgttggtacgaaatttctcaagaaaaatgtgacgtgtcctaaatttcaaagggaagagattaatttagatggacttactggatgacccggcggcggcggcggcgttcgccggcaagtagaacggctgcgtggagtacctgacgacgcagccggcgttgagcccgtagccctcggcggcgcgcggcaggcagcgcccgacgacgcggtcgcgcgcggtcgccacgcacgccgcgcacgcggtggcgttcagcgacctccagcactgcgccgccgcgtacacccgcggcgacaccgacggcaacgccgacgccgacgacgacgacgacgcgctgtagtagtagtagtccctggcgcccggcgcggccgccgtgacgttccgcagcaatgcggccgacgtcgcggcgaacgacgccggcgaggagacggtggcgttggagcagacggcggtgtcgctggcgtcggtggcggcggcggtgaagttgtcggcgccgtagcggaggaagcagccgtcgaggtagatccggccgccggtggccgggaggcagtgcggcagcttgacgcggctctgcgcgtagcagagctggcagtcggtcggcgagaggtagcccatgcactggccgaggccgtagacggtgtcggcgccctcgccggaggccgcggcgccgaagccggagcgcgtgacgttctggtagatgagctccagcgtgttgacgaagctgacgtcgaagccctcctggtcggccgcggtggtgttcccgcacaccgtggccagtatcaccggcttggccgcggcgccaccggcgtcgtcggccgccgcggcgacgacgacgaggaggaggcaccggaacgcagcagcggcggcggccaaggagccccggcgttgcatggcggcggcgagcatggactgcacgtgtgggagtgtttggtctctagcttagcttctcagcgtgtgatcgccatggccgtctcggttttgtacgtgcgtgttgatgactaagctgagaaaataaaaaagagagacgtccctccaaacattttttaaaataattataagcgtgttaaaaattaagcgcggaatgttaaaattaaaatcacacatttcttatcattacactatcaaatacggagtgcatcttaagtctaagctgagctaaggtcatttgcactgatcagtagccggatggaatggacctgaagtggttaatgtttacatcgtatataataaatatgagaagagaaaaacaccagcaaatttaagtacaatttgtgaatttagttgaatattttgattaagatgtactagattttatcttaattttcgttagcacgtttttttaaactactaaacggtagtagcgaaaacttctgtatagaagatactacaaaaaacgtgcttaaaatttatcaaatataaatcattcgataaatgatttatctatatatcagataaatcatttatcaaatttaagataattaaaatttaattaattatatgcttatgtgaactcaaacgaggccttgtgatgacatctggatggatgtacataaccgtgagtgcgatgcttcaccagacggccgccgccggcagaactccggtggcaccggctgaggatgacgccgccggcgcgggcccactttaactcgcgcgcgtgacgtgacactgacacgtacgtacgtaggtgcactgtatctctgcgttgccagcttatgcatatccatctcggggccatcgcattctgtctctgtttgatgcaggtgcagcagtgaacaacactagtgttacgtgactacgtgtctgctggcttaattactactccctccgttccaaaaaaaggtaaaccctgggtttttatgtctaactttaactgtccgtcttatataaattttttttataattcataattttattgttgttagatgataaaacatgattaatattttatgcgtgacttgtttttttaatttttttataattttttcaaataaaacggacggtcaaacgttgggcacggaaactagggattgtctttttttgggatggagggagtacacgttgacgttgtggtcgccgtcgtgccagcacgtacagccgccgcccctcaccggccggtcaccagccaccgccgccgccaagcacacgtggtgaaatgtaagtgtaattaaccaagagctaattacaagagcaaacgtattccagtgaacaaccaaattaatcaatcagtcgcgatgaagcgaaaatgtcgtctcgctagctatctttttcttcttcataaatctttcacctttccaaaaaagattgtatgattgtcttcttggattttaaaaatgtgcatggttttgattcatctgttactgctctacttggatttttaaaagattaattgtaggattgtatgattgtcttcttggagaacatagttaggtggaaaatgatggagaaaattatacagagattaaactactttattacagccgtcacggcggatactatattatatactagtctgcaacatatatctaaccaaagttttcaacgttattgaacttgaattcaagcaatctagaaacgaaacgaattttttgactcgttttcatgcagtcagcagcctcggtgcgcttggttggtggtggtggtctgattcattgtctcgtccgcacacgtgggtctaaaaaaaacattccacggtactgggtatgcagagaagaacaaaacagtccatttcatcatcaatcttcttcttttttttttcttttgatcatcttcatctaaggtgcattcatattcgtctccttacgtattacttcgctattggctttttacataacgtttaactattcatattattcaaaaatttagtataaatatgaaagtataagttaatattatagtttattttataataaaacaagtaaaaaaataaataatatttatatattttttaataaaatagatagtcaacatcacgttaaaaatcaacggtattatatattttaggacgatatgatgggtataaataaaggccatggcgcccatgccttgccccaagtaggataaatgtcacgcatggatacatcgtggtaaagatatactctagttagtagtataaaatatagagcaatatacacaagtgaagttgtggatatatgatttttcacattcttgtaagtataagtatagttgtgcgtatcctaagttggtcaagagggttgaattcatacttttattgcttttttaaaagaataccaaagcactgttgtcatattgtggtaacagtctaacagagagaggggcgctcgttactcataagtagaactcttcaaccagcaggagcgaagattcaacaaaacggcaatgcgtgagttaaaattttataaattgctacagcttgcttgatgtctccaacttaatttgctcatctcgtttgatgtggaaaataaatgcaaaatcgtattccatgtttgtaacttgctcgaagtcaaagtgtgcccaataaatacaatcatgcatgtaaagattaagatctcgcggatgatgggtccacgcatcgatggataaggaagtcagcagtagtgcaatcctactcactctttttttttttaatatacgaggtcgttgaatttttttatacttctaaccattcctattattaaaaattaaagatttatgtaattattatttaattattatgactttatttattatcaaatattcttttgtcatgactttaattttttttatatttacatagaaaaattgaataagacaaatagtcaaacatttataaaaattaacagcgttataaattaaaaacgtatgtacctttcggatattgcagtttcaaatgatgtgatagattagtggtggttttaggaagtagaaactctaaattttattcgaaatttaattgctggacaataacttttaaactatatgttcctatcatatcgtggctttcgctgacgtagatttacattggaccagtagttagcctactagtaccatatattagctcacgccaacataaatcttggatatatatatatatatatatatatatatatatatatatatatatatatatatatatatatatatatatatatatatatatatccatggctgaaaaataccttttgaggtttggactttggattgaacattggaagccgaaaattgttttggaacacatgagtttcaaacttttttttgaaagcactgagtaaatcagtacagctctacaaaccgtgcaaaacatgacggaattcacaacatactagtacaattcattcggaaaaaagaaatactcctactaagatattagtagatatttattatattattattttcatataaaaagagacaagatagaatattgcaaatggagcccatcgctggcctcctcattaatggattaggcccatatttaggagtttattccccctagtcttggacccgtgcgatcggtgggcttgggacatctcggcccatgaaaagcccgtgcagtttttgcaattaggtccccgatatctccggaacattccagaacccccttcccttacttttgcccttcccctcccctcgcttcgccggccgtctcgccgtcggcgcgcgggacaacgccgtcaccgccgccgcttcccaccctctctctcgattccctgcctgagccggaggcacgctccggccgggccctctcccccgccacgccgcctcggacgcgcgcggccgaggagctcctcctcggcgttagcaccgctgctcctgcggccggttggatcatccgcgggaggcgacgccggcgaggtgtagcaagaggcgacttggggatatggtacgagctctcatgacctctcctgcccctattaggtttagtaaaacttccctctccctgtagcttcattcactgtcacagcttgggtaaacctagatttttctctctctttttttttttggtttacccaatgtatgctcgcatggaaagtatgaacgtatgctagtgaattggtctgaaatgtaggttcgttttaatggagcatcaggttcacactgataattgtttctttttggtggaattaacttgtctcgatggcatagttcgaggttacttttaggatgcatcaactaattcgatgcgattgcgcaagatgaaaagatgtctccaattcgaacctatatatctattgtcagtgtttgagtttgaaatgaagtggtttttctcttgtgtctgggggttttggttcagtaataaatcagaatatactgtctgcaggaagctagggcaaggacatacgggtcttcaggagcttccccaggaaatctgggtgatcggtacgacaattatgcgaactactcaagctacttaaatgatgagccaatgcctgatgccgcatcagaaaaggaacaggttgggattaagtattgcatctcttgctactctgttcaaactttagactgttgtagagggacaatcctttgaagctaaaacattggttgttctgtttgattttttttcagggtaatgagtatttcaaacagaaaaagtttgcccaggctattgagtgctactcaagaagtatcggactgtctccttcagcagttgcttttgcaaatagagctatggcatatcttaaactaagaaggcaagtagctgcaacactgtgtttgcattcgctagactatggtgttcattaatatgattacagatacttaaaaaccttagttggatctctattctggaaccattatttaataagtactagctaccaacaatttcagactgtagatatgcttttatgctacttgtgatgcgtttcatatttctgctgatatacaatttcgatgtgcttttacatttgctcttggtgtagtcttatatttttttatgtgatattcactaggtttgaagaggcagagaatgattgcactgaagctctgaatcttgatgaccgctatgttaaagcatactcacgcagaattacagcaagaaaagaacttgggaagcttaaggaagcaatggatggtatcctatttttggccaccagtctttccttttttagcttaattgttgtcttgatgaacactgacaagcaggtccatacagatgctgaatttgctgtcagtattgatcctaacaatccagagctcaggaagcagtattctgagataaaagaattacacatgaaggtgaacaatctttacttcagaattttcgtcagacatctgatttaaaatagcttttgtgttactaacaaagttttgtgttgattcctatcctacgaaagtcaatattaatgtgttttaattctgcaggaagtggctaacagaagtaagccaaccaaacatacagtttttaaatttgataaatctggagataaaaaggacacttcccatgcaccaagtagttcccagaaggtaggtttgtagatttacagcttcatgatacttatgtagttttcattgtttatcatcatgtgtaataattaattttctattaatgaggtttaaactatgcacttattaatgaggattaacatgcctgccctaacacattcaatgcacctagtacatgtcgtgcacatggcccaacacttttgaactcaccttgttctgtttatttatagttggttatgttcatcatgggtataatcagctaatttgttttgttgtgtaatacctgatgcatttgcattctacaggacagtttcatggaagttgatccgcctagtagagttgcagtggagattagagagaaagcagatggtacatccaaaggtggatctggagtaatcttcaaagacagtaccgtacaggtgttcttttgctacattgtttttccagctatataacaaacatgcactttgatttgagtgttggtatacttctctagttataccatgcatagttagcgccatctatgataatgtgctacatgaggcagtttgtaggcctcatgtattacctacatatcaagccaccagtgacttagtaggcctgctgtcttcgtaccattgactctgcatcatgtctgcttgagttccagcacagcttgcatcacccctttacttttcctgcttggtttacaccttgcctctgggcctctggcgttgccactatggctcacagtcagaatttgcacttcttatttcatcgttatattgtgcttctcatgaaagaactggcccccactgaaaatggacaagcaccttcatgtgataatgtcagaagaggacatggttggtggtagcatgatctgttgcaaccttaggttgtgaatcagtgtgctagggctgtaggcaaagcaaaggagttctgcaaagtttgcaggcttcgtgttaaacaatcatgatgtgcattctgcttggtcgttggacctaagaaccattggtagtacaggtagatttttcacagttctgtgttttcttatgttatgtttcaattaattggtgcagccatctcgagatgctaaacagaagcctggaccagaagcatcaatacaagatcttgcatctcgtgctgcttcacggtatatggccagcactgtaaaaagtgtgaagacaccaaaaacagcatatgattttgaggtttcttggagagctctctctaatgacactgccaagcaaacacagttattaaaggtttgttcctagtccttctgttctctactgttggatacctttgcttgctcattcttgatgtgcaaatttcttatttgttttgcaaccagtcaattccaccatcaagcctaccagagattttcaagaatgcactttcagctgcttttctgattgatatcgtgaagtgcacaacctcaattttccggtgagcttatctgttttatgcttggtactggtttggaaccatggctgcttttgttaatactaattacatacccagggaggacacaatgttagctgttagcattttggagaatttggcaaaagttccccgttttgacttgataatcatgtgcctttcatccatgcataaatctggtaagtttgatcttgcaaccctttgttatcttcatttgtccatcatgcctggcagttacttattgtcaggacattcatgagaagcataggcaaataaaatgatttttggaatgcgatagtagtaatttgttgtgttcggccattcctttatggatagttagtttaaactttgaagtgcacaaagattattcgaaagttttttttaatgtagtcagcacgacatctttagaaaatactctacttgctgatgcttttttcttttcttttgtcacaagaattacggaaggtctgggatcaaatattccttgctgaaactgcatcagcggatcaggttgaagccctcaggcaacttcgagccaaatatattcaggaaggattgcaggataacatgttcacttcaaattaatgatgctgatgctgagacagctcgttagaaaccttttacgctctagccaattgatattgtgtaacacccttttcctgtagaaatgaaatgctaaactcagtgtggggggtagtcaattaatggtggaagttataaagttgtctcagaaacatccatcaaagcatgcgattgtgaagctcatggacctttgctggctgaaaaggctgtaccttcatattcttgatgcatatgtgcccctggggccagggttgccgagttctgcctgtctctataccctgatgtagcggattccctgacactgacatcctgttatgtcgacacaggtggattcggcagtaattttgttgtgcaaattttgcatggataagcattcagtcttttaatagaactttaaatatcaatatatcttttttgaaatttaatctgacatgcgaaaatcatagacgtagatttgtttgaaaagagctctcataatatcatagtcctgatggaatttacatatattgttacagtagatgttagtagtgctcgaagttgcatggggaagataatatctatgcctaaaattaagtgattggagataataaatcttaccaagtttattaaaattgagcacatagtactacttacatgcattatatagacccccaaaaaagtcatgatagaataatttgccattagcatttccctacaacagtgttcttgcatcagagaagctgcactcttggaccatgaaagataagcttggcaagggagatgcagacactgggagctcctcaagctcatcaaagaagtcacagctctcctcttcaccggacagcttggaggatgcaactgttactacctcagcaagggacatgccattgctgagaggatcacttgtgtcaggattatgtgcctgttcttggactgaatttgtagtagtagcagcatagttgtcatggttgtgatctgaggtgtaggtgatgatgagcagagatgcatcattcctgcacttgtctacttgcttcctggctgggcatcccctgtaactgctgcacttgtagtagcctctggatacagcatgatccacaaaaagagcaaagataatggattgatacaaggaaaaaaatcgtactagtaattgatcagacaacctgattcttgtgaaattatcagtgatgtaaagaatcagtgcacatgcaaaagattgtgatattacaagaacattcggtgcagtataagtatgaggaattagtgcaaggtgatgataccttggatgaggagatcctttgattggtttctgcccatatttcctccaggaccaactgtcagcaggtggcccttgctcaaccttatgatctttcaaagacaccacaaccttctgaacatcctgcctcctgcaacagtaacaaagatagacagctgcagtgacaacacaatcacaagagaatttgcagaagcagaagcaaaggatataggtgctagctaacactaccttctcttggggacactgccatcagctttcatgctgctcatctttgtcatttctgcaacactgactacacaagcatatggcagcaggtggaggaagaagagatatagctggtgaagagataatagcaatggcactattactctgaagggcacagaatatgttagtgaacagtgagatgatatagtgactgccaagtgccaacaccacaccacaagttggctgaaaaaggctggagcaagttgctgatctccctctctgccttgctactcttttcttttctatgttttcactgtccaataattgaatgcaatactgaaaatgttcagggttactgtttcagagcctcaccaccattttcctgtgagttcaatgatgatgtggactcctgcaagcctctcttacaaagtagtggttgcaattttgcaggtgtgatccttgtgattttccatgggtgaaccaaattacttaatgacttgaatatatgatatatctatttaatgaagctaaaataatagttttctttatgaacattttgattggccatgcacaaacaaacagcatgattagttatttagtttgtcttgaagagtactctagtactaatatattactaatcctgctagtattattaggtcttacaaatattctatgttctgtagaaagctacgtctatatcaaagcaataattatttatgacttgggtgaatagtattaaacatgtaaaatcacgttgcagttggaggctagctagctgtcaactgtacctccgttttgttataatttagaacatcgatatgatctataacatgcacctttaatggttacttttcttattcatttatccgtgaagatataatgaaagtacattgatatcaaattatttttcatgagaaatctacttatatcattttcactggacaactctcgactttttttgtatgttaatgacaaaacgtattcttaagatttgattgtgcagtaaaaatgacaattgctcgaaaatggatgtaatataaaatagagtaaattataaatatctttctcacaatgttttttttaatccaaatcgatgtatttgagaccattttgaaag

SEQ ID NO: 77523 - DNA, 693 bp, Oryza sativa
tccagtgggtgatcgatggcgcgcgcgcacggcagacacgggcatcatgcgtgcgaggtggtgagagagcggcgccgcatggcacaatcatcgccggccccgctcgcgcgcgcgggcggcgagacagatgtcccgtcgggaaagcgccccgccggcgccggcctcgcgcggtctatgcctcaatagctagctgcactgcacctggacgaatcctcctttgcggcgtatcctccgtgtgcgacgcatgatcgcaacagcgaacgcgctggtcgccactagacagcgacagctcgatctactgtgcgtgcccatttagtcacgaacactacttgatgatgagatccatgcagacaaccacgttttcagctatttggtgtggggtataactttttcttttcttttcttttactttttgtgatgtacaaatacagctgcaggttaaatttacgtcttccttatttttcctttccccggacgagaggcatttcaaaatgtactatcttagcatgtttcttctgtaccgaagagttatcttttcttagcggggcaacaaaaaaaaaacgactcagcaacagtttggaaatcctccaagtccaaatataatcgtccacttagttgtggcgcaagcacaattaagcatcagaacggccggggtcgcgctcatcttgagccactagcgctagattaagctaa

SEQ ID NO: 77524 - DNA, 12201 bp, Oryza sativa
gcccggccagagggcggcaaggggccgcctgcaaaatgcccggccccgactggcttttttgcattcgggcccagggcggcaagggttttcctgcaaaaaaccctccctccgtcaccgcccgttcctcccccgtttgtcacgtcagcttgccgccctagaggtgggcagcagggtctatttttgtaatttttttggccgatagattatttctgtaaatattaaaaaaaatctaaaaactaaaaaaattcaacacagatccagcatggaattattgcggccatggtgctctcggcccgattaaggaccgggctgaccgctgcactttaggcccattaggaggtaaaatcagcccactcaactttcaggtaagaaagccgttgctcatcaggaacttgttcttatggtgtgttccccttcttggggaaaaaaaacatatcaaatttattaccaaaatcaaccttatcaacatttagcactaggggtggacaaaaagcttggactcgtgagctcggctcgggctttggctcgagctcgtgaagctcggctcggctcgaggactaaacgagccgagcccgacctccctccacagctcgtttgcaaatcgagccgagcccgagctagctcgcaagccgctcggtaggctcgtcgagcctatgaaaaacatgacctgacctggcccattaacaaattgtctccgtctggcccataaaaaacagagaaccctaccttaactgctccgtccgaccctccccatttcccatcccacgcaggcgcaggcacgccgccgcacgcgcgcacgattggcgtctggcggcgactagcgagaggagttgccggccgccgtctccggctccatcccctgcgccgccgcccgccggcccgccgcctctctcctttatccccagtcgcccgtctgtgccgccggctcgccgcctccctcccctgcgccgcctccctcccctgtgtggctgcacagcttcggccttcctccccagcggcgctcgacggtcgacggctcgacgctccccgtgccgccgtggcgccgcctccctcccccgtccccagtcgcccctctgtgccaccggctcgccgcctccctcccctgtgtggctgcacagcttcggccttcctccccagcggcgctcgacggtcgacggctcgacgctccccgtgccgccgtggcgccgcctccctcccccgtccccagtcgcccctctgtgccaccggctcgccgcctccctcccctacgccaccggcccgctgcatccctccctcccctgtgcagctgcgctggctctagcctccctccccagcggcgctcgatggtcgatggtcgatggctcgacgctccccgtgccaccgcggcgctgcctccctcccctgcgctgcctccggcctccctcctcagtgccgctcagcctccctcacaagctggctcgagccggctcgagcttttaaatgagccaagccgagctgcactttttgctcgtttcatttatcaagccgagccaagccaagcctgttcttgaccaagctttcacggcttggctcggcttggctcgtttccacccctatttagcactataaaaatttggtatattttgatgctaccaaattttgatagcattggatatgtttaatttgtaatctttttaaagtttggtagtgtttttgtgagaggaaacttcgaaaacttacagtaaattttagtaaggtagagatgagaacatgtttattttgttaccttaataaaatttggtaacacaaaactgataaggtcagaaatgaagtaaatagccccttaataagataaaagtaaggttaggtgatgtttggtttaatacctcacaaattttagtagacttttgtgagtggaaaatttcaaaactaacaaaatttagtaggattgtacattagtactaccttacccaaaatttggctggtgatgtcaaattttcatttgggctgagtttatttccaaactttttctttaaactttcaacttttccatcacatcaaaacttacctacacacacaaacttttaacttttccgtcacatcgttccaatttcaaccatacttcttaagccatttctcgcccccgttagctgactacccacacagaaatgcctgcattaattacgaagcgtctcgaaaagaatcaaagttcacatgatggattgatggtacaagaattctccaaagacaaacgcagatgacagactcaactgcatccaatgtagtatcaatgtatgatcagtgataacatccatacgggagtcctaatgcccgcgaggggcttcatcacccgactctaccatgctaattctgacgctgctaaaaacatcatgcaacaacaacaggtcgtgtcgtctcctaatacaacagtctcaggttgaaaagtttatgtacaccatgcgactgacattacaggaagggactctcgtggtcgtgggtcacacacacttgccatgacaaataaatagcattacaccaacttgagaaggctttgtacatccaggtgtatctcgtcaatgaatctggggggcagtcaccttctccgtctttttgactccacctgctgaagagattagtccaaatgaaatgtttgtctttcagaatcgcagaatggtgattaccaaattaaaaaagaactaaatagtgcatgtaccttggatgggttttatttactgtatgattagattatgcataatataagagtgaaactgtacaagctaaagtagggcaaattgtgcagtatccaaaaaaaaggttacagcaattgccacagtaatcaacatgcaaaagttccccaatcctttatagttgtaaaatcacaccagactttttactgccatatgaataaattggtactgtttcccaactggtgctttgtgtcattaagtattggaaatttgttcaactacagtagcgatacaacaggacagacatctcatatattataataatattattaagcagcatgcctcaatatcattgaaaattatgtgtagcctatgttattaagacgacatggtgaacccgggagaccctggccttgatgtattaccatcgcactactgatagctaaacaaatcattaatgataattcagtaatcccaacatatcatattttaccttttcttcggattgcgctgtagcttcatgagaattctcagccatctttccattttccgcagtacagctctggcagaaaaaatgctctagtttttttgcatctttaatagtcattccaatgcaagaagggtgaaacctggaaagcaaaagcagcagatatttgttgtgacaaaaaaatgataagaaagttcatgcaaaagtaaaagcagaagacaaaacaaattaaatgttttattatctcaggaaaaggtccattttactccagtgaaccatcctcttcccaacttctttttgctagtacttttaagttcaaaccacgatggttgatactatcatattctatgctaagaaatattttcaaagttgtaataatcatttgcatagaagttcatatctcagtccttaaaccggtattaggtgtttccaaccaagtgaaatagtcaggaaaaatcttaaaatattatagaacacaatagtacgaagtaatctgtcatacctcaaagttactacttgtacaagaaaaacaaaatagacaaatgatgttgagtagtagtgtggcctagttttaatagtttgccatgtgcaatgaacaaaagaatatgggcctgtttgacaaggctccaactcctagtggaatctggagtggagcggtggagcggcccaagccccgcttcacccatctagttcattttttggaatcaatccagcccattccactccccttttaggtggagctgaaactgtttcgttgggctccaggtctaggaaaggtggagctggatatatatattagggggttaagagctccagagaaatagtttagagtagagtggatttctttcttcacttgctaaacccttcctcatcttttggtgttcatatatatattgtactgaaaagtgtatatgaaatgtgaagcctactcaaaagcaattctattaacttttgatggtggattccatggacatgtagcttgaggtcatgaatttctttcagagcgtgtgggggttggggtgtgtagagtactataaccgccaaggttctacagctagcaaaaaacaataactcagtaggccatatggggtttagcttgtttccttatgtttgctaggatatatatctctctatagtttttaccagcgcattaattgtttccttattttaaattagaattaggacaagcgaacaaggaaattttttccttcgtctctgcattgccacagcaaggaaagagttaagagagtctagtgtggcaattgtaatagtgcttattcccattaacaatatataagcacgacctacattattggccaaaacatcagcccaaaacacatgtttcaacaaattaatatggcgatgtaacaacaaagacatgccatgcatattgagaggcccactttgtagccttgctctcaggaatttagagtatagacattatgcaatggttatgcctttatatctgcacaaatctctttggggattgtgaataaatagagccaatgagtgatttgttctggtgtaaaaaaaatggaaaagcatttatttctctgacggctaactagttgccgcccatcccaataggcaagaataagataagggcaagacacccaaatccattaataggtaaaaaaaattggttgtcctattcacccagtggcaagagggataaaaccataaaatgtacaccagcgcagttcaggaaaaagatgaatttaaatgaattatttcattactcaccaatcagagcattcctcacattggatcataaggtcatcaggattgtatggcatctcacacttgcagaacctgtcatattgttagtaaagggatgagaaaatcaaataaaatgatgatattaatgcaatacataaatcaatttaatagatagcataggccagcaaagcatagcaatataagtgatatttggttgagaatgtagcaacagtaaataaaaatggtcgcagttcatccactacagccaaaaatctttattcatgttattcggatagaactaccataataaacaagacatccattttgtaaaatgaggaatcatggtcaaataaagaaataattgaaaccaactaacatgataaggaaacacccagagtggcatacagcattacaaagtgtcatatatgcttaggatttggcaacaccacaggctctaccgaacaggtacgaccatgctgatggttggcagcagcatcgcaagggcagggagataagaagaacgaaggtaaggaaccattttgttatttcttgcttaatactaatgacacagtcacgtgtccttatataagctagctatgcgccaaacatccttgtcaaacttataggaaggataagagatatgcctatccaaaagttagctaacaatcttaatgacagtacgacagcaatctggtggttcagcctatgatgcatggatacagaccgtaaacatggcatggtactgatacagggaattcgccatccccccccccccaacacccacagacaacacaaaacgcccacccacccaccaaaagggaaccacaatatggtgacacactacatatttaaataaaaatattatgtatacattattttcaattgtttgacactgaaataatgtatggcaagctgtaaaaaaggaaaacttatctcaaagacagtccatagctcctagaattcagtcaatactcaatgcatgcccatatgttccaaaattccattagcctggtgagggcacacagggatgggattagggttgagtatcctggctatgtgggctgggccgtgtcgcatacgagtcagagaaaagttgaccacatatttgagaagaaaactaattatttttttatgtataatcgaccaatacttggtcgatacctatctgagttgaacatgtcattggacattcacgtgcactgtgcacaccagctcctaatctcttgatgcgttagccagtcagcggcttccgacagaaccatgcacattcactactgctgctgccttcagaacattctataacctctcacattatgacattgcacccctcctttcgagcagctcatcctcaagcttctaggtggcggctatggctgcagtccaaggagggcccctcatggacaaaaaggctgcagcactggcaccctaccacatgagagcaccaggttgtccagatcgtgtctctaacaaatacgattggagacagccctaacaggcagaagtaataaatcataaccaatcttatctctaacctcgctaacactacatgatccggactaatctagtactatggccagcacaacctatagcctcatctcaaacaccaacagctagatggaaggtacggcatgagctgcttccatgagcctggcacgctgacccctcataagccttctaccagccgtgatgcatcatgcatgtgactcgaaaagaatagttttaaatggggcaaggtgcagaatgcactaaattggggcggtgtagtaagcaatgggttctagctgtcttggtacttatgtgcaatatgggctacaccactacacgagcctaccatagacataccacataatatatcatggcatgcagtggctcttcggtaaaagaacatctcaagtttgtaagagcattttactgtgcctctattttctccaaaagcaagtaataacagcaaatgtggcaagctgaaaataggcacaaaaccttatgcatcccttcatattccacttcaacacagggaaatagttattgtgactctttggaaagataaaactggtgatgcactgaagcctatagaatctagacaggtcataaggatacatatatcacatatcaactcatcagaattacgaacttgttgaccttgggatttcacatcaaatataaaaggcatgtgtgaaatccctaaagaagactggaaaacataatcaacagataacatgatatttaaatatggaaaatgtcatcgacataacagatcaatattgtgcagatgtcaacggaattaactgcaaatacgaaacaagttcttttcagggctatcacatagcggaggttgcattaaattcttacacagcaatgcggtcgggcacgaagcttcctgtggctgatttgtactcaaagcgacagaagaagtcctcagcattgacagaatcaagctttgtgtagctacggaagctgtgaacgttgcactttccctctatggtgtcagcactctgtacgtcatagtgatccgagaggaacacctctttggcaccatgaaatggacgccttccacccatggactcctctggccgatagtaccaccgcacccgtactctcacatttgtgcctcgtgaccctgcagcctcaatagcctcaactcttgccacatagggtggctttgatgtatcagatgccctcattagcacacagtccccagctgcaagaaacatataagagaatcagacaggtatcgagataattttatgcttataaaaaatagtgacatgggtcatcatcaagatgtaaagctggtattggatagtactggcatcacagtgataatctcagagcaaaggaaatgcaatctgcttacagtaaaacaaagtgtactaaacacaaggtaatcaaagcatcaaggttcatggatgctgtcaacatctagatatgaattataaaattaaacaaagggctgacactaaaggaaccaattaagtctacagatatcggtgtaagtagtaactatgtttatctgggcaggtttccataccaaagaatttaacagatatcaaaacttcagaatctgacacctctaacttgaatataagttagattagcagaaggcatgaatcaaccttgaacaaacagcacaaaaggagttcagactagaaagactatgcaacatattgattttgcatttaaggctagagaacactatctagccaaaacaaaactttagggtgcctaactggatagtattgattacataactttaagcagttaagcaaacattttcttcagtaaaaagtccaacagtagctacattgtgtagaaagagattagtcttcatgcaaatgtcaaaaccaaccagaacttagatgcaacataggctagaaggtcaagactataagcaccataaacaattgtaactacagctggtatttgcaacacatgaacacagccattaagatggtaaaaaaatctctaattagcaaaatgacgatcagaaggcagattctagattatatctagcagaagggttctgccagtagtgctaaattgtagctcacaaacagatacaaaactacttacagactgaactcccataatctaaaacaggaattcaggaaatcaaagtgcatttaagatcataacatagctcaacagcacatatatgtattaccctcctagaaaccatgaaaaatattcgtctgttcatcaaggtaatcaaaagttcaccaaacacaaggtaatctgttctcaaaacacacacacacacacaaggtaatcgaagcatcaaggttcatcggtgctatcacacgtctggatattaaccataaatatagaaaaggaggctcaagctagaagaagcatttaagtttgcatagattggtgcaagtaatataccggtaattaaggtttatctaggcaggtttccatcccaaagaatcccaatgtgccaatagaacaatgtcagaaatctcagaatctggcatctctgacctttgcataagctaagattagtagaacgcatgcatcaactttgaataaatagcacaaaaaagagttaagactagaaaaactaggcaaaataatcgtttttcatttaaggctaaagcacgctatctatcaaaaaaaaaacttaagatgcctaactggatagaatcaattagttagcttaacacaaggtctaagccatgagataaagattttcttaaataaaaagtcaaaggtaagacacattgagtagaagttattgttcttcatgcaaatgtctaatactaaccagaactgaaacacaacgtaagctacaagaaattttttttttcgaggggttaagctacaagaattacagcacgactataagcaccacaatgatcataatgctaactgggattagcaacatatgaatccaaactattggcgatcgtaaattgcaattaaaaacgctatatcagcaaaatgacatagctcatggtgctaaaactgtagctcacaacccagacaaaaccatgtaggggctccactggacataatctaaaacagaaaatcaagatgagtttaaactcataacataactcaatagcacatatatttttttctgtattaaccgtcctaaaacccatgcaaaagagagataaacccatgaacaatcaaaaccacaaagagttaacgctccaacagattaagttaacatgctcacatatccctaccatggtttccttttctgattatgaatcgagcttacatcaacagtaaaccagagacctaaacaccatttcatttcgcacggaaacatcagggaaattaaaatgctcccccgaaacagagcaaacatttccgcgacattcaatctaaccggagctaaaaccccagaattccagacctcaacaaaccgcgacccaccgaaacccacgcccccacaaaaaaaatcccccccaaaaaaacccccagaaattccggatcgaagggagcagcggttggggaggtgggagggggagcctcacgcttgatgactttgtcggagcccttgatggtgtaggactcgaggatccgcttgggcggccgcgacttcgccatgggacgcgacggcgacggcgagagggggtgggagctagggtttggagttgggaggagacgaggagatggggaattttgcctatttctttattgggaattcgtggttttctttttgggtctcgaaaatataaataccacggatttcttcgcttccttttttacccgcctcgcccgcgctccatttgatgcgagcagtaaaagttggtaaaaattcggagagaggagggcgcgtcttagccgttgatgagtggatgtggatgcatcctagccgtcgggaggctcctcttctggatggttcggaagggttcgaggaccagcctgctctgacgaggctttcaattacgatgccgttcagcctgctactccagataggctgtactccataaaaaaaaaatcaacctaagtaatagatttgatgtgttatttgttgtattagaaaatatctcatctaatattacgttgattttttttttacggacggagtactgccattttctattaaaaaattacctcatttcattttcactttcttttatccggatattcatatgatgatcacttaaatattagtttaattaacctcttcaataatcaaacagatttatcagtggtgcactggtgccgtaacattatttttttataaaaaaatactcaagatatgttgtactagatacattggcgaatcatctttggtatcgtctatcgatattatagtatgctaattatatttagaatataatgttataatatatgaataagcattttaagcataacttttgccgaaagtcgtcggtgtcacctgacaccggtggtagcttttactagttcatccaaagagtgggagtccaaggggaatttagtgtcatcatttattaatgtaagcatgatgcttagctgaattaaatgccattagatgcgtatttgcctcacggaaagtgaggtagagagcagataatgatagctatgtccatcctttgtattcatgtaagattacatttggtcgtgaggtttggctgcgtttttctgagttctgaaaatttttgtacctttttggcaattaagaatattttttatttatgtgattatactaatataataaaaaaagtacgtaatatatatgtaaattctgttgtttctcatttctcttctttttctgctacagcaaggctggtccagaaggaccaatctcaagctcatagcctcactattccctcaatgacaagcaagacccacacgttagaaccatcttcttctttgccttctttttccatgccgctggaatgagtaaggctgtgttcgttggagggggttgggaacccatctcccatgcacgaaaaaccaaacggtccattagcacgtgattaattaagtattagctatttcttaaaaaaatggattaatttgaattttctaagcaacttttgtatagaaactttttataaaaaacgtatcgtttagcagtttgaaaagcgtgcgagcgaaaaacgagtgagaggggttgggaacttgagttccgaacacagcctaaagcgagccacgcacaaggagttccatcaccgcgtgtccgtgttgttgtgaaaggaagataaccctggagagaaagatgaggataaagatcaggttacggttaagtcattattagtatagatggccatatggcccgaggcccacggcccgcccaaggcacgtcattttggcccggtcacagccgagccatgcttgggctgcaccctcggcacggtgggttggcccggcatggcacgatcgaagaaaaatagtacagggatgaaaaatagacttaaataaccatataaggcaacacccaaaaaggagagaaatacaaaatagatttatttctagccatatgaacatagcccacatagttgagggatgaaaaatagacttattctgtggagaagcacgatgggctatcatgccttcgggccagtccagcatggcccgagtcgtattgggccgtgcctaggccgtgtgtgcagcacgtgtgtgcaacacctcggcccaagcacagccggacctgggccgtgccgtgccgggcggcccatttggccaactatagtcattaggacttggttgtgtcaataaatttccccatacagatctcacccctgtggaattaacagtgggattgaagttgtggtacctcaagaacggtaaaatttctcttggataggtgctatgaaattatcaagtctgaagttcagatccttcatctcttccttggaccagttttttcagaacttttaacaaagctaatggaaggacagctgtttg

SEQ ID NO: 77525 - DNA, 13260 bp, Oryza sativa
ttggcatcttcaggctttgcacaataaagacaatatttttagcatgtccccctactgatcagattatcatggcacactttagctcattgaaagaatatgctgaccattaggccattaatcttgcccgcgaattaacctgataactaacttaacaacctctgcgcgcccccactactgtaatggccacgccaccatcgccacagatcaatctggcatcgacacaggtcaggaagcatctgacattagtgcaccatcaccgtgtctgtgtcttcaacacggcaacacctgacaactgacgagaccaaaggtaatattacctccgtcccaaaataagtacagccgtagatatccatgtccaacatttaaccgtccgtcttatttgaaaaatttgtgaaaaatttaaaaatatttagtcacacaaaaagtactattcatgttttatcatctactagcaataaaaatactaatcataaaaaaatttcaaataagacgaacagtcaaacgttgaatatgaatagtgtaaaactacacttattttaggatggagggattactaagcagtatcatcatcttctctaaagccgttcctgttccatgtataagtatgaatccacttttagttcagagcaacagtacgaggtctcctccgttataaatacgcggcgacgccgcggcgactctgcagaattcagcaacctgacctctcccgttctcctgcagctagcctccggccagtctccagcgcgtcgccctggaccgaaatattatgccacgttcttctcgtatgaatctgtggccgcattgcttcccgtgtttcgacgatggcgacagatcaggcaacaggttcagtactgtatgcaacttccccgatgatctcctcccgtcgctcggtgctaccgctcaccagcctcccaagctcaggaaatacctcgtctcgccttatgacccgcgttacaagtacgcgtgcctctgcttccgtatatgcctccaagactgttgttgttcatggatatcgatcgatcaagaactgaaatgtacgttttgatgctccttgttaatttttacagggtctgggaaacatttctgatcatcctggtggtgtactcggcgtggatctgcccgctggagttcgcattcctgaggtacctgcccagcgcgccttttgtcgtggacgatgtcgtcaacgggtttttcgccgtcgacatcatgctcactttcttcgtcccgttcgtggacaagaagtcctacctcctcgttaacgatccgaagaaaatagcagtcaggtacgtactagctagttagttcagaacttgaacagctagttaatttccggagatcaggcagacagacaacatggcacagcttaattttcttgtgctcactgcattcaggtacctgtcgtcttggttcgtcttcgatgtatgctcgactgttccattccactccatcagcctgctgttcaacgagcacgggcatgaccttggcttcaagtttctcaatgttctcaggctctggcggttgcgtcgagtcagttcgatgtttgcgaggtaaacgccacacgtgccctaccaatccactgtaaaatggttatacgctagccagtagtcagcatgtgacatatatatactatactttgatacaccatatataggcttgagaaggacatccggttcaactacgcggtgatacgctgcacgaagctcatctcggtacgtccatgatacgatatcttttcctctgatcagtacgttctattcctctgatcagtacgttctactccaccaacgagcaaaacgaaacttctatctgcatggcaacaccaggtcaccctcttcgcgatacactgcgccgggtgcatcaactaccttatcgccgacaggtacccggacccgaggaggacatggatcggcgccgtgatgcccaacttcagggaggacgggctgtggatccggtacgtgacggccatgtactggtccatcacgacgctgaccaccacgggctacggcgacctgcacgccgagaacgccagggagatgctgttcggcatctgctacatgctcttcaacctctggctcaccgcctacctcatcggcaacatgaccaacctcgtcgtccacagcaccagccgcacccgagactttgtacgtactgtccgatcctaccaaagcttctgtgcttttgttctctgtattgtggtttgacgatcgaaatggcttgtgcgttatttgcagagggatgtggttcaggccgcctcagaattcgcggcgaggaaccagctgccgcagcaaatagaggagcagatgctgaaccacatatgcctccggtacaagaccgatggcctcaagcagcaggagacgctagacgtcctcccgaaggcgatgcgatccagcatttctcactacctcttcttccgggttgttcaaggagcctacctgttcaagggagtctcctcaaggttcatccagcagttggtgagaaacgaggctgaattttgcataaaaaattgcgtaatggaagaccctcattaacaatttggttgtatatatgcaggtaacagagatgcaagcagagtacttcgccccaaaggaagacatcatactgcagaatgacagcccatcggacttgtatcttcttgtatccggagcagtagtacgtaaaatctagtactttaatactacctatatatgtatgatcagtgcacaaatcgtaacggaaaatgaatttctacttacaggacattctggtattcctagatggaacagaacaggtaatggtatctcctgagttgctgtttctgaaaagacagataacgggtttccggacaaagatcagacgcacttgaaaaaatgacacctggggccgtttcatgtttcaggtttacaggagagcagctgagggagaactgctaggggagataggtgtactgtgcaacaagccacagtcgttcactttccggacgacaaaactatctcagattctgaggatcagtaggaccaagctgttgggtatcatccaggagaacagagaagacggcgacatcatcagaagcaaccttcagcaagtgaacgtataagtgggctagcttcgctgggcgtgctcaacgcaagacagatgcctctgttggaaaatagcatttaagttttgagcggatagcatctaatagtttctgtacaaaaaactaaaaatggaggaaagatcatgcggtggaactggtgaaaactgaaaagattatctgtactagaacatcatgcagtgtaactggtgaaaaaacgatctgtgttcggacagatcttggacgttgagacaatatcacctgcctgtcaaagaaaactactactacctttaccaatcatttagggttcacgcagtaaataatgtgacttcaaatctgtgtaagcttgtaacaaacgagatagctgtaatgtcccggtaaagaatggctcgaagaaattgagtatatatttggttccttctttcggaccgggaagattttatagaatgggcctttttagcacaacaaagttgtattggtttttgcaataagttcacctacagtccctcaactttacctcaagtctgtatgacatccctattccccaataccagaaatgttttacccctcatgtttaaaaccatgcaaaataggtcctatagcagtatatataggtggtttcgctgacgcggcatcctagtcaacaatatggatccacatgtaagtgagatgaataaaaacgtgggggtcagcatcccttctttcttctcttttctcttctctttcttctccttgccgcagagcgtggtgcggcagcgggcggcgacaagcggctggagtaggtaggcgcagcggtggcgccgggcggagcggagcagcggcggcggcgggcgagcgccaggaggtcgctggcagcagagggggagcgacagcgagcgagcgcggtagcgggcgacttaaagcaagcagtcggagagaggagccagccgagcagagtgggggcggcggtgggcgagctctcgcatgaggctgtcaaggttgatgtcgaagtcgtccgatgccacagccgcggtgccgccgcttctgcttgcaccgggacagggcgtaggaggtagatgaagatggcccgaggaggtgatgaggtggttccggcagagagcaccaggctattgggcaaccgtcaactggtccggaggtcagtgaggaaggcgggaccggccatgcaggccatggagcgggcctgcgacggagtgggcggtggatcggaggggacccggcggcagtccggcgtggtggggagctcatccgccgcgagcggcatagagcaccataccgggctccagcggtagtgcgcgcgacatccttgacggggaggtgggagacgaccttgctgaggagctcgtcagggagggtgctgatgcggtcgacgacgtcgtgcggggtaagtgcgcagaggcgtgtggtagcggagacgggcgggctggggagggtgtagtggatgtaggagagcacgcgtgccacggtcccatacacatcatctgggtcgtccccgcgccgccggaactcggccgccattgcgcggcccatgggtacaagtagcacacgggtgtccatgggccgtcgctccgcttgctgccctctttctgcttcgctcgccccctgctgccgcactagcccgtagtggcttcaccctctgccaccggtggcctcgctcgctgaagaagataatagaagagaagagtagagagaaaagaggagaagagatggtagacctcacttacatgtgggccctatatatatatatatatatattgctgactaggacgcttcatcagcttaatgagagatccatactgctataggacctaacttgcacggttttatatagtttaggggtgaagaattcttgtattggggattatggatgtcatacaagctggacgtaaagtggagggatggccggtgaacttatttcttgatttttattatcatgtgggcctaaatacaagggctgccggatttatcttgggccaagctctttacgcacaccaccggggcctaactagtctaagatcctagtatgggctttttctcaaaagaaaaggggagtaggcccagagataaattaaacgactcagactactctttctccccgtttttccgccttcgctccgctccactgtcccaaaagggctaaaacccttctaaaaaaaataaaaagcccaaaaccgatcgagtacgtccacaaacacaattcggatggaatatcccgaaaatttggcgaagaaataccattggtggtctacgagaaactcagttctaccacaccaagccctcttcactaagggctgtgtttagttcagcgtaaagtttagattttggttgaaattggagttgatgtgactgaaaaattgtgtgtatataacatgttaatgtgatagaaaaggactgaagcttggatccgaactttggatctaaacacagcctaacacgtgtactacgagaaacacactgcgaaccgtcgcatcgctggaggacgtttgaaaatcgaaaccgaagcccggccacggcactggaccacggaaactggaagccactcgagcgcacccaccactccgtccgcacgccaccacttcgtccgcacgccccctcctcctcggctgcgcggcaacgagtccaacgagtcccccattggattccctccgccggcacgcatgacgcctccagcacaaccaacggctacctgctgactgactgactgactcctgaccgcctttaacttttaacggctactccactcaaagcggcccgccaacgggccccgctgggccccgcccgcccggtcaccggggattcgaacgtttcgccctccctgcgaccaccaacggctacatcccacctataaattccccctcaccacgccgcccatttcccgcactgcaattcccacacttgcacgcacacacgaacaccacagagagagtccagcggcgcccggcgagaagcttcagccaagtcacagcggcctcggcttcttgcagctcgctgctcttccctctcttgatcgtgtctcgtgccacacatcctcgtttcgtcatctccatggcggcgtcgaccaaggccttggctctcctcttcgcggtgctcgtcgcgctcgtggcggcgacggcggccgtgagagtgctggaggaggaggccgtcgagctgggcggcctcgcgcctgctcccgcgccggccaacgcggcgggcgccgtcgcgccgggggcgtgggccgtggccgcggtcgtctcgctcctggccttcctcgcgcattgagatgagattcgacccctgagagggcgcagcgggtagtttgcggaatctgttgggacgggaatcctgtggtttggatttccgttgcagcggtagcatttggtgtttatctgaggagattattgctgtacgtttctatagttattttaggcgtgtttgttctagtccgttatggaggtgttgtgtactgccgatctctcttttgcctgtataagagaggaatatggttttgaataatacaattcatttactattcttttataagctctgtcctgtgcactctcagaaaaactgctcataaagggccaaaaatactcggaacacgttggtactacactcggaaaaaggaataagttcatttagtgaccctcaaaagtgattgaaatctaatccgtaaccttaaactacaaaaccggatatctcgactcccaaactcttaaaacccaccaatttgactcccttggtggttttggaggacggttttgctgacgtagcgcctacgtggcggtattgaccgggtctcttttacacgtggcgttgacgtgacgtttaggtggcatttagaattaaaaatatgtgtgggacccatttgtcattgacatgcaaaagaatttgtgggacccacgtgtcccttctctctctcccctccctcctgttccttttcctcctcgccgctccctctctctctctcgagtggcagaggcgtgggcgtggcgcgacggcctgcgagcggcggaggcgcgggagtggcggcggcaggcactggagcggcgacggtggaggcatcagtgcgccagctaggcggtggcaagcaacagccgtcatcggtgacccgaccaagccgcaccaagcaggatccgcggcaagcaggaagcggtgagcagcggaagccgacggctgttgcttggtgccccttcctcgacgtcggcgagcaggaggcggcaagcaagcccagcggcgtcgcccttgctggaccgcagaaatggtttcttctcaattctaagcttgctctgctacttcattggatccggcggccatctacacgcagcggtaggccaatagctgtcatcttgccagatatttctgtcccacaaatacactgaatcttgctttgctgcaaatgggaggttttggtagatgcatagcatttggggatctctttcctttgttatctttaatttccttttctcttttttatgcatgcgaatgatttgtccatgtaaaggtgaggagtagattttggttttggatgaggggtgatgcaactatgctaagattagttattttttctgtaaatgcgcagagttagcagtaactatttgatgttgatacggatggtgatgaagcggaggaggtggagaaggaggtcgcgtgacggcggacggcggcggtgacggtggaggacatcgtcgtcatcgaccccgccgcatgtgcctccccccgtcctcctgctactcgcaggccgccgcgccatgcccgcgcctccgccgctcaccgccgtctctgcccgccgccgctccggccctcgccgccgtcgccgcgagagagagaagggacacgtgggtcccacaaattcttttgcgtgtcaatgacaaatgagtcccacgcatatttttaattctaaatgccacctaaatgccatgtcaacgccacgtgtaaaggagaaccggtcaataccgcaacgtaggcgccacgtcagcaaaaccgctctccaaaaccactaagggagtcaaattacaccggttttaagagtttgggggtcgagatatccgattttgtggtttagggccacggattagatttcgatcacttttgagggtcactaagtgaacttattccctcggaaaaaacattgctcactacatgaggacgatcaggatctgtcaatttgatccgttttctcttgttcttttagaggaggcccattaagctctccaacggacccaactggcccgtggcacatacggcccactttctgttcggtttcattcagaagaaagcccacagactggcccgtttaattatgaaaacacatgcctcggcccgagtgtagcgtgtatggctgtacgcatcatatctacagggagagatgatcgccaatttgcgatcgcccatcagatcaaatgcaccttttgttgaacgcgcttttgttctggatctctttaggataagatggtggtgtcccgtccccctcccccaggccccagctattccagcttccgatcaagccgcccgccttacctctcctggccgtcccaccccaccatccaaagctagatagcaaccacacgtgcccgcgtcgatgcggcgcaacacctgtgcatgcacgcattggcgcgcgcgatcgaaatcgtgatgcgcctcaagctagcagtaaaccacctcccccgtgcatctcctgactcctgttcatatatccggccgctgttttcccccagtactgttgccggtcgctgacgagacaccccatgtgtacgacgatctcgccctgtgctcccccactgctgcttagttcggtcgttcggtttcggtcgacacggtctagttatttcgtctatctgtgacgaatcgcgcgcatacgtacgtactggagggccgatcggatcgaggactgccactttgccaagttgcgatgtttttggtttggcaacgggcgggcagctgcaactttcaggagatgcacaccagctgttccaacgaatcgggccctgttgatttctccactcgtccacatgtttttttacacgtgagcgaactctatctcatattcctggacacctatattatattagcatatccatacgcatttgacgcatggacgcgtagtgataatcaccagaaagttcagatcaggttactgtgttatactgtactatgctatatatgtatgctttgctagctactagtctcattcagattcagctgctagctgcttgctagctagtgtactcgttcagattcatgcattggtaatcaattaccacaatcgcatgcatatatgccttgatgaagtgtcgtgcgctcactcccgggctcccggcccggccgctcatgcagatacactttaattgcttggctcgtgttcttccttcctggcgcaccaataatttgcagcaagccttttcagccgcatgcaatgcactactcaacgggatcacgggattattgtaacgaaagttttggcacgcatacactgtttgtcaggctagctaaatgttataacagttggcctatatatgtcaccactagctagctagcacgcagagatcacaaatggatttaatcatcgcacccaacaagacggcaacaggtaggcagcaaaacgcggatagccatcgctaacatctccggggattctttagacctcggccactaacttatttactgatgcttccagcagcagtgaagcctaacagtgtcctgataacgggagcacgatcgatcgcaatggcgaattattgatgctagcaggggcggatcaagatcgatgatgatatattataggagtagtatatactatactccctaacagatatgatgggatcgccgaatgactttggttatcatgcctcgagcctatctctgacggtactggtcgccgtaaacatcactggcgattcgagggaggaaaggagtttagctggtgaccacagggttgacggccacttctccttcagagttcagacaagactcccgtgcgatgttaaccggaggaagttgcattgcccggcccgtaccgtgtctgaaccaatgaagcgtagcgtagcgctcgcactccatcagaatgagtaacgactaatcttatcaagaatcagaaacactgatgagcagttgcacgcgcactgatcagagcttcagacaacaggtcgacacaatgtctacaaatatgcatgccacagcgatcaagaacacatcctagatgtcttgaggttacgtctcatgagagatcagagtagagcgtaattaatcgttgaaatctcggtcgttttcagatgtcacacctgagaagctcatgtatctaacgggaatctgaaccactgttcaggtgtcttctccgaggagctcgggacgtgcatgcgaggaggaaaaaacggcactaatcttaaaagctggatggagcaggtagattagatctcgcttaatgattatctctctatcttctggatgatctactgaataatcagcagctcctcacaccacacaattatgaaaactatcaccgtcagctatagcttgtcatgtcagaataaacatcactaccgtgccttttgcaatcagcttgtggtctagtgcttggagaaatatccagttccctgtataccatcaagtcatcaaaccatcagaatcaggactcctatgtcacccagtgcgtcagtcatagtgattagaccaaagtagtccacttgtacgttctggtagtcgtagtacaaaaaggaatacacgatatatacattaattattaaaaggtagcccgcgcaaatacacgggcatgcgtcgtacgctaagtttgagacactaaaagcgatatattaaccggagaacatctaccccaatttctccataaattgtttttgttagcattagttacttttataatttttaacctattagctttatattatatcatatttaaataatattagttatttataatcttcttcatcatttgaaaagaaggtagacttattttcttttgaaaatatttcaatgaaagtaaaagtaagtgtaaagcaaaagaagtgtgtttttatttttttattacacatatattatcatggtttattagaggatgaatttggtgggacataaagctccactaaattttatatagcctaatataatcgatatagtttgagagacaacccatctataaacatttcatgtagagtgggtaagaggttctacgcaatctaacgtgaatacaattgcacaataatatttttgaaatgtgatgtaccatgaatacgcgcttgtttttcttatataagatagatctaatgattaaaaataatggtttcactggtttaaaaggcataggagtattctaaaagtatagcttaaaaatcatggttgttttaatatccaacattattttgaattgaacatagcttaactggttaggttccttgtggtggaaattgcccactcgtgttcaagtcccagacttctttcagtggtagacaacgtacccatcgacagtgaggcactcatggtgactttgtcaatctcaaaatatgtcggcccaatctctcagaggtactcatagggggtaaagtgtgcatgtgtgcgttcgtaggggtgagtgtgcgtgtgttgtgagcgcactttgtctctcaagaaataatccaacattattgataagtttattagttattgataagtttattagggacgggtggacgatgcgtagtatgtacatgctcgggagatttttttttctcaatccggtggatagtagtacgtattgtacatgtgagaatgagatgtattttaaataaatctaatctaatgatttaaaaatagtgggtctgccgaattaactgaaaatcgagggttggatttttttttcttttttatcaaaatttgtaaggttctatctaatttattatagtgccacgtggcagcttaagggcattggtaggagtctcacgtggtggcttgagagttttctagaaagtttaatggatttttcatatataatatataggtacacaggacaaatacacatgcagcttttgcttgcttgttccgaagttgaacattaccgttatattatcatgttatacagaaagaaaattagctttatctttacttccatataatttctatttccttatcaagtagaatttggtacataataggtcatttctatcttaagctctgaatgatatataggtggacaaacagctaggatctgactgattattttttaagtaaatcttatttagttatgaatgttttgtgatgcatcaaattatggtataatctatattttgtttttctcataattcagaatttttagaactttttgaagttcataaatctgttttagttatgcatgccggtgaagtgatatatgatgaaatagtatataatgtcactttcttttaataattgttcatatatgtttgaataacatgtaaagggtctcaacaaaacttaaatgaatataattttacaagttaaaatatagtcaacatgtgtcttaaattctaattgtgattttaatcataaataacacaattgtacaaatagataaaaaattgaacgtataattttaaagttaaaaagttagtattatttaaaatttatttttgcaaataatatgtatttagaagtatgcttatttaaaatttattgttgcaaaagctttcatagagagagaatggaaggaaaaaaacgtagaggatttcctaaaagaaaacggagggaaggatggacgtcttttttttttaaggatgagaaaaattaaatctaatctaatggcttgaagtgttatgtccactaattttaataaaaaaattaaggttagatgtttattttttaggtatataatttaggtgttacgaatgttaaaatttttttaatcgaattccccctgttagctaatacaaggaaaaaggaattatacatagaggggagggagagagaggggcatacgtggggagagggcgaacgtaacgactgaggagagaggtggggaaggtacgtggtctttctttccatttctttatttatatgagattaaatctgatggttaaaataattagcctatcaatttaagtgaaagtggatgttagatcttcttttctcgggatttatagttttttttaatttattagagtgccacgtgatgacttaggagcgtttgaagatgtcacatgacagtttaggagcgtttgtagaaagtataatagacttttatatttaattactaatattaatttcggttttat

SEQ ID NO: 77526 - DNA, 6730 bp, Oryza sativa
gacagagaacatttttgaaacataaactggaaataaagctcgcacagatgcgttgacatcttatttgttgttcaagggaaagaatggtaaaataaatcatacatcactatatacacggtaaggaaataatgtaaattatctaacaataaaaaaaagaaatatattgcctaaaatagatggtagattttaatatactactaaatatgataagaataagaatatctctcatatttaaataaaaatcccgttgtcatggtcatatataaactcccctattgttattgtttcaaaagctatatgcatttttaataaatgaaatgacatattccacttctatgtataaatagtctaaccataccacttctatcggataatacaataacaccattaaaaatagacatgaatatctctctaacggatgaagccgactgtaactactagagctttcttatgtaatgccctgaaacatcggacctacatcgacgtagccgtgcccccaaagaccagcctatagcatcattttaacacttaattcactatcgtcacactcacaaaggattccattagttagtatttccctttagatacattgcctacagtagcctttcactgacaccaccttaacttaaccatatgtatacccttgcaatatttacgatagcatagtaaacactacaccctgcattgaaggacagagagggacagaaaggaggaggtaatgaaaatagttataatttttgcccctacttatttgtgtgtagtattatttttaacaaaatcgtagtttaaaaggctattgacaacacataagtgccggactgctgacgttgatgatttttcttgattagaactatttctttgattttactattgatattttttttgatttatcgtttttctccatagtatatgacataggtaattaagtttttttttccggaaagtgagatgatcgtacgaagtacacatacgtacgttattctttttcgggatggagattagcagcgtgggagttttgatatatctaaactaacggttaaaataacaggtccaccaatttaactgaaaattgaaagttggatgtttttcttttttctctgattttttaggatttctctaatttattagagtgccacgtggcgacgtaggaacgttgcaggaagtttaatggacttttagtatataatagatagattttgaaccatgtacattatcacagtcaaaagcggatccaggataagatatattatatgaatttattttgggactaagagggtactgtatatatatgcctgtgtcttaactccgacggggaaaaaaatataagactagttcatactctttcaacaattgagctgtaaaattagtacccctactgtttttacctgacgattaatttggagatctctatacagtttcaactgcacatattgatcaatacgctttagaaatatatttaaaagtttttaaaattatagcttcataaaagtacttgtcataatgaatttattaacatcattttgcataaagtcttaatttttatacattaatgatttaaaattttgatgtttcacgcacaagttcttgaacgccgaaaacccgtttttcattttctagtttggttaccacaaatcatgtgtgcaatacctatactaattcggtactcaaaatgggcaaagctattgaaaagtaaggaatggattctaatcctgggatgtcccctttgtttctttttcttccgaaacctatgtaaatagttataaaaaaattaatacaaattgaatagtgatatattgaactccaccaaaaattaaatttaaatttgatctgcacattaagaaaaaaaaacaaactcaactatgaatatataataccactattattcatatgttaaatttgtcttttttatatctcaatttgtgagtttgactttagatctaagattatatataatggcacatatatgttgtatgaatgttatatatttttttcagaatttttcatagttatttgaagggtttttagataaatgagaggacattctctcgagggtttaaaacagtatatatcgcctgataaagatatggttgatggttagaaggatcatagtgtcacaattggattaattaatatgctgttgaaaatagtactagtacacttcaggtttttttcattgtcattatatattcaattttagttgtcctaaatatagttgttcctaaattcgagattaatatatatgaaattgcatataggttggactcgtgaattagttttttaaaataattatggaatcgaaaataagttgtaactgacgtcgactttctaatctaatctggtataatttggaaaagaacagtacattgtgtatgcgattgaaattttaatgtttattcaaactagagtaattatcataaaacatgaaattacataaaccgcttatgttatggcttgtggcgtataactacgggttttatggtatacatgtttttgaaaccctaccattattcaaatctcatttgcatatctgaaaaaaataattttcaaaatagtgaagctagaatttaaactaccaaccttaattaataaatcaacaattataattttcatatacaggctatgttttaaaattttaaataaatttgtgctcaacatacatatgcatggtgtggttttgtgaaaactttagaaccattataaatagggttcacatgtcattaatcataaagctttttatgcaacattcatagtaaaacgtgtggttttctgaaatttcacacttgcccgggagtatattgcatttctatgtaagcaagggaaaaaaagtttaggcaaccaacaacaatcttctgttatatactgaaaagcccactaattaaaccttttacaaacgcttctaaaccagcacgtggcactcgtacaaacgctcctaaactgtcacatgtcatgtctataaattaagagaaatttcaaaaattcttaaaatggaaaagtacccagccgttgatattcacttaaatccattattttaactattaaattagatatctctaccgttataaaagttgaagatgtttttgccggtattttggtacgtcatccgtgtttgagtcagttttaagttcgttcgcttttggaatacatatcagtgtttgagtcggattttaagttcgtttgtttttaaaaatacgaaaagagtcgtataagaaattttgtaaaaaaaaaaacttgcatactaacttgagataaaaatcggactcccacagtgaatttcaccttagctaaccgtataataataataagattgaaatagcatccacccgttgcaacgcatgggcatcttttatagtattaaataaagtaaatcccttcctgctaacacccgtaattagcatgtatggtagatcactctcgaaggagtggagagacgtgctacgacgtacgtactcccacggtcatataaaaaatcaacttttggaatgaatttggacaagtatttgtcaggtttatccccagaagttttttttttttttgtgagggggaggggggggggatgatgtaggtacttaccaacgaatatcgtccacaatctcctggaggctgcttttgcagcgttggaggatgcctccatgcttgtggtcgtcaggctcgacgtccctgaggagctcgtggaggtagcgcttcttgagcttctcgccgcagaggcggttgcgatcgccggcgccggcgtgacgacgatggtacgggccgacggacacgaacttgggcgcgtacgcttcctccttgttgatggcgcgcacctgctccgggactcgccacagacggtacttcttcgtcttccaccggaacgacagcgacgatggcgggaggtcgccgccatcgtcgttgtcgtcgtggattatgttcaccctcacctccggcagctgctgctgccctgcctcgtccagaaaaaccatttctgtagtagtgtcatcaccgtttcccataatatgtatcttattgtacgtacgcagcatgctgcatgcacttagttatccaattccaagtatatataggcacgtcgtcgatcgatcgtccgaccggaatttgagatggcgtgtcgccggcggcgatcgatcggcgtgatggtggtgcatgcgacaatggcataaaataaaggaagaagcctcttctctggcctaatcgattctttttggttggcaaatggacgtatcaagcgatcagtgcaagctttgatgttctcatgcatgcatgctgatctgtatgtaagctagcccctttaatcttcttctttttttcctcttcactaatacagttagcatctcaaccttttttcctcttcactatatatatagctagctagaatcgtcaagcttttccttatgttgctacctgctcatgaagtaagctcaggttcttcttcctatattagtctatatacagatagtgcatacgtacgtaatagaaagagccctgtagatggaaaggttctttttttttcagtcgtatggacatacgtcgtttcatgatcaatgccgtcaaaaaattattttttagaaaaatatactaaaatagattaatatgtgatattttgctatataaaagtgcaagtaaatattcgactcatacaaccagaaacaaagacaataacaaatatcaaccatgaattatacgcacacctttttcatggtcatatatattggttgtttttggttcacacacatttgtaatttctagttgtgtatattaaatctaaacttgcatgcatgtttgtgaagtgatatatctcacatattgatatattttgtaaaaaaaatattactttttatgacctttttagttgacatgctttagttggcatgcgcgcataaaatagtctatgtccactcaaatgataaaaagactttcatatgtacatgggattttacatggatgttcagcaattactcatttcatctacttctggaaaagtcatttcatcttaaagaatgccctctctttttatatccatccaaataattatgatttatttaagggaacatatcatatgcacacaacattcctatgcatatactccgtgcatatcaactaacaaatgtcacagaaaattctagaaaaattggacacatacttctaatagtattacatctacgtgtgaaatcttatcttcaaattcgttatattttaaccgtaacaaaaaagacaaaattttgatagatttttacccttaaaactgtcagatttttcactttttggttacagctaaaatataatgaatttgaaaatgagactttgcatatatgtgtaatactattaggagtaaatgtccaattcttttagaatttttcgtgacatttgctagttagtgtgtgcggagtgtgcacggaaagcttgtgtgtaagatatgttccttattttgaagagatatatcactccacgaacattgataacatgtgtttgtaagttttaagctatgtagaggtagcatatcaaatatttaatagagttatatacattgaggaaaggtcctgatctttcgataggtatgaataactctcgatttggtggaaacttgatacacatgattcggtttccgatcaacacgatctaaaccctgcaattgtagcatcacggcttctctggttatcaaccatacgctgctatggttgatctcaccgagaaggctaatctctgcatacgaatcgaagaatacaagaaagaacagtatagattgcaactcaaggtgttgtcgtttcgtgttcaacagaaattaattcaccctttaattggttgaagcaacaaaaattaatcttggttgcctgtgcgcacacagggcattctatggtgcacatttactttttgtccaaataaacaaagcgacgatttgtgatatggtgattcttttgagaaaacataaaaaattctagatgataatcaaactgggatggagggagtagtactttaccgtacgcagcatcggccgctgaattgaatgcaaaagaagatatattgtcatcaaggaatatatgccagaaaaaaactttgagctttatgccaattgagggagagctataattttttatatcttattgctgcacgctcaatatattctttctacttttcaagtgaaaaagtagtcataaaaggtggtgtgaatctctttttttcgataaagctaacgcccactaaatacataaagcttaacatgcaagtatagtatttattagcactttaaaacctacatacaagcatgtcatatcaacccattaagcatacaaaacttaacatgtaagcatatagtaattatatatacaatttatttcatgcacaagctaaatcatcattctcaaaagcacgaattaccctcccccgaattatcgcggtcgaccgaattacccctctaaacccgaaaaccaaacatcgttcaccctgaacttgtaatatcggacaaattacccctcttacctaaatttagagcggttttgtcctacgtggcgtacatgtggcggtctagtcaacattttatttataaaaaaaatatggaacacacctgtcatactcctctctcactcttcctctctctttctcgccggtcgacggcggcgagcgacgccgagcggcggcggccgtggccactacaaggagccgcccctcggcgcgcggacggatggaggctggtgcaggcggcggcgcgggacacgaagacggaggcggaggtggcggcggcgga

SEQ ID NO: 77527 - DNA, 35366 bp, Oryza sativa
caattcctcactcccaagagacagaatggccttaccagccatactggactcctgacaaccaggatcatcatggatagtagcaacaaggctggtaaatagtgaagatcaataccaaaagaaaactaaccacattctctttcaccttgtgtggtctctgtcttcttgaatatacaacattgctttcttgaagaatgtatgtactacggttgggagaagaaatagattaaagagatctgtatagatctgcctccatgaaaaaagggagatcaaattaactgtgcaaggacactccaagatagaagagacaaagttgttgaaagaaaagaaaagagaggacaaaaaaagtttgggcaaaggtattgttgtgcttaattacatcagaatgaaggctagacatgctagatgcagtcaatattaatgcaccccaatcgaagcataattataattacattttggtttatcacagcttttgatatgcattagatatttttcaactgtaaaaagtagtattgtttgcatgtactgtgatgtacattacaccccctggccggtcccttctctctctagatgggtgtgtgcgtgtgtgtttttcaccttgcttaccttgtgcttcaaatgcatccagggggactaaattcccaacttaataagttctttttcctttctagaggcgcaaaaattgtttagcgtttgggtactgatgctacttactttgtaacgagagttgaattcatctgccatgcatgttggtttcaaggaataaactggcgttgacatgcatgatttttgtggtctatatatatcacatatatatcagattactcgatgatctaactagttagtttactgctgtacctgtacatatggatttaagaatcagagtggtgttggctatatattaagagttatgcttgcatactgatactgatgtacatatacgtaagcacagaaaattcctttgttcatgtaaaaaaatatcagctctcaatatagacatgtgttgtatttatacaattaatgtgcagtagtgcacctgtacctattggcatttcaagtttcatttacatattacggtgtatatatatagctactaaattaaatacaaattaattaacagctatttaattattgcatatcaatttaatgttatgcatatagtgtgctattttttgacaagtttgattacagttttaggctagactattttcaggaggtacatacgttttttttttaccaggggaacaattaatgagcattattagtattgttggatatatactattacattttagaaatacaaatattagtatattctaatttatcactattgcatatatagggagatctctgtgcatcgtcatactattccacagaatatattttttttgtgtgttggggggcactaacaaatatcacagtataattaacacaccctgctatttatactttaataccgtgcatgcatgttattgtcaatttatttacattaagttgcatgccctacatagaacataaggctttgtttaatttaacaaaaatgactcctttcaaaaaaaatttaacaaaaatgatgatttttggagtacttgaggattaaactgaacgaatccgaccccagcatgtacgttgcacacacatatatatggaatgaaaccaaaattgcattgttttttactgctccttccgtttcataatgtaagttattctagcatttcctatatttatattgatgttaatgaatctagacatcaatatgtatgtgagaaatgctaaaataacttacattgtgaaatggaggaagtagctagcatcactagatgtactgttttttttttcgggtaatgcacatatcactggtggtgtactcctacctattgttccaaattaaagagctagcgcttgtagttttcaggcaaaagtgcaacatatgaatatatgtcgatggaagaagaaaggtgcaggcatatgtgctagctgcttgtttaaggttgtcgctcgcatattctactgtgtacatttgtgtgtgattttgtgcacgtattaattctcattcgatcgtacacgcgacgtatatatatgccaattaattaatgcacgcatgttagagatcgacaaaaacatgtggttaatgtacgcatttgcatatatagtagtactatatgtttgcatatgtacagtacaccatttagaacaaaattaatctgcgaggacgtatgtgggtagctctaattaagtcggaacacctaacataagtgctagtattagcgcgcatgcatgcaacgccaccttttgtacgtagcatggtttcatcaattagtttcgtttccacattatgtgggaactatgaaacttttgggtaattagctattacccatttaattaattaattaggctgaagcatgcatgatatatataattttcttttcataatcctccaaaatgaacagcaagttattttcctacatacctttttttatgaattagttttgataattacaaacgggcctcaagaccaatacagcaaagtgctcttttttaactacttaattattgtattttgcgtttctattaaccataaacctcgcatcatgatagatcatcctatatatcgtacgtgctggctaatactgcattcaagtttactacgcatactccatatatatgcatatttaattttctttctcaattcgatcacatgagagatgcacccaccacgtcactgcttgatggggaggaagcagcaacgtgcatgccagtaattgcctgtggaccatgcatgggcggctctcgtatactcccgcgttttaaaatgtttgacaccgttgacttttaatacgtgtttgaccattcatcttattcaaaaaaaaattaagtaattatctattcttttcatattatttgattcattgttaaatatgcttttatgtatatatatagttttacatatttcataaattttttttgaataagacgaatggtcaaacatgtgttaaaaagtcaacggtgtcaaatattttgaaacggagggagtatatatcttggctgccggaatagatatcttaattactcgcagcaattttaattaactaattgagttaaatcaacactgtaactgaatctctacttaattagacgtacgatctaaatttactatctccatcccaaattaaaatacatggcacaactaccattgacacaaatatcaagaattattatcacctctggatcactctaataaaatataatacatacacccaaaaatattagattagagatttttaaggtgtatgatttaaaaatgaattaaaaggaagaggaatgtgctagttaactacatatatgcatgcgtgttttgtattaatattaaaaacaaatggttacgtgtcttactcttgtaccctctccgtcaaaaaatccaatcatacgtgtacccaggttcgtagctagagtttgctcttttttttttttgacagagtagtataaattaagatcgagtacctaggaagcttctatcttctgatcattaatgcagggggcatattgatcgatataggagggtttcacgtacgctaggtataaaatgtgcgtgtgcagtagtacatgccacatgtgatagtcccaaaatataagggattttgggtgaatgtcaaatcccttatatttttggatgaagagagtgtatacttagctatagctagtagaatatgtgtatatacaccaagctagattaccgttttatctagctaattgggatgagattcgtgtgcgctaatatatcctaatataacattgatgtttgatgaaacacagtacaataccttttttttgacatgaaatatattcaaatgacttatgatatgaaacggagggagtactacctatacattatatattagacatttatatgttagcacctcagaatcggagataaccctatactacaattagataatggaggtattccgatccctaaaaaaaattaaatgattggaggatcgatagagattattccggacctcagattgtacgtcaactcgatcctaggacctaccatgcatcgatatcagggtacgcgcttggaatatgatctcttcttttttactagctactatgcatacctttctttctgtaccatcatcgaattttatctggaagatgcttcttaaatatcactcggtctgatcatatatatacacacgaactgatcatggagttcgtctttctagggcataatgctacttctataattgctgctgagaatctcagtgctaaggagagaacatatgcatcgcctttcctcataaaaaacttgatgatgaacgagttaggtaaaggaaaggttcctccttgtttgttttgcagttaatgtcccctattatttgttctcgcatttgtcttttagcgaatcataataaactatctctatctttataattctacctttcagagcagctaaccaaagaagtaacttgcccatttgtgcgtctgtgtttgtaacctagctaaattatgaacattattcgtttcatctctaaattaagactgaaatatatagttcttgtacaatctgttttgggcaatttaacactagttaatatttactgctagatctctcagccgatatgatagtatgatatgatccaagctactgatcatgtgttttgttgcctatgatatgctcagagcctcagagattaataaaaaataatggttaggttcagacagtttcaggttcatggaacatcatagaacaaaccagatgctcacatgtccctttccacaggagatagaaaggataaaagaaagagtgaaaaagagagagttcggccatgtctcatgtctgtcttcttcactctcatctatttcttttatggccatgcaacaaaacaaaacaactattttgttaacaaagaaattgaaaagagatcgatctggggatatattctctctcacgcgcacaagcatatatacaataagaattaatacaccttaattatattacttggagacgatactatagaaaagaaaaagaaactaaaagtgcacatgtgtgtaggtgagttaacctcttgttaagctctcccatgtgtcgttgattcggtcccaaaaagaagttgcaaggcgaattgtactgttagatagtgggattgagaataacacaacatggcctagctaagctagcctatctttcctttccggattattctctcccaaatgtgatattgatctagctttagtttcttcttttcttttaagcaattgttccctaatcatatttaattatctcaaaggagtatgcctatctattcctgcctccaatgcgacgctgtttccttacccacatttgtggttttagtgctgtgtaagtaattaaacctagctagtaatggaagtaagtaaaacaactttattttcttgaaaggtacccatgtgtgcgatatttgtggggaattcggattttagaaccatgatgaataatcatatgcacccaacttctcaactgtacctcgatctgtcggtctatttaggagagttttagattcagataagcagcttgagagaatagaaaaaccatgtgaaaaaaaaacacacaactgaaaaaaaaaacatttttgcaggcgtctgcttcttattattttcctgaattttaaaactatataacttctccaaacctaaataaaaaaactaaactatttgagtagcttttgattgtcggaagcctctcctaaaatagccatgtgtttcccgccttcccaagtaagtaaaacaactttgggctatagtagtggatgggaacagaagagtggactaattttgtaataatattttgtgggaaataaaatatatgctggtgcgggtatatcttagattctgttggctttgcaattgtcgcctgttgtttgcagatgcgcgctccgcttagaaaatagcagcagaattcctcccaagaatatgacaaatccgatcatccgatgcgtcatggaactcgtggcgtcatcacatcagcaaatccaagtacggtgaactactacgcttcaatcaatttcccttttcttccaatgggcctcacaacgcaccgcggcccaatagctcttagcccattgccatccgccatctcggcccggaaccgcatgggccggcccacgccacgccgtccccatcacatcacaccggcccgcttctctctcgcgcgcgcgggtgaagcgtcgcgcggcgcgccgtggcgtggcgtggcgacaggtgaagcggccggcgaggcgaggcgaggcgaggcgaggcggcgtcatctgcgccgcgtccacacacatgtacgtcgcgctacgcgcccgcggcgccttatcttgacaccagaatccacatgattcctgagccccagctataggctatagctagctgctgttgctgcttggtcccggataacgtgacaaatgcgacatggttcatgcttgctcgattgattgattgcaatagacaaaaactcttcttgtctcttcacctcgccaccggggccgccatacaattacctccataaatcttggatagaatgttaggagtaactaactctgcactgtgccattgctgtgtgtcagtgtgtgtatatatatccagctgccagctgcagagtgaagcataaacatcagtagacgacggcgatggcgcccaagcgacttgtctgcttcttggccgtggccgccgcgctagccaccacctgccacgggtggggcgccggcgccggcgatgtcgtgtcgtcgtcggcggcggcgctctcgttcgtggacaggctgaggcagatgatgatcccggcggccgtgggcgacggcgactactgcgacagctggcgcgtcggcgtggaggcgaacaacgtgcgggggtggacggcggcgccgcgcaagtgcgacaactacgtcgagaactacatgcgcggccaccactaccgccgcgacagcaaggtcgtcgtcgacgaggccgccgcctacgccgaggccgccgtcctctccggcgaccccgccgccgacgccaacgccacctgggtgttcgacgtcgacgagaccgccctctcccacgtcaagttctacaagaagcacggcttcgggtaccacagaaccgacgagccggcgttcatggagtggctgatcgccggcagagcgtcggcgttgccgaacacggtgacgctgtacaagaagctgctcctcctcggcgtcaagatcgtcttcctgtcggacaggccggacacgccggagctgaggaacgccaccgccaccaatctcatcaaggaaggcttcgactgctgggacgagctcatattaaggtcacgttacaaactaattaatctctgaattcctgcgtgtactccctccgtcctaaaatataaatatttttagcatagtgacaaatcaaatattttaaactttaaccattaatagtaaaaaaagatcaatcatgtaaaattgatgttactagatttatcattaaacaaactatcatgatatgtaactctttttatttaaaacatcttacttatatagatattgttggttaaagtagcatctcgcagaccgtgtataagagtctaaaaatgcttacattttgagacggtgcgagtataaaattgatgaaatgaacgaacaggtcggagaactcgacggcgacgggatcggtggtggagtacaagtcgggggagaggaagaagctggaggaggagaaggggatggtgatcatcggcaacatcggcgaccagtggagcgacctgctgggctcgccggagggccgccggaccttcaagctgcccaaccctgcctactacatcgacaactacaagcgcgccggcgccgccgtccgcgccgccgtagccattacagcctcctcctcgtcgtcgtcgtcgtgaagcaaacgatgcctagctagctatagtactcaactttgaattgcatttttttttcagacacataagttcagttaataatcggtcgtgtacgtacctgccgtgctgtgcactgttgtatctttttggtgagacgattgaaatatctttgggtttatcttttataattggttttaccgtgaattaattaggcttgctgctaatgacaaatttctgaggagatatttctctctgctggtctatatcctgcctccggtgtcgcacgcgtgtgcatcggctgttggcgtaggcgattgcagatgcacaaccttatcctgatgaatacgctacgtgggggcatccgatcttggatgggctcttgtttggccggcatatcaacatctactacctccgtttcttaataataaaagccgataactttttatcaatatttaatgatttatcttattcaataatatttatgtaaatataaaaatatttatatcacgtttaaagaacatttaatgataaatcaaatctaatctacttacggttggttgatttgttgccatacgtcgaaccattttgtttctatagcaggtttttacatctcaaattaattaattttattagtctaaaatagttgacttttattgtgttaactatttttcactattactatttgtgatgctatggcttgaatattgaacttttgcaatatactctctgtttgaaaagctcgtttacctttttctttttcttaccatgtgcgaaacaataaatgatattagtgtataattaattagttattaagtacgacaaacttgaaaaacatgtttatttgatttttttaaaataaacttttatatacaattatttttaaaatatatcgtttaacagtttgaaaagtgtgcttacggtaaacaagggagttgcaaaagcaaaaaagaaaaacgaacacaccctaagattgtgttctcacttctctcgtttttcgcgtgtatggttttcaaactgctaaacggtgtgtttttttttaaaaaaaattttatatgaaagttgttttaaaaaaaatcatattaatcattttcttttaaaaaatagttaatacttaattaatcatgcaataatatgtatttcgttttgcttgccgggggggaggggtttccgaacacagcctaagttatggttggaagcttcagccttcaagctttataataatagctttctacgtatgtaagttccctacaatacttcttttaaatttataacagctaatccatttggttgtacctcaaatattatcacatcccaaatcatcagataatccgttgcagttcagccattcatccattaaagcttggaaataagtgtgatgcaatgtctccaacaggtgcaagtgcacaaaataaaaggaggagaaatagggtggctcatgatcttgctcgaatggcaatgagtgctaggtctagtgctgactggagactgtatgctccccgcccaaatcctagactcgttaaaccaagaatgtaggagtaatcatttattcagccaatgtaaaaaaaaaaggtattgggcctactataaccccccaccccaccaaaaaaaaatctattaaaagacagcatgatgatgcaaggatcaacacccgggcaacaggctgattttccattacgggccttcaaggcccataatactactgatttacgtgcgatcaatcaaacatacggtgagcagagacgacgcttgccaagatttgggcaaggcaagtcaggggcaagaatcgaatcgaatcgaatcaaatctctgggagcacaggacgagcggagcagagcaattttctctctcgctctctgcttcactctcatgagatgagagatattcagatgcgtaactctaaccctgccattaccagtagagacgtttgcgattgctttgcttgttccagtcctggaagagaagagaattttgatctagcagcaaaaccaggctctattttttttccctgtcatgtgttttccgttgctaatttttagtcagcattcgatgttatcagtcagtcattctgtgccaaaaggaggactgacatcgttgttggtgaatggtgaatcagtggtaaactaaacacaactgattagaagtttagaacaatgtgatgaagggaaattatattgctgaacacaaaaggcttcctgtgtgtccagcgattgcgttttatacttggtatatttggcaagttgttattatcgcaaaaatttctagaaaaatgagagaaattttggttcctgattcttgcaaccttgcaaggactgtttcatgtgaatggccctccaaacacacctctgtatagacttcatcttctgaaattcgaatgaccatgtagcccagtatcttatgagcattttattcgaattttccagttacatgggaataaacttctttagcttctatctcacagaaaggtagactatgttggcttccttcttatatctacccatagggcgcacaaatatgtgaaagctatgagagcaactttaccgagttcgccgattcaaatttcaacttttgacctacaaaatatacttcccttccagcaaatcagctgaaagcaattacatcatttttcgaagctaagggtctagaatagtgctgcaagattcccctttctttcagaaatcactaggaacgccacaatatggaccataaatatcactagcacattgataaagtttcctagaattgaatcacactaaggtttttccgaccgttttcatccctgctactatctccgttctctcatcaaaccgttttatctcggaaagcagattgaccagacctttaattgttcagacactatctcaaccgcagaagtattttatgtttaacaaacttacaaattttacccgaaaattgatttgctacaagctattgctggtctctgtagagacatgctaatttcatgtatcgcatttttgttacattttctcagggaactggaggggttactgtcaagaagaccttatctatccatcatcattggaatctatgaggaaccgatgactcctggccagtgcaacatggttgtggagaggcttggcgattaccttgttgaacagggtttctgaactcagaatctgcagtaagagggcaactgggtatatgtatacaagaatctgtcattaatcccataaataatcagcacaaaatttgggtatctgtttaaaagtcagttcgtcattatgttggaattgttgagtacatgacatgtgtcataaatcatgcatgtaattgtttaaccatggtggctgtgatgtttttgaagattatccagtttctcttcaatgtgattatccaatttctgcttaaaagcaaggaaattctctccattgctactttgcgctgcaccgtattgtttgttatctgctactgcctccgttttttaatagatgacgtcgttgactttttctcacatgtttgaccatttgtcttattcaaaatatttacgtaataataatttattttgttacgagttgttttatcactcatagtactttaagtgtgacggagctcgtggctcctcaccgggagaccgcgcaggcccccctttgccggttcggccgggggcttagggtgagatctcaagctctcgctgtgtgtggaaagattactcgcccgcaagacacacgagacacagcgatgtatacaggttcgggccgctccgaagcgtaataccctactcctgtgtttttgtggatttgtgtatgaatgagctacaaagtgtgtccacttctcctccgctctaggctctaaatctggcaagaatccacccacctctctatgggcaaggtcctccttttatacttcaaggggataccacatgcacccttccctttccaaactggactttttcttctttacgtaaatggacggagatttgcacggttgccctccaaacgtccttctgatgggacggcacatacctacctccacttctgccgggggcaggcgcgtcgcgggaacgtggctgtgagctgacgacctgagcagtgtcagaccggtcacaaatcggtcattcttgtccaccgcgtgtcagcttagcaacgtgcatgtttgcccttcttcacacaacatcttgcctgtaatggttaggatgaagcctggtataaatctgaccagggctaacgtgccatctctaagagataacacgctagctccggcttgagacgagttgcctagaggctttcgtcttgacgggatggggcaaggcgtgcgtcagaccgccagtcgccacctaacccttgatctgaccggtctgtgactggtcacagaccggataaaagagcgtgctgtactgcgttacatgcagcgtgacacgcttgaccagactgtaataaatgctgttaggtgagcacagctgtgctcacttatcccatatatgtggcgcagacttctttaaggggtcggggtgcctcggccctcggggccggggcaagcgtaacccgaccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttccgaagggaagcggtcaggtgtgacgccacccctaaagcctggtgacaggtgggaccggtctccgtagttgggcaaaacacccaacggtctcaatccatgcacattggtattggtgactttggttgtccataatgggcggtctactcaagactgccacatcacttgagcagcgcgcgaatctgggtgagcagatttgtctcgctcggagatacggtaacgccgcttcggtcggcgagcgtacttaatgcgcgcacgatacaatccgtttcgattgccacaaccgcatatccacttcatgcgccgtaagcgggcgaatgggattagtggaagcgtgggcacgggaaacgagggagcgagatagcgagatacgagggagcgaggtagtgggcgcgagaaacgaggagccaggaccagcgatggcaagggtataaaagcatcgaggaaaggatttgctcccttcctttcgccattgttcctcttgccttcgccgcctgagctctaactctttctctgctacgccctactttcgccacacgcgctcgttcccaatcatctcttcctccaccgccatggcacggggctctgctctgctcgacggcagtgtactgccgccttcccgcatcgtgaacgagaggcacgccggactgccgcgccgcttcatgccggagtccgccaccggtcgggagatagtgatgctgggcgaggggcgcccggcaccagactacccggggcggtccatcttcttcctccccttcgcaatggctgggctggtcccgccattttctcatttcttcatggatgtcctggagttctacgatctccagatggcgcatctcacccccaatgcggtgatgacattggccatcttcgcacacctgtgcgagatgttcattggggtgcgcccctctcttcagttgttccggtggttcttcaccgtgcagtcggtgtcgccgccgtcggtagttggcggctgctacttccagccgcgggggccggtgctgaaccgctacatcccctgcgtcctccgcaagaagtgggacgactggaagagcgactggttctacacccccctcgccaacgaagcgcgcctccgtcttccaagccagcccccggcgcaggtctccagctggcgggcgccggtagatctgggggaggagtacgacgccgtcctcgaccgcctggcgggcctgcgatcccaagggctcaccggggccatggtgtacggcgattacctccatcgccggattgcgccgctccaacggcgcgcccggagcgcctgggagtatactgggcctgaagactatatgcggacccaccagggagccagatgggattgggctcctgaggacttcaagatcgtagtccaaagggtgctgaatcttagctccgcggaggcgtctcgccttcctcaggagatcctccccctctgcagcgatcccgaccgcgtctccattctaaccattatgatgggggtcggggcctcagaggagagagcccctaagggccacgacggcgcgggcgtgcgccgccggggggaacaacctgccccaggagggggtcgtgcttctgggccccgcgtcgggggctcggggagcagccgccctgccgacgcccaggggaagaggaagctgggaggtacacctcccccatctcctccccgagggggcggggcggcgcgtgccagcagtcggcgcccggagggggccgcgccgacgtcgcagcccgagggggtgcgcaagaagaagcggctccgtaagacgggggagacggaaccatgccggggaaacctgatttcccctccaaagtggtcattcaaccgaccccctcgcaggttcgtctcactctcattgcaaccattttcctcccaaaaaagaagttttttcttactcattttgttcgtctttcggttttttcttctgcttcagcgatgtcccgtcgcattcctcccgccaccccaaatccggccagtccgaggccgaagatccggcggccgcagaggagcggaggcgagagtctgaccggcgtgaagccgcagcccgccttcgggaagctgaagatgccgcccgggaggccgcccgggttcgccaagcggaggaagctgctcgggaggaggccgcccgggctcgccaagccgaagaagctgcccgggaggaggccgcccgggctcgccaggctgaggcgacagctgctgctggcgcgtcacttgggcccactccctcgggcggtcctcaggtgacatcctccgaggcggctcgcgacgaggccgcgggcgcatcgcctgggcctacctcaccgggcgacgcccaggatcaaacgggcccgggggacatccccgagcccagcgcatcctccggggggccaagccgcgtcgccttttctccaaggcgacttttctcctcgtcttccgttgccccggtgagcgccgagcccattatgcaggccttggccgccgcaaacaccgcggtgctagatggatttagcgcccaggtggaggccttgcgagcggaacgagcggagctcgaggccgcatgggcgcgcgtcgaggaggggcggcgctcggtggacgccatggtggaggtgggccgtaaggcccaccgccgccacatctcggagctcgaagcccgcaaggcggcgctggcggagatcgcccgagaggtggaggaggagcgagaggccgccctcgtcgccaccaccgcgatgatcgaggcgcaggactccctccgccttcaacacgggagctgggaggcggagctgaagaacaagctcgacgccgcccagggggtcctcgacgccgccgccgcccgagagcagcgagcaacagaggctgaagcggcgttgcggcggcgcgaagaggcccttgaggcccgtgccatggcgctggaagaacacgccggcgccgtggagaggggcttgacaggccgcgaggccgccgctggtctccgagaggcgacgctggtggcgcatgaggccgcctgcgccgaggaggagtccgcgctccgccttcgcgaggatgcactcgctgagcgggagcgagctctcgaggaggccgaggccacgacgcaacggctggcgaacagcctctccctccgcgaggcggcgcaagaggagcaggcgcgccgcaaccttgaatgtgtccgtgccgagagagccgcgctggagcagcgggctgccaacctcgaggcacgggagaaagagctggccgcgagggcgcctatcggcggggcggccgcaggcgaaagcgacctggccgcccgcctcgcggctgccgaacacaccgtcgcggaaatgcagcgagcgctggactcctccaccggggaggccgaggcccttcgcttggcgggcgagattgggcccgacatgctttgggatgcggtctcccgcatgaagcgcgccggtcggcaagcgggcctctggggaggccagtcgtcggtgccccccaccaatctggaaggcctcgctccgcacctcaacaggatggcttgggttctcgagcaactccccgaggagcttgagaagaccatcaagtcatcctcaagggacctcgcgcggggagcggtcgaactcgtgctggcgagttaccaggcccgggaccccaacttctctccatggatggcgctggaggagttccctcccgggaccgaggacgacgcgcgcgcgcgcgtccgggatgccgccgaccacatcgtcaacggcttcgagggctcagcccctcggctcgcgttcgcccccagctccgacgaggagggcgatgccagcggtgaggacgacgatggcgacgaggccggcgacccgggcgcgtcagaatgagcccccgagcccccgtcaatctttacttttttctttttctttcttctaaggccttcatgcctcttttgtatagatcaaattactctgcaatcaaaaatgatgaaacaatttctatgttaactttattttgctatatatataagttgaggatgatctgtgccatggtccttttgcgccttagcttgaaataagggctcgcgcccaagtcccggtcctcgaatggctcgggtcggggctagtgcctggggagatccacatgtcgagactggccaggccgggaacgtggtgaccgaggggtatgggtaacccgatcgtgggcttttgccgattcccccccggagttcaccacaccccggggcacggctcggttctgggccccgtttggcgatttttgctgaccgaaccgaacccccgagggcaaggttgagcacgagtgaccttatttcaagttaagattctttagaaggaaaaacggcacagacacaacctttaggaaattgaaactgcttttattgaaaagctgaaataagaaaaggaatatatgtgcatgtgtggtagcccccggccaaccctgcacacccgaggggggtgcggggttggcccgagatagaaacctgacacccgaccccccctttcaggggtagaagcggcgaaggtgttcgatgttccacgggtttggcagctccgtgccgtcgcccgtggccagccgtaccgagcccggccgggggacaccgatcactcgatacggtccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatgttgaaggtcttggttttgaggcctttaaggatttctgcattggcgcgctccacttggccattgcttctggggtgggcaggtgaggcgaagcagagcttgatgcccatgtcttcacagtagtcgccgaagagttcactagtgaattgggtgccattatccgtaataatacgattaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacaatggtatgatctgcagggcctgggccggctgatggatttgcttggcgtggaactgacacgctctgcatcgccggaccagatcgactgcgtcattaagagctgtcggccaataaaatccttgacgaaaggccttgccaaccaaggtacgcgaggcggaatgggctccgcactcgccctcatggatgtcaacaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggcctggactccgacgggcctcgggggccggttaggcgcatccgtctcccctaagggatcgggtcgcgccgatggctgggtaagcctttcttcaaaggcgcccggtggggtctgggctcgcgaggacgcgagccgtgagagttcgtcggctatcatgttatcccgtctgggcacatgccgaagctctattccatcgaaatggcgctccatacgccgcacttggcgtatgtaggcgtccatctgtgggtcagagcaccggtactccttacagacctggttaacgactagctgggagtcgcctaataccaagaggcggcggatccccagtccagctgccactctgagtccggcaaggagtccctcgtactctgccatattattagtcgctcgaaagtcgagacggaccaagtatctgaggatgtctccgttcggagaggtcaacgtgacccctgcaccggcgccctggagagacagagaaccgtcgaactgcatcacccagtgggcggtttgaggcagctgtgaggggttcgtgctggcctcgggcattgagacagtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacggtgacccgatgcgcctggaaataatggcgcagtttcctcgaggccatcagaatagcgtaaagcatcttctgggcctgtgggtatcgggtcttggcgtcccggagggcctcactaacaaagtagacaggcctctgcacctttcggcggggccgatcctcttcgctaggggccgtatccccggggtgctcttcgtccaagtggcctcttggggcacactcgtctcctgcgctgatgacctcggggtccgaagatgacaggtgcggccttcccacagtggcctcggggccgtcccgggggtcgggggctcctggcgttgtcagacaagcgggcaaagggccagctccggtcgtcaggggcctcaggcctccgttcggctcgggggcctcttctccctgctctctcccgggtcgaatctgcacagggttagcctcggggtcaaagggtggtagatgcggccttcccgcagtggcctcggggccttcctgagggtcgggggcacccggcaccgtctgacgagcgggcagagggccgactccggtcgtcgggggccttaggccaccgttcgactcgggggcctctcctccctgcctgctcccgggccaagtcggcacagagtgggggtgcgcagaatgaggattgtcctcatcgcgctccacaaccaacgctgcactaactacttggggggtcgccgctaagtaaagtagcaggggctcatttggctctggggcgactagaaccgggggagagctgagatacacctttaactgagtaagggcatgttcagcttcctccgtccaagtaaacggccccgagcgcttgaggagcttaaataagggtagcgccttctctcccagcctcgatataaaacgacttagggcagccatgcaaccagtgacgcactgcacatccctaagtttgctgggggggcgcatccgttctatagctcgtatcttctcggggttggcctcaatgcctcgggcagagaccaaaaacccgagaagcttgcccgcgggtacaccaaacacgcacttatcggggttcagttttatgcgggcggagcggaggttttcaaaagtttccgctagatctgaaagtaaagtttcttggttgcgcgtttttacaaccaagtcatcgacatacgcctcaacattacgtcctatttggctacccaaagaaattcgagtagtacgctgaaaagtgggacctgcattctttaacccgaagggcattgatgtataacaataggttcctacgggggtaatgaacgcagtttttttcctcatcctccctagccatgcgaatctgatggtaaccagaatatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggacgaatccggcctccagaagtctcgccacctcctcgcggatgaaggctttacgttccggggcctgccgccgcactttctgccggaccggccttgcgcccggccgcacagcgagacggtgctcaatcacctccctggggaccccgggcatgtccgctggtctccatgcgaagacatcagcgtttgcccgcaggaaggagacgagcgcgtcttcctatttgccatccagaagaccaccgatccgtgtggtcatggatgggccgtcgcccaaggcaacctccttgaccgggacctcgtcgcatgtggccatccgctgcctcggggcggtgggggcagaggggccaagcctctcgtcaccaccctcgggcttggacgcagcagcgaggcggtcggcgcgctgctccatgcaagcgagcgcgactttaaggtcgccatggacagagatggggccaccggggcccggcatcttcatctggaggtaggcgtagtggacagccgccatgaacttcaccaacgcgggccttcctaggaccgcgttgtagggcagactgaggtccgccacatcgaagctcacccgctccgtgcggaagttggcgggtccaccgaaggtgaccggtaggtcgatgtgacccaatggccacgtgtgccccggcgtcacaccgatgatcggctgggacggtcggagcaccatccccggggccttgatagcatcaaaggccgcgggggaaaggatgttgagagccgctcctccatctatgaggacacgtcccaacttcacgttgcagatggtgggggaaactaccatcgcaacctgccctccccgggcaatgcacggtgggtggtcggtctggtcgaaagtgagagcaacctctgaccaccgcgcccgacgcatcgcctcatgagtaggggccatggccagaagctctcgcttcatagccttgaagctccggcgagagacgtgagcacacgctcctccatcgacggtggcaatggtggccccaggttcttggaaacctaggtcatcgtcaccatcatcgatgtcaacagcgggggccatctgcttggcctcacttcgccgtttgccggaaggaaccgccggggacttgccctcacggcgttcctgtctcctgtcctcctcccacttcctcgttcgctcagccaggtttttgactgcacgacagtccgcgagatcgtggagggaggtgttgtgcacggagcaccacctgccggcggggcgctccctgctgggagtaccagcctctttctttttgtcgctcgcaggcctcccctttcgggtggcccgcggagcgccctcgacggcgaggacatgaccctcgtcgccggaacggtccgacctcttcttcctcctcctgtcacgccgccctgtctgagcggcagatccgggggcggccgaagctgccactccggaaccggaggagttccatgtccacgcttcctctttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacagatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccgacaccaccagccgggggcacggagggctgatcctcacgtccatgtcgaggtgacactctggacgaggaggcgccctccgttgcacggggagtacgccggctgttacgccggcgctcgctgttgaggcgggcatccggcttctcatgctgatcctcccgagtcgacggtgtcgacgagggagtggcagccgaatgacgtgcagccgccgccgctcgccgcgccctccgccttgatgacacggaaccggtggtggcggcgccggaggtcttggtggtggtggaccgtccaccagcacccaggcgctgctgagccgtcatgaccaagttggccacatcttccagccatcgttgggctggagactccgggtcatggacgacaggcgggtgtcgtaagagcgcgccagcagcctgaagcgcaccctgaggcgtgctgccgtcgccgtatacgaggaggcggcgctccccatcttgccgtcctcctgcaccacccgcgactggtgatgccatggacttgtcgaccttctcaagcgcctccccctgcttagggctttggcgcggaggaggtgggggagtacgagctcgacggcgtggattcggctccccgtcgtcgccgctcacactcggagagaggtcgtgcgcctttgcttgctcggccattaggctgaacaagggaaacttggcgcccacggaagagtctgagagctcagaaaacacacgctgagccccctacctggcgcgccagatgacggagctcgtggctcctcaccgggagaccgcgcaggcccccctttgccggttcggccgggggcttagggtgagatctcaagctctcgctgtgtgtggaaagattactcgcccgcaagacacacgagacacagcgatgtatacaggttcgggccgctccgaagcgtaataccctactcctgtgtttttgtggatttgtgtatgaatgagctacaaagtgtgtccacttctcctccgctctaggctctaaatctggcaagaatccacccacctctctatgggcaaggtcctccttttatacttcaaggggataccacatgcacccttccctttccaaactggactttttcttctttacgtaaatggacggagatttgcacggttgccctccaaacgtccttctgatgggacggcacatacctacctccacttctgccgggggcaggcgcgtcgcgggaacgtggctgtgagctgacgacctgagcagtgtcagaccggtcacaaatcggtcattcttgtccaccgcgtgtcagcttagcaacgtgcatgtttgcccttcttcacacaacatcttgcctgtaatggttaggatgaagcctggtataaatctgaccagggctaacgtgccatctctaagagataacacgctagctccggcttgagacgagttgcctagaggctttcgtcttgacgggatggggcaaggcgtgcgtcagaccgccagtcgccacctaacccttgatctgaccggtctgtgactggtcacagaccggataaaagagcgtgctgtactgcgttacatgcagcgtgacacgcttgaccagactgtaataaatgctgttaggtgagcacagctgtgctcacttatcccatatatgtggcgcagacttctttaaggggtcggggtgcctcggccctcggggccggggcaagcgtaacccgacccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacaaagtgtgatttatatcttatacatttgcataaaatttttgaataagacgaatggtcaaacatgtgagaaaaaaaattaacggcgtcatctattaaaaaacgaagggagtatcattctcatctaaaagagtaaattccctgtgtacccctgaaaactcactcaatccctttcatacccctaaaatttacccgatcccttctatacccctgaaatttcaatttgatccctcccatgcccctacccttaaaatttacccgatcccttctatacccctgaaatttcaatttgatcccttccatgcccctaccgtgaaatttcaaattgatcccttccatgcccctaccgttacattttccatcatttcagtgttacgtttggttgcaaatgtcctttttgcccttgatgctttaggtttaaatataagcttcaaaaacaattgaaaattttgtttgagtgcacatcgtgtgcattttataaaactaatgagactaaataattagtgcagaaaattttgacataaattttgaaaataaaataaatgtaaaaaattaaaatttttatttgaaattttaataggacaatggattttttttatcaggagcattcataaaaaaaaatgttgtgaacattggtatacctatcttgctcctcatttttatgacctttttttaaaaaaataaatacgtatttttttatttcattatctaaaaatatttttttgataaataatgtatcacataacaaactcataactataatagtctcatgtgagaagcttttatatttttaataatgtaatttatgaatttctttattcatccaagggtaaaatggtcatttttatagaaaatatacggtcaactaacgggaggagtatgcaagggatcaaaatcaaatttttggggtatacaagaaagtaagcaaaattcaggggtatttcaggggtatataagagatctgtttcttatcattctgaagcagtaatcataaaaataaattctggcaaatttagtagtagctctttcgtgattggttcatttcgtatttatatgccatagtcctataatttccatctccatattttgctctttgagatatggaattctggcaaatttattagtagctctttcgtgattggttcatttcgtattatatgccagtcctataatttccatctacatattttgctctttgagagagatcattagattgtatggcaattctatgattctatcactactttgaaattaaccactacgcatgtccttaatctttcatttgctatgtccagactccagaaattgtttacatgattttttactgcatctgcatgcaaaaaatagccttttttctcgtttaaaattgccaaagttttttattattactgatgtaacttctggcttatcgtaatctctaaaacagaaaatcaaaggaaaacaacttcggaagatgaacgatagacagataacgtagctcaaatgaatcaaattgggagctgataacaccgaacaaatagggacacataattgaacacagctaaaaactactgccgagcacaattcatcctccattaagcattgaattttgatagcaaaagcatggttcaccagtgaagtaaccagcaacctatggctgcgttactacatatcaaaacatagtaggaagcatagtctttcctcaagtgttttcaacttaactaaagaagaaaagctaaaatcccaaacatcatcactctagtttcctgcgcaaagtctggtattgatgatagaagaggtgaccgcatcactcagtcaaacaaactgaagcccatgtcctgtaaataaatttgcaaacagttaaattagttaccattaggtgtatttgttctaataaactaaacatgaatgttaaatggcaataagaagcatagcagaagcaacggtttgcaaatcatacgatattatacattgaatagaagtcatgtcaaactaccatagacataatgaatgagcaaaatatgctaattgagacaaataagaacattggtcttacatcatcactttcttccttctcttcgaccttatcttctttcttcgcctcagctgcaggagcaccaccagcaccaccggcagcaggagcagcagcagcaacagctacaccaccaccaccagatggaactgaagcaaacttctccctgccacaagcgatgagctcagtgatgtccttgccactcacttgagacaacaggagttccatctttgcattgtcgatttcacaaccaactgccacaaagacaaagattgaggtcaaatttcacagtacatacagctataagtggatgactattacttcaatattatatttaatgaaagcacccaagaagataagaacgaaaccaatcaatctaaatatagtctaacatttagaaaggaatgcaaaccttagaatggtaccttctaatttaacgattaaatgctaagaaatttagaccaaaaaaactgctttctgaagccatggaattagccagattaagcagaagaaaatgtagacaccagttaagcagatttattggctagattacattttctgaacagtttcaaatatggacataaatcagggagatgaaattacctgactccagaatcgttgtcaaatcctccgcagtggggctggagttgccagccagataggccatcagataggcagaaatgaacttcatcctgaacaaatcaggacgaaatatggtcagactatgtaacttcaacttaacagatggatcatgatttgtagaaactcctcatgtatctaaacaaccaaggtgactaacaactatcggtaagcatgttatctcctaagaataaaggacgaacataggtgacaatgaccaagactgcgatgcaaagtctaaacagataaatggcattaactagccacaaaataaactatcacagcaaaagaatgaatctaacatataacactagcatgtaaggacaaagcaagtaaatgagcgtaacaaccaatcaggagagatagaatgcaacatatacaagtttgtacacatcccgtaaacgtggaactacatattcagatcctaaccatacttttgtccatttcatcaatacggaaacaaatattctatgattcacacatgaaactgtaacattaaaaaaacagaacatttcaagtaaacccaacgcccgctgctgcattcgatccaagaacctactgccaacgcgtagaagctaacactaacgacagcaagaccaattatctcacagcaaaaggatcacagatcgcagcactagcattagcgaagcacatttccagcacccgtcatcattccatcaacaagaaaaactctaccaaatggcaacctaagagagggagagatccaaggggggtgtgccgtttacctggatgggagatggagagagcccgacgagcggcggcggagatggctgcggcggcggcgcgctagggtgagctctagggtttctgcggtgaagggtttctcgcgctgcggggccgcggatttatacagcgcgcggccgccgcgggacgcgatctgcgccgtccgttttccatcggaaggcggggactcctgccctagctcaccctcgtcgaatcacagccgttgatcggggccgatggatcgtgggccggaaaaccaggcccatgggcacagacgtgtgggcctatagtagcgaacaaaagcccagaaggcccacaggtggttcagggctcaggtcgtcgtcgtcctcctcctccgatcccctcgccggcaaacggcgcgccgccgttggtcgccggccgccgccgtccggctcctctccgatccatttttggtatccatctctgcatttgattcgttcttttcgggcttcacgcctctgctcccgaagtcggaggctaacctgtattgtatttgttcctcttgttgctggagggagttgattcgattttgccgcgtcggattgctcgccggcgtgaaagcttactagggcatcatggacggtatgcacgcgcttgccctcttgtaatcccctttctcctactgctctctggttattatgtgttagtctggggggagtagaaagaacagtttttattagttaggggtataatttgtgtcttagctgatagaatgtgcagttggtgattagtgcggacctgggttgattgtagttgcatgacaggcaatttagtggtaagccgagttaattttggatttaacaactgcaactacaaggaaagaactctttttttgcactgataggcgatctgaattatagtgatgtgcagtgtgaaaatcactttgaaattcattattgtcagcattgtcatcctgagtagattgccaattatatgggtttggaggacaataaggactaagctctccagtccatttcttgtcttgaaaaatgaactccatatcatcctacagaatatgatggtaactttaataaaatttgtgttgttatctttgtattgtaagaaaggatgtaatcaaaatacggtgaacaaagcccttatagagtcagtccggacatgttcagtattgcagtctcatcgtatagtatctttttctcaggtgcctcttaagttttttctctctagtataatcttccattgggctttcaacttctggaagttgtgctgatttgctgcacacaatgatacccgagatttgttgattagctcagttggtgtctttgctctatttcccctccattcatgtaaatgatatcaagtttggtggaatgctggtaaaaatcctcttctagctgcataaccaataaagcatctgcaagatactacttacctacatgacattacaatcataactaatctcccaatatgctgtgtattcatacgtaatagataagagaatccagccttagattctaactttgtgatcatgtatggcttctgcttgtgcccgtgatgctattgtttcatatctgtttcccaatagtcgataaacaggaaacaatggaagagaccattctcactggtgatgatctcatgcgtgagccaccatcccctgccataccaaaagaaattgcctcgcatgtccttcaaggtgttgagccctgtgatggtatactcaggaatcttttcttatgtgagttaactgtttctgtgacatttaaaatcgtgtttctctttctctgtgtgtggaagtattattgcaaaaatattatacggcacaggcctgcaaatcaatgacatcgagcctttttgccaagatgaaattgtgttttaccgacaatgtgctgcaaaaagggtaaggttatgttgaactatttgaaactgcaagtggttttcccttttattatttaatatgttgcttttatatcctattttataggacaaggaaataagagagaagatggtagacagtgaatataaactgcgcatttcgatgcccctggaagaaggaaaggaaagaactactcaactccaattggaagtcacattgcttgaaaggtaacctaactaggattgcttcccccctatatatttccgtagcatcattctctgcttagcagctcatttttatttatactttctaaattaagcttcagtgaacccaccgaagtgttcaggctataattaagagatgatagcacactccaattgtatatgccttcgttctcccacatattttcttgtattaacaccaaaggaattattctgcatttctacctgttcttatagattttgatgagagcaaaggggttaaaaatgatactgtaaaccacatataagtagaagtcatgtagacaaacaacttatatacactatactccagtaattttcacattgagagccctaggtgtttactgtttagttaagttaagccgatgctctgtgaaacacttgtaaccaatactacgcattctgctgttctacaggcatacgagacaatgagtagcaccagggacaaagccaagcacacgttaaattgccttgtgaccactcttcagcaccgtataaaatgatttacagacttttgcttttaagaacactacctattgcctacagactttttttctaattgtattgattagattaaactggacaaaagaaatcatcaggtgtactgagtttttgttaataattcatcggcatgatttcatcagttctgcttgtatgtagtctcgtacttctgtaggcgcatgattcttgctagtgggcttgagggcatggagggatttcgccagagatggagcttgcatggacagctcgaggatacgaggtattaaatcttgcattgttcatgtgtttttatcatctctgtcatagtcgaatgggctcacttgtaacttgtgaacatgtacttcaaatattgacaaactagtgaaggaatggtgcttaattattgtgttatataatccatatgcatttgaatagtttctttattcacatccagatgattggtttgtattgcaatatgtaaacatctgaaaataaaggccttgtcaatttcttttacttcgcaattaagaatattcagctatcatctgagacagcaagaaatcccgactaggcctaaggggccttatcccacccatgctctctctctctctctctctctctctctctcttgaaaagagggcaaaagttttgcctcgtatgtattgatagagcagaatgaactgttacaacatatttacacccatgctcattaggatattgaacaaattatacactgatacgttaagtgcttcttgaatggctactccagatgaaaatttcaattgtttgagttcagaaatgggcttacatcttcgtttttgcgtgtcaagtttgcgttttcgctgttctgtttttgtctttgcaggaaaaggatggaagcactggtccgtgggatggagaagggagaaagccaaaattctcaagcgcaagggagctaagaagaggtggttgttttggtaggttagcacattttttttctaattgcaaaacagagcagttgacagtatattattggcaatgccatgcactggttccttcacctcttcaagtgcccttcctcaaaaccaaccactgaatcagtgaatctgctaatcaacggatttgcttacatacattacatactagctccgagtgaactgacgcaattttagcatattcttgtcggaatgtaacagagataaatgggctttttgatggcccagtaacactcgcttcagctatgggctggttcttcattggacttgcaagacctctgcaaaattaaatgtggcctttccctgaaggcccgcctgtccttgtgttcttttgcaaattgcaattgggccttggaagattatgtcgtctcaaaatatacaaggttacgaatttgctatatatttgtcgacaaattttccaccaaaaatttgacagatgtaattataatacaatcgtagtgtaattacactgtaactataatgtaacatgtatgtaactttcaaaaatctctccataacgtttagagtaaatttcacaaaactacacgttttgtggtccaagttgcagaaaaccgcacacactttgatacttgacacttaagtacatatattttggtagtgtagtttcacaaaaccacactatcaatggatagattcacccgcgaaatgacgcggttggttcacctaggacaaggacatggcatcctattaccagcctcgcacgaaattaataggatgccacgtccatatcctagatgaaacaaccacgtcatatcatgggtgaattcattcattgatagtatgattttgtgaaactaaactaccaaaatatatgtatttaagtaccaagtgtcaaaatatgtgtggttttctgcaacttgaaccataaaacatgtagttttgtgaaatttactctaacatttatttcggtaaaatggaggttgtgagaaaaaattctttcacatatgtgtgtgatgtgattttttttcttcctcaccggaacaaattttataatagatctaacgattcaaaattacgtgaaacttatatacaagttacactgtagttacatgcaagttacagtgtaattacactacgattgtactataattacatctgtcaaattttcaaatttttagaagaaaatttgttgacaaatgtataggcggtcccacaaggttattaaatcttgaaagaagagatctttttgcaactaaaataaacaaatcctaaaaagcatctctatgaaagggtacataatatatacactgcactattttgttgccaaattggagaggggaggaaatgccaccataattctttttcagccatattcatgcaataaaacctcgttctttttttttcatgagcttttttttttttcatttttcacaagaatgagaagcgcaggctcctatttattgcacactccaatccaatgaggaaatgacgatatgttgctgtcagtttctcctgcagtctggctgcgccgtccctcttaaattcagcaacctaaacgaatttcgtcctctctaggcagactcacatgaatcacctcacaatcttgagtgaccttctgatgaactactgaccattcctttatttgggtagccagcgtttacgtcttaagtaactttacggtgctctttgttggtaatattctgttaccagcgtttacgtcttaagtaactttacggtgctctttgttggtaatattctgttaccagtattattattagtagaagtgatttatgaattcataaattagtaaccactgattcatgaattatattatcaatagaattctttttttactaccagtagttgatgtggtagtatatatagatttgatccattggattagatgaaataaacagactaaaattggttgtactaagcattgtaacccacctcttacgttttcgattcgaaaatggtgcaaaattatgtgcctggagagaaagacccaacctgtccttgatttgggatcaattcctgtcctgagaggggaaaaatatactactattagtactagtggtacagtagaattgaggcaaaccatgcactctgacattcttcagtgccacttgtggcttgtgaatgtgatggatttgatttactccttcactaacagcgaggaaattcctcacttgccatactttgcactgaatcagagcactgtatccttggcatttctgatctctgaacaagaagcagtgattcattctgattttctgaaggattgtctgcctcgtgcctctgccctgcaaaacctgtagtagcaaatgaggtccactgaagctttcaattctaatgaagatttgggcagccaatttagagcacaccagtgcatgagaatctcactactgatgcagcgaagtaagtactgctctacttaatcgatcactggcaattcaaattatacatgtgtgctttgcttggcctgaacaatgctttgaaacattcccagcgaaaatggttacagctgtgaggtcactctctgaataactaaatgatcctgaggtcaggtggtcctaaccccaaagtttagccattgcctgaatgcctgacagttcttgagatttcaattcagagttaatgtgagtggctggagaattgagagcgacctagctttgctttgggagctcgatcgatcgattcaggtgtcccctctgaaactctgacagctgagaatttccttgggcgttgctcaactgatttcatggtagatttttgcctgtaaagcgacacatataggacgaattttttttatttataattttttttattaaaagttttacaaaaataattttccattttgaaaattgacggaagtagtcgcctaccgccctctgggagggcgatttttaaaaatcgccctcccagagggcggcgaaaataacgtggcagccggccgttcgctctcgggcgacggccgtcaacgaaatttgcaggcggcccccttgccgccctccgctagggcgattttgtactgtgggggggggccgcctgcaaatgggcggcgggggggcatggaattttgcaggcggcccccttgccgtcctgggggagggcgattttatactgtgctctatatttttgtataaatatcaatagttatcaaatctttttatattgaaaactatacaagattaaaatctccaagactggtaaaatacaattttattattttttagggcatatttggattgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgtggtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcactgtgcaagtcgtcgtcgtagaactggctagtaggaccagtcctaccggcgtgagacgaagaggccccagtaccgaagatcccggctgcaaatcct

SEQ ID NO: 77528 - DNA, 1499 bp, Oryza sativa
aatttgaatcgggtatataaactttagatgtatagaaacactatatatgaaaaatatttgaattcaaattcaaattcaaatttgaattggatataattcaaattcaaatttgaatcggatatataaactttaggtgtataaactttagatatatagaagtactatatataaaaaatatttgaattcaaattcaaatttgaatcggatatataaacttttggtctctaaactttagatgtgtaaatttgaggtgtataaactttaggtgcataaatttactaaaataggaaagtaatacggtgccaaaaatagaaaccaggtggagggaggagggggggaatttgatcgctctgggcgacgcgctcgctcaataacatttccgcaagctttggcccccgctcatttccacctcgcattctctatactacagttattacaccgtgcgtatcggtcagcgcaccgtcttttacggttttaccggaggtgccgcttccgtggttccgtgccgtgtagtggaggacgtactacccggcctttagagcagtatagccaaatgttactaagtccagatcacttatagctaatctaatagtccatttatataatagttatttataaaaatatactacaccattaatatccgatcccacctctcatacacacaaaacatcttggagtctatgttacacttgactataaatccataacccgtttgcttctctttctcttttcttcacgatatgtggttatagctagcttataagctgctattgtactggctgagtcccggagcaaaggctgttgccttgttggcgtcgggcggtcgggccacgacgcaccgcaccgtccctgccgcgtggtccggggacgccgggccggctgcctccaaggttccaagtccccaacggtgggagtcccgcacgtacgcgttgcggcgatcgcatttcgcccgatgccacgattagatccatcacgccgtcggtggacggaggggcccccgtcggtggttgttcgtcccgccgcgctcgcgcggtgggcatgcgtacgtgggggaggtgaataggtgatgcagtccggccagccgccagcggccatggcggaaaaagcgatggggacagtacgactcggaggggctcctcctccctttcggtcggcgatgtcactttcatatagccatgcgacacgagacaaactggaacgtgcattacaatcttgatcggacgacagaacatcgttcctcagatccaccagttagacgccagcaggaacagcatccaccatatatatccacagagtacaattcgagtgctgaaagttgtagagagaatcaggagtagtaactgggaactgtagactgagagtaatcgttcgactggacgactccactagcatgtgctagtgccttcagttgcgtctgatgatactgcaagtgatcaaggctcatcttcaataccacagcaacattgctgcaacatctgtgaaaagtctcagatttgagc

SEQ ID NO: 77529 - DNA, 16354 bp, Oryza sativa
ttaggaaaaagcttacgtggaacattaggaaggttgaagtatccaaaaggggcactgatcagcatccccctgcataacacatgaatgcatcaaaactacagttaattcaacaatagggaataacaaggggaaaagctgggggtattggtcataatatctctcctgatgacagagtaaccagctcagctgttctgttcagtgtttaaatggagaaggatggactcgataaaaaacgatgttggataatggagggaaagcttttattttcggttcatcgagatatacatgtattttgtggtccttaagcatcatctggtggaggaaaaagggtcttgcacacaatcattgctgatgtgaaattcagttaaggtaggctgtaaccatcagggagactaaatttgctgaatatacacacagtcagactggtactcctaccatctacccattgatccattcattgattcctgctcaataagaaggttgatgtgctgataatgagctgcatggaagttgcagaacctaatagaagattaccggaacaaactaaaagtacagttatgtagttcttatactgccatttctttgggattattgtcatatctgttatagtcgatattacaaagtactagatcctttcatcctcaagaccgagatctagtaaagcaaaagatatatatctatgtacacaatagcatgccaaaaaatgggcgcaatctgaatccagagtatataaaatcacataccttgcatcaaacaaccgaagcgtccaaataattttggcatccatacattatcactatgtccaattgtagacaaacgtagatggatcaaattcccgatgcaacctgggatgcttggtacaaatgaatcagtccaatctacaacacgaagataaggaaatctcttgaaaaatgaattatcaactctgagtgttttctcataagaagttttccatgtccttactttatattgcacctcgtccatgctaggtaacattaccatgttcttatctgtgacgactgaaacacgtcgaagtttagacacagtgttacctaccaatgattctgggtttccaacaaaacattcttcccttgacaaataacaagcaagctgccttaaaagatcatgcattttgcagctgctgtggtcataatataaaccatctggttgaagaaggttccggtggatcagctcatagtaatactcgtctgctgtttcttctagtagttgacctccatggtcctctataaagccttcagcgatccacatccttgtaagatcatcacggtaaatgtttgcatcttcaggatatacactacaataaagaaagcattgcttcaaatgatgtggtaactcatcgtaactcagatataaagcacctctcaaatcatttggaaggttgttcatgaaccaagcatttttgctcaatatttttttccattcgttctctgtttgttctttactcgctaacactctagcaataaccttgattgcaagaggaaggcaaccacatttgcgaacaatctcaatcccaacatcctgcagagtttgcaattctatgctttcactgatattcatgctcttccaaagtaactcccaccctacgtcggttgacatcaaatcaactcgataagtatggtccactccgatttctaaggcaacaatattatttctagttgttatgagaattgctcccatttctgcagcatgcaacggaattcttaataaatttgtccatgcgtcagattgccacatgtcatccaactcaaggaaaaaacttgtctccttaattgctatttcaagcttgctctggagctctccaattgattcatcttgatcatgatgaacttccataattcgaagaagttctctcaaaagagaagcttcagagtacactttggaaacacaaacccaggcttttttgttgaaacttccttttatttttctatcattgtatattttctgagctaatgttgtcttaccaactcccccagtcccaacaattgcaagcttataaagttttctccccttatgttcaagcactaaatctaccatttttctgcaggcatgtatgatctccttgccaacaatgttgggctcaagtaggtgggaactttttctcactctcaatactgaactgcttccagtaggaaccgtactcttgagtgtcaaaaatactctgtccttcgaaatgttttctatcttcctgttgagacttctaatcttcacagcaacctcatgacgtgcctgaacattagaaaagcaagtggaaattgacaggccagtgcaagcaattgacttccttgatgacgatgaaggatgatcagttagtagaatgcttcccttaaatctagccaagtcaataatatcatcaacatcatatagaacttctcttagctgaccaagccaattgtcaactgctgactcttccatcctcctttcctcagcatcactaatacaacaatgtatgagttcagtcttccgctgcaactctgcgagctcttcttgtatccctagaataagtatcacctcttcagtaataatctctttcaacttattggcacatgatccaaccaaagaatctaatatggttgccataggaaaaatcagcaagggagatccacttttaacgtttcagaaagtgacagcattgtaggttggcaaggaatgcacgatatctgttagcatgatctgaaaaatatataatgttcactaaaccttttgtattgataaaatagacatccatgggtataactactgaattgccatttatattaatacaataattagcttatcatacttaaactaaagttctagggacaaatcatgcacagtatgaggtacataaccaacactaaaagtattacattcttatcatgtgaggtattcatagaagtatgttttttttctgtgtagtgtagtgtatctactcttaatatgggactacaactaaagaatggtttatcttttacaattacataattgtatataggactggtgagaataagactaactaattaacagcaaacaatacacagtctaacatactaaaatgaacggaagaaggcaattatttcataaaatcatattcgatactaaccgctgtaaatttcatatagtgcagtgatccctctacccctatttggttggtgtgcaaagttccaattcatcttggatgatgatatcatggtgacttggcgagggcatcatgtggatggtaagaactagaactagaacatattaaatctgaaagaactagaacaatgggattacctttagacagcttcttgggtcaacgggcaacgacgaagaagaaatgggcaacaagttgagaggttttgcttaagcatggaaggcgaagtgttgctgggtgtgaggctgaaatgagccggatcaacgtcttctgctggagtacaagaagaagatgactgagtgagccaacgtctcgatcgactccaaccatgacaggaagcaggaattgaacaagggaaagcagaagatatattaagtccatatggcaaagaagaaagactcaccccagtccccagaggccttaggtgcgtacagccacagcatcaccggctgcaaggaagacgatgagcacgttcctggtgatatactggacctagattatgcagtggcagagaggagaagacggatatgaaattggtgcagctcgtttagtttggagtattcacagcctttagcagtgctggacatgacaaaagatgctgttaggtgatatgccctgtctgtcgcagtgtgcattaggagtttgtttttcgccaaattgcagaaaagacaattcatcggttttgacattccagaagccaccgttcctctattgtctatatagggtctgctacataattttctccatcatgctaataaaaagattcccatgtctcattaaagaaaatattaggagtgaaatctgttgtgtcatttcttgacatgacatgatgctggtacaaagttatcattgtttatatctttctgaaagtattttattttcatatgtctggcaaaagtacgctggccgattattaagtgaggagaagtttttagtacatgtatacagcaagcatggttattaagacatccctagccgcagcaacctccccacagagcaacttgcaggaggtcaccagaatctttccaaaatctatcatattattaaagaaatagaaaaagaagcctccacgttcactctcatggcctagaaattctcacattaatcagagaaaaagaaaaagcagagtccatgtagaaatacaatttagaaataactgaaattcggaattaaaaaataagtaatattagaagaggagactagagtctatatagaaatacaatttagaaatagttgaaattcagaattaaaaaataaggaatattagaaatggagtatagagtccatatagaaatacaattaggaaataactgaaattcggaattaaaaataaggaatattagaagtagagcatagagtcagtatagaaatacaattagcaaataactgaaattcggaattaaaaataaggaatattggaagtagagtatagagtcaatatagaaatacaattagcaaatcactgaaattcggaattaaaaataagcaatattagaagtggagtatagagtccatataaaaatacaattaggaaataatagaaattcgaaattaaaaataaggaatattagaagtggagtatagagtccatatagaaatacaattaggaaataatacaattttggaattaaaaataaggaatattagaagtagagtatagagtccatatagaaatacaattaagaaaaaaaatagaaattcagaattaaaaaaaggaatattagaagttgattatagagtccatactggaattttaaactaactaaaatttggaataaacagaataaaattaaaagtatagtttagagtccgtataaacatacaatttacaaataactaaaatttgaaattaagaaaaatatgggaagaagagtttaaagtcaatataggaatacaatttagaagtaactgaaattcgaaattaaaaattaaagaatattgaaagatgagtttagagtccatataggaatacaattagaaataataaaaattcagaaataaaaataaataatattggaagaagagcatagagtctatatagaaatacaatttacagaaaaattcggaattaccgcgaaatctgcgcgggccaccatgctagttatgattgaaacagagtagtgcatctcatcttcaaaggattttgggtggcaactggcaccgctcatcacccctaactaggggtgaaaacggtacggaaacggacggaaaccatctttattattttcgttttcatattttttttcggaatcggaatcggaaacctcggatacgaaaacggaatcgaatattatcgaaaccgaaaacggagcgaaaacgaacaggcgcgaatatggtaacgaaaatttatcggaataaaaaaacccctcaaactaataaatccaattgaataaattatctatgtttgaaagagtaatgttgtcgataaatcccaatgtaggacaaaaaatattcttctgtaattttagatttgcataacaaatattttttaaaaaaataacagccaaacaccatggtattcactatttagcgcttaaaaaaagaatccagggtatttcagtccaaaatttctggtaattccgagaaaatttccggaaattccgagaaaatttccggaaagtttccgaccgataccgagttccaacggaaactgcccttttcatttccgattccgtttctgagaaaatatttccgatttcgtttccgtttccgaaaaattccgaaaaaattccgaccgaccgattccgttttcgaaaataagtccggaatccggaaagtttccgtaccgttttcacccctacccctaacgctgtcaacttttccagttgaacacaatcccagtttcatgtactcgtatctgtactgtataacatcaataggttctgaagcttaaacggcagtacggcatctctgcatcattgaacgctacagaccaacagaggaacacgaactcaactgctatcgaccaaaatttcttcgttccagcgatccaaaaccacagcctctctctgcaccgttcgatcatatacaggcggctgagattagacgcgcctcggaatccgtgggccgattttcgtttaggccctcgtattatctcgtgttgtcgtgtcgttgtacaagggaggaagagatgtcgagacgccgccgccgctgccgccggcgatgaggagaagggaaccgggcgttgcccctggcgcggcctctccactgcaatgttcacaaagataccccgaattattactccatctgcaactacacattctgttaatcacagttggcatctgaaccgaaaccgagaattattttttttgagaatatgcagaacttgcgttagttgagtatcttttgtattaactctgaactctgaataaactagttggtttggttgtgatcgataatcctgacctggaagaagacagcttcgccgtggccgcaggcggcgcaccggacggacttggtgcggggcagggtggggtcgccggcgacgtcctggagcacctgggtgaaatccccgggcggtgtggtgcaccacgttatggtacgcgcagtagctctactgccagctacctcctgtgattcagggaattgcaagttcagtcaagcaatgcagtgacattgccatcctaaactgttagtactttttagctcaagaatgaacctgaatcaaccaaacaagggcactagctccgtagtaagatctaactgatgttgtgttctggcctatatgacagtggtaacgcagttgtttcttttacaggaaaaaaaaaaggctaacagttggaactgatttctggaacatggctgtgtcctatctgcttcttgctgaccttccccctcctcgctgaattgtacctgttttttttttctagaagctgcaggcaactgagatgatctctctcaagaaggcgattaaaagatgagaaagatcaaatctttgtagtatctccaagtgtctggagaacagaatctcacttggccttcctgacgccaaccagttctctgcttaggcatgcatttgcattgtgaaagagctggttgacagagacaacggcagaggtttctatgagaattcggggcttatttccagtcctgttgcatacttgggatcaaaacttttagcgttgaatccaatggacaggtttcacgagtaaacatacagaaatatttctcatcaaatattggagtttacaggagtaattgtttacaagtatacttgttttcatgcgtttttgtgtatctggccaaactttgtacgtactgctaacaaacagtgaatgatttcctttgcctaacttgtgtctcaattctcaactctcaaacagcaggatgcaaggactgagagggggatgaactggtgcatgtgtctatcccaattgattttactgggaaactacttcactgtgtttggtccatatgtggggagtactgttgtatcttttgataatagaatcagatttgtccaacagatacagtttggctgaagtgctgaactgaatcttgtctgcacatctatctacaagctacttgcatttaccatttagaaagcatatggattgcgacttcaacgggaagcattgatctaacattctcccaaacagagatagtataggttgattcaggtcttgagatgatgtgaatcactgaactctacagagtacagaccaacaaaggaacacgaactcaactgctatcaaccaaaatctcttcgttccagcgatccaaaacctcagcctctctgcaccgctcgatcttatacaggtggcttagatttaagcatgcctgtgactgtgaatcgagggtttattttcatataggccctcgagttatctcgtattgttgtcgtcatgatcgacggtgacccggcggcggcgggatcttctgcgatagcctgtggaggcgctggcgatgtcggcggatgcgggtcactggcggcagcaagtggaggtgcgaggtgaggatgaggacggtgaggtggctttgcgttcaacagcagtggctgtggtggtggtggccatgactacggtcaccggaggcatggcggcctcggacggcaagacgagggcgtgggagatggctacatttggccggcgcgacatcgtttggtagaggggtcggtgaccggcttggcacgagaagcgcggccgatggagggaggccggattggcgcgagaggcgcgtccgatggagggaggccggattggcgcgagaggcgtgtccggtggaggaggccggcttggcgcgagaggcgcggctgacggtggaggaggcgacctaggtgtgaggagaatctgctggtgggtgtggcgcgatcttcggcgctcgaaggctagccgactggggacaccagtgcaggggtcccacaggtcggcagagcttgtatggtggtggggcatcagtgcgtcagccgtggatttgcaggtggtgagcggcgggtgaaaactcagtccggccttggtcgaaccaacaacgaggttctccctcctgagggtgttgtcgtgttgtttcatcccccaagggtaattgccgggcgaaagcctagtcttggctccttcgagtcccgacggacggcggcagcggcttttccgtcacttctcttcttgaagacatcgttttggcacccctatggggcgatctcgtcagtgtccctttgtcggcctagtggcggtcggtcatacttagcggcggccggtccggtgctagccttctcctgggcttgtgtgttggcgatgtcggtgtgtgggtggggttttttttctttttcctggttacgaccctccagggttgtaatcttgtaatctcgtgcgagtcattcaaaaaaagtttgcctccgcagtgtgaaggagcagggcgggttaggaaagggcaagaatgtaagtgtctctatcatcaatggtatagttaggtaaaccttgtataagcaaaatcctagggtttgcttacggttcctgtaaaataaaattagacccaagtggggaggctacaggggagtttttgaaatactcctacaatatactacttcactccttttggtccacatgtcacatgtggggactactgttgtgtcttttgataatagaatcttgtctgaatacagtttggctgaagtgctgaactgaatcttgtctgcacatctatctacaagctgcatataaaaagcatttctagttggattgcgacttcaacgggaagcattgttctaacattctcccaaacagaaataggttgattcctttggatatagaggccggattttatccattatctaaaaaaaataggttgattcatgtcttgagatgatgtgaatcactgagcgctacagaccaacaaaggaacatgaactcaactactatcgaccaaaatctcttcgttgcctcaagccttgccttcgagcacacattactgcttgggtggtcaaattcgcttaaccatcttgtctccccttttgtatctatgtatctcttgtatttttttttctttcttcctgtttttctcccttgtacctctgttttttctcatgtcttttctttctgttttttccttcttctcccccctctgttctcttgttcggctttaccagattttatctgatttgaccaccattaatgcaatggttataaggtagtctctaccttttgcgtcaaaaaaaaaatctcttcgttcgagcgatccaaaacctcagcctctctgcaccgttcgatctgatataggcggctgagatttaaacacgcctgtgaagtgtgaactgggggtttattttcgtataggccctcgagttatctcgtattgttgtcgttgcgagcgacggcgacccggcgacggcaggagcttcagcgagaggcgatggggagaagggaaccgggcgttgctgcgagcgggcgatccgacgagccaatgaggtcatcctcgagctcctagcgcgcgcggccgtcgagcgagcccccacctcggcgttcgtgccggagaccagagaatgtaagcgacacctctcactcctccctttcttttcccgtcgctgaatgcaattcagttttgctttgctttctgctgcattttgtcatccaggggaagacaattttgtacctgttagatgaacttgttgcgatgacactaagcgcctctttgaattggaggaaaaacataggaattttggaggatttcaatcctataggaaaatttcctatgaagcccttcgaaacaaaggattgaatcatatacaatcctttgaaattcctatggacaatcctaaagagattttggaggaaatttagcaagagcttcaacctcttggtaactttcctacgagtctatctctctcatctaattcctgtgtttttcctgcgattcaatcaaacggtcattcctgtgtttttcctgcgttttgcaatcttctgttttacacttacattcctatcaaaatcttacgtttttcctattcctatgttttctcaatcctgcgattcaaaggggccctaaaaagtctgtgcactaaactgaatgactgaagagctcttacaggaagatgaaaggaggacgcgtcccccgcgtcgctctcacgcgggcggctcgggggcgaaaccctagccacccgtgccgccacaccctcatccccctcctccacctcgccgccgccgaagctcgccggcggcaaagccagtggtgagccgggaaggcggcggcaaggcccaaacgtacagctcggtggaaccgtcctctgcgtgaggaggacggagaaggccgacgacggcgcagccgaaggtgagacggccgatcggtttggggcggcggatccggcgcctccgtggccggatctggccccctcacccacggtttcggccagcgggctagcgtcgcgacggaggtggagaggggcatcgagcggcacgagggaggacgcgggccccggctggcgaggccctcggccggtgatggggggccacgcgagacggcggtggggtggccgcgagacgacggcgaggcagccgcgagacgacggcgaggcagccgcgaggcggcggtggccctcggcccggcgatgggggcggtcggatccggtggcccttggccagatccaccaccctcctggctggatgatggcgtgctgccaaggtggggaccagtgtgccctcgccagagcggcagtgggaggccggcgacggcgggggtctggtgctgcgagaagacggatgccaggcccttgtcggcgcagtggcaacctccagctacgcccactggcgtcttgacaaggtgcagcgggcctgcgggcgcttgtggcgacggtggcagcggcataccggggagtgggtgctcgtggaagcgatggcagcggggagcttctacgaccagtactttggccgccttggccggttctggtcggtgcagcagaggagtgtgggcgatggtaggatgcgtcgagggtggaatgcttgtgagtcatcttggactatcgtttggtcgtcgatgtgggggtgcttgtgtgggtaatgtgcagacgctggcgaaagccttgctgtacctttggccggctcgatgacgacgacgcacccattggcgccatttcccttcttgaaggcgttgtcaatgtgctctcccatttgccccacaaatctccaagtgaaaaccttgctccggcttcggacgagcggcggcggcgttacgcgtcgtgtcctccttgggggcgtcgcttcggggaagttcctttacatcgatgactattgagggtctcttcggttcaaaagctttctttccttggtgcttggcgaggcctaagcctcttgggttcgcttcgctcttgtggtgggcgacacactcttcggttgtttctacggaggaagtcggagctgctcgctgctggggtgcggcgacgcttgacaacgatgacgtgttgcggtctcttccaaagagttggtgctggccatgtgaaggaagtggctctttcatggcttggctgatgtccattgtggatgtcggagctgctttcgctttggcaacttccgtggcttcaatgtcgctgcagtggtgaagtcggcgctgctgggttgcttggccggctagctcggcaacgataacacctcttctatgatgtcggagctgttgtgccacttttgtgtttagcttggcaatgatgtcttgcgtttgggctccgccgttgttgttagtagtgtagttaggtcccatgttttcctctgtgatgtcggttccccataattaaccatgcagctgtatgggtttcgggcccgatgtctcttgtctgtacagtttctccctctcttaatataaaaccagcaatgctggcttaggtttaaaaaaaaaaagagctcttacagtaatgaacgcaacacagctggattctaatttcagagtccatgacagtgttgaaaatttggggagtgaactccaaagcattaggagataacattctctgaacattacgatcaaatgccatcaggtgaaatgctgctaagtatctgaaactggatctaggaatttaaacttctgacgaaccgcagcctccacaccgcagtgttcacaattctcaattctcaaacaggatgcagggaatgagaggaggacgaactggtgaatgtgttcgcctccattgctttcacatgaaaactggtttgcaatgaggtcaagctaaaatagtttagaaacagaattgcccaatagagcaccagagtggatgagtgtctagaagtgtttttcagtaaactattccatcaataaaaatgcaattaacttgacaagagtgcagaaattttcaagagaactttcactgctctagatagcagcagcgcattgtttcacttaatgtctatacactattaccccctgctccttttccgggcttgggaccagaagtgcttcagcgttgatgacttaggggtatttcagtccaaaaagagatgcaaagatgataaaataaatttaaaatggaagaaatgatgaaaatggtaaagtggcgaagtgtactcagttcaggatgttattctagcgaagcccatttaagtgatggtatttttacgaagccaattttacgcgatggtacatatgcaattttctctttttcgggcttggaactagcaatgccattaaagatgcacacccaagatggcataggaggagctacctacacacgtgcaagacaaaaaacaaaaacacgttttttttttcatttttggatctgtatcccttttttgactttttttttgtaattttcgtgttcttttcactcttttttttttcagtttttgtaatcttccaaagaccagcaactaggtaaagacaagaaacaaatgagaggagcaaaattgtttgatcctgcagcaaaattgtatcttgttgttcaggacttcaggcacatttgggctccaagacttgaaaaaaatttttgctcctcatcaggtcatggtcggcactgaatttccttcacctacttgtcaattcgcagctcttagacctggtggtctggtcaagctagcttaaatagttcagaatcagatttgtccaacagagcaataagggtggatgagtctccagaaatgtttccacaattattccatcactgaaaatgaaattaatctaataaaagtgcagaaaattcccaatgatctagcaacggagcatcatttcaacacacatctataccaaactatcccctcctcctttttccgggctggggaccggctatgtcatttagttatacctacgatgacataggcggagttacctacacacctacaaaaaaaaataaaaagaaaagaaacacacacgcaaaatctaacgaaacatgacaatatattttacaagagctaaagaaaatatattttttatttttttgacattttccctttcttgatatttttgttttatttattttttaaaaaaataaaatttttttaatatttcaaagaccaataactaggtaaaacaaaaatacatattacaagtgactgcacagcccaaattcttcaagattaacaacctacaaaataaataagcacacagaaattaatcatggatgtatatatacataagtattttggtaatttaataacttaattaaggaaaagaaaatatatgtgctatcagtttttcaacaatcatattttctggaattgaacttaccaaacaatacacgtgcattacaaaaggcataaggaaaagacacacatggcctatacataggcatgccgatcagcaatatcctcttcttcttttaacaggtagaacacgaacaaaactattaatcaatttgaaccaatacaaagacatttaggtggcttttttgtttcaccaaacaaaccttaattaattaggagccctacactaggaacagatgttgggcggactgtgtgctgtgccggcatggcccatttgtccgtgtcgtgcttgggccagcaccttagcccatgggcttacacggcacggcatgcctgttgacgggtcggcacgagcacggcccagctgcccatttattttccctacaattttctaatttttcccatatttttctcatatttttttattttttttcatattttatcctatttttaccatatattttctaatatatttcgtatatttcctaaattttcctcacgtttgtcctgtcttcattcattttttaacttcatattatttttccctcaattttcaattttttatgggccacgtgcacggcctgctacagttgccgtgccttagtgggtcgtgccactagtgggcccgtgcgtgttgggccgggccacccatttggccagctatagtcatggtactgtagttgagtatttttaattgaattaattaattagttttggattaatcatcattatatccgaaccgtggagacttccctcactgttttccaagtcaaatcatggtaaagtacaagagaccggatgcccgaatgccgccattccaacatttttttaagcaaaataatcattttaacccatgtattcaaccacatgtacaattgaatttcttaaatattttaataacccatacaacgcacgggttgacgactagatctaatggttgtaaatgatgggttcaccagatttaataaagataaatgacaagatgtttttgtttttctcggaatttttagaaatttctttaatttattagaatgtcatgtggaggcttaggagtgttcgtaggagtgctacgtgatggcttagaagcgtttgtaggaggtttaatgtactttaggatataatagattataaaatgctataacacttgtttctgtactggttatggacattgagaataattacaacacaaagttttaaggatttctgtactagttttaggtgacaaggtcagtaatataggtacaaatattaatcataacaactaccgaaagtttgacattttgtctaatatatatgatgatctccttactaagaatgatgcaaagtgtacaacatcaatgaatgtaaagtgtacaggtgagaataacattagacatgcatgattttggctgaaaatatgcaaagttggaatgaaattaaaatatgtttccactattttagataacgatagaataaaaatatgtatcaacaaatacagagccaatgcccttaccttgtgtctctactaatctactgtcttttagttgggtcttcacatctcactctctaggccacgtgtagacatccaggtggcggtactgctctcgaagcccatgcacccacggtgatgagtcctccatattcacatccaaccatagctgctccaaactgcctaactcctcaacacagctcaaatttggacaaacacttacaaacagctttctcactttgggaagttctgtaaccctctccaggccttcacatctacaaacagaaaggaaaccagatagggatggaaggtccttcaccgacttcaagcagcttgctgctacaagggagagctctttcaaactggtggcctcgtgtccaagctgttgtgggagagccctcagcttggggcagttatcaatgtccaacctcttcaaagagggcagcacacacaaccttggaaatgaggcttcccccttttccgtcacagtggttccatcctctcctccttcattcattgctgcaagtgatatctcctcctcttcggccacagcagttccatcccctcctccttcgttcattgctgcaagtgatatctcatcttcttcaataaaggcccattcctcccagttgggcatatcattgatgatcaacc

SEQ ID NO: 77530 - DNA, 638 bp, Oryza sativa
cataggattctcacatagatatgcctttgctcttgaagttctttcttcctgaagttctgtttcgtcacagacatgagtaaaagggcgtaagagttatttccagctggcctctagtgtgaacatgcctattcggttttgagaaatttcacaggaatttttaaggaattgaactatttcctacgaaaatcttgtaaaattcatgtattccgaaggaggcttcaacattctagggatggccaagaagtaagcaatacaagttctgctaaccatcatgacatggattgattatccaatatacaccgacaggtatgcaaactaaaccaatcgtgaatcgtctttcctaacatagagttgcaagtttgtattcgtacttctcacttctttttccttctgaagtgagtttcttttttttttcttcttaagtgagttatatctgttggtgatgctcttatggtcaatcttaggattgtaacctatatgttggtgatgctcttatggtcaatcttccagtctagatgttttttttccctggggatttcagtgctaacttgaagtttcctcccatccttagaaggtatataccttcttaccacctatatatggtagttatattttcagctcaagctagctttgcataa

SEQ ID NO: 77531 - DNA, 11303 bp, Oryza sativa
atatttccttggcaggcacaggaacctgtgttttggcatcgtcaatgtcgtacccatcaaggtaaaaatcatttcaactctgaaaaggaattgtgatggtagggtttttggaaggaacagtgatgattattggtgctgggtttgtagatgggactgtgattggcatcgttggattagttgcctgttcatcgtgggcagtttgtttgcctgcagttttaactaacaaatagttaattagtcattgagtgtcatcattagcaaaccaaaggcttttattatgtcctgattaagctcaggtcagccttctaaaagatgtactagtacttaatcaaagagtagtcgtttttttttaaaaaaaacaggacacaatttgtaatatccatgagtaggaaacggtcgtgattcaggcaattaaaaaggactaatgatccattaggtgggatgtgggattgaacatagataaactagttggcagcccgcgtatttgccgcgggttttatagttttatcgtcaaacaaaatcataaaaatggttaggtgtaactctatgtatatacaaaatatatgataatatggatttatatatgtcttatgttattacaatacaatttagctttattttttcaaacatcattgtgtattgttataatatatgaatattattttcatatgcaatatgggtttcgttatagttagacaatttacatttctctacttcactcaagttttttctgaaaatagattcaggtaacgatacctaataattatatgctattttgtcatgcgtaataaaaaaaacatacatattaaacaataatcacataataaacaataatttgagtagtatttggaaaacatggtgttatgcacaaaatatataacagtgctatgtgtgacagtgaggtagagcaaagggaggtgaatggataactaataaatgattgaattggatgaataagtggcttcttgatccaatggttattatctttatactaatattttatactaatatgatcaaatggcttaaaatttttgatgacgtagcttcttacatgtcttactttataggaataaatgcccctagtgtgtaccaactatatagaaagataggattagatttcctttccatgctcttgtaatattctactagtagtaagaaaagagacgaaatagcgttatgtcgtggttcccccattccattggatggtgtattatcaaatttctcggtccaaagaacaagaccaaattgttaatttggtcaagtccaatccctcgtcacgctaagctcttgcaaccaaacaggaatgtacaagtcgaaatacctctaaaactggtgtaggattaaaggaatgatgaaaaaccgtagtcatatgctagccaaatggaggagcaaacgcggtgcattagggagctagagggaaggaaaagggaaaaacatgggaacagaaaggaagatctggccttgtggacgccagcagcaactatacaacactttgatagttcatacacagtgaactgaactgaaggtgcagatggaagcagaggaataagcacacagacctgagcagcagggaagcgcgcgggagaggatgcaggagcaggagaggaggaggaggaagaggaagaggaagaggaagaagaagatatcctatctcctggccatagttgtgctgtgttgctgggaagctcaagaaatgcgatttgggagtggagaaagggacataggggagtggggaactggcgatatgactagagagataatgcgtgcttgctaccgttgcttgcccttttggctagggaaagtgcaaatggttggtctgaatttaactatttaccacttttagattggacaattattcaaatatccattttaggtttgcacatattctttttgctctcttaagagatgtcttcttaacaatttgccacttttacccacatggcatgccaacatggcaagggagggtagaaactggtgtgggacctactagttagcctctcctctctccttcttctctccctccggcccgatgtggcgctgccatgatggtgtagcggcgacatatgaggaggagcagcggcggacagagctccttgcggtggtggaggacgcagagcggcggtgccggcagagaggaggcgtagcggcggcggacaggcttcttgcggaggcggtgaggcggagcggcggctatcggcggaggaggaggtgtagcaacggcactggcggaggaggcatagcagcggcggcactggtggaggaggcatagcggtggcggacgaacgccagtgaaggaggcgtagtggcggcgaacagcctcctcacggcggcagcgccggcgaaggaggcgtagcggcggtggtgggcgtggtggggctaacggagactgaggtggcgacgccacgccggagtccggaccggagggagagaaggagagaggagaggctgactagtgggccccacatcgggttttactctccgttgccatgttggcatgtgttgatgcaaaaaatacacactggcctgagagatctgcttagctctagtgcaggtccaaagaaattgctttcgggttctgagcgtgccaattggtttgatcctgcaactaacaagaaacaaagaaaagcaaagttaaatctatcaacgatagctgatcggctggattgccgatgacgtatcgttcagtattaagccgatataacatgtatcagatcagcaataaggaatataacaaagaaagagttagatctacttgatcggctgtagatatctatcacgaccggaaataacccaacgggcgttccttacgtgcgtgtattattccttgtcccaggaggcaaggtacaccgaaagttgatacatttcagagtttatcaagcggaagcataaatagttactttattacatgggcggcgaaggcccagcacacaagaagacaaacgggaaacagcagaagactagggcgacgaccacaggcgcttgacggcaggcacgagctaaacaccaaagacttcatcatccaggggctcctcttctgggtttgggaaaaattgagcaagactgagtacaaccaccgtactcaacaagacacacccataagtgcagaataaatgcaagggagtacaagggggttataatataaagggttagggtttgcaataaacagcattaaaagacacttagttgctcaaagctattttgtaaatacgatcctagagttatacaagattattaatcaaggccgtgaacccacacgaacctgccttaacccaaggcctacgatgattcagaccgaactggcaacctgaccctgggtcccagctcgtcccaagccaacccaggccaaccattccacattttagtggttaagcaggttttaagaattaaaacactaacttgggtacattgctcggcttgcccataactgagggcgcggctattcgaataggttatactctgatcagaggtgtacatctttacccacaagacacatcttcgtcacgtgtaaccacgtgccacataccaccaccgtatacggacggaagacgtgacatagtttccaacccattctagccatagacaagagtaccgacccaaccccacctacggccggaacctccgggacaggtaggcaggactgagcccctagcagcaggacaccggccctgtgccatgacatctcgactactgggccgtagctcgtgtagccttcatttgccctagagatgtccatcgacccccgacttcgtccacctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcctagcctaaaaccattttgaggattttgaatagagggggaggtgtgaatccaattccacaataatccaaccattccatagtgttcaggtgatatgaatattcccaaagtctagagttgtaaaaccacctaatgttacctaattaagcagcgaagcatctacctaaattcatactagtggtaccatgagtagagtgtccactagttggggttttgtttattctagggtgaacaaggtaataataataataacaataataataaggtcataacaaaggtaaataggcatggctaaataaaacagtgataacgcgggaatttaaataaagcgataatgtaataatttaaatcaaaataattttataaactgggattcaatatgttcaaggatgatgtgacttgccttgctcactttcccaaacgtcggcttcaacctccacgaagagcggatcttccgaagctgcacgaccaacggaaaagaaaagggcttttactctaataaactccacataaccagcaagaacaaagcacaaaaatgggttcttgacttcttaaggaaaaattagagacttgaacggtccaattccgagttcaaatggccaagttatggccatttgaagtttatattctctttaaatgaatatttgcgaatttattcatttaaattttaatttaaaaaggggtttattgcgtcagccgaggggaaggggcgcgcggaccgggtccacgggagtggggcccacgcggcagcctcacggtccacggtggaccgggtgcacccgggctcacaccggccggcgccgtgggttccacgcgtcagccgcacccgagggcgcgggcggctgacgaccgggccccacgcggcagccactcggcgcgcccgaaggcggccactcggtgcggctggcaggaggcggcgcccgcgcccctatggtcgccggtggcggccataggcacggcggagcggcggccgagagaggggaagggaagggggaaaagaggcggcagtccacggctcaccctaggtcaacggcgacgatgaaaaaggcggccggagcggaggaaggtggcggcgcggctcgggtcgacggggtcgacggcgttccggcggtcggcgaactcggcgagggggtggacggggtcgacggtggtgcggcgaagccggggcgggagacggtcccggcgagcggagaaggccggccggaggtcgtcggcgacggaggagagagagagagagcgacgacgcgagctcgattccggcaaggaggaagggcggcgagaggcggaaacggacggaggaggtgcggggagggtttaaatagggttggaagggggagagggcggccggaggggaaggaaaccagcgcggcgttctcgggctccatcaatggcgccggcgggattaagggagggtttccaaacgaatccaagggagagagggaaggaaaattggggggaaagggagagggaatcacggggaataattcccccctattgattgcacgcggggacgacgggatgcgacggattcggcgacggcggcggcgcttggcgcgggtggagcggcgggaggtcagggatgacgggtgggccccacccgttagtgagggtggcgggcgggcccgcccgtcagcggcgcgcgcgcggggaggggccgagtgggccgcggggagaggagagagagggggagggagaagggccgagccggcccaagagggggaggggggaattttaaggtttttctttttataaaatcattttaactttgtttatttcttcttaattattatttgtgctctgaaaattccactaaaatttatttacacattttaggcttttaggaaatatacaaaaatcctccaagccttatttgacttttaactttgcacattttaatttttggaggctttcacacggattttaattattctaggcataatttagaggatgtattttagagttgttttgggacgtgacaatatcaatgatatacgatctatgtttcgaaataagtttaaactaagtgattgggatagatcgaacgggatgctgagacagtataaatcacttatgtctaaaagtacttcaaaataaagattgtatatactcatagcatagccgataaagcaaacctatcatgtatcggctagtactccgataccactttatactaaaatatcaatatagacgtaatataccaaacataaatcaatctaacatcaggaaaaacctaatggatcaatagcaagcttgatatattctatctaagtgagatctcaatataaagggcagatttagcatatcaaataaacatataagaatcaagataactaaatcagataagatcggctgaaactccgatgctatctctattagcaatcatcaaacaggctagattttatagttctaaatattactcaacagatcaaacttaactgatgcagcaataagcataagaagaaacataaaatctaaacgagtctatgaaagctttttcaagatggtggatatactatataatttaattcaatatcagtatccaatcctatcggttgttttcgttgatagaagccggccgatgtggttagatagcaagatcgatctagattatatagcatatatgataactcgacgatttacataaacaagattagagtgtcatgaagatgtaatcactagtcccgagaacgcaagccaccataacaagttttaccttttcgtcggagatcgaacccgatgcagcccaactcgaaagcaagaactcgtgaaaacaatgaaagtagaaaaaggtggcgatgcaccgaaagtattattgaactatcgtcctttgtttacatggtctcgggtcatatttatacccaaaatacatgatatgtccttgccggacatgactctatctttattacaactcaaaatacgaataagtcccttaggcggactcttaccaaaaatatctctaagaaaactaccagaatatcttacaactcaaaatacgaataattcccttaggcggactcttaccgaaaatatctctaagaaaactatcagaatatcctaattaataaatagaattgccttcttaggactcaatccatgtgtggcaacacttgtgcagcacctcaatcgaccctaacaatgattctagaatcaccttgccgaaatcggctatatcgacttctcccaaacagcagccgatgcaaacagcagcagatgcaactcgtagccgatgcaaactctgtttcctagactaccaatttcctctaaatccgcttcagatttatccccaaatccaatctgtgatttaccaaatttggtcgttaaaagcatgccacgtgggcaaaagtggcaaatagttaagaagacatctcttcagattggaaaaaaaatatgtgcaaagctaaaaggggcatttggataattgtccaatctaaaagtggcaaatagtaaatttcccctgctctgcagtctccactctggactggagttgcagccttgcatgccttcaaggcaggattgtttttaaaaaatatgttattatttcaccggttttgtatgaatacacatgattgaaaagaattaggaaaggcagagcgcaccatcgctccacggggacgcgaactcgctggcctcagatttttcttttatattttagatcatttaaacaaataattttaataatagactttacaggaaattattttcaaaaatgaacattttcgccacgctagccgcgatggcgtgaccaaactgagctgccgtgccagtcgttgccgttgacaaggttaatcggggccgacgtggcagggggcggctgggcttgctatgccaagctcggtggcgaacaccgccacgccatctcgcctggcgtggtggggggggaaatataccccagtcactgccgccgcccctttcttcctccttcctcgcttcttctcctccccgttgttctctctcctagcgatgaagaaaccggcgccccctccccaaatccatccaaatccactcaaaatcctgtgtttttgctccgatttgaagctcttttgagtgggaacccatcccgtaaggtattcgttttctctcgtttttgcatctattgtaatgtttagggttgaatgtaatgtgactgaaatatgtaataatgaggttcacggggatggatcgaagtagattgaggtgtattatggagtagtactcgattctgttagggttatttacgtggaaaatatggtttttttatgatatggttaaaagtggggttagacatgggatagcacgaacatgatatttttaagtatttgtgattatgtagcatgttgtgcttatgttggtctagaaatagttgtattccgccattgtattgttccctaactagtgctaattgtgaatatttaatattcgccgtcgttaattcatcgccacagacaaacccgttgttggtatttcttacgatcacagatagaatccgcaagtgcacagatataccgatgtagcacttcccctacggagtattccaagggtatcgaatccaaggaaacgtgtgtgattatctctttctctagttcatccaaggacacaagataaatataggtaaagggaaaagaggattttctagtgagaaacaatgtctaaggaaagcttaagtttaatcctaacgcgatacttcaggcattggcaacccgctcttcccagatgtcgctctactacgtacccggacagggaggacttaagtactcttgagggctgtcaccacctctacacctacctctaacatactgtgggatacgcagcaaccactgaaaattaagtacccagacaccgcgtctacgcaattaataactactctagtgctagctaaacactaaagcaatcactatataatttatggactatagtaaacaatgatcccgtatgctaattaggaactaaccaagaataattctcacgaagcaaatcttaattactcagaatgatatttttattgaaccagagtaaataacaaagtacaagaataaggagaggattaccgacaactccgggattcctccaacttcttctactttactctctctctctctattctaagtatactatagaacatataaagaagctaaagtatacttagagcctcttataattcagctctacatcttggtgtgtattgtgaatgagggagagaggagtatttataggtggagagatgccttgggaatgtggagatgctaagcatctaaatggcatcttcactctcctcttgccatgtgtctagctgatgacggttattcaggtaaagtcggtagaaaccgtcataacaagtcggcaactgacggcatgtgaagtttagggccgaatggcgcagctacgggttcggccaaacccttgctggcccgttttgctccgaattttctcgtgggctttggtggagaacccctcagcccaaatgtagttgcatttggcccatttgaatgagtttcattcggtttgtgggtccaaaactccataagcttgaatatggaagtttaattcacctcctcctctatgtatcttttgtctcaactttggtggttcgtcacctgcatctaaatatacaccaacactcatggaaatggttagaaataagccttatcactatgttggatgttttatatttagggtcttatgctggtattgacggcgttaatttggtacttaacaaccgtcaacacctgtatcattcctcaatgtgacgatttagctttattttcgtatgctcctaatggtttctgctattgtatggttcacgaatcgaacattaatggatctattttatttttattaataaagttgcatccacgtcctactgcattttcttccttctacttgcgttcttattcctccatcctatcacgatattgctccaactagcattcaggtgattgctttttgtggtgccggatttagtcatttccatctttccaaattgaagcgaaaacaaggaataaggaattgacaatgcttgaaccattcatatcttcaacagataaatcaagtccatcaaaaccgcacgaagttttctaggaatacctcacaaatactacagatactttatccgatctttagtaccaattttctaaatacaaacttggcatgttcaccataaacaagcaattgtcatgatattaataaaaatattcctaacacatgaaattttcttatcataatttttttcttcagaaacataaaatagctgggctttttgcactgccacaccaacaagccgggcatggaagtagccacgtcagcgcccgattgaccttttcaacggcaacgactaccatgaggcaatttttgccacgccataaccaatggcatggctgttggtatttcttacgacattactagaaacataatttccagcaattgtgcagaaatactcttggtatattatggttacaaagttcatccacaagcgcacggatataccattgtagcatttcacccgaaagtattccaagggtatcgtatttgtttaatcctgtaggaagattatagtagagagaatctgactaataatttatatgttacttgtaataatcatagtctaagcaagggttaagataatccaagggtagagtgacacacaagcaggaagctactcattctcatactaaaatatctatgctaagtggaaagaaaagagaaagagaatctattcctataattctagtatacatagtatacatgcatcatagttatctgacatactagctaataccctctatctgatgccctcctggtacttcgagaagccacccctgactaccgagttccttacgacaacccgttatgaccatacaaccggggctaaatacggaggagtaccctccccaggaaattaacttaggactatatacacgcgcggaggaatacccgtactgagctgtcaccatcagaggcccacctctcattcgtagcacataaccccaaataatgatatctcgtaatctagacaccacacctaaactaccagatactactctaatatcatcgtcatgacatagagtaattgcataagcaaacactatacccgtaccgatgcatctcccagataagctagcagtataatcagtataacatgaacataatgtaaagttgacattcatatactcagaaagtattccaataccataaatgtatatagaagagtattctaaataaagtacagagcttacaaaagagaagagaagagctactagaggcatacccgaactcttccgaattcttccacactccgatttctactctatttctactccactagcttgagaacactaaactaaacttgagagaatatgagagagctttgcttgaggggtgtgtgtgaagtgaggatgagagcaccttttatagcttgagaatgac

SEQ ID NO: 77532 - DNA, 30327 bp, Oryza sativa
taggcgagctagctagctagcacgtcttcttcctccgccacggcccaacgaggcagccggcaaagctaggcaggcgtacgaactcgtggccaggaaagctgccggcgtcgcgccgtgcaggggccagcctgccgtccatcatcaatgcctatgtcagggtctcgggccggctgcacatgggccgctaggcaacccgtcgccaagaagaaacagaacagaactggcaatcggcggcttcggccacggcggcggcggcgactaggtttgggcaagaaccttgtcgatctctctcccttacttctccttcttcctaccagccactacactcttcttgtctccctctatagaaccttctagaagcttgtaatactcagctacttcgctcaattccacctcaaattggtttagatactgttgcttgctatttgcttggtgcatcgggttgctaacagcctaaagggatcctatgtctcgacgcaagcagctagcagcacagtgcagctctgctctgctgctctgagagattcggtcgtctgcactgccgcgtcttacttacacggggcacctcttcaacgacgacgacgacgccgccgccgtggcaccggccaccgccgagacgacgccgctttggacgctagcccgctcccactcccacagccctgccccggcggcgccgagccggcatcacggtcgcatcaccgaccgcgaacaatggtgacgacgactactcggcggcggcgtgcagcagcaggtggacaggaaggctgcctccgtgtcacccgcggccgccgccgctccgtgtcacccgccgccgccgaccagtgagagaagaagagtgagacagagtgagagagaggaagagtatgacatgtgggtctcatatttttttataaatagaatgctaactggactaccacgcgtatgtcacgtagattaaaatcaccgcggattgggtcgagggagataattcgttcggtttgcatagttgggtgtgaagaatgtctggttttgcgattcagaggggtaattcgtacgttttccttttcataatatttcaatccaaattgttttattatttctccattatctaacatatatctcgcagcaaagcgcggggcatcatctagtatatttatatgggtgtgtagcccaaatttagtaccctattcattagtaatacatgaaactctaatcagtgtctgttttcttaatttaacaatataattaattctgttataccctaacttcaaaaagttgtaaagaagtagtacttgcaaaattgtaaaatatctcatgaatgtaaactgtcgccgcgcggttttcaatttggaaaaaaacaggtttcctttagtttgcagtgtttatacttttgcgcaaatcagcggccgctttaataccactcaaagaacttgacctttaaatcagcggccgctttgttccacttgcaagtgggacaatggtagccgtaaattgatcgtacgtgcggctgaatttttttctgccgacgccatcagatgcgctgaattttgatcatcgccagaaaattaagagagaaaagatcgagttagctagcgtggaatatcgccaaggaatatatgcacgcttgcgctttaattacttgaatgcatattgtgccacacgacaactaattttctgtccagacgtactgcttttggagagaaatttcatcaaaaagcatatgccgatcatgttggactttttgctttgtttaatttcgtcgatcccttccttcactcgatcaagcttccaccgtaaaggtttcacgcgtacgtcgtgtgttggccgacgtgctggccgtggctggcatgtatgtcttgatagatgcgtttttgtgcatcgacctagcaaacagcagctatatatatatatatagagagaggagggtcttgcaatatcaatccatcatcacaactcatcaaactcagatcgattgtcattgagagcgagcaactagcgctagctactactcgaaggcaaaatggtaagtaaatctcgtatacatatatgaagtaattagttatttggcaattagatgttgctgtaacccatttccattatctaaaaaaaaaagatgttgctagctagtgcatatatattcatttatatgcatgatcgatactgctggccggggccgccggatacatctgaattattagacgtagaggccggattaattatgtcatcttaaagagaaactaatttaatggttatgatgtatatatatgcaggacgtgatggagaagtctcggcgagctcacttcttgttcgacgacgacgaccaaacgccgccgaagcagaacggcccccagaacgacgaccagcacaacaacgacgacggcagcggctgcctctgcgtgtcgtgctacggcggcgtcgcaaaaccaaaggcgcccaagtcgtcgtcgccggcgaaggacgtcgtcgccggcggccgtcctgctgcaggctccaactgtacctgatcttactctaaccatatatagcttgctagcgatcgagctcgatctcatctcgcacctagcttgatcatgtcgagcaaccatgtacgtgttgatcgacatgatcactctagctagctagctagctacttcatatggatgttgaataagggatcatatcggaggaagacatgcatgagtgcttatgcaactatgcaagcatgcccgtctccaattactggtacagactacagagtgatgtatgttacgagaaatgtactctttacaaataccatgaacatatattatgatcaattacatgacagttgtattattaattagcagcgttctgaattcattctgaaagggtgtgtccggcctttcgaatggacaaccagctgctgtaattaagctgttcattgttcgatctcttgccgaatagtataacattttttttggggggaatgggcactcatttattctttacaaatgaatatatctccgtaggagtataatggaaaatctctcgattttgattgtgttgtctctactcaacaaaagctgagtggaagccgggaaatttcctgcacaagttcttcaacttctgttgcaatccactttattcgttttgtacctgcatccacaaagacatatctagctcctcaaaccacatagtatatcttgagagtaagtttaatgcttctatatgctcctcaatgaaaaaactgcacaatttttaaagaagatgagaggcccagattagaaggtactgatagtgtaaacttcatttagggagggtaattttgtcctcgagggagttaagtctagagcccacaccaacagtaatcaccgcaacttttcacaaactgaaaaccactaattaacaaccgtgatctccattgcatttgcatcgcatcacaaacacaaattgttcatcacctgaaagtttgaaacaaactaaaaacgaaagatgcatgcattccaagctgcaatcattcttgcgtacaaaatgcatccaaaagttacgcaatggcaattatgggcactgcaccatgggatcgaagcaaacaagcaccgatcgatgcgttcgttcacttttccctgataattgcctttctcatctcctctccacttaaactgccatccaagcttccaattcctggcgatgttggtccggaatcgatctaaattaaaagagaactggccggattactcaaccgtactgccattgaagcaaccaaatcaaggtatttcaatgcaaatattgtagatgagatgagtgtgaaggaaaaatataatagggctttgtgggcgtctggagtatgaactcccagtccagatcaatcttgtgctagccaaaaggattgatccgttgagtgtggggatcagtctgcggttctaaccatgatgacgggatccgggtagacgctggcaactacaacagctttgttcatgtaacgctccgcttctcgtgatacgttaaaaactaattcggcaaaatcctatatgcgaaaatttcgttctttgtatgcgagtctaagttgtgccaaggatctcaattcaatctcttgttgttccctctcatcgccatcaaaatcgtccacctcaagattccaatttcgactcaagtctccgaaatcaaactccgaaattcaatcgcatcctttgaatccccgccaaatacctatccccatttccgaaaatatcaaattcccatctcgaatcctttccttgagtctcccttgattcctccctaaacccccgagatcgaatctcaaatttgaaatttaaacccaagtcccaaatccctccaactcaaattccctataaaagtctactttacctccctgtgtttttggatggaccgattttcctcccctcggcccaccttccccgccgtccctccccagcccatttcctccctctgccgtcctccaccctcctctcgcacgtgccgagccgagccgagagaaagagctctctcgctctcgctgtttctctctctctctctctctctctcgttttctctctcgcgcgccgacgccgcttcccgccgtcgccgcccaaaacccgccaccgccttcgctcgttcccgcgcgcgctcccgccgtggtggccgacagccctcggtcaccgtccgccctggcccgcctgcgccgcgcagccgcccgcgcccactctgccgctgcccccacctctgcgccgcagcgcgcgtgtgtccaagacgcggaggcagtgcctctctctcccacgcgctctctcctccctcagctcgtccaaaatcggcaaggagccgagctcctttctccctcccctttttgctttttccccgatcggcgtcacgcccgtgaccgcctctaccgccgcttggccgctagctccgagcacgaccgccagctgccgccttgaccgccctaaggtcggtttgaaccgacctcccgcgcgaaccaacctcgcctccactataaagccgagtccctcctctcaaatccctcccacttcagtctccaccgctgcagtgccatcgccgccttgctgccgccgtcctcgccttcctccgccgtcgcgtgtgccgggaagccggcgtgcgcgcggaaccaaagagggctctggccacccttcttcttccccttccccggcccgacgacggggaactcgcttccgcgccgttggctgcttgtcaccgcgccgtcccggctcggtagtgcctccctcccgttccccttccccgctcaccctcgtcccctctagcttgcgtggtagctcggtagccctgccgaacgcgcgtagacgccgccccaaggaccgccgccacccggcatggccccgccgccattgccgcccacccccggaggccgcctctcatcgccggctgtcctcggtgctcctccgtcccatccggcgccggaaacggattccttgaaccccggatatgctcccaccccttttaatcgaacccccgttgctccagtgaagtttcccccttttctcgccgccggcgtgcgccgccgcgattcgtcatcgccggcctccctccggcgaatccgatccggtggctcacttcctctcgtccgtcccatcgttccggtgtactccctctctctcgaatcgtcgcgacgagctccggtgaactcggccgccatcagccgtccatctcggccgccccttcttcctcctcccgccggtccgcgtggctgccacgtaggcgccacgtcggcaccacctcggctttgaccgagccgagccggtcagccgcctccttccttgcccccctcccgtgcacgcggtccacggtgcaccaaccggctgcgcgtgggcccgccgcatccctggtccatccggtgcacgcgcgtgaaccgcgctcacccggaaccctagagctgccctcatgcgccgctcccacggtgagccgcgccactgacaagcgggccccacccgggaccccgcaaggtggattcggtccacccggacccatccccctctctcctcccgcgcgccccgcccgcttgggccgcgccttgcccggccatgggccgcctcctcgcgcccgcgcccagcccattggctcggccgcgccgtgcttatctattgggccgcactcaagccgcccgaggaagtctaaatcacatccctccatccttttctttttcagggatttaataaatcctttttcctttgtcccataaatcaattccttattcccaaaattccacaaatcatttcctttggtcccgcgcgtcagtgactgtcaataatattcttgagaatattatttctataaattccataaatcatttctcctatttcggaaaatccaattaaacttcgaaaatccatatcttccgaaccgctcatccgattgactccgttccacttccaataattccgtaaattgagatctatttaatggcactactaattagtctaaataggatctttcttttggtcttttgtttaggtttttgattgtttgcgtatagttgcggttaccggattttcgtcgatcgcgggttttctcgaagattcgtgaagcttcgtgaagaccttgagcaaggcaagtcaccctttgatcaattgcccctataattgaaaagtcattattattttgtttgcaacttgcattattagaatcacacacttaacttgcttggcctcggtttgtgtgccaaaccgacggacctacccagtagtcgcactaatttccgtaggtcgtactaccctgattccttgtcgctccacccttgtggtacctcggtattcgtgctctctgagcgcgtataccaaatatcccacatacaccgttgtttgtcgaaaacttgggaaatgagtttgtgaagccttcaaaacccgatatgtggtgtcggtgtgtttgaaaataaaatgaattgtgaaaactcgcgatgcgggggttgtgcctatgtggcactgtcccgtattcgcatataaggaccgattcctgtggaaaactcatcgaacataatcaaagtgcaaccacaaggtggaatgggacaccctggctaagtagctagtcgattcagggaaacctcgcatgccaatagttgggaacgccggggcggggtcggttggagccaaaccgggttcctggtaatgcaagaacgagaagtttgctgaattaccgatcgaggtggttggagtttgaattgtgaacgcctataatggcctatgtttatgtgaggatttgatcattctatgtggcatgaggtatccctgggtcggcttgggaaaggctttgtcgcgaacctctgacaccggccagtgtctggagtaagttcgtgtcttgtgggtaaagtgtacccctctgtagaggttaactaactgttcgaacagccgtgcccacggtcatgggcggatgtaaggtggttcccgttgcgtagatttgtttgcctgtgctttgtgaaaagttgttgtggtgtgggaatcgtaaccagaatcagcctatgtggcagatggatgacctgagtggtcagaaacaaatctgtgtgattcgggatgtctgtgggcatcatagactaggcttcccgagtggaagcggattgttgtgctgctgggcagctggactctgggagtccgagaaaatgaaaaaggctctgggagccgattaatcaagtggaatggctctgggagccgagaagtaatgatctgagccgggaggtcggtacattaccaaatgagctgttgaaaaacatctcttaaagtcgaaacgagacgcaagtctcttttcggcccaaacttagaaagaaataaatcacttagtgttttcaaaatgtcttcaaataaaagatttgcaaaacaaccttgcctctcttccaaacttgcattaaacacctaagttcccgtgacttgctgagtacgagagtactcacccttgctctatataaatatatatatatagttcctccgctctgaagagaagataaagtgaagtgaaaattagagtttcgtcctggttcccagccgtcgcctgtggtgttgggtgttagaccgttggttccgctgctgctgctgctgctgttggtgtttcctcgtccacgtcgtcgattgtattctcgggctgtctgagctgcaacctaagttaaggtaaataagtcctctatttattttaaggattgctatgattcatatttgtcaccgtgggtaccagcactatgtcctgggactggtaccgagatcgcggtttcgtaggaagcggttcgcgccgttttccctacgacacgctcctgtcaggtgccgttgtacggcggtatcagattggggtgtgacagttcgagggtagtgctgccatggtgactttaacaagatggtcgagcgatggcgcaccaaatatggaaaattctactagaaaaatgttttctaccaacgatccccatactctgtaaatgccgtagtcatgatctacaaacatcgacaatacatgttaggtaccaaaggatttccgtcggtatcaatcgattcccattgttactaggccgattcccatgtagataccccgtcggcaccaagcctgatacgtgtgataccaaacccctgatatatgtagattcgattactggtatcaggactgggcaaggagacggtgatgatgacggttggcatacgccctccactacgacagatatctagagaggcccaattaatcttagaacaaactatgtctttctctatatctcttttttgtatttcggcctttgaaatggtttgctagttgaactatttatgactgcgttcgatgcttttgctttgtttgtaaatccactagtcccgatattttgaacggttctattttcatgcttcatagctccatatgtttaggtagggatgaaaacggtcggaaatgatcggaaaacagcctcaaccatttccgtaaccatatttttctcggaaacgaaatcggaaacggtaaagtcggaaacgaaaacgatatcggaaatatcggaaaaccgaaaacggaacaatacggacggaaacatgtcggtacagatcgaaaaccggtaacaaatacggaaacattaaactataaaaacatatatttaactttacataagtatgttatatatatacataaattcaagcttatactatataaattataaattaacttcattttagccatatacaaaagttagagattttattgaagagtcattcaatctataagctgtgggtcaagtatagacatgtcctataatatcgacatatttagaatacggtaattaccatattataagaaacggtgatttccgcgagaatacggtaaatacggaaacgatcggtataacagcaaaaccatttccgttttcatttccatattttttaccatttccatttttgtttcggtcgattaccatttccatatggctcggccggtagaaagtcgaaaacgaacgccggtcggccggtaattaccgttaccgttttcacccctatgtttaggttcacaatttcgtaaacttattattttttaatcttccagttctatttcttttggcttcttaccacaagcaaaactaagggaatgtttggtttatttggctaccttgccgtgtcatattttcgtcttttcatagtttgttaaatattgtttgcttcattgctacaatattttaagtttgtcacactttttttattttacttggcacccctaaatgtcacatgtacattttattggcgaacgcacaattaacgtcgtgcaacaatttaatgccactttggtgccatagttaacctaagtataataattgtggcacatatgcacaccatacagattaaagaatcacacataatctaaaatatgtcagggcccaaaacatatgtgtcccctttattggatttattaaattattacaacattttggtaacaactacaaaacacagaggatatgaattccacgcgcgcacacacacaaatatgcacacatatttatggcatatatatctaagatgaaattagataatttccaatagggtagggtttatttttgaaccttaagcttttaatgaagtctatttttcactgtgaacttaaatttcatcataagctttcaaaaattaggtagtactagcactccaagtaaataaatttatccaaatttgaaagttaggagaataaaataaggtgagttgtatcatttgggatagaaggcggtggtagtctgcaggatcgtggagatggcgagcagagtagacacgacgagcgcaaggattttgacaggggtgtccatgtacttcttcgcttccgcccaatctcggtataattggtactggctacataccctgagctgatcgagcaccttgccgatgggtgtgtcctccttgctccgctgattccaccggcataggttcttgaagtaattgatgatctgcggtaattaacaacgacatcagatagatatgtatgtcctgtctaaaacggcatgtttttgtcacggagggaatgagtaacgtcattaaagaagtgtccaaaattccactttttcccccttttgttaaaagctatatatatatggttccatatttttctcttgattttccgattgcttctctcatgtaattaattgatacctctctgttttcttatatgtatgtagtaagtttctctcctatttcaagtagataatcaaattcttttatatgacatatatttagtgtaaaagttgaaatttataacgtaattatagtgtaaacgtatttatttaaactttttcttggaaaatatgcaccataaatatagttagtctttttctaaccagttttgctgaaaacatgtgccatatttttagttgattacggtcacttatttctcagcaccgaatctagtatgtggaaaaagtatcttaatttgcttcatggttggttaatttagcctgcttcaatccccttgcagaacttttgttatggtgttattggccattcacttcacatgtttcatccaaataaaaaaaatgtcaagaggtagatttccggaacctaacagtattagttgtttccatttcctcatttgcatttttttctcaaattttgttttatatccagggaaagcttatttactctttagtttgaaataattaaaagatatgattgacctcatttgcgtaaaagaaaacgcaaaccaagtttctttcctttgcctacattttctatcttctatctcatttatctactcttctgagtaggtaatcggttactttaaattataataagtatcatggaaataatctcaaaattattaaagcttataattaattatagtgtaaatataggtaattacaataaaaaagatttgatttatttaagatgatttgaaaatatgcctgcatatgcaatatttgcaagaaaacccctcctcatctcaaccatttttgaacatcttagatcgcaccaagattcgtgcaagcataatagttaaccttctcccttccccacttcccccttctcccgtacgtgatgcgaggtcaaacttgccacctccaacgccgctccttcctgttcagcacagtgttggcatcttcctttgtcgaagagaacccacctatttcctttccctgccatcaacctccccctccctacctctccttctccccgaactgagtggtatacgatgttccccgcggctccgccccaccgtcttaactgtcttcgacagctcccttgcagctggaaatgccccctcctcctaaacactcgaaaccgaatacttcctctactgtccccatacatcgcccttatccaaccgtacggttctgacggcagtgttacgccacccgcccgtgtccgccactcacaaacatccctttaagtcgtcccagcaaacttctctctcctccctcccccaacctcctcatcccaaaccctaatatattaattagtactctggtagagttagggtgtcgccatcgagaagcccggggggcatgaatctttgcatatatacaaccaacggtagatataactgtaagagatctcccaaaatgtggtgtagagtgctatttttttcctcagatcggcaagttcatatggttttagagagagatgttccctttgtttttgtttcatattataagacgtttgattttttaggtttcattaaatttatagaaaaatttaacttctacaatataaaattattatcattaaatctagcattgaatatgttttcataatatgtttttttaaatactaatatatttttctataaatctattatattattaagacagctcgaaaagaaggcaccacgttcgccgtgggggctagaaattctcacattaatcggaggaaaagaaaaaatatcgaccgcttgttcattgatagcctatattttaatggctgagatttaattaaattttggaagattagacttggtttcacgtatacggacataccaggcactagaaactggacatacgtatcagctttgaaaggagacaccacattcactgtgggggctagaaattcccacattaatcggagaaaaagaaaaaaaaagaaaaggaaagtccaagtagaaatacaatctaaaaatagttaaaattcggaattaaaaataaacaatattgaaagaagtttctgtataagaacccaatttgagattaaccgaaattcgaaataaaaataaaataaaatccaaaattagaaaaaaaaagagagaccaattagaaatataatttaaaaatagctgaaattcgaaatttaaaataaaatattaaaagaagtttccatataagaaaccaatacgagattaatcaaaattcagaataaaaataaaataaaatccaaaattagaaaagaaaaggatagtccaagtagaaatataattttaaaatatctaaaatttggaattaaaaatatggaataagagtccatataagaacccaaaacgagattaattaaaattgggaataaaaataaaaataaaatccaaaattagcaaaaaaaaaaataagagttcaagtaggaatagaatttaaaattagctgaaatttggaattaaaaataagcaatattgaaagtagaatccatataagaacctgatatgagattaattaaaattcagaaaaaaatatctaaaattagaaaattaaaatagagttgaagtaggaatacaaatttgaaacaactgaaattaaaaataaaaagtaaaaatattaaaagaacacaatacgatattaattaaagtttgaaaaaaaataaattctgaaattagaaaaagaaaaataagatttcttaagaatacaaattataaataactaaaattgtgatcaaaataaaggctattgaaagaaaataccatctaaaacatatgacgaaataaattaaataacaggcctataacggttgatacgacatataaaaattattaataaaacaccaaatataatcctaatgatgattaaaaggagggacgacaagcaggccgtgaagtaaacgagcaaggcggttaccgggacttttagaaagtaaaaaaaaataaacctcattgataatcatattcgatttttaaaatctcaatgacaataaaaaggagaagcagcgggcggggtgtataggagtatagttgcatagccgccgacggttgacggaacttctagaaaataaaaaatgaattccaacgatagttatgttcgatttttagaatcacaatgacaataaagactaggcggcggacgggccgtaaaggagcatagtgccattgtttgacgagacttctaaaaattataaaaaataaaactcaacaagacaattaactctaaaaactacaacgtccaatttttaaaggttcgaaacttctaaaaagtaaaaaaaacaatgataatcatgttcaattttaaaatctcaattacaatcaagaagggaggcagtgcgcgagccatagagaagtacaatggcaaagccgctgacggtttggcgggacttctagaaagtaaaaaatgaacccaaacgataattatgttcgatttttgaaatctcaaggacaataaagagaagtgacagtggacaggccatagagaagtataatagcaacgtttgacgggacgtctagaaactataaaaacgaaacccaacgttacaataaactctaaaaactataagatcctatttttaaaggttccaaggagaatgaatagaaatagtggtagatcgagcaagcaaataaaaaggagatgatataagagatagcaactgatgtgacttttaaaaaactatataattagaaacacaggatgataagatttggtctttcaaagtcttaagacaatgagatagctatttaataaattttaagtaaaatcatactaaaaaaatatatgattttatttgggtgctagccgcgcaattgcgcgggccacccaactagtttgattaaacttaacaaagtttgaccagtaaaaatgtgaaaacacgagaaactgagtgagagtatataataatgcggtgttgctgaccgtttcatggcttccgaagttgttgaggaggacgcccttctcctggagctcggcgatgtcctccgtggagctgacgaggttgtacatgaggaaggcgtaggtggtgaagtagtccttgcccttccgcccttgggtttgctggtcttgtccttgccgcgccggcgtgccctgctgctcgtaggcgacgaggttctgcagaagcaccgccgtggcctcctcgacggacagcgccggcacctctagctccggcggtattagtctgatctcaaggcttttcctgagccgcacgtcgagtatcccgcctcggtccctcttcgccatcctgatcttgacgccaaggccccgcagctgcgacgccgacgcgatgttcgccttggggtccgtcttctcgccgccgccggcggcgcaacaccggcacatgtggagcggcaagctgacgagaaagagtgggaggatgcagagcagcagctgtagggcgtgccacggccactgccagcacagctgccactcgcatggcggagacttggggccggcgctatcgaccttggcgaggtgagctatgtgcaccaggtgcagcaggtggtggacctcctcctcggcgatgagcttgtacagatcgtcgctctcgcgcgtggggagttggaaccagtcctgcagcatataccacatcgccatgactatcagcttgtgcctcttcctccgccgcatcgtcttgtcgtcgtccttggcgacgcggcgcgtgatcttgcccaggaaggtctgcggcgtgaggtggtagaagatctcctccagcacgaagaaggggatctggttctccagcaggccgaggtcgatgcgcagctgcgccggcgaccaccgcgtcgcgtacagctccggatcatcgtacccgatggcgaagttgtagatgtgcttgatgatgaagcacccgtcgagtagcagcatcctcaccatctcctcatccgtcatgccgcgcaagtactcctgatcctccgcgtaaaacctatatatctttactattataaaaattgaagatgtttttgtcgatactttggtacgtcatccgtgtttgagtcagttattaagttcattcgtttttgaaattacatatttgtatttgagtaggtttttaagttcgttcgcttttggaaatatagaacaagtcgtataagaaatctgtttaaaaagactcgcatgataaatcgagacaatcggactcctaattatagcttatgattttgtaaaaacaatattcaagcaaatttctacattaaattttattttagttaaatcatataacaataataagattaagataaccttcaaccgttgcaaagcacaggtatttatttagtatatctatacgtacacacatacaaggtaaaatgatgattaacttttgcccctcaagaaacatgtacgtacgtagtacacttgtttttttttattatgtcatgtaatcttggttataaaaaagatgctgaaaggatgagataacatagataattttgtgatgtatcactctaccaacacgtaagtcatttaaactcgacattaacaagttgaaacgtaaaatttcgacttagttcgtttcatggtaagtggagaatatttccggtgcacacgaaacaagaagactcattagccacatgatttattaaatattaattattgtaagcttgaaaaatagatttatttgatttttttaaacaacttctatatagattttttttaaaaaaaatacaacgtttagcagtttaaaaaacgtgctaacgaaaaacgagtaagttgaaatttggagttttgcaaatagaatggggccttatggtgtaattgttttttattttctcattttatggatcaatttgaaatttatttcttttgcaggacgatagaagacgactaagatatccatgttgtcaatttttttcagctttcttatagctgttttttaatttgagaaaataaaactaaaaatgaggagaaaagatgttttaatttgtttcttctatatttaacaatgaatcaaataatatgaaaaaactaataaatacttaaattttttgaataaaatgaacggccaaatatgtttaaaaaagttaaatgcgataaatatttagggatggagagtacttagagaaggaaacgtacgtaccggcgaacagaatccagcatctccccgagcctacatgtgcagagtaggaggatttcgtctcgtttggcgcgatgatcgtcgacgtgaggaggcccgacgacgtcggtgagcagctcgtcgaggtagcgctccttgagcttctcgacacggaggcgtctctcctcctcctcctcctcctcggcgtcacgatcgccgccaccgcggcggcggcggcggcgatggtacggcccgatgcacgcgaacttgggcccgtacgcctccttgttgatgtcgcgcacatgcttgggaactcgccagagacggaacgacgacgacggctgcttggaggccgacgaggcgccgccgccgtcgattacatccaccctcacctccttaggccagctgctcgccggcggcggtgacggcggcgccggcgtctgttgctccgccgcctcttctcccatgatctgattatatatatatatatatatatatatatatatatatatatatatatatatatatatatcttcttcctctcgacgtttattagcacgcttgcatgaatgtgtatatataggcacgtcgtcgaccggaatttgagatggcgtgttcgcgggcggcgatcggcttgatggtggtacgacgacaatggcataaaataaaggaagaagcctcctctctggcctaatcgattctttttggttggcaaatgggagagtatagtgatacaaacaaaaggacgtacgtatcaaccgatcgatgagtactgcaagctttcgtgttctctctgcttgcatgtagtatgtatcaagctaataacccctttattaatctctatctttttttcccctcttcactactacagttagcatctcaacctttcttcctcttcactatatatagccagctagaatcgtcaagcttttccttttgttgctacctgggcatgaagtaagctcaggttcttcctatattagtgtatacatacagatggtgcatacgtaattgaaagagccctgtagatggaaagtggtttttcttcccactcgcgtggacatacactcgtttcatgaatgccgtctaaaaatattaatttttcaaaacataataaaacagattaatatgtgatatgttactctataaaactataagttaaaattcgacttatagaagaagaaacaaaaataacaaatactctctccatcccaaaatgtttgtcgccgttgactttttttaaaaaatatttgaccgttcgtcttattcaaaaaatttaagtaattattaattttttttcctatcatttgatttattgttaaatatacttttatgtacacatatagttttacacatttcacaaaagtttttaataagacgaacggttaaatatgtttaaaaaagtcaacggcgtcaaacatttagggaaggagggagtatcaaccatgaattgtacgcacacctttgatagtcatatatatttgttgttttcggttcatacacatttgtttctacttgtgtatattaaattttaacttgcatatgtttgtgaagtgattatcacatattgatatattttgtaaaaaatattatttttcatgactttattagtggacatgcatgaaataaagtgtatatccactcaaatgacaaagggacttaatatgaggatgcgattctacatgcactactacacaaaagcaaatagctaggtgtccgcactataggtgccggaacagctaaaaccggtgcttttcccttccaaaacacgcatcgatgggacaccattggctagaaccaacacctttatgaagataggtgtcgattctgaataaaaactgacactgacggagcgtggggctcctcaccgggagaccgcgcgggcccccctttgccggttcggccgggggcgctaggtgaggttctaagccctcgatctgtggaatgtttcgcgagagagcaaatgcctaagacacgggcgatgtagacaggttcgggccgctgagaagcgtaataccctactcctgtgttctggtggatctgtgtatgaaggagttacaaagagctggagagcaatagagttcaaactctagagaccctcttcctctttctctcctctacgagctcaggtgttctcccctttttttcccttttttctcttaagtgggcaaggtcctccttttatatctcaaggggataccacatgcaccacttctacctactcttcttttgggtggggactcaccctatcttccaaaaaaaagactggcttgcgccttcgcctggaagctaaatcacagcttgtctttgagtgaggcccagcgttatcactcgcctggcaccgaggatctccctgttactccctcattaatgggcggagatttgccatggctgctgtccgaatgaccctccgatgggatgggccatacctacctccactccgccggaagcaggcgcaacgtgggagcacggttgtctgccgatgacgtgaccggcgttagaccagtcacaaaccggtcattcttgtctaccacgcgtcagtttagcatgccacacatcagcccttcttcctaaaatgacttccttgtaatggttgcgatgaagcctggtatgaatctagccgggactgacgtgctaactccaggagttagcacgccggctccggttagggacgagtgcctagaggctctcatcattccgacgggacggggcgaggcgtgcgaaaggctgcctgttgccacctaacccgcgatctgaccggtctgtgaccggtcacacactgtgacctgtcacggaccaaacgagtgtgctgcgctgcattaaatgcgccgtggggcgctcgtccaacccgcaataaacgcggttaggtgagcgccgctgtgctcacctaacccacacacgtggcgccaaacccacagggggtcggggcgccccagccctcggggccgaaacgggagtggcccgaccccttggggagacagagggaggggcggccacatcaccctcgggcccgacccccccgagggggtcaggccacgtgggtgaccgcggctgccccaaacctctagtcaagatacccccggtcccatgtcaccgacagtagcccccggcgttatgccagggcgatcgccctcctcgaggaaagcgctcgggcgtgacgccactccttaggcctggtgacaggtggggccggtctctacaggcgggcaggaatccagtggtcgcaaatcgcgcgcatcggcaagggaaaaccgaccgacaataatgagcggctttcttcaagaccgctacattacttgagtagcgcgcgaatcgggacgagccggttcgtttcgcctggagatgtgatgatggtgcatcggtcggcgagcgtagtttaacgcgcgcacgatatgtcccatctcgactgccacggccgcacatccgcctcatgcgccgcaaacgggcgagcgggattagtggaggagtgggcgcgagaaacgagggggcgagatagtgggcgcgggaagcgaggagccgggcatagcgttggcaagggtataaagacgccgaggaagagattcgtttccttcctctcgccactcttccccttgcctttgccacttgtgctctgactctccgtttccggcgccctacccttgccatactcactcgctctcaagcccctcctccgccggcgtcatggcacggggctccgcaccgctcgacggtagcgtgctgccgccttctcgcatcgtgagcgagaggcaggctgggctgccgcgccgattcatgccggaatctgccaccagccgggaggtggtcgcgctgggtgagggacacccggcgccacactacccggggcggtccgtcttcttcctttccttcgcaatggcagggctggtcccgccattctcttctttcttcatggatgttctggagctttatgatctccagatggcgcacctcacccccaacgcggtaatgacgttggccatcttcgcgcacctgtgcgagatgttcatcggggtgcgcccatctctccggctgttccggtggttcttcaccgtacagccggtgtcgccaccgtcggtagtcggtggctgctacttccagccgcaggggccggtgctgaaccgctacattccctgcgtccttcgcaagaagtgggacgactggaagagcgactggttctacacccctctcgccgacgaagcgcgcctccgacttccgagccagcccccggcgcaggcctccagctggcgggcgccggtagatctgggagacggctacgacgccgttcttgaccgcctggctggtctgcgattccaggggctcacgggggccatggtgtacggcgattaccttcgtcgccggatcgcgccgctccagcggcgcgcccggggcgcctgggagtacaccgggtccaaggactacacgaggacccaccagggggtcaaatgggactgggtccctgaagacttcaagatggtgatccaacgggtgctgaatctcagctccgtggaggcatccctcatcccccaaggtgtcctccccctctgcagcgatccagagcgcgccaacatcctgaccatcatgcaggcggtcggggcgttaggggagcgggctcctcgaggccacgatggcgcgggcgggagccacaggggggaacaatctaccccgggagggggtcgtgcttctgggccccgtgacgggggcccggggggcagccgccctgccgacgcccgggggaagaggaaacaggaggataccccctccccatctcctccccgagggggcggggcggtgcgtgccagcagcaggcgcccggagggtgctgtgccgacgtcatagcccgagggggagcgaaaaaagaagcggctccgcaagatgggggggaccgaaccatgccggggaaacctcatctcccccccaaggtggaagtttagccgacctcctcgcaggttcgtcctcgcgcccactgcggccgtattcattctcccatctcccaaggcaagttttcactcacccgtttttcgtcttctggtttttcttctgcctcagcgagatcccgtcgcacccttcccgccattccaagtccggccggtctgaggccgaggagacggcgaccgcggaggcccggaggtgggaagctgaccggtgagaagtcgcagaccgcctccgggaagccgaggaagctgcccaggaggccgtccgggctcgccaggctgaggaagccgcttgggaggaggccaaactctgccgggccgaggagtccgtccgggagacggaggcggcgcgcgcacgccgggcggcctgccaagcccccgacccgactccgtccgaggcgacaacgacttccgaggccacccacgacgaggccgcgggcgcgccgctcggacccgacccctcgggcgacgttcgggacgagcccgcttcgggggacgcccccgagttcggcacgtcgatcggcgggccgagccgcgcggcgcccacaccgaggcgggtctcccctctgccttccgctgccccactgagcgcagagcccctcctgcaggccttggccgctgcgaacaccacggtgttggacgggttaagcgcccagatggaggtcctgcaggcagagcgggcgaaggtcgatgcggcgtgggcgcgcgtcgaagaggggcggcgctcagtggaagccatggtggaggcgggccgcaaggcacaccgccggcacgcctcagagctcgaggcccgtcgtagggacctggcggagatcgccagggaggtggaggaggagcgggagactgccctcatcgccaccgccgtgttcaacgcggcgcgggacgacctctgtctccaatacgggagccgggcggcggagctagagaagaagctcgacgcgtcccggcagctcgaagaggcccttgaggctcgcgccacggtgctggaggagcgcgcccgcgccctggacacgaaggagagggaactggcgggtcgcgaggccgccgtcgccatccgggaggcaacgctggcggcgcacgaggccgcctgcgccgaagaggagtccgcactccgcctccgcgaggacgagctcactgagcgggagcgagctctcgaggaggccgaggccgcggcgcagcggcgggaggagcaggcgcacctcaatctggaaggcgcccgcgccgagagggccgcactggatcagcgggccgctgaattcgaggcgcgggcgaaggagctggacgcgagagcgcgcagcgacggggcggccgcgggcgacggcgacctagccgcccgcctcgcagccgccgaacacaccatcgccgagctgcagggcacgctggactcgtccgccggggaggtcgaagccctccgcttggcgggcgaggtagggcccgacatgctccgggacgccgtctcccgtctagaccgtgccgggcggcaggcgggcctctggggcgggcggaccgcgaaatacgccgccaaccaggagggcctcgcccagcgcctctcagagatggccgggaccctccagcggctccccgaggagctcgaggagacgatcaagtcatcctcgagggacctcgcccggggggcggtggagctcgtactggcaagctaccaggccagggaccctgacttctcctcgtgggcagcgctggacgagttccctcctggaaccgaggatggcgcgcgcgcgcaggtccgggactccgccgaccacatcgtccacagcttcgagggtacggcccctcggctcgcgttcgccctcgactccgacgaggagggcggtaacggtggtgcggacgacagcgacgacgaggccggcgacctgggcgcgtcggcgtgagcccccaggcccccgccaatcttaaatagctttttctttcttcttctgaggtcttcgggcccccttcttgtatagactgatttaatctgtaatcaagtaaagaggaaatttctgcgtcagttatgtttgttgtgtgtatgagacgaggatggtctgtgccgcggtccttctgtgtcttggcttgaacgagggctcgtgcccaggtcccaacctcaagcggcacgggtcggggctagtgcctggggagatccgcgtgtcgagactggccaggccgggagcgtggtgaccgagggttatggatgacccgattgtgggcctttgccgattcccccccggagttcaccacgccccggggcacggctcggttctgggccccgtttggcaattttagccggcccgggccaccgagggcagggtcgagcacgagcgtgctaattcaagccaagattcttcaaaaggaaacgatggcacagacacaatcctcaggaaatcgaaaatgcttttattgaaatatggaagagaaaaaagataaggacatgcatgtggtagcccccggccaaccctgcacgcctgggggggcgcggggttggcccgagcccgagacctgacacccgacccccactaggggtagaagcgacgaaggtgttcgatgttccacgaattaggcagctctgtgccgtcgcccgtggccagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcgactcggagggccgcgcgccgccttcgctcttccaagtagtcgaggtcatctctacgatgctgatcttgatcagcctcgcagtacatggtggcccgaggggacctcagggtgagctcggatgggagaaccgcctccgcgccgtagacgaggaagaaaggcgtttccccggttgctcggcttggcgtggttcggttcgcccagagcaccgctggcaactcctcgatccacgagtcgccgtgcttcttgaggatgttgaaggttttggttttgaggcccttgaggatttctgcgttggcgcgctccacttggccattgcttccggggtgggcgggagaggcgaagcagagcttgatgcccatatcttcgcagtagtcaccgaagagttcactagtgaactgggtgccgttatccgtaatgatacgattaggcaccccaaaccgagcagtgatgcccctgatgaatttaagcgcggagtgcttatcgatattgatgaccgggtaagcctcgggccacttagtgaacttgtcgacagcgacatacagatactcgaacccgcccagggcccgcctaaatggacccaggatatcgagcccccagacagcaaacggccatgaaagaggtatggtctgcagggcctgggccggctgataggtttgcttggcgtggaactggcacaccctgcaccgccggaccaggtcaaccgcatcgttgagagccgtcggccaatagaaaccctggcgaaaggccttgccaaccaaggtgcgtgaggcggagtgggctccgcactcgccttcatggatatcggcaagaagctcgacgccttgttcccgaggaatgcacttcaggaggactccgttagccgcgcgccgatagagggtcccttccaccagcacgtagcgcttggagatgcgttggacgtgttcactcccttcgcggtcctcgggtagagtcttatctgtgaggtatgcctggatctcagcgatccaagcaaccaatctaagggagctgggagcgctcccctcgggtcccgaggcctggactccgacgggcctcgggggccgttcaggcgcgtccgtctcccctagggggtcgggccgcgccgacggctgggcaagcctttcttcaaaggcgcccggtggggtctgggctcgcgaggaagcgagcctcgagagttcgtcggcgactgcgttatcccgtcttggcacgtgccgaagctctatcccgtcaaaatggcgctccatacgccgcacttggcgcacgtaggcgtccatctgcgggtcagagcaccggtactccttacagacctggttaacgaccagctgggagtcgcctaacaccaggaggcggcggatccccagtccagctgccaccctgagtcccgcaaggagtccctcgtactccgccatattattggtcgcccgaaagtcgaggcgaactaggtatctgaggacgtctccgtttggcgaggtcaacgtgacccccgcaccggcgccctgaagagatagggagccgtcgaactgcatcacccagtaggcggtgtgaggcagctacgaggggcccgagttggcctcggggacggagatgggctcaggggccggggtccactctgccacaaagtcggcgagggcctggctcttgatcgcgtggcgtggttcaaagtgcaaatcgaactcagagagttcgattgcccatttcaccacccgtccagtaccctctcggttatgcaagatttggccgagggggtaagacgtaaccaccgtgacccgatgcgcctgcaaaataatggcgcaacttcctcgaagccatcagaatagcataaagcatcttctgggcctgagggtatcgggtcttagcgtcccggagggcctcgctaacgaagtagacgggccgctgcacctttcggcggggccgatcctcttcgctaggggccgcatctccagggcgctcttcgtccgagaggccgcgcggggcgcactcggcttctgtgccgacgacctcggggtcggagggcgacaggcgcggccttcccgcagtggccccggggccatcctgggggtcgggggtgcctggcaccgtcggacaagcgggcggagggccaactccggccgtcgggtgcctcgggccgccgttcgactcgggggcctctcctccctgctctctcccgggtcgagtcgacacagggtggggatgcgcggagtgagggttgtcctcgtcgcgctccaagaccaacgccgcgctgaccacctgcggggttgccgccaggtaaagtagcagcggctcatctggctccggggcgaccaggactgggggagaactgaggtacgccttcaactgagtgaaggcccgctcagcctcctccgtccagataaacggcccggagcgtttgaggagcttaaataagggtagcgccttctctcccagcctcgatatgaaccgacttagggcggccatgcagccggtgacgcattgcacatccctaagcttgctgggggggcgcatccgctctatagctcgtatcttctcggggttggcctcgatgcctcgggcagagaccaagaacccgagaagcttgcccgcaggcacaccgaacacgcacttgtcggggttcagttttatgcgggcggagcggagactttcgaaagtttccgctagatccgagagtaaggtctcttggttgcgcgtcttcacaaccaagtcatcaacataggcctcaacattacgtcctatttggctacccaaagaaattcgagtagtacgctgaaaagtaggacctgcattctttaacccgaaaggcattgtcgtataacaataagttcctatgggggtaatgaaagtagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcaccttgggaacgacgaccgggttcgccagccactccggatggataacctctcggatgaatccagcctccagaagttgcgccacctcctcgcggatgaaggcttgacgttccggggcctgccgccgcactttctgctggaccggccttgcgcccggccgcacggcgagacggtgctcaatcacctccctggggaccccgggcatgtccgccggtctccaggcgaagacgtcggcgtttgcccgcaggaaggagacgagcgcgtcttcctatttgccgtccagaagaccaccgattcgtgtggtcttggacgggccatcgcccagggcaacctccttgaccgggacctcgtcgcacgtgatcatccactgcctcggggcggctgggacggaggtgctgagcctctcattgccaccctcgggcttggacgcggcggcgaggtggtccgcgcgctgctccatacaagcaagcgcgactttgaggtcgccatggacagagatggggccaccggggcccggcatcttcatctggaggtaggcgtagtggaccgccgccatgaacttcaccaacgcgggcctccccaggaccgcgttgtagggcagactgaggtccgccacatcgaagttcacccgctccgtgcggaagttggcggatccaccgaaggtgaccgggaggtcgatatgacctagcggccaagtgtgccccggcgtcacaccgataatcggctgggacggccgaagcaccatccccggggccttgatggcgtcaaaggctgcgggggaaaggatgttgagggctgcacccccgtctatgaggacacgccccaacttcacgttgcaaacggtgggggaaaccaccatcgcgatctgtcctccccgggcaacgcacggcgggtggtcggtctggtcgaaggtgagggcaacctccgaccaccgcgcccgccgcgtcgcctcatgggtagggcccgcggccagaagctctcgcttcatggccttgaggctccgacgagaagcgtgagcgcacgctcccccatcgacggtggcgatggtggccccaggctcctggaaccctaagtcatcgtcgccatcgtcgatgtcctcggcgggggccttctgcttggcctcacttcgccggttgccggagggagccgccggggccttgccctcacggcgctcctgcctcctctcctcctcccacttcctcgtccgctcagccaaacttttgaccgcgcggcagtccgcgaggtcgtggagggaggtgttgtgcacggtgcaccacttgccggtcgggcgctccctgctgggagcgccggctcgctcgcaggcctcccctttcgggtggcccgcgaagcgccctcgacggcgaggacgtgaccctcgtcgtcggaatgggccgacctcttcttcctcctcctgtcccgccgccctgaccgagcggcggatccgggggcggccgaagctgccacaccggaaccggtggagttccaggtccaggcctcctccttgcgagccacacgatccgcgagctgaaaaagctccgcggtggtctggggctccttggaggcgatcttttcgagcatgcggttgtgccgcacgccccccctgaacgcgtagattaccgcgtgtgcagggatgcatggtatggtgttgcggacttgacagaaccgctgaatgtacgagcgaagagactcatcgtcccttcgctgtaccgcatgcaagtccgcttcttcacctgggcgcggatatgtgccttggaagttcatggtgaactgctggcacaaatcctcccaagagtggaccgacgcgggcggcaagttcattagccaaccccgcgcctgtcccttcagggccatggggaagaaattcaccatgaccctgtcgtcacccccggcggcctcgatcccggtcgtgtagacctggagaaactcggcggggttgacgcttccgtcatatttttcggtgatggtgggccggaaccttgggggccaacggacgttccgaaggctcgccacaaaggctcgacagccgacaccaccaaccgggggcacggggggctggcccccgcgcccgaaccgaagtggcgctccggacgaggaagcgccttccgttgcgtgggcagcacgacgaccattgcgccggcgcttgacactgaggcgggcatccggccccctacgcacatcttcttgggtcggaggcgttgacgagggaatggcagacgaacggcgggtaacggccgccgctcgccgcgccctccgccttgacgacacggagccggcggtagcagcgccagaggccttggtggcggaggaccgcccaccggcgcctaggcgctgctgcgccgtcatgaccaagtcggccacgtcatccagccaacgtcgggctggagtctctggatcggggacgacgggcgggtgacgcaggagcgcgcccgcagcttggagcacgccctggggcgtgctgccatcgccgtagacgaggaggcaacgctccccgtctcgccgtcgttctccatcgctcgtgggcggcgaagtcgcggatctttcgaccccctcgagcgcctcctcccgcctaagacttcggcgagaggggggcggtggagtacgagctcgtcggcacgggttctgctccccgtcgtcaccgctagcgctcggagagaggttgtgcgccactgcccgttcggccattgggctgagcgggagaagcttggcgcacacgaaagaggacgagggcttagaaaaacacacgcgccccctacctggcgcgccagatgacggagcgtggggctcctcaccgggagaccgcgcgggcccccctttgccggttcggccgggggcgctaggtgaggttctaagccctcgatctgtggaatgtttcgcgagagagcaaatgcgtaagacacggacgatgtagacaggttcgggccgctgagaagcgtaataccctactcctgtgttctggtggatctgtgtatgaaggagttacaaagagctggagagcaatagagttcaaactctagagaccctcttcctctttctctcctctacgagctcaggtgttctcccctttttttccct

SEQ ID NO: 77533 - DNA, 12109 bp, Oryza sativa
  unsure (1)..(12109): unsure at all n locations
ccttctccttagccatgcttggcttgaactgtcagcaaattaaagttagcacatctatatatcattatcagtaccataaccaattattttaggagccaaacaaattctacatgtaggtgttatccaacttgcccagacagactattgaaatgaccaattttattttcaaaagaaaaactgaacaaagtaacttggagcaatgattgaccaatgaccagcagaaatagtgcaagacaagtggatacagaaacttcaaacaattggtcagcaatgagattatcggtttaatcattgcacaaaagcacgaataatactgaagtgccataacataaagttaattatgttagttgtgattgagaacatacgagcatatgatttatcatggcaacagaaggatcaagggtaaattagcatagtgagctttcagtgcttcctcattgatatacatgtacgtaagtacataaaatgccacatggagaactaactcaattcacgaatgtacactctggtcaccagttggcatcaccgctaccataaattatttacactggagaatccaatatttttggaagtatgttctttggtgttcaggttaagaaaatgcattaaagcaacaatcattgtgcattagaacaaaaacaaataaatagcttggcatatcaactagacaattaccttatcctccttgaaatgcaagtctaaccagttgcctttggaagctttgtaaagcgtcacaataatctttgtaggcttgactaaaaccttgcatttctcaggaacaatttctttgtgcagcttaggtatggcacatcggtagttcttgcccttcacatcatggaattttgtatctactgacataggcttaaaagtagtctccaccttatcttgctcaacaccctccaggaaaacataaatctgaagatggacaaagctagattattatctcaatgctcataaagtctccacatgcaaatgccacaggatttgattaataaacagcataaactttacatatgcacttatcatattttcgtcatcttcactagccctaaatgaagctaatgatccacaagatactgactgacatctcattaagtaaagcaggatacatcacattattgtgcttccaagtttaacaacagagaatttcctcctcatcaatcactattaatacatgaaaaccatgaaacacaatatggtcaagaattattatgcctacaaaatatcatattattgtacttgccagaaatatatttgatatacgacataaattgaatttaagctcaattgaacggagcataggaaaatagtttttgctaacatgaaattcttaaagtttttttaaaaaaatatataattgcaccttagcgttagcatgggcatattactagacactattaatatatgagagccatgaactaatgtctacgtaacacaaaatgaccaaaacaatcctaaggtcttgttcggttaatccctctttcaagaggattgaaggggatttgatggggaataattccagacctattgagatgtggaattaacctcgttcaaatccttccaatccctttctcctaggattaacgaaacaagccctaaaaatagaagaattacggaagtttgtatcactgagttttctcgtagttgataacatggcaagcatatgctcacctatatagtttaacaatcttattcaaggtacatataaacaaaacactaagaagttttacgttttttatttcacttcataaaatcaaatcatcattaaacatccaagatcgtcgatctcttctgtatttgcaattctgcatacagaatacttatatcgtttcactatcctctactcccttcgtcccaaaaaaaggcagaccctaagtttccgtaccaacgtttgactatccgtcttatatgaattttttttataattaatattttcattgttgttagatgataaaatatgattaatactttatgcgtgacttatattttttatgcgtgacttatatttttaattttgttcataattttttcgaaaaagacggacagccaagcgttggacacggaaaccaaggtttgtcttttttttgggacggagagagtactagtcaatgcaatcattctgctaattgattccacatatacaacaggaatccctaatcaaacattgcaacttctaacatatcaaatgtcccgcaaatttacaagagcttaaattccaacattaactagatcatactagcaatcacaaccatcgatccatcattgttaagcatatgccaaccatcgaacgagcaaaatgtttcattctccaaagcaacatacctttatcttctcagcatcctgatcccagctgaacgaccccaacgtcacgtagctcaccccagcagcagcagcaggtgccggtgccgccgccgccgccactacaggtggcgatcccgccgcgacggcctgcggtgcctgcggctcggtcgctttcgccagctatccgcacacaaagacaaacgtcaggaattccgaatccatacgcaccacccaagccccgaaacgaatcggcgaagaagatcgcgagagtgaaaaaaaaaagaaagaaaaaaggaaatgaaacaaccttggcatcgacggcgcggatctcgttggcgagggcggagaggacgcggggccgcttggcgaggccctccagccgccgcagctcctccaggtccagccgcagctcgtccgccgacatctctggaagcttagctttcctctctcctctctctctctctccgtcgcctctcgtgtctttccggtggtgggatatgaagggtttaggtcggaagtggaagggaggagaacgttctagaggaatggagatgcagcgacgattccgtggaggcgtcgagaacgaggggcgggccggcggcccgaaccgttgggcctcacccgagtcatgcccaggagagaagatattgagccttgaaaatccggcccatcaaattgaaactgttttgggggttatttttctcgcttttccaaattttcatggtccgttcaaaattcaaattcctgatctactactacttcaggaattttcagaggccgttcgctgtatggatggatggcatcttcacttgcttttaacggtgaccaattgcaaccactacaccaatagtcttccagtacgagtgtgtaggacgcgcaatgcacactcgcccctacatgtcgcgaacacgtaccggctcgctagctagcgacctagcgtgcaaattaatgttgggctccagcaagaagaagcaaaggaagatgcaaatgccatccatctgtacgtgccgtcgtggcgacgcagccgacccccaacaccgcgcgatccacagttcagcacttgaatgttgcggccttgcatgatatgcggagcaacagactaaagggtgtgtttggttcacggttaaggctggatgggatatgacgatccatattttgttggatatggcgatccagtttttttggttgagagaatatagtgatctagttttttgtttggttgtagggataaagatggatttggtaatccaattttttgtttgattggagggagtaggatgaatttgtaggtgtggtcacttctcacttgagatggtgagtataacccccatcaaattaatacacaatacaaatcataaaatttccacaaattttcacttctatctccattataaatacacatagaaaaaaaaagagggaaaaaagccggctagatctgggcctctcgggggctcgccgccgccgccgcctcctcctcagctttcttggccgcctccgcggcttcaccaacctgcttcttgagctcggcattgtcggccgtgagtatggcgacctccatgtccttcgccatcagcttggcctttagttccgcgacctccgggttctccttctcgccggagtcaatggccgttgcgtcaatgctctcctcttcgatcatcttctttgtctcttcctcctccagttccttctcagccaaagcggcctttatgccacagctcacctcctcgccgtcctcggcgccggccgcgctctggttctccttatcccccgattcggtccggacgacctcgaacacatccgtcgcgggggagtttatgctgctctcctcctcggccggcggctccgtcaccttcagctgctgctcagtcttcttgggggtttcgaccgcaaccggagatggggagcgcggagacgccgcggcggcggaagcggggctccccttggtgccaacgcgcttcttagcctcctcgagcgcgacctgcgcgtccttcttggcggcctcggcggtggcgagctgctcccgcagcttcttgagctcgtcctgcaccttgcccagcttcgtctccagctcagccacccgcgtccccgcgcgcttcttctgtaaacccaccaataaccgccaaaagcgattgagccgctgctccttggcctcaccgggaaaactgaaaacggaaggagaagcttcgcagcttattacttacctcatgcagcgggctgcgcggcgagtggcggtcggcgagcttggggctgctccggtcgacgactgtacggtggtgcgcgccattcgcatccgagcaggccgtcgtcttgaggtgcagcggcgcccgcggcgacgctcgctgcggcagctcggaccccctgcaatcatcaaccgcgtcagaaatgggaacacctcgacggggaaaccacctcgctatcgcaggtcacgcacctggatctcggcatgctccgccgcgagctagctaagccggcagccggcgctggttgctctgtccgtccgcccggccgcccctggtctctatcctctcgccgcgtccgtcggtcgcggcctacgatgagagcaaacgcggggaagactggctcatggaaaatgcaggcgaatgtggcgctgcgcaggtagcggcgaaaagaaaaggagccctcgtgcaagggaaaacggaattgtttgcgtattaataaatcgtggcaccgcctcccacgaggccaccgcaccggtgatttcaaatttgaacgcagctggaacgccttgggaacgccacgccacgcaccgcacacccagccgaacgttacgtgggtctctctggttttctggttggtggcgcaccggctgcacgggcgttaatgcgcggggtgacgcgcagagccggacctggaagagccgtgggacgacgcggggcgagcggtagcctgtgcgcggagccggcgccgtcgccggggttgtgagccacacccacatgggtcatggcgggtggccaacttgcaggcactgaccgtctcggcagagggcaggatgacgagccagccggcgttgatcggctcagggatcgctgccgctgctgctcgaaaagcgcatcgcttgtacgggtacgtgacagggagatgctttggctttgcgtgaccgtttggctgcttgccaagggggggggggggggngggggggacagtgcaagccaacanctcntggacaaacggggctgtaccccaaaaggacaagcgggggctggaggtcaaggacaaacaattgaaatcgtagtacagtctacaagagggggggggggggtttcattttcatcgtgacggggttaatacacgtagtagtagtaacagctacgacaagtgaggcgtactccacttttgaagcaatcaggcggcaatcacagggctctgatntgctttgcctttgcatgcaccattagtaagctcacatgcttcaggccctctccactacactcgctttcgaggtggtttgtactgaacttttgagctctactaactacagtagtttactgtgtgtgcttctgatgattgttgaatgtcccctatcaactttatctcacatgtagcttttctgcaatcctttctttttacaattctccaacgaatactactccctccggttccatattaattgatgttttggacaagattgagatcaaatttttataactttgaccatcaataactttaaaaatatttagtttaaagaaactagaacaacatatatagatttgtcttttatagcactataataaaagtaaacatgcatttatttatctattatataattaaagaaaaaaaaaaggagcatccacgttcgctgtcatggcctagaaattctcacattaatcggagaaaaagaaaaaaacaaagtccatatagaaatacaatttagaaatagctgaaattcggaattaaaaaataagaaatattagaagaggtgactagagtccatatagaaatacactttagaaatagctgaaattcggaattaaaaaataaggaatattagaagaggagactagagtccatatagaaatacaatttagaaatagctgaaattcggaattaaaaaacaaggaatattataagaggagactagagtccatatagaaatacaatttagaaatagctgaaacttggaattaaaaataaagaatattagaagtagagtatagagtccatatataaatacaattaggaaataaccgaaattcggaattaaaaataagaaatattagaagtagagtatagagtccatatagaaatacaattaagaaaaaatagaaatttggaattaaaaaataaggaatattagaagtatagtatagagttcatattggaatttaataccaactaaaattcgaaataaaaaggagcctccacgttcgctctcatggcctagaaattcttacattaatcagagaaaaagaaaaaacagagtccatacagaaatacaatttataaatagctaaaattcagaattaaaaaataaggaatattagaatatgagagtagagtagttattacacatagtagttttgaaaagttattgcaaaatttaaaattatgttgtcattgtaatatattttataataatataatgagaaaacatatatgctattatatgagagaaaatataattatgctagccgcgcaatctgcgcgagccaccatgctagttatatatattatagtagaaaaataaagtcaaacatatatcttgtaggccatatcattgtccaaaacgtcaattaaaatggaaccggagggagtacagttctagggaaaccgacaagaaagagaaaagggcaatgctagaattgccgcaggacaactagtaatggacacaaatgaaggaatttggatggctcaagccgcacaagcgaatgggcagcaattgggaaatcaatgtactaggccggaccgccattgctcgcaaggaaggttgtcgacgcgcaatcggcaataggtatggtatttatagactaataatctataaactggagtagtttttaagtaggctgcgagggaagttgaattgctagtgtagaaatatcgggcacgcacaaaaagtcgtcaagagaaatcagatgcccgaattgatcgatcgatgcggcagaagatagatctcgtggcaaagtcagatggagcagctgaacgaatgctacttcatacctagctaactgatgtgcgcgatgttaccagcatatctatagcttattagggcatgttaaatgcgtgaccctagagagagtatccctagcgatggccgtttgcttttccgtccacgtcgtccccccacgatggaacgcggctctctctgcgcctcgccaacttttttgtggggagtcgcagccaggcgccgcgttgagcgcatgtggagctcgtgggcatggcgtcgttcccccaagtttccccttgcaccctcgcctcactctcgctctctcctcagtcttgtcgcaccgcgcctccttctccgcttcgtgcgtccgccggcgctggggtcagaacgaggagctgcggggcggaggggttggcgccacgcccgacaccgttggcatcgccaccatttccatcccgatctagccgcgggagggccaaatccgctagcgttggcaccggatttgccgcccccggccggcgacggcgcgaggcggaggaggccggggaggatgacaacgatagagagaggcagagagagcggtggagctagtccgccgtcagtcaaccgccgttcgttgtcggccaccccgcgtgccgcttgccgtccgccaccgcacccggcaccggcgaggtggacggcaacgagctgcggggaagagagggggagatcgacgacgaacggtggcaggagagagagagagagggcgtggaagaggcagacggatctggtgaagcgggatctggtgaagcgcggttaggtggacggcgacgagcggcggtgggccaacgacagcgtggaggagagagggagaaatcggcggagtggaggagaggagacgagaagagacgaggagaggggaggaagaaaagaggagcgcgttggtgggcagggaggggtactttcggaattttgtacttggggctaccttggactagacacccattgtgggctgaagtatcttcgtcaaatggcctcagattttaaagaacccattaggagtatccttcattgggaggtgagtttcctatagagtgtcctcggttagtgaggacactttaatggtggttttgattgtacatgcccttatgcttactctgagctggtgttggaatacgtctcctatgcaaacgagcatatcttgtacatgataacacgaaggtcttccgagttttagaaactcagagggtgtttgagccatctctccaaaaaaaataagtccctagcctccctcccaaacactctcagatagcagtatctcgaaaggcaaacatgactatttttactgtaaaaggttccttttttctcaacagccaagactaaattccaacaggctgcaaaatatggatgctctagtaggagtaaataaaagatggacaacgtcatacacgtacatgatgtactgaagtcaagagatcgatccatatcttgtggccggctgcgacatcacctgctcacctacatgcgcatagatccaagcggaaataccataaatgatcacgacaggtcacacacctactccaacttggaacacatataacacgaagtatgggcgacgagatcgatcacacaaaggaaacaagacgcgcactgcacacatgaatgatcaggtcatcaggacatccgctcccccacacaactacgactgtgttttcagcgcaaagtttaaattttggttaaaattggagatgatgtgactgaaaaattgtgtgtgtatgacaggttgatgtgatgaaaaaggactatagtttagattcaaaatctaaacacagcctacacaagcgagtactaccatataccctggaccggaagtagagtaccaagaaaaaacaacgcgtatgtatgtgcaaggacgcataaactgtggggcttgaggacaaacgagaaagagggggggaagggtgaggaggagataaaggtgccaaaaaaagctctcttgttggaatgcacgtcaagccatggaacatggcgaggcacggcgagatcagtgagataatgagatgtccatggaaggtcgtgtgcgtggcgtggatgcttgcgctcatgtgcggtttggttcctttgctgtcactacagcggtcttctcgttcctagtttctgctgctgcttctttcgtctcgaggaaactaaactattccattggaattggcttgttccatttgcaggtgatcgaaaacgcatggaagggctgcagctgcactgcctcgcggaaggcaaggcgcatggtgtaggcaggggtcgcctgcgcgagctttgtggaaggctgtgactgagtgagagcaatttggttataatccctccagttaacaatatttgagttgggagtatcaagtttagccacgtcaattattatcgaatagagagagcgacagagaggagggccttaataagatttattttccggatcttcatggtttgaaagttgaaatatcaatggcatcatgatctaaggttgtattccttggtgccagttaggagtcttggaaaataaattaatataaatttttaagcaactttcttaaagaaacttttgaaaaaaaaacacacaatttagtagtttgaaaaatgtgcacacgaaaaacgaggattgggaacaaggggtgccgaatatagcctaagtcggttgaaaacgttctgcatcgtatatatcttgttgggccaattgatatttataaattttcagactatccatctacccattgataaattaatagatacaccctctaaaaataatacgacttttcanacatccaaacatctgatagctgcaagattcatggacacccataaaccctagttccacccccctctcnttcctngttcccttctcactccaagcaccgtcatgcgcgataccagacaccatcgcgacgcttgagcgctcggtcccgaaaccaccgtcgcctgcctagcctccctagttggtaaaaagacaccaatatcctcccgactcgcctcttcccgatctcctcttgagtcgacggtagtgaggtgccccgcctcactgtcttccccgtctcttattgctccccactaccagatccaccaccaccagccgcctcatcctaactagtcactctgttttgcccccaccatcctcctccatcgcgatagctccatcgatgcatcgcctcactactcgccctagtccaacgtccactgccagtcctccgttgcccacggctatccctctaagccacaaggaaacccctatcttcccccttcctctgccctttcctatttaaccctccaatcccaaaaccccaagtgactgaggttactgccgtcccgtggaagctaccatgacttgtcggagttgaggagaaggagaccaacatgaattatatttttgcgtaaatttaatggtccaaattcgatagaaatactcccctcctaaaaaaagaaaaaaaatcttttgcaaaaaggttaacaattcggcaaaatttaatatggccaaacaaatgtattcagtttcatccattttcatggctaaaattgcaaggaaccagtttcctacgttagagggacgtttaactcacgatctccatcgcttgtgcaccggacaactccagtccgtcctttgtccttcggcccagaaatgcaaagtccagcatgctcgttccgcctatgctccactggggctcgtggcacaaggaagctccagccctcggagctgccactcgacccgtcgtcgtctagccggggtatgcggtgctgccgccggcgagggcggattcctcttgacctcgattttgctgccaaccctaatgttttgatagggcggcactttgaaaattttagtaaggcctggtttagtttctaactttttcttcaaacttctaactttttcatcacatcaaaatttttctacacatacaaatttttaattttttcgtcacatcgtttcaatttcaatcaaacttctaattttaatgtgaactaaacacattctaaggtaggaaaataaaacaagcctttaatttgtttagtctgatgtgcagctaagcaaacattggccctgtttagttccaaagtttttttttccaaacttctaattttctatcacatcaaatctttcatatatacaacttttctatcacatcgtaccaattttaactaaacttccaaactttagtgttaactaacacaaccaaagtaaagtaatgcttgcaaatctgcaatgctgcgcctgccaggccttgctcaacgtaaattggtcagcacgaaactgtcgaagtcctcactcctcagcacctaaatgcaaattgaggagtaatctaataattggaatgcgttagttcagaataataattggagtcagtagtaccaatcaaacgctaggatattacactgtcagtgcaaacatttccacgtggttctcgtactatgacacagaattgcgaaaaacaaatgcactggctgctctgcactttacagaataaaggtaaagctggcgatggcattggaacaggaactaaacagtgggtaaattatgtatcggtagcaaggcacagtggcgccacacagcctcaccgagggctacatggaaacgggttgcctcaagctgtaaaggcctctgacagacggggtcccgtctcccgacccatcccgttcgtttttgcacgctgcagcaagcggccaagcaga

SEQ ID NO: 77534 - DNA, 1426 bp, Oryza sativa
attgggggcactggttagtggcttgctgctcgcaacgcgtgttggggcggtggggtttggttgaaggaaggaaagggattagggttgatgggaaatagggtgttgagtttttatatgtcaatttgaaatgggcttgctggacttgtattgttgcaatgggctatttttaaagaggtaactcacatctggggtcacttcgggtcacccacgggtttacttccgatcctcgccctggcccggaaatttacgggccccgtccccactcacccgtgggtgagaattctcccccggccctggccccgtaggggcggctccccagccccaacaggaaaaatgccacccctatgtatccgctttgaccaaaccatatgttagagtggccacctcccccttaaactttaactacagcatctggactagtatagtcccaagcgtattatggttattttgtaaattctctcgttgagttggcaaaaacaataaaatattgtaggcggggccttaaaaaagtaacaaaaaatcacatttttaaatgcctatgagcgacgaggccacgttttttcctctccaacaaagaccgtatttttggaatatcttctgataaattttttaatttatgtaaattagtatgcaatgcaactatacaattttctaaaggtggaaaacaactaactacatgcatagcatatgttggacatgttcgactgacctatacaattctcactgccaccttattgctagctgctacaaaaagtgaattggtgcagacaacggggtaacactatactacctccgtcaggttataagactttctagcattgcccaaattcatattcattaacatatatatgaatgtgagcaatgctagaaagtcttataatatgaaacggatgaagtattagatagccgaacaagtccactacccatatataaactagtatagaggaagtagtagactacttgaacataaaagccatgttcagccggaggacccaaagttgccgatggaccacaacattgtactttgatttcatgattaattttaggccggtcattgctcgtgtccttgttctacgcctacgttagctgtctaaaaaacctacactgccaacgatttttaaagaattaatcaactccatgtataatttgtgaattgtgggcaggtttgcatcgctggtccagcagctttgaacacaagcacggagacgcaattctggcatcctgcggggaggaaaatgcagcggcggtgcagtactctccccggatccgcatccagatcctcccccgatctcgatggcatctggacaaaactcccgcgggccccaccaactgatgccggccccaccaactgatctcccactgtgtaccagtcgctgtgcccgctagctcccccagtctccggggagaccgaccgtgcgagatcgcg

SEQ ID NO: 77535 - DNA, 21887 bp, Oryza sativa
  unsure (1)..(21887): unsure at all n locations
aaactcaccgtagccggcttgctcctggaagaactcatcgtcagcgggatccgcttcatcttcttcagcaacttgggggggattatttatatagagcaagggtgagtacgggagtactcagcaagccatgggaaataagtgtttaatgcagacttcaaagaaaggccgttgtttttgcgattgattttatttaaactcttttctgaaacaactaagggagtgcttctcaaacgacacggatgagacagtgcgtctcgtccggtcggagtatatgcaatgtatcagtcttttgaattgatcaagattggcacccggccaacagctttcaaacggccacccgggcctggctgatcccatcagccgcagattttccaaacatcaaacccattccacaacagcaaatttcacaaggcagtagtcaaacaaaactacgctagaaatcacctcacatccgcccatgaccgtgggcacggttgttcgaacagttttaataacctctgcagagggggtacactttacccacacgacattactaacccggatcatccagctcgtggggatcagccacgtcgggagacctccaagctttcatgacaaggcatttccaaagccgacacatgtttaccatatgctgacgagaggggtcccagaccaacaacaggttaggtcccagaccatactgtgccaggaagcccaggggtcctccccgacaccaccccggcgaatccacttgtctctcagcatcaaggctcccctgattagctaattactcagccaggggtgtcccattccacccatgtggtcgtacttgtcttatgttcggatgaaattccaaggaaacggtccttaagtgcaagagcgggaaactgtacacccggtacgttccccggtcctcagttttggaaattcatttagttcgcaagcaccgacccaagtgtcgggttttccaagtcttttgtaaaacccaagttttacccaagatgtttctcagattttaagtttgaaggcgaccgttgatacccgtgcagagagcacgattaccgaggcacaactaggtgggtacaagggaacatggtataacaattacaatggaagggtcaaatgcaacaaattaggtaggtccgccaatctgccttgcaaacgggacaagcagattaagtgcgatcctatcaatgcataatatttttcaagcaacataattaagtttaaatataggctcaagttgttcaaaggtggcttgcctcgctcgagatcttgagcttgatcctcgaaatcctcgcactgcgggtcttcgggctccgaaactacacgcgaaacgggacaactcagcaaacggcgaaaataaagccctattatcgacctctaagcgtgccattagatagatctcgagatttgaggaattttggaagttgaacggagtcaaacggacttacggttgggaagatattgaatttctaagattattggatttttggtctaaaggaaaaggatttatttaaatcctttttgaaaaagaaaagaaaagaaaagaaggagggagggaaattagacttccctcgggcggctagggcgcggcccgagaaaaaaggggcggctcggccgagcttaatgggccggccagcccaagaaggcggcccaaggcgcgcgcgcgagcggggaggggagagagagccggtgggccgggtccatcccgcgtggtcccgggtgggacccgcttgtcggcgactcggctcaccgtgagcgaggtgcacgcggggcgtgctagggtttgggaagggaggcgcggcgcatgcgcgcggttcgcggaggacgcggtgcggcgggcccacgcgcagcctcacggctcgcggtggtccgcgcgcgcgagggggcggagggaagcggcggaccggggtttgcttgacccggtcgcggccgaggtggcgcctacgtggctgccacgcgggccggcgggaggtagatgacgacgccagccggaacggacggcggacgacagcggcgagcggcggagcgaaccatggcgatacaggcgaaggcgagcacactgggatgttgcacaggacgaggggagacgagccaatggctcggattcgccgggggatgctcgacggcggcggattgcggcggcggcaaccgacggcgggagaagggggaaacggcgatgaggtcacgaggggccgattcccggcggtgagagcatctacgcggctacgggaatccgttgctagcgtcggattgggcggagcgacgccgagcgaggccggcgacgagcgggcgctacggagcacgggcggcgacggcggcgagcacacagcgagcggcggcaacggtcggggcggcgccagctagctacgggaaggctacacatgctactaccgaaaactaaggggaggagatggatcgaggagggagaacgggggaatgcactaccgagatgaggcggggcgctgtgacgagaggccgacggcacgggagtgatctctccggcctcgggccggggaagaggaagtaggcgagcgcccggagtccccttccgtgtcctcgctcgtgccggctcctccgacacgtgcgacggcgaacggcgacagcgaacagagcacgggaggcggcgacaatggagtggaggcgaatgggagagcaaaggaaaggggggaagcttgggtttatattggcgacaatgtcggtttggtagaggggaaccaactttgaacggtcaagccagcgagctggcgctccggctagcagccaaatcggcgacagggaggaggggaatgacgccggcggaggaagaaaaaggaaaaggaaggaagaaagggggcttgccccttgccactttgggaaaaggaggagctctgcctccgtcccttggaggctagcgcgcggaggtggcggggccgggtcgatgacgacggcgatgacggcggaccggtttggagtggagcggcgacacgggcggcagacgcggggcaggcgcggcaggcgctgacggcggcggcgactggccggtcggccaccacggtgcgcacgcgcgcgggcggcgcggcgatttgggcggcatcggcgggaacggcagcgagagcggagagggaggagggctcggcgcggctcacgggcagagcggggggagagagagagagagagccggggagggagggggagatgggccgagagggattcggcccatcgaacccgagggaggcaaaatagacttttgcggagggatttgatttgggaaggatttgtattcgtgattgaactcgacgatagatcggggatttgagatctgagatggcacggacactagacaacaagcaaagaaacagatttcgcaactagggttattaagagatagttttctcgctaggcgccacgacggaacgggcgctacaccaagcaacgcagatggatgcattagtggcagcgggctgaggggaatatcggcggcaatgaggacgagaaaagaggacgaggggaacgaaccgctcacgcgataaattatcggagcggcaattctgtttcttttttccttttttctttcttttctctaaccactcacgctcacgcggataaggacggaggcagcgagctgacgggaatcaccccagcgaagaaacgacgctcttttttttttcttttttcttttctcttttttttattttttttcttttctcttactgcttacagtataattgtgacatatgaacattagattaattcgtggattagtacttttcagaaaaatcttttgttacggcatgtttgcgtgtataagaatacttctaattgactaattcaaatgttaatatgatattttatatgatagtatagagataactcacctaactaaataaaaggtgcttatacacaccgtttctcttatgaaagtaactaaataaaatggtatattagctagactaaataaatacaagcaaccaaataaaggaggcatgcgtatcctcttggccatatcaaactcaggctaataaatacaagcaaccaaacaaaggaggcatgcgtatcctcttagccatgttaaactcgggttgtataagggagataagccaggctaaggagatatgagctaccaaacacacgggaaggacggggtagcttttgttgatgatgctgatggttcttcattcaaggatgttctggtcgagtactgcttgaagaacttctattccaccatactttaaaaaacatattttttcaactgtcacgttttattttgtttgtcggctacgtggaccacgttgaatcgcgcgattgagtcatccaacgcattaaatcgcttcggtaaggaccccgaaagttagaaggaattaacccgccttgctatccacttaccaattcgatccaatcgttcaccatgcacacacctgctccacccttatcccttattcgtttctcccatctctcagtcgatgatgggtaggtactggcacctgctggtcccctccctcgatcacctatccgtcgtttacgcgtgacacgatcggtctgcacgtgatttcgcgtacagttttagaaatgctacacaatacttgagaaagggcgagtattatgagaatatgagtatatcaatatgcaatagtagtttttatccgattgatattctgatcaatacttagcctaataaataatttatttgtcttttatccatagctctgtagcgaagcacgagcattttgctagtatatataaaaaaacagagtaaagaaatcgtaagcatatcattgacataaattaaatatataattttgggggccctaattatatttttaaggatcttgtacggtggcacatcttaaacgtagggacagtcctctgtacgaaaacaaggctaaattaaatacgcgcgcgaaccgggactcctctctcaaatcccgctaaaactactatcaaattgttgcagatcgaggatggtttgaactatggacttccttacagagatggaaaaaatttgtgtgctccgcatatatacactaatacacacatcgatcaacatcaagtggcgcacgtacgtagctagccttccaaagaccatgcaaacttctccactcaggctccacccctccactcgggcatgggtcgcatgcagttgccgtcacgaggctagctgcacgcgccttcgacgacacaacgtacgggtatttctttttccgtgtagtgtctcctcgagaaacgtagaggcagccgtccacgcgtttaattagaacggagtcaaacactagttagacctgtactccatgcggtacactgcatgcacgctgtccgattacgtgttccacggatcggatccgttgttctcttgaaccgcggataaaacaatggtgcgagcaccgcatttctgcagtgaagaaacccccttttcctctgcatgcagtcaagagatgatccgggctactagcttttttctcagatattgttacatgcacgttacatgccttcaaccacagcctcgtagtacaatgttgcttcactcttgtttacgatagtacaccgctaaggatcagggtgtctggaaaaacaaagaaaatatcttacagcgtttctttacgatgaaagcaagaatgaaatgatgaatagtgaatgatttctgataattattcgaaagtaatttatactatatatgaagttctttctttagaaaaacaccatttagaaactggggaggcatttgccactataccattctcatataatgaataggcactactaaaatacctacttaggtgcctgttggaaaccccacatggataccggattccccgaccggcaccgatgaggtgcatggtttgaaaaaaaaaaactggattagcttgatttgaacaaatgcttcgagcccaaatatttcccaaatttttcttcatcaaacacattattattatcaacatcacaaatcacaaaatgaatcataaatttttggcataatgcaataatactcaaattagaatacatctgctacccaatacctaactatccattgcagcatcaaagggaaaaacaacatccccaaatccttaacagataagagaaccgaataaactaaagatccccaaatcctcaagatcagccgtcgcttgttgttggttgttgcctccatcatcgtggtcccatccgctatagtccggatctagccttaattaagcttgcatcagcgctcgactgggagaaggagacggggagcttgtggcagcagatttccctgccctcgagcttgtggcgacggatcagctggcatgaggaagtgaggaggaggaggcgatgctgactgcggatgcgagaagtggttgtagtggtggatgcgaggagtggtttgaggcggcagtggatgcgatgaggagggaggacgcgtccgggacgacgctatgtgaggtagagagacgaggcggattatgtgatcgagtcacgcgtggatgcaatcgagtctcgtgttaaaaaagtagggcagctggctgtctggtgggctcgactccctctaagagatcgattttttaataaatcgacaccaatgtcctacatatgagtgagcttttttgtcacgcctcgaactagtctcgaccggaactagcccgtgacgctccaaattaacctgttaatcgataccagtcccaggaaacagtgctggtatcacagagagacagagtatcacagcaacagaggtctctttattatagagtagaagtacagtcatgttgggctgcggacagatcccgagctcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccacttcatcttcttcagcaactgggggggattatttatatagagcaagggtgagtacgggagtactcagcaagccaggggaaataagtgtttaatgcaggcttcaaggaaaggctgttgttttcgcaatttattttatttgaactctttttctaaaacaactaggtgagtgcttctcaaacgacacggatgagacagtgcgtctcgtccggtcggagtatgtgcaatgtatcagtctttagaattgaaacaaggttggcacccggccaacagcttttcaaacggccacccgggccaacaacttttcaaacggccatccgggcctagctgatcccgtcagctgctgatttttcaaacatcgaaccaattttcacaacagcaatttcacaagcagtagtcaaacaaaactacgctaggaatcacctcacatccacccatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccgacacaggtttaccatatgccgacaagaggggtcctagaccaacaacaggttaggtcccagaccttactgtgccaggaagcccaggggtcctccccgataccaccccggtgaatccacatgtctctcggcatcaaggctcccctgataagctagttactcagccaggggtgtcccattccacccatgtggtcgtacttgtcttatgttcggatgaaattctaaggaaacggtccttaagtgcaagagcggggaaaactgtacacccggtacgttccccggtccgcggttttggaaattcatttagttcgcaagcaccgacccaggtgtcgggttttccaagtcttttgtaaaactccagttttacccaagtggttactcagattttaagtttgaaggcgaccgtcgatactcgcacagagtgcacgaatatcgaggcgcaactgggtggttacaaggggacatggtatagcaattaacaatggaaggatcaaatgcaacaagtcaggtaggtccgccaatctgccttgcagatgggacaaaagattaagtgcgatcctatcaatgcataatattttgcaagcaatataattaaatttcaaatataggctcaagatgttcaaaggtggcttgccttgctcgagatctggagcttgatcctcgaaatcctcgcactgcgggtcttcgggctctgaaactatacgcgaaacggaacaactcaacaaacgacgaaaataaagccctattaatgacctctaagcgcgccattagatagatctcgagatttggggaattttggaagttgaacggagtcaaacggatttacggttgggaagatattgaatttctacgatcattgaatttttgatctaaaggaaaaggatttaattaaattctttttggaaaagaaaaagaaaagaagggagggagggaatatagacttttctcggacggctaaggcgcggcccaagagaaatggagcggtccggccgagctaaatgggccggccggcccaaggcggcccaaactcgcgcgcgcgcggaagggaggagagagagagccggtggaccgggctcaccacgcgcggtcccgggtgggacccgcttgtcagcggctcggctcaccgtgcggagggagtacgtggcttatgcgcgcgggcgggggagggacgcggtgcacgcgcgcggctcgcggtggacgcggatgcggcgggcccacgcgcagcctcccggctcgcggtggaacgcgcgcacggggagggactgaccggggtcggctcgacccggtctaggctgagctggcgccgacgtggcgcctacgtggcggccacgtgggctggcgggaggtagacgacgacccagccgcgaatggacgacgggcggcggcggcgagcggcggagcgaaccacggtgatacgggcaaaagcgagcacaccgggtggttgcacgtgatgagggaagacgagccaacggctcggattcgccggagggagcttgacggcggcgaatcgcggcggcgacaaccggcggggagggaagagggaaacggcggcgaggccacgaggggtcgattcccggcggtgagagcatctacgcggcttcgggaactcgacgctagcgtcggattgggcggaactacgccgagcgaggccggcgacaagcgggtgctacggagctcgggcggcgacggcggcgagcacacggcgagcgacggcaacggtcggggcggcgtcggctaactacggggagtctactcaagctactaccgaaagctagggggaggagatggagcgaggaggaagaacggagggaggcactaccgtgatgaggaggggcgctgtgacgagaggccggcggcgcgggagtaatctctccggcctcgggccggggaagaggaaggagagggcgcggccgaagtccccttccgcgtcctcgaacgcaccggctctcccggcgcttggcgaaggacggcggaggcgagacagagcacgggggcggcggcaacggtgaggaggcgaatgggagaggaagggaaagggggaggcttgggtttataggatggcaatgtcggtttgggaaccgacttagggcggtcaagggcgcgagctggcgctcggcggtcgcggccaaagcggcgacagggaggatgacgccggcgaggaggaaaaaggggaaaaggagggggagaaagggggcttgcccctttgccgattcgggaaaaagggggaggggagcgggggcgacgcggcagagagaggaggggcgcggcctccttcccttggcggcttgcgcgcggagtggcgggggccgggcggtgacgacggcgatgacggcgggcggtttggagcggagcggcgacactggcgacaggcgcggcagacgctgacgacggcggcgaccgggcggtcggccactcggcgcgcgcgcgcgggaaacaacgggcggcgtccgcgcgggcgcgcgcacgcgaacacggcgcgcgggaagcgtctttgcgagcggggagctcgcgcgaggggaggggcgctcggcgcgggcgactcccgcgcacgcgcgcgcggtgcgcgggcggggcgggagggggagcggggagagaggcgctcggggcggctctcgcacgcgcgagcagcgtgcgggcggggaagagagagagagagagaaagagagcgggagagcgcccggggggagagggagagaggggccggggaagaggggaagatgggccgaacctcgggggaggcaaaatagacttttgcggaggaatgtgattttggattcggaaatgaactcgacgatagatcggggattgagatcttgagatggcacggacactagacaacaagcaaagaaacaaatttcgcaattagggtttttaagagaaaattttcccgctaggcgccacgacnnnnnnnnnnnnnnnnnnnntttatagaaaaggcacaaatatcgttggtgccgatttttttttaaaaaaaaggtacttacaaggggggttataggtgtcggttctctcaaataaccactcgcaggcacgcgttcaggtgtcggttatagacttttcggcacctatagtatcgtctcttttttagtcaatatagtactgatgacgagtggctccgctattgacatatgtatatctattattgaacggattgtttcagtagattatctacttattaaagaaataaatattttgagaattaacagacatgttagaataagagtggtttaagcaatacaatactataaaattatttaagcaaacatgtttttaacccatgaatatcacaataatactaattcggtaaagtagttaaaataaactcgaggtgtacccgaatcacgagggcagttaaacgaaggtgtccagctgattgttgagtctcatgaacacatgagatcgcacaaggcccaagaactccacgtcaggagaagttagtgatgcaatatactgtacacaccgtggtttcctggccaactgatctctgtcccccctgtggtcagatctagtcattcgaaatggaatatggtcaacgacagttccccggcctgtaccactggaatctcgaacgaaggcagtttggggattactttgcatggaatgtctggttgtactacatgtgtgcgtgctagacatgcatttctggcaggtgtgcaatggaggagtacaataatggaggctataatgtaattatgtaatgtgtgaacgtatcaacttcaaggaacataccgtagccaactttataatccaaaaggcagtactagcagatgtgttttataatccaaaaggctgtcccatagagcgtgagaaaaaggcctagttgcttcagcggcattgactaggggcgaccttttttttttatgagatcgaagtgtccaactggcctgccggcaggcaggccgccaccgttgatcgccgcgaaaaaggcaggattagattaacaaaggttacgtgtggcacggatgtcagccgcgagcccgcggcgccgctcatgatcgatctgtgcggctttgcttttctatgtgccgaatcagcgggattatgcagaaatcgttcacgagcctctctgcatctgcatggacgtgaacgcccccgtgactgatgaaccgatccgatcgtttattattgaagtccaccgttccctcagcaaagtcagcattgcttccctcttcccgatgccattgccaccctagcataggtgaccctcgcggccctcatgctgagaccgcgagacggtgagcacaacaatggtacggtcgtctcggtctgtcaatatataatcagcagtcaattaatttacttacttcgaaagaaagctttgcctgctcctctttatctcttccataggtttcacccccatcgtttatccacggggagaaccggagaagagagcaatggcggcaatgcttaattatctgctggagtaagagattaaagcaggctctagcacgagggaaaaccctttaaaaagacagacaaggcagacgacgcatatgcatgcatggtgacctaactaagcaagcacggacggtaatggtatggtggagtgtgaagtgcggactaataaagcacgtatgatgtgaggtttggagtagaaaatgaagtggatcgatcggacctgagcacaaatcggcggggttctctctctcatacgttcgccgatctcatcaaaactacttttgccaaattagatcgaccggaaattttggctagaccacagcggtaccatgcatgctttaatcgtgcgtgtgagctactgccgctaataatctatctatctgtatcaatcggatacttcaagagagttctcacgttaacgtaaaagaatgtagttattgactggatggatccagaagcagaatttcattggttttagaacccttttagttttaaaagcatactctcatgaaacttacttgtaacttaaatgagagttgttgtattacttacctccttgcacaaatgtaagacgttggttagtttaatttttagctaaccaacgtcaaacaaaaaaatggagggagtataaaacaaactaactaattttgaatgctgaaattcaccatacgttatacaagttgtttctaaaatttaaattttaaacttgattactattttctccatcgaaatattttttttagcatttgacatttaaatcactaaaggcatgtgtttcatccattctattgctaattactcatgcagcttataattagcattagccaatggcaggggcggatccagcatgggggcggcggggtctcgagcccccactactggcgtgaagactatgagagaccccacaaagaccccactaaaaatttttaccatatatagatgggagggggactgtaactctatctagtttgctcagaccccactgctatttttttctggatccgccaatagccaatggagtcttaatagttttgaagatcaaaattaaaaaaatataaagttgttctcccaagttgctgtattttaaaatatccaaaatatttagcataaccacaatattgacaacaaatatcccgtaccatactcgaccaaagatatttcttttgcgtgttcgcgtacactgtggctagtgggtttttcacgtgaggaagatgtgcgtgcctggatnnnnnnnnnnnnnnnnnnnnatgcacctatgcagccatgggccggccgtttccccggtggatcgtgttcggacacgtcgcggcccctccacgacggccttggctccattgccaccaccagataaagtaggcgtgcatgcgccccacccccaggcgagtcagagcagcgcgcgcgcgcgcgcgagcgagcgacgccgtgagaaaccagagcaccaaaccgaaccgccgtttctcgcgtctcgccctctccgtgactctgcccgcggggacccgcgctgcagggggagaggcccacccaaccggcaggtgccctcccccgctctatatatacgcccgacctctcccacttctcccccacatgcacttgcagtcagtggtacaacaccacagcaacgcaccaccggccatcaacctcctctcccctgcttctcgctcgctctcctgccctgtttcttggagaagtgagcttaagtgagagcctctgtccctcgcacacgctattggccatggtggttctcgctggcccgcccgccgtcgatcacatcccgctgctgaggtcgccggaccccggcgacgtcttctccggcgtgccggtcgtcgacctcggcagccccggcgcggcgagggccgtggtggacgcctgcgagcggtacgggttcttcaaggtcgtcaaccacggcgtggccacggacacgatggacaaggccgagtcggaggccgtcaggttcttctcccagacgcagcccgacaaggaccgctccggcccggcctacccgttcgggtacggcagcaagcggatcgggttcaatggcgacatggggtggctcgagtacctcctcctcgccctcgacgacgcgtcgctcgccgacgcctgcaccgtcccgtcctgcgcggtcttccggtgagccctcaaaaccgacggcgatatataatatcagccccgtccgtttctctcggttttttacctagtgtttgacatggtgcgcgcgcgtcatgcatgcagggccgctctgaacgagtacatctcgggggtgcggaaggtggcggtgcgggtgatggaggcgatgtcggaggggctgggcattgcgcaggcggacgcgctgagcgcgctggtgacggcggaagggagcgaccaggtgttccgcgtgaaccactacccgccgtgccgcgcgctgcaggggctcggctgcagcgtcaccggcttcggcgagcacaccgacccgcagctcgtctccgtgctccgctcaaacggcacgtccggcctgcagatcgcgctccgcgacggccagtgggtgtccgtgccctccgaccgcgactccttcttcgtcaacgtcggcgactcgttgcaggtacgtacgcggtacagccccgacccttggcgctgccacgtgacaccaattccatcaacgcgctaccttcctctttctttaccatactttttcctttttccagaataattcccattaaactagatggtgtagattaaattactaaattaaatgacgtggacacggctgaaatggctgcgcctagtgagcgggtcaaccgggacatcgttccagttcacatcggtattaaaaagaaagaatcatcatctggacgaatatactaacccaattaagacgagacaagcaagaaaaggaaaggggttcacctgcatgatagcatatggtacgatggccacagcccacacggcagggactgggtttcgtagataactacgacactcgagacccaataactgccgccactaacgagcagattcagtacatgaacatatatatgtgtgtgtgttaggcatgaacacttctgttatgcctgcgtggcatctcattgcgtcatcatgcacacactcttaaacactttgtgcacttcccatatacagatggacaatatttctttatccgttagcacaagaagcacagatacgtttgattaatttttcgtgctgactattaccgtattacgcatgctgattataaccgtattacacatatgctgatagatatacatgtggtttcttggtcctgtacaggttctgaccaatgggaggttcaagagcgtgaagcacagggtggtggccaacagcctaaagtctagggtttccttcatctactttggagggccaccgttagcacagaggattgcaccattgccacagctgctgggggagggagagcagagcctgtacaaggagttcacatgggatgagtacaagaaggctgcctacaaatcaaggcttggagacaacaggctggcccagtttgagaagaagtagctagctagatgcctagcaacagaactggccggtcaagcaacaacgactttactgcatggcagctagctaccttagctatgtctcacgcacacgtacggtacaccatgaccacgagaagatgaagctgcttaagagagaaaaagaaaagaaaataaaaacaggaagaagataataacttcaagatgcacaatgtacagccaggttggatggatagctagatttttctcgtgtggctaatcaccgtgtgtggtgaggtgggctcctttcctgtttcggaatactgatcgatggatgaacagcctccaatagttaatgttaaccaaatatagcacaacaaaggggttcttttcttcctttggttgtttcttttttcctcttgcctttgattttctcgtcatgctttctgagcattaattatgtgtgcgtgtatttcggtatacgtaacgtacttttacctatgtgtgtatagtacgtggcttgtgttaacaagtaaatattatagtctctctctttcgttatgcaactgacttctgcgcggtccaaatgcattgatggagatatatctattggtgtacaatgtcaccttcaagattaatgaattttcatcactcaggatatccctttattattacatgtcatctaaatagttatcaaaaaattactaaaatagattaatatgaaatatatcactccactaacatgcaagaccaaatttgatttgtacaagttacaataaaaagaacaagttaaactgaaaatagttaccgtacattcacatatatatttgttatttttgttgtaacttgtgagagaaaacctagattggatgaacgccgtgcgtgcaactgaacaataacaaacttaccagccatcttaatccgtttgcatatgtgataagttcaaagtagtttagctaatctaacactgcccctcaatctaaacatcttatattaagataacaacttgtagaagttaaattttaacttacatatttgtatagtgatatatttcatattaatctatcttgtcttttttttaatttttttaagactatttaggtgacatgcacgaaacgagttaatatcccctccatggatgaaatcatttcccagatttcaagggcttcattcttatcaaattttgttttgctttttttcccctatcctgcttggtgcaagtgcatcgatcagctaatttctaggattctccatcggagcctagtagcttttatcttctctaactgtcgtgcgtgcaactgaacatgaggtgcataggagtcgtcttgagcaatttatggttatcttgtggtattctcttgttcaccaccacaatagacgttgtccgggtcccccatgcatgcgtccttttaagttgaatcaaatttttgcatcctccctcccttaatctccaaccatgagctatataacacccacactttggaattaaaaaatgattttcaacttacatctcgtgcattttatggttgtcttatgggaaaacaatcaattttgcatgcacctaagtagtagatatctacccaccttccacactgttggatgtggcctatatataaatgtctttacgtacacacataggagcataagtatgatatatcacaggttcatactaagagcaagtttaatgcatagtatagccaactactagctccaaaatcatctatagccaatgtaatagtcaatttatacaatagttgcttactacaaaattaatacagatctgtagccgttgttcttctctctcttcttttatctctttaaaatatatttatagctggcttatagtctgttattgtacatgctctaatactacacccctcatcactcgctaagtaccagcttaagagggccggtcaagatcgaaaaggccagcatgggaacaaaaactgaatttaaccgccattgtttcattttctagcacatgagtgactgatgatatgtattacagcatgtttctagttgactagttgactacttcctccgtttcatattataagactttagaaagtcttataatatgaaacggaggaagtagacaacaaacagaagcggatttgtggtaattacctcgtgtttgaccacaatatataaaaacaaaataaaaaactactttatccatccctaaaagactataatttcagcataagtatttgtctcacaaaaactgtatttttagagtaggcctactagctagatatttttaatatatttttttctcgttttagctatcgaagtagtagtacttcctccttaattagcgttttctctccatattatcgaaggatataagttttttaacctcctagtacttaatttgtagttgactaactatagtcttcaggatggaggaagttattaatgagtacctttacggtgatcttattatcaataaaaataatgttaatttatgagttctactataagtataaaatatcaggaattgaggtgatagatatatatgatctatcaaattagaaaatatagatggcccagattgattctagtgtcacgatccattactggagaactgatctttcgtgggtcggccaaaaatcacattagcctctaaacttttttttgtcccagttaaaaagcacaacaccactttataatctttaccaaccgggactaaaaatcatttttagttccggttcaaaaagcgtctggcccctactatctttagtcccgattggtattaaaaatcaacgtgtcatatgtaatgccttgcacttatcctctcatcctcgatcgcaaactcctcctcatctttaacttcctctcatcccttcctcctctctcttctctctcttatgctctccttttcttgcagtagcagcagcgaggagcgagcgaaggcgatggcggtggcggcccgtgcggccgtgttgccgacgctggcacaggtggcgaagcgggaggggaggtacttggcacgggtgatatgtttgtctgtaaatttattgatttgtgatgtctttagatctgtaaatttgtgatgtctatttgagtatattcattcaatctgtgaatttgtggatgactttgtgatgtttctatgaacgtggataatttaattgttgagtttggttcaaaaccaatatgcaaacatcaaaaacaaatgacaagaaaaagaaaaaaaatagacacggttggtaacatcatccgggactaaatatcgatatctttagtcccagattcgtggtcccaatttacaaccgagattaaaggggttacaaaccgaaactattatgggtttctccagcagtgaccattataaaacctctctagtgataatgcctttttggatgggccctactccctccacccaaggcatgatagttgcatctttcactaatgctcgtcctttcaaaccaccctccgttgctatactcttcatttgtgcagcagcagaaacgatatatggctgaggaagaaaggccattgaagacaaccgtaccaccagcacgagcaggagccatccagctaggttaccattcgcgtagtaaaggcggcgccagcggactgtacgacccgcaatccagcctccgcggaccacggggaataaaagaagagagggcaaaagctgtgtcaaacagggtggactgcgtgcctgcggtgcggtgggcagcgacgctcgaattgagccggtctctcgcgtggctgaccgcttgatgccctgagcgcagcgcaacgcatgcagggctgtggtggtggccactagctgggcactgcggctggaccgctggatgtgccgcctagatgccgatactgctgctgctaccgcgcgctagccagccagctagtacactggtatgtttttgttgtcaaaggctctgtgagattagtggcggatccagaaaatcgattcgttagtgtcagaacatgtctatccgtgttatagtatgctaattattcttagatcatggtgttatagcatgtggataaacagtttcgctataggttttgttaaaagttgtcggtgtcgcttgacaccggcccttctactgtagatccgcctctggtgaggacgccaggagcccaacgaggatgcaatcaatccgcgagcagcccaccgtatttgcaacgcacgcattataacgctgtatacatgcaccgtcgtggtcgtggtggcagtaatacggtcggggcctgcacgcatgcacgaggtagttcgagcattagccaaacatcagatcgatcgagagtggcgtgcattggatgcatgcgtgtacggacgacagcctctggccatcgcccgtactgctggcagtctgttgctagctgttttgaacggatgaatgctgttgctagccgatcgacctgtgtatgttttccgttccctctcgcgtggagttctggatttggcggggccaccggccggcggccggggaccaattgtgccacgccgcgcccgctaatagctactgacgcgtgtgctaccggtggctcggttgggggccggagtagatcgatggatccgtgattgatgaggccctgttccgaactcctttccagcaaagaggggggctttggataatctcctcacacggccgctagtatctggcattactgatgacaattgtaacattaactgcctctctgtactgtattgcaccggtcagttacattgatcgatattattgcgaacctcactatcgcgctgacgggcgaacgatcgagatcagatcgtgctgtactgttgataatctcactagatgacctaacggctggaagcctggaactatatagctatagctagcatcgctctagctaggtcagctggtcctatgcccgccccaaacgggcacatgcatgcaaggttaggactttggttaggaggaattaaatcatgcatcagagcaacgtacgtcctgcatatatcatatcgagtgcccaggctttacgagttctgtagcctggagtcttgtggaccctatatactgtagctagctaagctaacctatcatagtaatcaatggatatatgcgattttgcgaactgcatatatcctatggcgagtcgcgcgctagcttgctctagcacgcgacggtgcggcgccaccagttttaattttctcccaaccacgcgcgtaacgtacgtcgtcgttctagttttgaccctagtgcgaattctctctttcacgtcaggacaccagctagccaccatgaccatgccatgtttgtgtcactgtgtgtctacgtcaaagagtcatgcagcggctactgtgctcgtacctggccgagagagcatgcacgtacgcacgtcggatatccacacgtatatatatccaacgtgcgagagcgtgtgaccgatgtagccgggacgtcgatcgattggcaagttaacaacgacgacgacgcagagatatcgatctatcgacggcgatattgtctcgccggccggagacgatcgccggcgagcgctagctacgtacgttacagctagcgtaggtggccgcacacgtgtttttgggcagtgccgcagttgatgtgccgcctgcaggctacaggctgcgttaatttccgatggcacgttgcacggacgcgtgtacggtggataacgcagtgcatgcatgcgacgcgagcgaagtgctcgtgcaccagcatgtcagagcggccctgggcccgggcgaggccacgaacaggttggctaattgggccctgcatgctgaagtggctcaggctttgggcctatcaacgcatccaaaggccggtccagcgttaacgttgcaccagaaaatcgatcgagctgctggatccagcaaagcagagagaccggaccagctttcctcgatgattgtgtttattatgaacctggcacactggcaaagccagagagatcttgttctttccccctggacgggatcgccaaagctggaacggaaagtgagaacagaacggctccccttctccatcattcccgtcctgtcccgtgttaaggttcatgcaccagtgatcaccaccagtcggagacgctaaaccagtaaccacgacacaaccggcagtgcagtttcggctgcttgtgttgccttgtcagctggggtccctgctgcataggtgcactgcattgtggaattgcctttctatctgctactataccccaataattctcgagaacgaactcgtcagaaatgagtagtaccttttgtttcaccagatacattctctgaacatattaaaaaaaaatcgacacgttcttgcaagaaggctgcgtcgccaaaagctcgagagcttgcggtgtggcaacttgctgctggggacagcgagcagaattgcgaccagttaatccagatctggggcaagcagagaatattttgttttaattattacggaggacccctaaaaacctcactgaactgacaggacagctagcggaggaacgtgcggcataaaatatgtgtattttgcttatgagattgagatcccggccaggtcacatgtgaatcagaattcagaatgcatgtggtagaagaacaatggtgtcatactgggattagctcggtgacgcagcgtggtttgggtg

SEQ ID NO: 77536 - DNA, 591 bp, Oryza sativa
atattcacttcattccccgtaagccggccaatgggatttagggaaaccttggccccggaaaccaaggaaccaaattaccaaaatccaaggaaccaaggtatgggccccaaaaaacaagaacccagaaccaccattggcaaggttttaaaaccttcaaggaaagattttgttcctttcttttcccctttgttctttttgctttccccgctgaactttaattttttttttgttaccccttattttcccaaaaccccttctttccaattatttttttcttcaaccgcattgcaccgggcttttcttttcttcaacggaatgtacttgccgctttccacatcgtgaaccaaaaggacccccgacttgccccccctttcattcccgaatccgccaccggttcggaaataatgattcttggcgaagggcgcccggcaccaaactacccggggcggtccatttttttccttcccttcgcaatggcttggcttgtcccgccattttctcattttttcatggatgtcctggagttctaccatcttcatattgcgcatttaaccccaaatggcgtattacattggccatctttccacacct

SEQ ID NO: 77537 - DNA, 15568 bp, Oryza sativa
cccttggggagacagagggaggggcggccacatcaccctcgggcccgacccccccgagggggtcaggccacgtgggtgaccgcggctgccccaaacctctagtcaagatacccccggtcccatgtcaccgacagacacctattgtactagtgttggatttttttttggaagaaccgatacccatatttatattataggtgccggttttataaaagagaatcggctgacatcgaagtttagattgagggggagtgttagatcataacatattggtgtacttatctatgtgtgttagttgagatacccggtagtttagataagctaatcatcccatgaactccctcctttcttaaatgtttggcgccgttgacttttttaaacatgtttgaccattcgtcttattcaaaaacttttgtgaaatatgtaaaactatatgtatacattgaagtatatttaacaataaatcaaatgataggaaaagaattaataattacttaatttttttgaataagacgaacaatcaaacatgttttaaaaagtcagcggcgtcaaacattttgggatggagggagtaaataggatccgggttatccatgcaacacacatatatatgcctgtacttctcccgtgcgatttatgcacaacaaaattaacatgtagcagtagcgtcacaccgatcgacgttaactcagattagattttctttcaatgtgatgtggggatttggggatttcaatttggtttgggatgtttggggaaatcaatatgcaagcagcaaaaacattgaaaaaaaggaaaaaaatatctgtagtcccgctaaagattgcagtgtgtcacacacgttatcaatgtcgaactggacgatgacatggatcaagagctgatcgaaatccgttcttgatcagggcgaagtgacgatgtgttctgcgccgactcgacgacgaagcctcaccatgatcagcctaaaggtcatcgacgtgccccgcgcgtcgccgagctgtgtcaccggagaggcgcgctggtgtgcattgacagcacgctggcgtcgcccatcaaccacacaagtctctcaccctcagcgccgcggcatcatcctccacaccgccacccaccaccaagtacatcaccggccaacctagacgtcatcgtcggctgcgtcagcgggctcagaggcttgggccatagcgccggagctcactaccagcaggtggtactcgccggcatggagacgaggagagaagagaagaagaggtggaaagtagaaggtcatttacacgtgggtcttacattatttattttatttttgacattattttattttatttttgttgattagggtgtcacgtcagcgaaaccacctatacatactgtcacgggacttgacttaaatggttttgtcaagatggagggtgaaaaatgtctggtattacggtttatggatgataattaaactcggtgtaaaaatgagggatgccaagagaacttattccttcaatctatgccctttctagcgttttggcccattttttagcccatcgcacacaatcatttccaagctcattttggactttttatttttcagtaacaggaaaaaaaaagaaaatcaactacaatttgtggcatagtagtttgatcatgctagataagtgtttccattattgatgcaggcttgtcacatttttaaagttcatattcccacgtgtcatactcacacacttccttgttaaagtttgtcatgtttttttttattcggagatctgtcaaatttataatcactaactttggtgtcacacaaattactgcatttgcgaaaacaacttttctggcacacattttttttcaagaacacaatcacacaaacattcctttccttggcccatctacatgtttatttgggcttagactttgtgtatggaaactttcttcttagatactttctacatagaaagtctatacatattcaaaaactttctatagttaaattttaaacggatttaaaaaattagtttaaaagaaaaggaaatattgtatgaactttctattggaccttaaattagctcaaataaaaactaggtccatatgcatgtgtagttaagcctgcgagcgatgataacgcgtgtatccatgactcgattctatagcaagattagtaagagaaaaagataagccattcttggttgatatggttttatttggagaatagtttatttactttagttacctttatcttgcaaaagaatggtccttagttttgtaagtccgatcttatgtgatgtgccagagattattcgatctctgaactctgtttagcatgtctctcctacccgacatcgacattgatattactgcctccattctttgaactaagggttgaatttattttgagactgggagaatatcatatgcccttgcatgtttcataccccctccgtctcataatataaagaatttgggttggatgtgacacatcatattactacgaatttgaacaaatggacaggaacaaaactagcatcaaaacaagggggtgcactaccattgaacatttagaaaatttcactccaacactgtacattctagtgtttttgagtgagaaattagaaatttgggggttcatgtgcaccccctccccccccccccaaagaactctatagcttcgccactgcagatggagtatgttatatccatattcgtagtaatatggtgtgtcatatctaacccaaatcccttatattttaggacggagagagagtatgttataaagaaatacaatatttactatttaatggatcgttacatgtggcattaattaccacgaaatgtttggcacaataaggcgtgcacaatgtttgattgtgaaaagcagcatggattgaagaagagcattgcgtacgtacgtgttgcatgaaaccagtttggacaaaatggagcaaaactcaacatgtacagattcataaaacaatgaattaaatccaaggggatattaagtcaagaacatataacaaattctgtcattaaattgggaaaaaaaaaggcaagaaagaaataagctaaaaagatcggagtagctcgctgcgtactctatccgtcccataaaaaactagatgtgatacatcctagtactacaaatcagtacatacatatatctagatttatcgtactagaatatatcatatctggtcctagattcggttttttatgggacggtgggagtatcgatggattaattccatggcggtcggtctggacgagatcatcctcctttctgcttgaaggaggagtacatctggacaatggtggagacgaaggtgacgaaggcgacgaactcggcgaccaccgcccatggcaccgtgaagtagttgcgcttcacgtccgcccacatcatgaacagcgggtgccggctcctctcccggagctccaccaccatccctcccaggtagctccgctccagctccacctcgccgctcgccgccccgacctgccggaacagcctcaccacctcctccttgccctcgccgccgccgttcccgtgcaccaccgccaccacctccgccgccgccagcgccccggcgtcctccgccgactgcaccatcttcgccatgaacgacacgtacgccgacacgtcgcgcgcctccgccttcgccgccgactgctcgaacgccatcaggttcagcagcagcggcgccgtccggagctccacccgcagctgcggcagccgcagcttgtcctcgtgcgccagcttcaccgccagcggcaccggccccatcaccgacgcgatgcctgtcaccgccgccgcgccgccgccgcgcggcttcttgaaccgcacccacatccgcttcaggtcgctcgccgacggcacgtcctcccgcccgtagctcgcccgccacttgctctcctccggcaggatggggtacagcagcggcaccagcagcagcagcgggagccgccgcagcagccgcgctccgtcctgcgccgtcccgagcaccgcgccgtcctggatgcgcggcggcggctcccacttggtccgcgccgcgacgatcatcgcgtggagcaggtggaggatgtgggacacgccctccgcgggcggcagcgcgtcgcccaccatgtcgcggcccttctcgccggcgaggtagtagagaaccagcttcacgatcagcaccggcggcgggtggccggtgctcgcgaactccggcaggtcggtgatcctgaccaggtcgacgaggacgaagaacgggatctggttctcggcgaggatgaggtcgacggagagctgcacgggggcgaacggcgtggcgtgcagcgacggctcatccctcccgatggcgacgttgacgaggtgctcgatgatgaagcagccgtcgagcaccagcatcatgatgaactcctcggcgtacatgtcgacgtcctcgctgtagaacgcgcgcgcctccctctccctcgccgcgacggcgcggatgtactcctcgatgacggcgagctgccgcgcctggtcggagtggccgcgggagatgaggctgtggaggtacgccatcttgaggcgctcgccggcgccgagccgccgcgcgtcgccgcggtggagcgggccgacggcgacgaaccgcggcgtgtaggcgtcggcgttggcgtcgcggaggtgcgccgggacgcgggacacccggtggctgctcgccatgatccggtgctgctcgtccgacgccgccgcctcctgcctctgcatcagcccgcgcgccatctgctccacgtgcaccgtgatgccgtcgccgtcaccgttgccgccgccgctgccgcggcgcgccatggctcgccggcgagctatggcgccgtcgaactcctccatatctgatcagtgagcaccaataccagatagcattacgtatcagcttataaatacaagccaggtagacactagtgtacagtgtgcagttcatgaacgttattaaggtcttgtttgtttcagcttaagattattgtaatccagattattaaatcagattactctaagctggattataataagctgatatagaataagttgcgagttgtttgtttctctggattattggaggcatctaagggtagtgggtctttagccactcaataatctagaaaaagctccttcaaaggagattattagattatactaatctggcttatagattataataatctatcataataatctacttgtttatttcggcttactcatgataatccagattataataatcctaagctgaatcaaatagggcctaagtgtcagtgatggattaggaggcttaattaacacgacttacagttacaaaagggtagtgacatggacacgcaagaatttgattttgagtatattttatcatctggattctggaagtagcttgcattggggacaaagatgacgctaatttatccaagtcatgaatgctgataggctggtaattccattctttgcttgcagtgtctgcagacgatgagattctttttgtctccaggcttgctaatctttagtaatttccaatcaaaattcatacaaagagaaactgacacaacctagcaatgcagacaaatcattcacatgagcatctctccaaattgatttccaagtagaattgtgttacatcccaaaaatataagttgttgtttgagacaacagtgttagtattgatatcagactatagcagttaagtctagtggcagtaactgaaaaaggggcacaatggctgtatgcccaggcatcttcagagactctgcagtattctcctgcagtagaagtcactgacatctgggctcttggtaagtgtggcccacatgtcagtcgcagtactgcagaggatctcattcccatcttcagttatgctgtccaaactttcaaaagcgtctcatcaaacttgggggcattgcaaaccatctgtgctactaccagttccgagctctttccgtcttctcgcgttcgtgcatatgtccaagcagggctcctttagggctttgtcggtgtcaagaggtggaggtgacaccccaaagttgaactgaaatgaaagacaacatgcgcctgagtattccattgtgcttcatcatgacattcggttttgcaaagaacaaaacttagcatgtacatatctagtttgttggaaagtttttgtttcagcatagtaagattaatcatgaaatgaattacctggcagctatagtcttcaaagtttggttccatatacaaatcaacacccatgtgatccttgaagaatgtctggaaaacagaaaatggcgttcatacaagtaatgacagaaaaattcagaacaaaaaggttttcaagatctatactccaaattaatgtgacatcaacagtgatagtgtacataaaagtaggtatcccacacatctgaattatgctaaacgatcttacaatcaaacctgagttggcagtttgcatgtgttgatacaaacaccaaggcatttgctctcttccaaatatttgcacttctcaacaaatacctgacagtttccatcacgcaatgtccgtgaactgtaaaatctcactgagtgaaggataaacaaaaaaaacagtaggaatatattggtaccccgcttgataatgattttccattggataatgttatggaatttaacaaacatggccccatcagccattggcatgaaagtgctgttgctctagcttcacatctcaaatgtattaaaaaaatcagtaaggccaatcacactacatcaaaagcaactactgcaatgaactcaccaaccatcgattcctattgtatgtctaataagtaccaacagaggtggcaaaaaatgtcacttgagtgaactcaccaaccatcatggaagccaattgaccattagcaattggtgctaaaagagctttgaagagaacaagcaagagagggggaaacagtgatcggagtactcggacctgaaatttacagagaagagagtttgattttatcttctaaaggatacggttttttccaagcaatgagattgtgcatgagaaatttatatatacagctgattgctctgtctccaacgcactcttccccttgatcatgaggcggttggcaacttcaatcagtccattgtagccaggcttttcagaatcccatccaacctcctacagctttacagagaatgagagaattaccaaatgtacaaataaggagagcaaaagtgaaaaatatggatccattctcggtattgtataacggtagagagctagaaggagaattgatccaatgcatactcctaccgatcatgatacgttacaaatgtaaacacatatatatgtgataaactctaactgggtcagctatacacagggaacagaacacgccataagcataggacgtacacacgcacagagcagtatggcacacgttcactaataggcaattaggcatacaattgcagttgcagataaacgctatacaaaatcatagtaataagcaattcagcgatgccgattatgggagttaggaatagataatttatccacgaactgatcaacaccacttatcaatcatttttgttcgactctgaacattcatcaaccatcaatatgacattgtcagattatttgctagtagtagtaagcatcttccttttcgggaggataatcctatcgcaactcccttgatatttctgctagtaatcacccatgctactaaaaagcaagcactaggaaggggcaaccattgttaagctcaaaaaggggaagacgaagaagaactgaagaagagtttggggtgatggagcttgtcacctccaccatcttggcacggaagaaggcgaggaggaagtcgtcggcgaaggagggctcgtactcgcggccaccctcccccgacggcgacgccgcatccgcctgcacaaagtgaaacaaatcaatcaagaaacactagcagcagcagcagcagctattcgcatcttgcttaacaacgaaagggcgtatcattaccgacggcgaggagcagcggagcaaggaggtagtaggccggcggcggagcccccgagaagaggaggaggcgacagggaggagggcgcggaggaggcagggaggagacggcggcgccatggccatgggcaagtgcagcggcagccggcgcgcgagacggacagaggctgaggcaaatcggtggtggatagccggctgggaccacatgtcagctaccaaggccgtagtcaccgatgtccacaaaccaatctaacatatatgggccgcgcgaaggccggaatctcgttcaggcccatattatattgggcctcacgttgactggaatagcttctttcggcccaaccaaaggaaaaagtacactcgaaggtacctcaacttgtcaccaggataaaaaaacgtcctcgaatcgcaaaaaccagataagcggggtcccttgactatacaaaatcggtcacccgaggtcctttggtggttttgaccccggttttagtctacgtggcggctgagtcagcgtgggacccacgtgagccccacatgtcaggtgtccacgtcaccctctctctttcccctttctttttttctcttctttttttttacttctcgttccttgctactcacccggccgtgtgctcgcccacctgccaccaccgccgctccatgcctccgcttcgccggtggctgcgcgctcgcctgccgccttcgttggccgccgctcgctcgctcgccgtgaacagcgcgaagctaatgtcaccgcctacgcgtacgcgcagctgcagagtatccccgtcagccacgcacatcacatcaccttctcgcacgccaggttctccagcctcagcgcccccgccgcggtcaggttcatccgggggtcgtccgcgccgtccgccgcgtcagggcacacgaactcccacagccccttctgctcccccgccgccgcctcgctgccgatgggctccttgccccagaaccatgggtggatcagcacgatgccctttaggcggtgcgggaggtgttggctggtcaggccatggtgcatggcgaggtgatggcagatgttgccgccggcgctgtcttccgcgaggaagacgtgggagaggtcaccgtgcgcggcgagccatgggtcggcggtggagagcacccaggcgagtgtcgtggcggagtcctcatacgcggccgggagcgggtgctccggggcgaggcggtatgtcacgccccgaactagtaccgaccggaactagcccgtgacgctccaaattaacctgtaattcgataccagtcccaggaaacagtgctggtatcacaggaagacagattatcacagcaacagaggtctctttattatagagtagaggtacagtcatgttgggctgcggacagatctcgagctcacaactgcattacaaaagggaaacggaagccaggacttggaccaaacaacacaggcgcgacttgggaactaggccgaaaccctaaaactcatcgtagccggcttgctcctggaagaactcctcatcagcaggatccgcttcatcttcttcagcaactgggggggattatttatacagagcaagggtgagtacgggagtacttagcaagccaggggaaataagtgtttaatgcaggcttcaaggagaggctggtgtttttgcaattgattttatttgaactcttttctgaaacaactaagtgagtgcttctcaaacgacacggatgagacagtgcgtctcgtccggtcggagtatgtgcaatgtatcagtctttagatttgaatcaaggttggcacccggccaacagcttttcaaacggccacccgggccaacaactttcaaacggccacccgggcctacctgattccatcagttacagatttttcaatcatcgaacccctttccacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttgaatgaaattccaaggaaacggtccttaagtgcaagagcgggaaaccgtacacccggtacgttccccggtccgcggttttggaaattcatttagttcgcaagcaccgacccaggtgtcgggttttccaagtctttcgtaaaacccaagttttatccaagaagttttttattagattttaagtttgaaggcgtccgtcgatactcgcacagggtgcacgaatatcgagacgcaactagatggttaccaggggacacgatataacaattatcaaaggaaggatcaaatgcaaccaattaggtaggtccgccaatctgccttgcaggcgggacaacagattaagtgcgatcctatcaatgcataatatttttcaagcaacataattaatttcaaatataggctcaagatgttcaaaggtggcttgccttgctcgagatctggagcttgatcctcgaaatcctcgcactgcgggtcttcgggctccgaaactacacgcgaaacgggaaaactcaacaaacggcgaaaataaagccctattaatgacctctaagcgtgccattagatagatctcgagatttgaggaattttggaagttgaacggagtcaaacggatttacggttgggaagatattgaatttctaagattattggatttttgggtctaaaggaaaaaagatttaattaaatcctttttgaataagaaaagaaaagaaaagaaaagagggagggaaactagacttttcctcgggcggctagggcgcggcccgagagaaatggagcggtccggccgagctaaatgggccggccggcccaaggcggcccaagcgcgcgcgcgggagggaggagagagagagccggtggaccgggctcaccacgcgtggtgcccgggtgggacccgcttgtcggtgacacggttcaccgtgcggagcgagcacgcggcgcacgcgcgcgggcgggggagggacgcggtgcacgcacacggttcgcggtggatgcagatgcggcgggcccacgcgcagcctcacggctcgcggtgcaacgcgcgcacggggagggactgaccggggtcggcttgacccggtcttggccgaggtggcgccgacgtggcgcctacgtggctgccacgcgggccggcgggaggtagacgacgacgccggccggaacggacggcggacaatagcggcgagcggcggagcgaaccacggcgatacaggcaaaagcgagcacaccgggtggttgcacgagacgaggggagacgagccaacggctcggattcgccggagggagcttgacagcggcgaatcgcggcggcggcaaccggcggcgggagaagggggaaacgacgacgaggtcacgaggggccaattcccgacggcgagagcatctacgcggctacgggaatccgatgctagcgtcggattgggcagagctacgccgagcgaggctggcgacgagcgggtgctacggagctcgggcggtgacggcggcgagcacatggcgagcggcgacaacggtcggggcggcgccggctagctacggggaggctactcgtgctaccaccgaaaactaagggggggagatggagcgaggaggaagaacggagggaggcattaccgtgcggacggggcgcagtgacgagaggccgacggcgcgggagtaatctctccggcctcgggccgaggaagaggaagaagagggcgcgcccggagtccccttccgcgtccttgctcgtgccggctcctccgacacgcgcaacgacgaacggcgacggcgaacagagcacgggaggcggcggcaatggcgtggaggcgaatgggagaggaagggaaagggggaagcttgggttttaagggcggcaatgtcggtttggaaaccgactttgggcggtcaaggcgcgagctggcgctcggcgctcgcgtccaaattggcgacagggcggagggaggaggatgacgccagcgggaggaaaaaggggaaaaagagggagagaaagggggctcgccccttgcttctttgggaaaaggaggaggggagcgggggcgtcgcggcagagggaggagggctctgcctccgtcccttggcggcttgcgcgcggagaggcggggccgaggcgatgacgacggcgatgacggcggggcggtttggagcggagcggcgacacgggcgacaggcgcgggcaggcgctgacgacgacggcaaccaggcggtcggccactcggcacgcgcgcgcggcttgcaacgggaggcgcggcggattgagcggcgcggctcgggcacgcgcgctggctgcggggccgagcggctgcaggcgcggcagagcagcggggccgggcggcgcagacgcgacgcgggcgacgaccacgcgggcgcgcgcgcgaacgatgcgcggggagcggcagcgagggagcgaagaggagggctcggctcggcggctcacgcgcacgcgcgcgcggcgcgcgggcggagcagagggggagggggagagggagaccgccacagagggcgagcgccccgcccccgggggagatgggccgagagaaattcggcccatcgaccctgggggaggcaaaatagacttttgcggaggaatttgatttggaaggatttggattcgggattgaacttgacgatagatcggggattaagatctggagagggcacgaacactagacaacaagcaagaaacaatttcgcaattagggtttttatgaaataattttcccgctaggcgctacacggtagttgacggagacgacaacggcggggtaggcgatggcgaggtcgttgaggcagcggtggtacgcaggcgatgtggccgacctgatcacgaaccccccgccatggaagtagaccaccacggggagcctctcgcctccgacagcaacagcggcgggctgcggagaaggcggagaggcgcacgtccctggacaccacgtctcctgcaacacgcaatccagatggccgtgacgaggtgctcggcgtggtggtcgagatccaggaacggcacggcgcctccacctccagatggtcgacgtcgaccgccgcccgccgcctccgtcacctctccacccacagctctgcccccaccaccccgcgtatcctcgctcacctcgccgccgccgggtccacgccggtgagctcgcaagagcactgcctccctccttttcaccctcggccaaagcagccgccacagagccagccgtcgccggcaaccggacctcctcctctcccgcctcaccccgccggcctcttccgcacccgtcggtcggccgtcggcctgcccagagtccttgacaagaaagtgatggagaagagaaagggagagaagataggaaagagagagatgacgtggccagtctgacatgtggggcccatgtgggtcccgcgctgacgcagccgccacgtagaacaaaaccaggtttaaaaccaccgaaggacctcgggtgatcggttttgtatagttaagggactccgcatatctgattttgcggttcaagaacgtttttgtatcccgatgacaagttgagggaccttcggtgtactttttccccaactaaatgggtagcacgtgaagcctgaatcccgttgcggactaacatgtatatgggctgcacagcagcacgagggcccgttgcattcattttaagagcgatagaagttgttgactcgtgaggaagacaattacgatcggatacctgaacatattacggtgatataaagtggtcaaccccctcaaattagtaaaaactagattaagatgggttttgatagattgaaccggctagcgaagccgatttagatggaataaagataaattacccatctcgtgagcgaacgaaaggtttacgagacaaatctacgaagagatttcgcactcttacaactaatgcggatgatttacggtgcaaattgacaaagatggacaaaactaggctaaaaaactagacggaaattagatgcaatattgaaaaatcgattcaattggataaattgtattgagagtagattgtattgccctatataagggggttggtcttgccccctacaggtcctcctccacgtctaactcgggttagaaactaatggaaacccgaaacatacattcccgagcaaggaagtccgagacctgacgaaaacagctcggagtcggactttgccagtttgaccggctatataccgctggtcaaatcggccgacaggcagcggtcagatcagctctatgaacgaaacccgactcttttcaaactttggcaatattctcctattttaatcctaagtgctaaatttaggtgtaaacacatgcctcctgcctttttgtgaactttgtgaacctaaaagcataaaacacgtgatcttagggcaataatctaattgccggccatataactccctaagcgtcatgccaaacactcaggaagtatttctacaagtgtttcccattgatcgctctctaatatcgctctccttacaatgtctcgagataatatgtattccctcgaacgattccacatatgcgataaggatccttccaactaggtgaccacttactgaagtccttagatttagaaaccaaaggcaaaattgtcttccataccaagtctattacttgaaacaattttgctttcactcttttattgtaggctttaactaccttctttttctccttttttatctctcctaaagctttctaacgtttatcggtcacatcatcaagattatctcttattaatgttttgtactctccaacccataaatcatctttctttatgtatctataagagagccaagaactacctctaccagtaaaacggtttcttgcctataaacttactcaaaggggataactttagtagcaccatatttagatatcttatgagcccccaatatctctgaaagcgcctcatgccatctctttggttggtcctcaatctttttcttgactaattgtgttacatttgagacagaagtggtagtattgatcatcagacgacagcagttattatgtctagctagtaatagcaactgaagaaggggcacaatggctcaactcctctgcagcagtagaagtcgctgacgtgtgggcccttggcaagtgtggtccacatgtcattcctatcttcagttatactatccaaactttcaagaacatctcatcaaacttgaggacattgcaaactatctgtgctactacccgttccgagcactttccatcgtcctgcgttcgtgcatatgtccaagcagggctcctttaaggctttgtcggtgtcaaaaggtgaagtggcaccccaaagttgaactg

SEQ ID NO: 77538 - DNA, 7952 bp, Oryza sativa
aaattgggaatacctccctgatatcccccatgatttataggagctccaaaaacagaacctcccattctaccagtaaaattctctccttgagtaaacacagttggctcaggtcgagtggtgtcaacacctgggccactactgccccccatttgacaaaacagactcttctgattcattggtgcagagggtatcacaacgttgggttcgatttcaaaacgtacctcaggtgcagtggagggaaaaaccactccagtactcggcccagcagcgtcagtaccctgtcccgttgatcccttaactgctgtagtagcatctgctccttctccaccctgatctgccattttcttttgcttacagagttcacgcagcagctctttgatttccttgacctcccccttgagcgatttcagatttgttacctcctttttcagggtcaccatgtcagtcctgaactcgttcatctcttccaaatccaccatcgattcgctggagcgcgtcttcgtcatcttactctacaggattggtttggaacaagttcctccccactagatcctatcagagatgggtttaccaccgccaattcttagttgcgagctccggagatttcataggggcacacaccttggtggctcccaaacccttgctcgagcaaccaagaacaccaccacgcctccggattgattctgcccgggttcaggaattttacgatggatctcaccgccgccttccaccaaccctcaccggacaagatcaagagccaagaatcgtgcttgctctgatacctctgtcaagaccctgagtgcgaaatggaagaaacaagggaaaacagagcagcgattttagggttctaagctactttagctaatcctaagacaaagtaaattgtagtttgcgttctgttcttctccagggccaaaggcctccattagtagcttacaattcaagcattacatccagctgtaaaaacataaagacaagaaaagtagcatcaaaacagcatctgaagcgtgattcctgctaaaaatgaaaaatgacaactacagtggtccccaagtgatctcgtccatccgatctcccttttttttctccactgccgttggattcattacttcacttctgaatcgttctctgaacattctgaacttctctgaattcccttgtctgaatttggtccagaattccatttccctcctatgctcctgacagggggttcgacgccgacgccgcgctccctcctggccgacgacctcaccgcgcggctgcgggcagggcagaggctgggcgaggaggccccgcacaagcgcagcggccgcgaccgctacgtgtgctccgggacagcgtgcaaccgccgcagcaggccctcaagcacggcgccaaggcctactacgacggcccggcctagttcttctgttcagctggatttggtttactactccgtccaggttcataatccttgatgttttagataatgatatggcctctaaaatatatctttgatgacgattttgttttatattatgtaaagagttgaataaatatataattttattaaaaatactttttaatactaaattatacatcatgctatagtatcttcaaactaaatattttaaaaattgtaattgtctgaccttattcaaaaggtcaagaacctatggaaccagaggtttcattaattctcatttctaagataattttaatgaacgtattgtgcttgggtagattgaagcccaatgttaagattgcagcatgaactagattgaagaactaagattctataggatacaattttaacactttcctctctcttttttttggcaaccatgcatgtatatatacgtgctttgtacatgtacacactttttttattgccatattcctcgatggcactatacacaactctcaactttccactctaattatggtgcagagatctccttgggagaacttgcacccatgcatcatttctgcacattttcacaaatcacaatctaaaaagaaaagaaatagaaaaaaaacagtaacatatactgcaacttatgctagtataatattcacagttgctcaatctgcatgcataccacaattaatctaccaacctccattcctaccacctaagcaagtcttcacttgctttgcttccatttgagttgcttaatttcttctgttgccagttgccaccttgcacttccatcaccatgatatgattcatggtgttgcggtcgccggccgacggtgatgcaccgtgcaccgcagcggggaccgacgcggcgccaccgcgtcggaatcagccgtcgtcgcctgagagaagaggacgctcatcgccgcctgctgctgctgctggtaccgaccggagtcgccggggaggcggaaataggacgacggcgacggctcgtcgaagaagaggtcaccgacggagacctgcccttctttcctgtactgcacgatggccttgtagatgaacgggatgaagccttccatgatcagaatcttcagaagctctgtactgaaattttcagaaagagagtttaatttgctggcttcagagagatggagagaagttgttaggacacttgagagagaggttttctttgggtggcaatggaaggtgatgtgggcttaaaaagggagggaaagaagcctgaactggatagagaccaaaatggagtacttgtcaaggatctaactgaaactactagtattatagctaggcaatatgctaatgcaattattaattttcctcttgacagacttgagcttaactctgaattaaatgtgtcatgttcagagacacagggatggctttcaggttttatcttgttaataaatagggtttgtgcactgggatatttcctgcaaaaaagaggccaagacttgaacgcaatgggtgtttcagtcttagaaggcgagttttacaggtggacagtgatgtggtgagtgcagggatttctttttctcaaatttaacccttggaagcatgcatatatgggttacctgctacaaaagaaaagaaagctccctctttcagatcatgattgagcatcaagatgaagttttttttttaatctcatgttttccggtggcgtaatcggttggaaaacaagaattttcgcttcgacttgcgtcactccagccgactctgccaggttaagccaaggcaatcaatcaattcaggtgatgacttctgaatcacttgtttttgagttgttgcataccaaggatgattagagtaaagaaaaatttgcagttcgtgtggctaagagagaagaatggaaggacgactgcagaattgaccagcttaaagtaagaggataggttttgtactcttgtttatttgatcgtctggaagacggaagatgccgatcagacgacagttcatacggatggatatttcatcggctgccagttgtgctgtgtcagcaacaagctgatttatcttttacctggatagctgcatctgagaagctagatggcattttaaaattggcactgatgtgtttgtcccaactaactgtatttagattgggatcaagagaccacagaattcagctaggttcacaatttcggttcaaaattcccgaaacattgggtctacctgaatttgtttagctttagaaaataaaaatggttcaaattcagtgaaaacctattcaatcttttttatactgaaaaaaacagattcttctgaaaatttagaatttcaaaactattttgcattcctaggttctgagccctgagttcagctaaaaccggatatgcccgtcgtttgtaaaaccccaggcttgagatttcgcatcaagattgcatacggccgctttctttgatatccagcatactgtgcctgaaacagttatctccacaatccacatgccgttatctgatctaccaacttaggacttaagagcgacagtttcgcgagtagtaggaatgattatcccgtgggtgatccgttggtggacaaggtttttctgttggcgctgccggaaaatgcagatagttggtactttttggcggtcgaactcgacgtcgactcggcaccaaaaacgggaggacgaactgaggaagttgcatcctaggcgacttgcagatatattttttaggctctataggctttaccaggacgccggatactgcctgttggatgttggctgatggatggaggatggaagaaacagttatgtaacagatacatgaaacggactgcaggtgtgaaacagttatcccagtctaacggcgacaaagggctcatctgggatgaagccaaggaaaggcactagtgtactattcacttcatccagaagtcacgtgtttattttatcgttcagatcaataagaaattactccctccgttccttaatataatggatttttgacattttacttacactgtttgaccaaaaataaaaagttgtgcttaaagtactttggataataaagtaagtcacaaataaaataaataataattctaattttttaaaataagacgaatggtcaaacagtgcaagcaaaatatcaaaatcccttatattaggggacggagggagtaacttatttcacatacaacaaaaccaagcattgtatgtctgtacgcatgtatgcaactagcgagtattaactattaagatgactaaatctggttaacaatttaatctatcattacacaacctgaacctcttcatttaagtatttgatagaagaagactacaaatataactatctgatttgtaaaaccaggaaataaaatatgcttaaaacttttgtatggagagagtactctctactgcattagaaaataaggcaagcatgaccacatagggatggagcaaggttcacaaaaccaaagaaaactattcaatattctacaagtttaaggttttgatctagcttgagttgacaaaccgtttaaattcaaaaaattagactgatttttatttctttttggcaatttgtgtaggagttttcatgagaaatgataaaaaccacttaggagcggttttcaatcagtggatgattttgtgaacactaggattgcacaaaggaggcattgcggaaccaagagctctaaaggcttccccttttagtgcccctttgaatcttagaataaaaaaacggaggaataagaaaaacacatgatcctgacagaaatgtaatggtaaaacagaggattgcaagacacaggaatgatcgtttgattggagcgcaggaaaaacatagaaatcgaataagagagatagacttaaaagttttttttttccaaaaggttagacctcctactaaatttcctccaaaacctatatgcaatgagccattccataagaattttatataatttgaaaaacttcaatcctttgaatcaaatgactacatagaaaaatttcctatagaatttcaatcctataaaattctttcataattcctttgaatcaaaggagcccttaaagtctcctatggagtttttttcattcgtaggagtctgcaaaccgcaaatttaagatgcagctctgcatacaatagttcatagatgatcaaaaaggcctctttcaaaattgctcaaaggaaaaggctatacatagagaaatttaattgcgaaactcttacagcactaaagtagcatgctatgagtaaatctatatttcttgtagctcctatttagttaaatcaaatggttgaattttctttataagaatttatttgtttataagactttattaagtacgtagagcagtgttcgtgttaaataaaataaaataaagggcctatgttgaatgaaatgctttttcatgttctactgaaagaggaacacatggcgtttgtttaactccactttgatttggtagtttgtatttgttagacaactgtccatatataaaacaaaaaaaagggaaaatcaacgtcaagcataacaactcctaactatatatctctgggagtcaacatgaagcactgtgtagtttctactatgttagttgcttttgtaaccgttttatgtacaacaacagagcatcatacattcaccctagcgttcaacaaggtctacagaggttattacttctagttgctactctttgcatatgcacagcaacacaagcttgtttacattgcattgtaaaaagacaatgaaaagaatgatattgcaagcactgccatgtatgcgcattggggcagtcgggcagcatggacagacagacctcaaacctaccaaattcctaggagaaccgaaagcatgcatcttcaatctttcatcaggtaggatattccgcgagaaccaacgtgtgccaccaaccgcatgaaacgtttagcgggttgtacgcttccacgggcacttggcatggtacgtttctgtctgttgagtcgcccaaaccaagctgttggcacaattaaaagtttcagacatggttcgatgagttccattgacagatttggacaaagagcagaaggcctacctgaccgtacttgttccaaccccagcagaagacatctcctttatctgcaaaaaaaaaaaaaaattcctgttaaattacagtgtgcaaaccatttgagtacaaattgaacctttggaaataaatgtatgggaccttaagggtacaacgttcatagtacaacacaaaatgctggatgaagcacattccaagagagagcaaaactctatcaattgaaggaaatgcagaatagagccaggagtgtacctgttatgactgcactgtgtcgggctccacacgaaacacctcttgcatgattattttccaatttcgaggcttctaccaactttggaacaatctgcataagattgatggtcctggcattaattgatcatttttatttctaaaactagtatcaatgcagtatagatttttggaagtggaagagattgtcaacaggacaaatctacattatcctagtatgaggtgcctgaagattagaattctacctcagcttgatctgatccagttcccagctgcccaaactggttacctccaaaggaatatacatcaccatcagcagatgtacatacagtatgccatagcccagctgctacacgttgtatcttcactcccataatagccgaaacacacgttgggcttaaaatatcatccgtgttcccttgtccacactgaacaaaaggggatacaacagtgaataatgtttaaaaaaaatacaacagtgaataacgttgacaagaagctctacgggcaacagtacatactaaaaaacaagcttctccaccagattaacaaaatgcatatctgaacgcccccaatagtttgtacttagtactgttttaaaacactggttactgcaccagtcaaatgttttcatttccatgtgctagtccaaaggcccaacacattattatctcaactctttcagaacacgtgttactgcaccagtcaagtgtttctcgtttccatgtgaaggctcaacaggcccaacaagattattacttcgtatactggactgtattctctccaggctacccatttaattactagcagccgctgttgatgaaactaagcaacaccccacttaattccagcaacctttagtcgttcttaccgggtaaacctacactttttttttttgggggggggggggggggtacattgtctaaatagaacccttgtcaatacagttgatctggatgatgactctattcgtatggttggactggacctctcagcaaagttattacaaaacaggaggtggtttgtataaaaatatgaaaatcaaaatcaaacacaatttataaccagttcacatatttggtataccatgactaatggttgagctggcctagattacaggttttttttaatgcacaaaaggatattttacagtcacagaactcgcagcatgactctttacaaccaatcagttattataacaactatttcaatcaacataccaagcagaatagactaacagaaagtttaatgatttcataaaggtaaacg

SEQ ID NO: 77539 - DNA, 27315 bp, Oryza sativa
ctcatagagagttttttcaaaaacgcccatccaaagggcgttaaggggtctaaatgtataatttccagtataacttattaactctatgaatttgcaattttaaagtgtatcatataaagttgtctgaaatcaaactttatatcataattttatagctcaaggaaatctacaacttcgtagttaacaaccttttcatttaagattgttagttgcccaaatgttcattacaaaatataaaacctattttaacaaaatctcaaatctacaatacaaacgacatcagacggagatgaactttatataaaagttatagatatcgatgagatctacaactttataatttattaccttttcatttaaaatcatttgtaatgtcgaataagcattattagttttttaagcaattaaaaccaacggaaatggtttgaacacaaataaaaactttacattcaggtcccttaatgccctctggaagagccattttaaaaaaccgtcaaggtgtgaggcatctatatttgtaaattttgcaacacgaatttttttaaaaaaatattttaataaaaaatgtaaaaattaaaaaaattcctggtgctgaacatcgtgcaaaactgcaaagccacataccaggcttgtcgcggcccatgtcttcatcccaacctcagtactctcaggctctcagcctcgtcaagagagtggcaagagcccaagacgtactcaaataagaagcttggatcttgggccttctctgaattaggcacatatatgggccatgaacaaataggaatttatgaactcgaccgtgtccatgtggattttttctcttgcaatccagcaagtccctcgcgtggaaacgacgaagtgcatgcgcgagcaggccgagatttcgcaatcgtatgaaatcttcccagcgaggcagcggcccagcgtcgcgccgctcaaagcataggactacttcaccaatcacagccacctgggagctgggaagctttaggcattcccaagaggccccgggatatgtttgagtaggttaagattttaaaatgcagctgctgagaatctgaagaagctaaaaacccgcttctagcttttagttcatttttcagattctacaattacagattctcagaatctggataaaaagctgagctgtttgggtgagcttctagcaactggatattcttggataagctgcagctgctagaagctcccccaaatagaccagcaaagcgctatttgagtagtgcgtaattcgaaatcgattttactactctaaaaatataacaacttttaattataattttgaagctctggacaataagtactgctatacgtatgatccgattatataactagagacatgtactcataaatcaatcaaaagatatcatgttataaccgttaatcaaatttagtcagacagatatatcgtatgcataacaatcttcatgaacaatacatttaggatgatggtaacactacatttttttgtcgccatgtttcttggtcagttacagttaatttgtaggccatttaggatgcaggtgcagctcagcaaattagacaacacgtccactctagttcaagcaattagaagcaacgttcgtgacaacaagttggctagttaatggttgtgtttttccctccttgtagcacatgctcacttcttctcgagcacaagagtaagaataaggggatgttaaaattttagccaaaataaagcttatcaaaatttttggtaggatttcttaagtgcttattaaagtttagcaaaaaactaaatgtaggaacaactttagcaactttactaaataatgttatggttggaaatgatattaattccctaaaatttagagtgtaaatttgagaatttacgatgcaagttttgaaaactgattatgtacttaaaaatataacgacgccataaatatagtgatctcgttggaaaattagaatgagccatattttcgaccgtttctttgtaaaactatggtgccgtgccgtgccgtgccataataatgtatgtctgtactcccagtatctttgtgttagacaaaaagacgcgccggtaaaagatagtagtacacccctctgaaaggaaagagatgactagtacagtactttgatatgctttctcatcgcacgtgaactcgtgactcaaccagattcaagaggtagcgaggccaaagcagcagtactcgtaatcgaagaaggctgctagtgctagcgcaggtccacccgggacgtcgcatacgcagcgaagagccaaacgtattcggtcgacgaccagcacggcagcaacgggccgggcccgtcgtcgcgaaagcagaacggctctaatgtcttgtcacccgacgtgccatgccaccccgtgtaccgcccccattccatcacccatcccatccacatcccacaacggggaggggaggaggaactcgcctgaaaaaggcggatctgggcccgcgcgcccgtctccctgcttggctgcttccctctcgttccaaaagacgagcaaagggaagagggcagaggagtactactactcctgcagtcctgcggtgcgtgagctgtgcgtgggccacggccacggacacagcagcggagcgggggacgttcccccgggatagcagccgagcgcgccgcctcgtctcatcactcggccggcccgcgcgagattggctgacgaacagtggctcgcggccgtgcaccgcatgcatgcagtggcgctctgggctggcggcatcggctgccgcgccgtcacccatcgctaggtaggcaggcaggcacgcgtagggggaaacgggtggactctggtaaagccgcacgttgcctcacgggctcacggcaagtagggtacgttaccgagtaggaggagtaccagcaaggcagggatcggcgcggcggtatcattgttggtttcgttgctcctgcatgctgtgcgagtagcctgcgactcgcgaactcgcgatttcgcgagtggtcgcccggaggggcccggtcggatactcaacgattattgaatgcacggtgagtattaaaaatctctgaaaagagtatactgttagtaaaaaaaagagagagggcatcgtgacagagctggtcagacccgtcgactgcgtcgcattgaacggcatcgtgcaaacgttgtatatgctcgcagcctgggcattaataacgtgcagaagtacaacactggtcgtgacggccaagagcatcaattcatcacacttgggtaggctgtcccgtaaaacagagagcgtcaaatgagacgcaatcaacacaagatgcttccactgtatgcttgtttcatcagtttcgcagatgaagcacacccaggtaccaacgcatgtactaagcttcactttaccaccatgtgttgatgaaaagggtcggaatcgcaccgttctgaatccatccaaagcggaactgtgctaagaacagatgacggcactgtgcttccttttctttccacgaggcgctggcggtggcattggcatcctggtgggggaacagtgacccccaaagttgcagctgccagcactacggccgccccacagtagccagtaaacgcgctgcagctgcagcacgcccccgcaccgcgccaagggctaaaaccgaagtgaaaaaggaaaccgcgaccaacccgtcgcctcttcacccgcaccgcaccgttgcagcccgcccactcgctgactcgctccagccagcagcagcagcagcagccactgctcgcgacggaacagacgacaccaccacgacgcccgcgtcataaaggcatgggcattgtcgcaggctagccacagcgacggggtagcagcagcatcagcagcagcagcggcaacagcgaccggcattgatagcggcagctgaggaaggaagagggcgcgcggtcgccgcaggagcggagcagggggggcatgggctgggcgggctgagcgctgagcaggagatggctggagagcgacgccctcggaggcattaatggcgtcgtccgcatcctcctcctcctccccatcctcgcggccgccgctgatggctctcccctctttttaccggcccccttggccgtccgagaggggcggcgagcagcgagccaccgactgttgggccggatccccagcggcgggaggcggccgggcgcgtgccaccgccatgggcatcgacctcaacaacaccgcgagcggcggcgaggaggacgcgccggcgccggggccggtgtgccgggatctgtggcacgcgtgcgctgggccggtggtgtcgctgccgcggcggggcagcgcggtcgtgtacctgccgcaggggcacctctccgcggccggcgccggcggcgggatccgcggggaggtggcggttgccctccctccccacgtggcgtgccgcgtcgtggacgtcgagctatgcgtgagtgaaccgctgtcgctcgtggtagggttttcgctgtgaggccgcgcgtggtgggctgcatttacatgctggactttgtgcaggcggatgcagcgacggacgaggtgtacgcgcgactggcgctgcgggcggagggcgaggtgcaacgctgcttcaattatcttattgattcatgtgcttccgggattggggattggatgagattcttgggggcgtcaaatgttggttgcctgcatcctcttttcagctttgggcgtggcataagctgcaatgtgatgggtgttgaatgagctttgatttttattggatgtctaaaaatagacattgttggttcattctaattttagtgagccacataatttgggacttactagatctacttggccagcttgatatagtatgagtgccgttttctctgcacaatgtagcttcatttagcacatctatcatgcctctaatttgtatattgtaccgatacgatgaattgttttggcataacaaattctattaacagatttgatttatcaatggtacatttggttggttcaggtatttgagaggaacttgcatggtggtggaatcgaaagggaggatgacatggaggatggtgatgaggaaaggaagtccaggatgctgcacatgttctgcaaaacactaacggcctctgatacaagcacacatggagggttctctgttcctcgtcgggctgctgaggattgctttccacctctggtgatgagattagaagtttgatttgtttcctattgactcttcaagtgactgcttgtcttgtgatgtaactctaacgaagtttgttttctttcgtgccttaataggaccacaaacagctaaggccttctcaagagcttgttgccaaggatttgcatggagcaaagtggaggttccgccatatttatagaggtgacatccgagtacttgataagggatatgcaatgcccttgttacacaatctatttatttaattgctagtaaatgtttgatttgatacctttgtatcggaaacttgtacgtcatactcatgtttgatgatcgggcatatacagagcattgctaaattatgtgtgactgttttagctttgaaagaggtcaggaagtattttagtcaatgctacaaaatatatggcaggtgtagcttttcaactctttgaatgtttgacattctaagtggtcagtagttttgcctgtctgaactgcgcgttcagtcgtctttgccattccctaggatgcaaattatttccttcctagttcatcttctgatacaatttatgttattcttttgtgacttccatcactttgttatatatggtgtgttatctctgcagtgaaaattacttctgttaataaaactgtacaattttgctcagatagtagtgtccttgaaacagtggatagaggatgctctccaatcttattgttgtccaagccaatatctccattttgattacaagggaaatgcacaagttatcttgtagttatagcatgtgatggagcaaagtatgacattatgaatttttaacattcttttcattccaggtcaacctcgcaggcatcttttaacaactggatggagctcctttgtcaataaaaagaaactggtctcaggggacgcggtgttatttctccggtaatcacttgatccaggtgttaaccataaagctaatgctttcttgtctatattttctaacgaagcattttaagcgtttgcaggggtgatgatggtgagctaagattgggtgttcgaagagctactcagcttaaaaatgaagcgattttcaaagcttttagtagcgaaagttcaaagatgcgcacactgtcggctgtggctgattccttgaaacatggaagtgtttttcacatttgttacaacccaaggtctgctgaataaaacatatagtgtttcattttgtgtggtccaactcaatacaatgtcattttctctggggcagttggactatatatccattcacatattgtaatcattggactttgtagggctactgcttctgagtacgttgttccatattggaagttcgtgaaaagcttcaaccatccagtttgtattggaatgaggttcaagtttcattttgagagtgaagatgttaatgagaggtttgcatttttcagttgaactatctttttttgtttttgcataatactttcttgggtcttactatctgtgttgtaggcgttctggaatgattgccggtgttagtgaagtagaccccatcagatggcctggttcaaagtggagaagccttctggtatgcatttgagctgcttttttattaagcttgttgactacggaacattaacttttggctacctgccaagtctttgaaacatatattagggcaccacatatagtcaatttcagttactgttttgtctatcggattaaatgtgaggttatttcacacattaaaataaattcatcaagttagctgaagtgctgaactcttgaatatgggtgcaacatccttcttgtcaaactcaaattttgaatccaagcctgatcttgtggagtagagaaattacttaggatgttctatgatcttttgtttgtgagtaaatatgtgcaaacattaataaatgctcaagtgagaactgagaagttgtcgaaataaattcaatacgtaataaaaatggtgtgctataaaaatgattagatgatttgtatcactttgattcctacattttgcagtctcttgcttagcccacattagtggttgggacaaatcatattagtcaattgggatgatatatcaagaataaaatgccaacccatctaaagggaatcagaacaaatggtcttgtaagtccttgaggcaccttaagacaaatggtcctcgcatgcatttctttttcacacttctgatcccaagattcccatgtaggtttaccattagcagatgtcagatagagaattgtttctgctggagtaaaatttcttaagtatctaggcttttgtagtttgagaactttgtagttcctgcatttctattaatagaaatggggagtttggccccttgataaaaaataagatagagaattgtttcacgcatatttggattgaaaaggacaataatgatgtaggatgtgtacaatctgtttatccgttttgctgtttataacatctggttggcagctaaaaaaaactctcttgatgaggaatttcgttggtcttctgccagttgccaatgtttgtcgccctatgccgcccaatgaagctcattgagcacacaggagaaacaaaacagtgaagagaatactagaggcatgttattattgcttgctaatatgggctggaacttgtttgctttcataatgtaagctgtaaggatcatcaaagttgtgcaaaaccaattatttagaggatttactaactgtaaccatatacattttaatgctatcaacaccttttatgatggcatccatgtctgtttaggtggggctaaatattttttattggattggaccaagaccacattatcaaggccccataggaagcctaacagcttagaatttttatagattttgatttgtccattataaatcgtttatggtgaatctattgtcaatattacccaaattcgctaatgttagcaatttgatttgctgtcttttcatacaggttcgatgggaggatgctactgactgcaacagccaaaatagagtatctccatgggagattgagatagttggtggttcaatctctgttgctcattctctgtcggcatccagttctaaaagaaccaaattatgccctcagggcaatttggacgtgccagctctgtgtgagttccaagagcacgaggtcaatacttggatctataaattctttaaccctatatgcttattggtttttgtgttaatcctgtagatggaaatggtcgtccagactcggtggaaactgaaaagttccccagggtcttgcaaggtcaagaattgatgggttctaggacccatcgtgctacttgttctcctcagtcaatcgacattacaaaaagtaagtcttttgatgcttggagattccttactgatacacgaagctgcatgttgggcagttcaacaagcagacttccagtgcagtactctggctatacccaccaatctgtaagcttcggtgaatctattggattcccagaggtcttgcaaggtcaagaaatttctcagacagttcctccgtttcaaggaatgttgcctgatgcatgttcagcgaaaagcagatatgaattaaagaattatgtgtgcaccccagctaccatgaatggactatcatctgcaaatgaaggatattgtctctccctgtcaactgtgccaccttctccaccttccagtcttatgttataccaaacaggggtaccacagcttgaattggcaagcaagaacaatgacaaaagtggaaatgacagccaaccagccttgcgacagcacaagttgctcagtgaaactagctgggaccagtttaaaattggaaaggcttcaacacctgggaatgctactaagcctggtaatggtggaagggaggttgacagaactagttgccgcctttttggtttttccttgaccgagaagattatcccaacagacaaagatggtgaaaaggaagtgagttatgaaactgattgccaaaatccacggatgctagacttgtttgggtacaattgcagtacgcctggtgctcttcatgccctttgtgctgctcctttgggaatatgatgctacttgagtaactggtatgctctagttcttccttactgctgaaaattcacttctcctgtacctttggacctcgtactctaccattatccaaaagctaatttggtcactgacatttacacagggagggatacgtacatgtggagacgcagccactccacgcttcatcccagatgtaaacggcatcggtctggttatggtcccaccgttcctgatgctttgcatgtaggtattgctgcctcacgcctgaatacctacgtgcggtcaggcgaataaagcgactcgattgtatgtttgactgcagctctagctgtcgagtcggaagggcgatgatgtttatcgtcgttaatgtaccatcggcaccctgtttatgcagaaatgtggacctaattattatgaacttatttccttagttctatgtatggttagcttctgatctagacctagttatgagcctatttcagaagtgctatgtatggtttgcttgtcaacatttgtttctgtatcggtacaaatcactatgtttgtatgtttattatgcacttcttttgtgttttaacatcagatgcgttccatatggatttcgtttatttccgccattgtgatgtatacccggcacaggatccataatagagagggaatcgtgggctagcttctgatctagacctagttatgagcctatttcagaagtgctatgtatggtttgcttgtcaacatttgtttctgtatcggtacaaatcactatgtttgtacgtttactagaggtgaacgcgcgcttcgcgcgttgcaccagtggtgccaggagagggaaatcattgattacatctgttggttctggtaggtaactgaaacaaatgctatttgcaaggtctgtgaaggtcaagtataggctaacgacatggtgtgagatttaggtttagtgtagtgcaaaaaatgaagttttgtgacgtgagcatttatattgatagttgttatagaggctaaaagctaatcacaacatatatgcagattgtggacagtcctaaatagcaaaatgtgccacatgtttgatggcaggatagacagtacatagtagttttatagtggtagcattgaaacagagcacataggagtataggactataaaactatattacacatggctaaattctactaatatggtttggatgccttcaccgaattcacacaggggcccttttgttgatgtgcaaatggaagtgcaatattttttgctatgatgaattgcttctcccgtgtacatagctgcctgagaagtgatgcaaaaatacaattttttttatcaatactggcagtcaataatcttatggcattgaactactcaacaatattagaacaattaagcatccttgtttcctagtaatgttctttttctgaatgtgaaaaaagcaagttaacatagttgtttttttggtatatattcagattgtaagaatcaaagaagcaattgccgatgtcaagtaatctgtgaatgaattaactgaaggaccaccagcaggtacaaatttagccgaatgtgaagaaattaattaaacatctcaaatagcagggggggcacaaaaaggtaccaaccaaaagcaaagtaatgatttatccatactaaaaaaacaaacaggtaaacaatccaaactgttttcagtaattttctaataatcaggtatgtgaaccaaataatgcacacagcagcatatttattcagcaaagaaagttggaatggatggtattgtaggattgtaaaggtcaatctgtcaagttaacctattggtttctggttgtacatcttttacatagattataaaaggtatgtgattttaatacctaaatcatagcaagcacaataattttatgagcagatactatcagtatgtttaaaggaagagggtgaaagtgcaagttagtcaaataatacataacttagttaaaatgggattttaacctacagggcagcgctcatcgtcctaaactgaagctttatcatcccaaaccaatagttatattatcaatagtcctgaaaaaccacttctatggcaagagcaaataataacattagtcgtttcaaagaaaacttcaattttagaaccctaatcaagccaatcttttatatgctagtctaagcattacctaatcatcacatattaaataaaaaaggacataaatattagaagcattaggtagaagattcaaagtgagctgcaataaaaactggatgcatccaatgtagaacatgagaagcatctgaaggacaagtcagttacatttgtaaaatatcataggcattactgaatgcaaattagaaaacaatgtaacatcattttttttatatcaagttaaattctgttgcacatcgtggggatgtcatgataatttaatatgttcagagttaatgtctattatgtcatgataattaatttttttatagagttaccaatcttcagctataacttgcaacagaattcttgttcacaaacaaccaaattatagaactaatatatgcctatttggtaaacagataatcaactaaattttcacttccgtaaagaacatgtcaaatataatttaaacggtgaactcaaggtaggcaacgaacaacgatcagccaaactggttgccagtggtgccatttctcctcctggaggatggcaccaatgcaggcatcctttgttctgatctactatgttgtgtgcacctggagtcttggcgtgttaaggcaggcatcagcctatcatagcctagttttgctactgaaaccattgcaccagctaaagcctacaagaataagagaagtggacagctatgccagtcctttgatcttgcaccaatccatcatgttttctttggttcttctcatattattcgcaaagcaataatgtaatccattgtaatgcagcagctgattggcgttgggaagattagatagcttagaatagaattgaagctatagatggattgtgcaacaaattgagataaattgattttctattgttaggcgccggccctaagtggcatagcgcgtagctgtgctcgacgggagggcgaggacgcacgcctcacctccccggagccgtggtggaaactaacaggaactgggattaacttctttcttgattaatcacttaaaccgaatggcctatataggcttacaatggaaaaccaaacagctactaaccaggaactaacaacttaatcttcctaacaaacttaatcactgaaactaatcctaacaacttgatccaacatcacggcgcctgctctggctgttggcgtcggttccggcgctgatactgaatgccccacataacatctatagtgcaaaaagagcagacacatagcgagctttagtaatcacatccaaaaataatacagagaaaattacagttcattaatttatttttggtgcaacagtaatatacagttctgatccagacctgtataacctttatcaaatgcacttgtatatttttggtacaacagtaatatatagcagcagtagtagtgattagtgtgattagtgtatacgtttagtctcagattctgcatgtaaaaggtcatctaatgtcaagttacaaacatgctcgttataaattaattttatagaagtcactaccttcaaggggcataattagtaatgaacaaactaaaaatgcaaagccacaatctattttgatgaagatgcatgactacatttggatggagcattatcaaattattatccacaaaaaatattgtacattgctatattttgctggaacaaatcagcatactcatacttcaacaaaagatatatcaatttcttatacttggaaacaaagaatcttatgcattaactcatttgtaatttaaagtcatctgcatgctacaatggatcgtagatgaaccccttaaagaaatgcacagccaaattgacagcaacactaccaaagcaaagctcgccgccatcaaagtggggtcacattcggtggagatgcaacctggttgtggtggcagatgaccttagatgctgtgccagaggaccagtagggcagcacggccgtgacgcaaggggatggaggtggcagcatcctctaggaaccccgcgccgatgcccttctctgctttgcgtaagctcaacaaagcttcactacaagctgcattcacacgctcacattcatagtgttacactgatttaaacttgcaaagaaaaattcaatacacatatcttcatcggtccaaattaatcacagtatcacactaagaccaccaacttggcaaagatataacatgcagtatgaaattccagaggaaactttcctctcctcacctccttccaaaaaggcagaagaagaggtaggatggagctgacgaggagccctccatgcggcagatccagcagcacccgccgtactggagaccgccgctgtccgaaacgggacaccaatgccacagatcatgcagctccctctccaaatcggttcaccgacctcctggatccagtgattccccgtctcctcgacgtcccacacgcacgtccgtggccgcctaatcgcaggcatccgttgatccggaaatgaacaggatggagagggagagggagagggagagaggggcagtgccgggcatagaggtagaagagtagaaggcggctcctggcttcccctcgcttcagggcggccggatctgccggcgaggaggccggagtcaccggatccgacagtcccggcctcctcgttggcggatgcggtgcgggagcgagaggatggcgatggcaggacgacggcgcggcgacagcaacagctcgcagtagggagtgcgcgggggaggtcgccaactgcgggaagaagaggatgaggggacggcacgcggcggcggccgtcgcttgggcaggagagagagcggagcgagaggagaggaggcagaggaatggtggcggctagggtttggggaaaggggtgagggttgcaaaaacaacccctaaacttctagttttcagagcgcggttcaattttccgttttttcgcttcttcatatagaatattgttttcttaagaggtcctctaagtaagagcgcacaacgttagaactaaggaccagggatctataacaaattatcaagtaaatgaagggtgtttttgcaaaatcaccaacgacgacacggacgtgcgagagctcacgaaaaccacccgccatccagcgcctcgctgacgcgtcagcacgcgcaggtggccacgccagctcaaaaatctccaggagccgcaaatctcggcaggtttgtatataagcgattatgcacttcttttgtgttctaacatcagatggtttccatatggatttcgtttaccttttcctccattgtgatgatacccggcacatgatccataatagagagggaatcatggtttagctactgatctagacctagttatgagcctatttcagaagtgctatgtatggtttgctcatcaacattagattctgtatcggtatacaaatcactatgttttgtatgtttattatgcacttttttgtgtttttacatcagatgcattccatatggatttttcgtttacctatctcaccgttgtgatgtacccggtacaaagatccataatagagagggaatcatgggtaaacctcgatgacggaccggatgcccaggacgtgcaggatcttgtagccgctgaagcccgcgtcatggaatatcttgcaaaactcccgctcgtcgcgctcggggctccccaccacccccatcatcatcacgtcccacagcagctgcgtctccgtgtccctcgcgccatctcccaagctcgacgacgatcccaccaccaggtccatcacgatcaccctcctgccgtcctccctcgccggcaccgcctccctgcaccgccgcagtatccgcacgcactcctcgtccccccacccatgcaggatccactgcaaaaatagatgtcatgcttagagtctcatcagttggcctaataaatcaaagtaaaagctaaaattaaatttttaatttgattttaagatattttaacgtattttttatagttggcttttaagttgataggaacaaatatataagaagttttacatattaattaatttctattttctgataaatcgtttttggtttattggaatataggcaagcaattgcgaggattataggagaaggcgcctgtgatggtgtgaccttgaggaggacggcgtcggccttggggacgtggtcgaacatgtccccggcgacgaactcgacgcctccgtcgcctggtgggacggtcgcgacgacttgcggtagttcgaggacggtgcacctgacgtgagggaacgcggcggcgctggccctggcggcgccgccggacccgccgccgacgtccaccagcgaagtgatcccccggaacagctgcgcgccgccgtggtggtggccgtgcaggagcacgtccatcacgaagcggccgtcgcacgccatggcgtcgttgaacgccgcgccgaaccccgggtcgtccttcgccaccgcccagagttcgcgcccgccgtggacggcggcgaacggcacgcgcggcgcgtccgctccttcgtcgtcgtcgtcggcggcggcggcgcggaaccacgaggccagagagatggacggcgacacgatgatggggtgcagcatggcgcgcgcgaacggcgagagcccctgccccgcgcccccgggcgcggagacgaggagacgcgagaccgcggtgagcccgtaggcgtcctccgcacccgcggccgcgtcgaagatgccaccgtgcgcgagcagccgcatgaggcggcgcaggaagggcttcctggagcgcggcagcgcgagctccgcgacgagctcgggaaccgtaacggcgccgccacggcggtggacggcgtcagggatgccgagctcgacggcgcagcggagggacatggacttggtgtacgcgaagatatggttccacagctcagcttgggcccggaggagctcgtcggcggcgaggtcggagttgcggctggcgtccattgctcagctgctcagtgtttggcccgagtgattaattagcttttggttccgtagtcaaacatgacaactttaggatactacgaaattatgaagaatcctatattcttgcctccttcaagttgttgggttttgtcttcattgtgaaatcgcatttcgcatgcatttacaaggagaaggtgctgccgaaatccataatgcttaacatgcaagtgctgataaaaaaatgttactagtagattagctctgagtgatcaagtcagaagtcaaaaagtagttacttaagttgtttttctttactaacatatcgtgcatgtataagtcgcagttaaaatttaaattttaaaacctaaacttcaagttgatttaaatgttttttttcatcatattttacttctagcctaaacttttaagttgctcaaaatcagtttgagtaaattttattttggttcaacttttattactgatgtttcattttgaatcatcgtatgagaaatctttttttaaaaaaactcgtatattaacttgagataattggactcctaattacagctcgtgattttctaacaaagtatatatccaaacaaatttaacacggtgaatttcacattaactaaattatatcaataataagattaaaatagtcttcacccgttacaacgcatgtgcattttttatagtttaagaaaataacatagccttacggtccagtaaaccttctttgggtaaaagtacattgggggacataagggtttaatctttcggttgggctatttgtatctgcggtggccgaaatattaaaattgtatgaattttttaatacaatttgatcaaatttaaaaaaaaaaccaaattcacgaaaaaataaaaaaaatgcggccgaaataatatggtatcggctggggcggtccgataggaccaacttcggaaatttcgttcggcaattttaaacccgtagtgttagagatccaaacaaccacaaaattaaattactggagtagtagagtgctagtagaccagaagaggggagtcaaactcaaaagtgtatcaaggataagcagccgaggaaaaggtatttgacggaagcctgcgatgtctgcggcgccggctgcgagcggctggttgcggccgtccgcgaccgcgcggctctgcgaggcggggttcttcaccgattacgccaaccccgccactacgcggatctgcatcggccggaggcggagcggtgcgccgagaaacatgtgagacccccttccttgtctctgaatctcagatttttgggggttgattgcttgaactcacgcctgatgtacgcgcgcggattcagtagtggtaaccccacaagttcgattttgttggggattattgctgttctcaaatgcccctttcaaatttcatcagttttgggagtaatttgttggctggatgggagaggtcgtacgtttagatgaggaaaattgaactatgcaggtaatacgtgcttggtcaaatacgcgcttaggtagatgctaaggaccgtatgatatttggtgaggcctatagaagtgaattttgtagcttgcaaatcaaatatcagttgttagtgcatattcagttagttgttctaaatcccaagttgcaacctccaggtattgaagctacttgctgaaattcgaggctagaagaaagatcattgataatatttgcatcatagatttttttcagttttcactataaaaaggaaacctgtgttttcttcagaatgtctaatatgttatcttcagtgcagggcttcaagttgcatcatccaatttgggccgatgcaaaattgctcatgttaaaagtggagatgctgatggttacccaacgactgaagatttgtcaattgacgaggaaaccctgcagcgtaatttacagacagccatccaggaagaagattattcccgggctgcaaagataagggatgatctgcgcatcctccatgaagataccaaagcttccctccttgcagcaaacacacggttttacaatgctttcaagaatggcgatcttgcagcgatgtactctttatgggctaagggtgaccatgtatatgttatccatcctgctgcgggtcggatatcaggttatgacgtggtcatgcaaagctgggagatggtatgtggcgcagattatgagttcccactaaacattgatctgaaaaatgtagaggttcatgtgcatggtgaccttggttacgtcacatgcttggaagtggttaagaccaaaggaagaacatgggggaagcaagtcgccacaaacgtcttcgagaaggttgatggcacatggcgcatgtgtgttcaccatgcatcacacatagaggaatgaaaaccttagttgatttggcatggaaattttgcagaaaagctagacaggcaatacatgatttcgagatttctatcttagcagctgcatcattagtctatgttttctcgagtcaattgtatcgatgcttaagttttcaaactgaattttttgtggtttcgtttgagattccatagtggttggcatattatgtcacttgagattatatatgactagctatttttccatttctttttggcggctaactgggaatggacttgatctgcaagtaactcgtaccaggctacttcactgaaacaaaacctgatttgtcaattgtcatgtactcatgcttcttgttgtaaactgagtcgtctggttttttatatgctttactttctacagtaaattattagcaatatattttaccagattcaggaattgacaacttatcattggacaatttcagcagtaactttgtataggacatctgcttgccctccggtctacatgttgccctttgttctgctgtttcctggttatatgggataacatgaagtttccacgctgacaaaatttgagataacaaaatcaaacaaagacacaaaaaaaaatacagaaaatacttcctccgtcctaaaataaaccaacgagtagagttcaggattcctctcactttctacgaagttgtttgatctttgatcttctctctttctgatttagggcgagattatcacaaaaaggaccagacgcgaccaccaacttggccaataagcctgaaactgaacgaccccccctcctcctgctcgcttccctctctccttcctctccaagaaagagccaactaggcgagcggagcgcaacaaactcgccaacccgcgccgcgtctcctcctcgtcgtcgcaacccgcagcgcgagcgcctcccaccgatcatacgaaccccaccgccacgtctactccctcgccgcagcgcgagcgcgcacggagaagaagcaagcagagagagagagagggagagggaggggtggcgctgcggcgagaagtgatggtgctgccattggtgaagctcgggtcgctcgcgttccggacgctgagcaagcccatcgcggcccgcctcaagcacaacgccgggatccaccccaagttccgcggcttcatcatcggcctcgcccaggtgacgtctcgtcttcatccctgatcatctctctctctccgcggctccgccctgttgatgcttggattcatagattgccgcgtcgcctgggtggattgaactgcttgagcggttttttttttccgtaagggcggtttggactttggagatttgaggatgttcctccgagactcttgggtttattttgttgggaactagcgacgtgtggggatgtgtatgatgaaatgcaaatacgaaagtacgacgagctagttctgaacttctgatgctttttggtaaattaatgggttgtttcattggtatatctttacattggacggttgcgtttatgcacagttctggtttggttgcagtattctgtcatggagctttcaggccatgatacaacagtgctttgtaatggatctctctgtttttgtagcgagttctggatttttttttattgagtcctacaaggatctgcataactcataattccgctttgatctcctacaaatgtacattcatctcgattgtttctgcaacatttatctgaggtcaattatttgatgtggataaatgtcagaaacacatgttagttattatggattttggtgttcatatcaagtggaataatctgcagcatttacctgaggtcaattctttgatgtcagaatcacatgctagtaattcatgattttgatgttcataataagcaaggacagtttagcttcaagctttgagccagattataatgattccttacgtctgttattcagtaatacatggcttctgcaacactgaggaaacaatagccatgatccttatctgttcagagcaccaccaataattcacattacttcacaaatctaacctttaaaatggattctgcatatactgatgatgggtatatttcaaataagattgatcagaaactatgaatacatatgcatatactgatgatgggtatcttccaaataagattgatctgaaactatgaatacatctgcatatactgatgatgggtatctttcaaataagattaatctgaaaccatgaatagataatgctgctgctcaatccttctgtagaacatcaaagaattttaggctgagattattggcgacctgagcacagtaaaatggatgaattcttcttatcctaactcatgcatgcctttgttttagtttgagcagaaaattttttttactactgtactgacaaggtgtatggcacattatgttcaggtaaaccatcgtttcactacaaacatgcagaggcggctttatggccgtgcaactgacattcacattcggcccctgaatgaggagaaggcaattcaagctgccgcagatcttcttggtgaactatttgttttctcggcaagtactttgatctcagttattctaaatgagtttttgtctgttaataccagaaaattctgaacattttactctgaaatgctataattgaagagcctgaaaactggttcttccagaattcttatttttctctaacttcctatgctcgagaagtacttgattatgtcaaaagattacagctgacatgaattgtcacatgatttttcaggtcgctggtactgcaatcatctacgaggtgcagagaagtgctagggcagaagccagaaaagaggagatccgtaagcaggaaatcgaggtaacatggtatcatgcgtagttttttactgtaatttttgcaatacgcaagcgttctgcagagattgttaaactgtctctgttcttgaaatggcaggcgagaaagcagaggatagaggagctagccagtgaggtgcagatgatgaagaagaggatcagtgagatcgagcggcagcaggacgagagacgggcccttccgaactcccgcggctccaccactgccactccgatgcaggcagcttcggcggcagcggcagcagcagcaaaggcaaagcatcagcagcccacggccgctgctgcttagcttctccagtggtactgtccaaagcccataggctgtctcccctgccctgcatttcggaaggactaacgcagattgattgcccctgttttcctcccatcccgtagctcgattcgattgtagttattcggcgaacggctggacttcttacttgttgcgctcgttctgagttctgaccttgtgaatagcatacgtgagaggtcggtgtttgctctgagctgaagctgttggtgggcggatcagtgaccatctggctcgaagttttgatactgttttcggatatgctatagtcaagtgtacattgcagtattcttgctttgcttactgatgtgcaagactaagtacctgccattaacatagctcaaaaggcaaaatagcctgcatcccctcattgttatttcaccaccatttgcattttctagcaaatgaagtctgctttatgtgatgtttcatattttcttaacactaggaaacaaatcccggacagcaggagttcagtgttgtattataggtgatttgactacttttccttgtcgacttaggcttttgctgaattagttaataaatctaacttaagtaattagggctaaattatcattcccaatttctttagtgcactagcgctaccgggatcgaatcatgcttttcacctttcatgtactcctaggagggaaagaactctcagcagagatatatgtgccagagtaaaagatgaaatgaaaatttctttcgggcctcacgttattgcttactgcatttccatgtatgacaaatgcatcttgacaggacgaccaaattttgtcaggccaacaaaccgatacatatttccaaaatagaggtaaagaaaaaggagaaagttcttacgatttacagacaggtgcggttcttctgttcctacaagagaagaatcttactaaaactagtcaaattctaaaaccaccttgccaggcaccagccttttctccttggcctcgtgagcttctcttactttgctgatgggaaatgtcttctccaccggtatctgcaatttcccagctccagacagcctctgtatctcatgaagtccttcagagtcagctctcatgtatgtccaccaataatctgatattaaatttgtaagaaacatgagaacgtcttgtataaacaatggaataggtcatatagataacttctgtaaagcaattcatccctaaattaaatacaaaggtagacatgaatacaattgtatatcataagatcgcatgatagacacacatatcctgatcatatctattaagaaacaaacaaattgaacccttgtagaattaagtcgttaaccaaacactgacaagcagttcacaagcaatcgacaccaatggtgaccaacttagtcattattaatcacttaagtgctggatctaaactttaaagagcaggcggcccactgctatcagcctcaactcgcatgtatgcagtcaagaattcaatgcatcactaaataaaaatgaaaatattttatattcactgtacatgtatagtttttctcttgagggttattttcaaagctactgatagtagttattaagttgttttctgcagttctgggaaatggttgggatgtttatgagcgaaatcgagtaaggttgcatagatttgcgtattgatctaaaaagctatctgagagaccaggccatgcttgttggattttggcaaaagcaagccctgctcttcgccagttagtcagatactgaccaagttctagttggtgcaagtccacataaataaaggccgtgtttagatttttttttttttgccaaaaacgtcacatcgaatgtttggacacatgcatagaacattaaatgtggacggaaaaaaaaccaattgcacagtttgcatgtaaattgcgagacgaatcttttgagcctaattacgccatgatttgacaatgtgatgctacagtaaacatttgctaatgacggattaattaggcttaatagattcgtctcgcagtttacaggcggaatatgtaatttgttttgttattagtctacgtttaatacttcaaatgtgtgcccgtatacgtcaaaaaaaatttggacagtgaactaaacacagccaaagttttttgccgggtaaacacagccaaagttttaaagtggaaacgtagatagtctattagtctatgaccagctactataattaaagcaaaatatatcccctcaagacacaataaattacccaacaaaaagaaaagattatatgaatagatacaaacctattccatgagaataacggtactgcatttgtttctttagtaaaacagcagtagcagcaggaagtcccacagctaatccatatctatctgctagggcagccgcctctccctatcacaaagaaggatgatacaataatgaacaaatgacaatcaaagcagaaacacagaaaaaattaaaaggggcaggttgacgacctgaagggtcatatagtgtccgcctctcctcagaacattaatgccaattctctcagtttcaggtactcctatggtatccaacacggcatcgaactttcctttaactgctgattcagtatcctgtaaggtaaaccataaaatatgaacattatggagacaatggtactcatctagggaaatttcttaaagagaaaaaaaaaaacaatctacaggacaattagtgagctaacaattttatccaatcgcagaaatgatctatatgccctgacacaaaattcactaatgttttctcactcatggagaataacggaaaacttcagtatcctctcctatatttaccaggcacaaagaattagacaatagctcaaagccacatataatactactgagcaataggactgttcgttccaggtttctcccaacccgtctaaactgtatcgtgttggccactgatgctgcagtcacaccaccagccacaagcggcaatgagttgcaagttttgaatgatgttgaaaaccggttcaaacactcttctgctgtgcagtagtactaatatcattccctgataatctataagtataaagtactatgttttgtattgatgcaagaagaaaagaaaatagtcacattagacctaagaaaaatgatatgtcaagtgtaacattgcatatgtgtagtcttgtaggagaaatgaaagattccacagctaagaagatgaaaaactgctagctgctatcagttctgtgcatagcttcacagtgcaaagtggatgaataagcgattcagagttcatatgtctgcatgtaagcatgagtttatcagataatgtggtaacagaacaacgaaccacaacgactaaacaacatctaaggcaccatggtaccattaaatatccattcctgctgtgtaacaatcctatcttagcaaagacaaataaatatatactccctccatttcatattataagtcgctatgactttttttctagccaaaattatttaagtttgaccaagtttatagaaaaatatagtagtagcattttcaacacgaaacaaacatattatcaaaatatattcaatattagatttaactaaactaatttggcattttagatattgatagctttttctataaatttgatcaaacttaaaaaatgtttgactagaaaaaagtcaaagcaatttataatatgatgaaacagatggaatagatagctagacatattaaggatatggtttgcctgcgttgataccgaaaatagtgcaagggcaaaagaattcactatatcatcatcatcgtaaagaaaatataagtacaagagtttggacttctgaaagcgtttacctcagcagtgtaatcgatagctttttcagcaccagcggccaacacttgttcaatacttttagttccacaggttgcagaaacgctacaccctgcagctactgcaagctgaacagcagctagcccaacagccccacctccaccaatcacaagtactctttgtctaaaacgaaaattaattgcattcagttcaaaaaggaaaggtgagcataacttcaatatgtaaccactcaaccagacatgaaataacattttactgataacgaaaagcttgtgctgtgaattggacctaaataatagggttggttttcggattgactacaagagattacaacttccctgcataatttatatttatataatagaacccgaagagagggaagtgtagtgcagatcaccattaaaattaagaatttacatatgtacctagatatatgtgaaaaaaatctgaaactttatgaaaggagatgaagtaacttttgtagtagtatgcttctagctgtctgccgcacaagcaaactacgaggagcacactttttaataccaaacccatttaaaagtcactaattacatacttacctaccatgctaacaatccaataaattaaaagtaaaggtagatgcaagttataggaaacagcaacaatggcaacaaaaagaacttgttgtctgtttcacaaacagtggcgtataaccagacatacccttcagaaattcgagccgtaccatgtaaagcacgccatgcagtcaaagcagcaaatggtatagcgctagcctcctgcaatataacaaaacttgattcgattagcttgcagtatggtatttttttcacatacaggtaacattggaaaccaagtcctgagctatctacttaagaagatagaaattgttctccccatcaataaacaataaacatgaactaaaaccttttagaactttcattaaaaagctttcaaaggatgggtttttgtttaaatctacacaaaggagttcctatcatcatccattagccacaatgcctgttaaatacaaaaatatgatgcactgttgtacattcctgaaatggaataaacatattgcatacatccagggaaaggaccaggtctgtccagttcatactatgtgaagattaatggtgaaagaaattgacgtgatcctgaaatgatattttgaaatatcaatgttacgacgagaagagttatctgatgaattcataccacatgactgagtgtagatggtttggaagtaagctcatcctgtgaaagaattgcataatcggtgtatgtccctcttatggctgttggatgcaaagcaccaaacacttcttgcccaatagtaaaggacgacacagaagtccctgtagctgcaacttcaccacttatatcccggccaatgatcagaggtaggactggctcaaatattgaacgcccataaccagaccgcatctgaggagagacatttttttatgagatgaattaaatttcaccaaaagaacaatatattccatttcataatttggaaagcacaagaatatatgcatatccgattgttcatgtcaactgcattttgcttaattccaggcttcaaacagagtataacttaactcaaagctgttgtagacctatttggtatctaattccatgaaaattgggactggggtcacctggccttttggttcctaaaagaaaatgagaacacaacatttctcatctggggatcacaaactataaacctactgctgattgcactccttcccttcctagttcatatagcattaaacaagaatccaccactctgttgcattagcagataccaccaactgatcagtgactactacctacagtgcaaagattgacccaaaacgtgcacccgtgccaatttttctacccgacatatcgaaaattataataaaaaaagttatcatttca

SEQ ID NO: 77540 - DNA, 19069 bp, Oryza sativa
gtatatagaagagtattctaaataaagtacagagcttacaaaagagaagagaagagctactagaggcatacccgaactcttccgaattcttccacactccgatttctactctatttctactccactagcttgagaacactaaactaaacttgagagaatatgagagagctttgcttgaggggtgtgtgtgaagtgaggatgagagcaccttttatagcttgagaatgacggttgtgacggttggaaaggtcggtaatactcaccaatcgtcattggggagtcatctcagccgtccaggagaaccctggattaagtggcgctgcgagggggggagggggttcggccgaaccaagggctgggccgacctggcccaaaatcggcaggtggcctcctcctttgctctcatatgtagacttgtgaattttggcccagttcatcgtgtcaattctgagttattggcccattcatacataagtttgattctcgacatcatccgattgatttattatctggtttgatgtcgattttcatccactttatagttattctctgcaaaaggttagtaaccaaatgctagtggaatattatgattctaacatgaatatgcattgcaagcataactagttctcctctattttggtaatattgacggtcaaaactaatcgctaacgacttgtcacaagtggcgaaaaggttcatttttaaaaataagttcctaggaggtctattattaaatttatttattttaaaggtctaaaacataaaaaaaaatctggccccgcgtgagtttgcttggctgaacagcgaaatgcctactaaattgttgacgatgaattagcggttaattaaatgctaataacaatagaaataaccaccaattaattaatttctagtgatgctaattaattatttaatcatgcgatctgcagtgccgtgagttcgcatccacccatttttctccatgcgaagtcgcgccctagtcgcacgaactcgtgatgatatcatgaacacattatgagttcacgcactcaccgtacaaactcgctgcgtgtaacatcctggcctaattaggatttggcatgtgtggcgcatgagagttgggtgctcatgtttagtaccaccttgtttagcaatgttggaaccaatttataaggtcttttctctccaactatattactctcaggttaactattttacatgaagcgaggatgaaagtgtatataagtgggtggtatatgtaagtgggtccacctgtcggatgggctagctacgtggttatagagggaggggctgagattcacacccctctgcgacaatggtatacacttttttaactttgttcttcaaggcagcaggtgtctgcctaaaagcatagagtagagcagtagtttttaataatcacttcagcggacggccactcatttatcatatatcaactaataatgtagggtttagggtttataaaaaaatcaaaaaaatgatacggtagactaatatgtaatatattgctcaacaaacaagtacaaattgtaataaaaataataattttgactgcgaatatgcatataccaattaaagtttattttgttatttttgttgtaacatgtagaaatcgaatttgactttaaatgtttatggactgatataaaaaaattttcataactatttagttgacatgcgataaaagagtggacgtccacccaaatgattagaatccctctccgctctcagggtccatgtttcgaaggggaaaagtaaaaaccggtaaaattttgagatttcaagacgggacataatcatgtttcgaagcaaattttaaatatattttgagaaattaaaatttaaaatagtaaattttaacaaaattccattggaatttgttaaaaattgatggaaattgatgtaccaccagggtcagtatccggccatccatgggaaaggtaaactctcatactgctagagaatgctaggggtagagatacgatgctgcggttttggtcatttttgtttattcacttttactatgctaatattatatggacttagaaattttatgggtgtgttttgaaacattagaaaatttatggacttttatagcaattggtttaatttttatagaattagaagaattcccatgatccaatgagcccttaatactttacgattttcatgacaccccacttgtccacaatattttgcctttgctttactagtatgagatattacggcatatcaatcctacttttaatcgtacacacttcttaatacgagtacactagtccaaaagttcaagtaaatacacatggaaaaagatacttcctccgtttcacaatgtaagtcaattctagcacttcccacattcatattgatactaatgaatatagatagatatatatgtctgtctagattcattagcatcaatataaatttgggaaatgctagaatgacttacattgtgaaacagagggagtatgtatctattacatgtcgtccatgcaaatgtgtgatagttaaaaaagaaaaaaaaataagggaaagctctatatctatctcttaattagagtaaaaaaaatatctttacaacatgaaaaatgggtgttttgtaaaattttaggaatttaacatgtttgagtatagaattatgattatcccttggatttcttggtacacctttttctcaacccttcctaactttctaaactagtaaattttagaaaaccctatattttattgtcagtgttgtagaaaaccactggtatggtcacttgtcgcatataaccacaggttttatggtctaaattttgtaaaaccccatctttatttaaatcttgattaatttaaccatatctgaaacgatatctttcaaagtagcaaacagttaaactatcaaccttagtcaagaactcaataattaaaaacaattcaaatacactatgttttaaagtgcatagagtaaggtttgtgaaactttacaaccataatacctagggttatgtgccactggtcataatatctagggttttatgcaactttgaaataaaacatggggtttgctaagttttactccttttaaatttatctgtttctttttctcatcaaatgattggaccaaaggttcatgaacaactttctaaatactagctaatgcccgtgctttgctacggataaaatgaaaaatatcacaatattttctaaaataaataaatcatatttttcatgaaatgtgttacccacatttttcctataggaaatagggctatccatttagatttagttgttatgtaatattaagaactaggagaggtggtaggttcaatgccacaccattggagtgagtatagaatcttggtgtgcccaattgtatatttatgtatatgtgccaaaggaatgaagcatgtcatatgccacttgtatgctatttatcgcctttggaagttgagcttggagatgctgagaccaaaaaggatggcaaacaggatgggaaacatggccaaaattatggctgctagtggcagtaggtcatggcggaaaccgaagtaatccttaatgaaggcggccacagatttagtctctccaaatacagaaatctccttctgatgctcatccccaaattgtgtggtaaagaaaacgttgagtgtccacgacaatggggaagtgtagtacaaccatatccaccatcttggaatttgctgccatatcagtaaaccatatatttatgcattttgtaatgctatgtatacatacttacattattaagcaataattattcaggtgagatgatggttttgcttactggtgcaggcacgatgaagccagacatgaggttctgcagggtgtagaacatggatgccaatatagatgccacttggatatttggggtgagtgacactatcatcattccaaagtagaggaagtacagcagcgtgcacgctatggtgtacatgaaccaaaagaacttagctgcagtccatgcataccctatcatgggataagctatgaacatgatcaacaatatttgcaccaacacataagggatctccattgcaacctactccagccagccccaagatgcaaaatgaataacaaatagaaagtcatattaagcccaagcataatacaactaagtcttttacatataaggttaaggtcttgaggacataagatacctgtgccaaggagtaggcccaaggagagtacattcctgcaaacctctccctataaacgacagagcgctcaatggatatgaacggtatcaccgattggcagttattgatgccagtaaaaagagtggtgccgtacatgcaccctagtatggtgaataggccttgttggtcatttctacccaccaaggaaacaaaaaaagaaatgaaaaaaggatcaatgcaaatcatatcaatcatatgcatatgaacatgcttcctctatatctatttacaaggatggacatagtgatggttcacaatacatacatgtggttgatgtcaccttgctgccagaacaatacaccgaagacaatgcaggagattgttatgaataaaattcgcactaggttgtaggaaggacttctccaatatgacaaacactgcttccagatgcaagcctttagttgctccctaaacttctgtggaaaccgtgttgggaaatggagatcactcgtgcctagagctggtttgctcaaactcttcactagagcatccttgtcccttcaataaccaattacttaccatcataccaagtttgtttttcccacaggtaagagtattgttaattacaagtggcgtgatgacacacgtaagtatcatttggtcaattattttatcaagaccactcttggcacccaagccccattgcattttatgtgtaacttgttttggatatataaatggcactagatccaaatgtgatgggtttttaaaaacttacttgcacatggttgattccctgtaaatttgggcaaaatctacccccaattgagcttccatagatgcacaagtaacttcgagcatccatgttgatgggttgtaattatccttgatcttgggtaccccgggaattgtctgaaaaatcaaagagaaaaggttaggtactcctcccttttcaaaagggtggctctttgctttcatatcttatcttttggcaatgtactggggtttatcccctaaactctgttcttgcttaataatatgtttgtgtgttaaaaaaaagatatattcttattctacggttcaaaagaagtgtgtttatgattatattgcacgtcccatcatctactacagacattagaaatcatgacatccagagaataaatttttaatgacacgtaatatatatgtaatgtacaatgtacattggaaatagtgatgcttggagaagggaattgtaagaataatgtgacataaataaattaattattgaaaatacaaaaaaacatatatttatcaaggaaatcaaaatatccacattgcttgcttcatcatatgcaatgtacattggaaatgcaacatctggagaatggatttatacgaataacgcgctctacatatacaatacccaattatatatatacgtagagagagttgagggtgatgatatgttcttcacccacgcccatttaaaaacctttatggctgtaaatatgtaggaatatgtgtattgttgtaaaacttttgtaggaaagtattgcatctttgcatatgtacatacatttctggtcaacttgcctcataattatgcacacatgttaaggatttaatggaatataattttgtagtttagacttaatatatattagtttggatccgttaattatagcacatgcacatgatgctagatagaaaataatggactggaaatgcagacaaaaatcataactagtgattagtttgtaacttcttaaaaacatataggtcatgaaaataatgaaatcagatgtagctagctaggtcaactttaattggttttcatcacataatatgaatggtgatacgaaacaaattttatttatagctagatacttttgtacaagcaatatacaatgaacaagttcaagttattaattgatacctcgaaatagtggatgacgttacatgaatggagtccaagaggcccagcatatatcaactctccaccccttttcattagcataagctaaatacatatttaagataattagttataaggtacttcacttttattttactcatgcaaactaaagaattttaatatcactaatgcacattaaatatacacaaaatatctcccgttattattgaaaaaaatatggaaatttcatgcttaacttctccaacaccatgaatgcttaaaaaggttacagttgtatgctcttagcccagtaaattaagccgtaaagatctatgtactatagcaaattaagaaacttttggtaatgaagacatgtagagttatcaacatgatgtttttgtctagaaaagtaaatgaatactccatagaagttgtaacttgaaatacccctatattgtaatcatgttacatgtattgttgacgtagtaagtttacgtacaaatatgtatcattatttttttcttcatatctaatatagtaatagagggtgtgtgtagttgaacaagtctgctaaaattcctatgaataattaatgtaatgtatgaccactttaaagcgtattttttattccatgagagctatcctttacacttcatagttagtcctagataagactattgagctatatatgtaacacaataacttgaaagtacctcatcaaaggcctcaaatatttcaatacttggttggtgaatggtgcacacaactgttcgacctgtgtctgcgacattcttcaccgcacgcatgacaatagcagctgctcgtgcatccaagcctgatgttggctcatccatgaatatgactgaaggattggacacaagctccactgcaatagtgagacgtttcctttgctctgtagatagcccacttacccctggtagtcctactaaagcatctctaatatcatccaactcaattgtttgaataacttcatcaacaaattcctatgatggcaaaaaaatatgtatgtgttaggtcatagttccatctcaattatgcaatttacactgtaataatatttttgtattgatttacacatgtatatttcatttttttataatttgtttcaacaatgaaataactcactcttcttgtttttgaatcgacttctgttggtagccgcaaccaagctgaatatgcaacagactcctccactgtgatttgtggggaatggacatcggtttgttcacagtagcctgatatccttgcaaaagtttgttgaattttaggataacctcctactcgtatatctccttcaataacaccaccagttttccttccagcaagaacatcaagtagagttgtttttcctgctccagtaactcccatgagtgctgagagaacccctggttggaaagctcctgtgatgttgtgcaatagttgtagctttcgctccttgtaaccttgctccctcatttcctaaaaattgagaatacactcaacattgatttcagcctattatacttctaaatatatgggaataaccatgaagcacatgctaatagaacaagtgaatatattgctctctttgactactgaaattcataacagtcaacaactaagcatgattttcttccactagtaattgtcttgactattaggagtttagaattaccacgggggtgtctacatagtagttcacatcttgaaatgatattgtaagtggtgagaaaggtaacaccatcgtccctgcacaagatcacattattgatgtatttaatatgagatgcatttagtcatagaatgtatatattgaactaaccagtcttgttaggtgccaaagcatttcctacttgtaacttaggcatcctattgtccatgtccttggacatgtctttgcctcttctatcaaatgtggaaaacttatcacgagatataattgctcgggaagttcctgtagctgaggtccatatggtatcagaataacgcttgagagaatggaactatttaaaaacatcaacatgaacatatgctttgataaatatggatagtgaagtgctcgggatgtattatttaatggtatttcacatatcatacttacgtttcttaatggtcaagccaatggcataacctacattaagcaacaaaataaacccaatcaatgcactggcggaaatccaataaaagtagctagagaagtctagtcctcgatccattagtaccctccttccaagtgttacaccagacgttgtggtctaataacatagaaaaaatagtcttttaatgttggaatctaagtagaaggtactcaccttatctaaaagataggctaaggatgcaacaacacgtacctttagccatcgtggtgccaaaaactcatttccagtcaaccctatctcagcatatgacaatggagagatccaaaatccccattttagccaattaggcatagatactgtaaaatatgacacacatggttttaattagcaatgattgtttaatacataaccatgtacacaagaattagtagaaattctgaacgatgtcttgttagcatagtagggcttatggaaaagagacagcggcttacgccgaggaatgataaagcccccaaatagaaggatgactagaaatgacatggtaccaccaactgaactagccaccattgtttgacagtatgaggcgacacatcgaaacaacgataatgctccagtgtggacgaggaatagaatgaggagctggcaaaaaaacctaacacagaaattgagtatgttaacacacaacatagtcattgcatcttaaagatgaggtaatacgaataaacactaaaatagagtctagatagttttatataaagaaatcctgtagtcttattttggtagccaacatcattgaaacccaaatagtaaaaataaatacacctatgcatatcttgaatagactggaaaaatgtttgccctatatatggtggccctcgtaggtatgaaaggttcacacataagaacaaccggaaagagttgataatatatacagtcaaatgcgtacttcatgtgtacaatacttttacaatagagtgtaatttaacctggatgcttctggagtatagccaatgaggtagtaagatattgatgtccaagttattgactcaactaaagaaagtggaatctttagtataaaagaaggtattgcataagcccacgccggatagaaatagtagtctctttgtttgtaaaagacgggaagtctgctaactgcaatagccaactcagggaaaccattaactaaaagaagaatgagcgcatagaagagggaacccatataatagtcagcatgggccctatcgacccccatatgtgtccgtagaaacactgtcccagtaataacagcaagtaatccaagctgaaaaaaatgtaatatgttaatttgttgagaaaatgcaaaaactaaagttttggctcatccgaattctaaacaactatattatatactactatgtcccataaaaggaccaatcctagctacgaacctagacacaaggttcatagctaggatttgatttttttatggaacggaggagggtattatgcaagatacactcttctaacaaaaacctcaattccttgaaaaaaataataatgccaaagttaatataattcatgtgtcaattgaaatataggaagcattttaaagatatcaaatttcaactggaaaccttgatatattacaacctccattgtttttggtgttgatatagtactatatgtagcctaaattgtacatagtaaacatgagaaaacttagctacgtgacaatgagtgtaacatcataaatcaggtgtcaaaaaccggatgttttgtatcatagaatgcattcatctattctcaaaactatgaacatttgaactgaaattttctccaaaagagatatttctacttccttacctgaacaacttttgttatgtagatgaaggcatttcttctcatgagaagaatttcccttgcaaaacatgccttgaggagatcccacttggttagagagtagatatttaaggacaaagcattattgtatacttctgatttatcaaagggattcgcaagctcttcaacaagattttgaccaacttgagatgctttaaatttctcacagaagtgatcaatagtaacaaagttgtatgtttcctcagtacgactccagtattgttgttggtctttcttagataaaacctatacgcaagtttagaagagaaataataataagaaagtcaaagacacatcatactaaccaatacttaactgcttaatattaaaaagttgtatcttgaacttgtaccaacattgtaagtacattatacaaaatgcagagactaagtaaaagagcatgtctctataaaacaatggctatttggaatactatagaacctaaaatgtccaatttagtttatccatattgcatcgaacgaaatccctaagtaggacaattgacatggtagattctattagaattatgaaagctcaaatatgcacttcttatcatgcctgactaatttagataaaatgcatggctcaagtgtcttgtatttctccttttctttctccaatatcttatcaaataaaccattaactcatgttgtttcaagttgggagctatacacaccaactcaaatacacacacttaaacttcaagtcattaatttccaacaagtacttgatgctgatagtgttcattttaaacaatctcacttcgctgtttagtcaagactttttgaactaataatacttttctcatgtacctcctgtagaaaatcagctgctccttttctttccgggcacttgaacccgcatgattcaaaaaaattcataatgcaactcttagacccatggtatacaatttttccttcagccatcaagataatatcatcaaaaagatcataagtctctggtgctggttgaaggagagagaccagtatggtagactctgagatatgagccacttgttggaggcaagaaacaatttggaaggtggtagagctgtccaacccagttgatatttcatccatgaatagtgctcttgaaggtccaactatcatctcccctggttccaagatgatgtttcgatataaataaaaggaaaaccaagcatcttgcattgaattaacaacttgacttgtcccaaaaaaattgagtttgtatggcataaatgaagataaccctattccttttgttttttgtttggaaaaaacttgctagcctgatacctttagttaggtggctagcatacatgtttttgtgaatagaaagtatacattacctatatttgtttttttattggaacactacctgtatttgttggttagctagagtgtagttctatagtattatgtttagcattggaatttacaagggtgtagatcctcccatacataattgcggaattttagttgttgaattgagtgttttaatttaattacaactatatttcaattgagatgatacaaacgccatcctggtattggtatatatacacggttaaatcacctgtggttagtctcttcttttcaccacctgaaatacctcttctcattatatctccgactattatgtcagcgcaaatgtcaagtcccataatctattaagcaagagatagattatacataaggttaaaaagttatgtactaagatccctgagcattgatcattggactgagcattcttcattggaccagttaccttcataatgtaatctgtctgcatgctcctttctaagccttccacagatattgcctacaaaaatacaaaaatacctaattgaattgtaatggtagagcttatgccatttagattacaaatggctaaacaccaaactattttttccaacaccaaactgaatgaggaaaatgagacaagttttcactgttgtttagatacactatccaaataccaatgtgttgcaatgaaatttaaaaagtatgttataagttttaaatttgaaatgtcttatataattcctaatcaaatatcagttcataacatattaagctacacacacaaatatgtatttgtcctcaaaaggtcccttcaactcgagaggtggtgggagtggcagagtcaccaccatcactattggcttcttttacacaactagctaggtggcccgcgcaattgcgcggctagcacccaaacaaaatcatatctttaacggtcatagtgctttcaggcgatatagcaaaacagccataaagactgttcattgtcattttatgaatgaattctaaggcttttatgtttcagttcgccaggttgtctcttgcctgctcatggattcagcaggcagttcaaaaggttgacctatttgggaatctccggatctatgcttattttcaactccccgaagcatttcgtcgcttgctacgcccttcctcgtaacccttttgcttttccagcaatatgtacatatctaagtaattgtcgttctgtcataccatcatgaaaacgaaatttccgtttttcttctagacgactgtatcagcacctagttcattactcttgatggagggggaggatctaccttcttagatttctttttctatttatttttccatctaggattagaaccgtatacttggtagattatttttccatctaggattagaaccgtatacttggtagatagtaggaacggcacattatggcaaaaaaaaaagtttgattcagagagagaggaagcggcagaaattagaacagaaatatcatttgattcgtcgatcttcaaaaaaaaagataagaagcaaagtttaccctttgagtttgagtgaaaaaacgaaaatgcggcctgactattctagaggattgtgcgatattattgcggaatactgagcagaggctggaacaacccatagaagtgtaggggctgcttttacttccgcacttagctactctaggttggggagtagggcccgggggagaagttctagatacttttccatactttgtatctggagtacttcatctaatttcctccgcagtcactaatctaaagaaaaacaaaaaaagaattccattgaattgtatttttattgatcaattagaactgccttctagaacgtataattgtctcaaaagggaaatgggaaaggaattattcctttagaaccatggaactcccgagcggttgtggttgtacctgtacttgcagaaatccgtgtcccgcccagcaagaaaacggctgcgcattattttactaacgcgcgacggagcaagaaaacgtatgcgcgtgtacggaagcgcaacggctttcgcgctcatcccttgcttcaaaactacaggttttagcccagagtttgctggtcgccaaagacgagagcttcgcctttggaagcgccagtagcgtgcttgataaaaaggatctagtgtctatgccaggttggtaaaccatatagatctttcccaaacaaggagtaggggctagcttgtaagccacgacttagtactacaaggattcgggcgttggagggaccgttttgtcttttgtgccgaagctatttataaatcacaggccgaaaccggtgaactttgactcgtcattcaacactgcatgtagactgaattcttcaccatatacaaatggagaagagacaatagggttacttatctcttatttatgtagatttacaccacattccgtgtagatttacctttggtatctatgtgcgtagcggcacaaaatcgacgaagattaccatattgatattcgggcgcatgataaacatcggtactccagtgcatttccccatctgattcggaataaatatgtttttgtaccttttctttaaaatgcaaagtgggcgttccagcacgaatctccgagttctctctcctccgactttcctagagcctccggtagcacagccgagacagcgacgggttctccacccatacggggatggagcgacagaagcatgcttcgtttgctttttcctctccatggactaagataagactagttgttggtcgtaaatctgggaatagtccagactgagaatatgcatcatctcgttagagaaggaaactcactctagtaagatcaggcaaggcagcatatgatccaaacattcactcgctctaagcacgggaatagaataaaggtatgggtcccccaccttaccatccgttctgtcagaccaattgctaaagagttttattcgatttgagagtttttactactcaaagaacttccctatgcaatggtgctttctagttcttatctgcacctacatttaggattaaccctattcttgataatgggaatcatgaacatttcagtatgattttacttaagatttattaaatagctatccccgtatttctaattatatagtttttaaaagtcacaccagctgctaccccttacttctgtcatatccttctttattttcttgctcggtctaccactatttctattcattctccttgaaacctttaaaatttggatcttatatagttttttgagtttattatctcgttgggtttcgtttttataatttctagaagtcccgtcaaacgaattatactcctctacggcccgtccgctgtcttttctctttattatcattgggattttataaatcgaacataattatcattccggttcattttttactttctataagtctcgccaaaccttcagcaattttgccattgtactcctttatggctcgtccgctgcctcccttctttattgtcattgagattttaaaatcgaacatgattagcattgttttttttactttttagtagttccgaatatttaaaaattggaccttgtagtttttattgggtttcattttttataatttttagaagccccgtcaaacgatgccactatacttctctacggcccatccgccgcctattatttattgtcattgggattctaaaaatcgaacataactatcattagaattcattttttattttctagaagtcccaccaaccatcggcggctctgcaactgtactcctatacacgctgcacgctacttctcctttttgctgtcattaagattttaaaaatcgaatatgattatcaatgggttttttttactttctacaagtcccggcaactgccttacccgtttgcttcacggcctgcctgtcgtcccttcttttaatcatcattaggattcaatttggtgctttactaacagtttttatatgtcgtatcaaccgccaccactctattcttttataggcctgttacttaatttatctcgtcatgtgttttagatggtcatttttttttcaatagtctttattttttatcatcaatttttgttatttataaattgtattcctaattgaaatcttttttattttttaatttcagaatttatttttttcaaattttaattaataccgtatagtgttctttttaatatttttattttttgaagtccagttgtttcaaaattgtattcctacttgaaacctcttttcatttttctaattttggatattattttattatgaattttaattaatgtcgtattggcttcttatatggactttcaatattgcttatttttaattatgaatttcagttgattttaaattgtattcctacttgaactcttcttttctttttgctaatttcagattttatttttatttttattccgaatattaactaatctcgtattggattcttatatggatacttcttttaatattgcttatttttaattccgaatttcagctatttttgaattgtatttctacttggactctccttttctttttctccgattaatgtgagaatttctagcccccacagcgaacgtggtgcctcttttcaaagctgtcttaataatataattagcatggtggcccgcgaagattacgcggctagcatcgttatattttctcttatataatagcatatatgttttatcattttattattcaaatatattaaaatgacaacataattttaaattttgcaataactttacaaaactactaatgtgtaatatttatattttattttatatacgtgttagttattaattatttttaatatcaaattttagttatttgtaaattatatatattcctgtatggactctagactcgtcttttaatatttcttttctttaattccgaattttctgtaaattttatttctatatagactctatgctcttctttcaatattatttattattatttctaaattttcattatttctaattgtatttctatatggactctaaactcatatttcaatattctttaatttttaatttcgaatttcagttacttctaaattgtatttctatattgactttaaactcttcttcccatgtttttcttaatttcgaattttagttatttgtaaattatttttttatacggactctaaactctacttttaattttattatgtttattccaaattttagttagttttaaattcctatatggactctatactctacttctaatattccttatttttaattccgaatttcaattatttcctaattttatttctatatggactctatactccacttctaatatttcttattttttaattctgaattttagttatttcctaattgtatttctatatggactctagtctcctcttctaatattccttattttttaattccgaatttgaactatttctaaattgtatttctatatggactctagtctcctcttctaatattccttattttttaattccgaaattcagctatttctaaattgtatttctatatggactctgctttttctttttctccgattaatgtgagaatttctaggccatgagagcgaacgtggaggtttctttttctattcctttaataatataatagatagatagagatgacaaaagaaagcattcctataacagagacaaggggaaagaaaaaaaaaagaatacataaatgggtggttaatgtttaccttcatatatgtatctatgtcagggtcaggggtaatcccggcctccttctccctcctaatgacttccttcatgatctctagtttgcacaagaaaaataacgacacttggttaagttgagtaagtaaacaaaaatgagacagataattaaatgtgctatatatacctgctctagtgccaacgccctgaaaccttgcagagaagtcaagtgtctctctgacagtcatctcagggacatgaagatcatactgagaaatataagctgatgtcttctctggaacaaaggtattcagattggcaccattatactcaacttcaccggtcaccctgcatgcaaaatgcattatgcaatgcgatgatatgataatacagcgagtagccgattattgatgatcaaaatatgtcgctgcagctagtaggctggttacttgtgattagatacttaattggtggaaggatcacatgcaattggctgggaatgaagaagtaaataaccttgagatttttgtcgagctttcctgcaagggcgagcaagagggtggttttgccgcagccgggaggtccaaggaggagggtcagcctgcacacaacacatacatctcgatggatgatcgatcacctcgcgatgaccatgcatgagaggctaatatcaatagtacctggaaggcttgaggattccggtgacgtcgttgagaatggggatcctcgcgtgcggccggcggctcaacccccgcgcggtggcgagcacggtgttaaggagcgtgggcagcggcttgccggaaaccacctggcagtccgccttcacgcgcacgttgagccaccgcacctccaccgtcggctgccggacgcccaccctctccatcctccgccgctgcttgcggagcagcctcaggttgtcgcgctggatgtcggccaccagcctctccaccagcacccgccgttgcgccgcccccagccgccgcacgtccaccgcctccgacgacagcaccgacgtgcgcatcctgtccaaggtgggcagcctctcgatggccgcccatctcagctcagcttcctcttcgtcgtcgtccccacgatgatcccaccgcaacgacgacgacaaggacgacaggctcctgcaggttgccgcagctcgcaacgatgaaggcactactggtgcttcttcttctgcttctgcttcttctcgttgctgctgctgctgctgcttcttgtcctccatctcaaccacctctaattggctcatcttaatttctggatgctgctgccgctaaacgttgaggagaaatttcagttgtactgaattatttatactgatgattgttgttgacagccagcatcgatcgacgtcatccaaccatacataaaaaaacgagcaattctactatgtttgaggatgtaccatgagataccaaaaatttagtgtaaaaatttagtgtaaaaatttggtaccttatgataactcatactctctctgtttcaaaatgtttgacactgttgacttcttagtacgtgtttgaccattcgtcttattcaaaaaatttaagtaattatttattcttttcatatcatttgattcattgttaaatatactttcacgtacacatataattttacatatttcataattttttttaataagacgaacggtcaaacatgtgttaaaaagtcaacggtgtcaaacattttgaaacggagggagtagtacctagataccaagagataccaaattaatttacaatagaaaaagtgctatctcatgataccgcctcgaggaccgtaaaaaagctctaaaaaaaacatgtgttgcttgctccagagcaacttccattttttttccttctttgttgacaaaacgacaattaattgataacatatactatatatcattattatgggcatatacatattgcgtggacaaaatacaaacaactcgatcgatcgatttgtacatgatggggctacaggtcaaattaacaagttgtgtcgtcgtcatgacacttgcatcgatcttcatctggatgtgttgttcctggatttttctaatcgatgctattgctaag

SEQ ID NO: 77541 - DNA, 11924 bp, Oryza sativa
acccagcttgccacctgcgagaaccatagtccatagatgcccgcctacgcccatcaccgtcgttggtttgcttggccgctggtcgcccggcacaacgacgtggggagaccggaggctggaccatgggagcggccatgtggtggtcggtgcccatggatgcgtagagtcgtggagaggagaggagaggagagcacatatgatggcggtggctgtgaggagaagtgcatggagggttggaggctatgatgatagggttgttaagatgctgagttaggttttagcttttatatcccactattactccatgttgggcttcttgggcttgcaatgagctgtattttgaggggtatataccttcttcggggcacacaggtggattttgctagacacttgagacgtgtgtggtggaaagaactagaagaacgtgcacgctcttgctgcctcgccttgcctggtcaggcagcacgcgtacgcgacacgctcatggatggtttcgccaaaatgaggagagggagctttcttttgcagatgttggttgctacgaaattcggtgtttgtttttttggaaatatagtttttcacacatattgaatattctgatgcgtggagcggcgtaaagtccgaataggttacacgcgacttatctgattcggttacgcattatggagatcatgcaggcgccctgatcactcttcttgttatctctatataaaccgagtcgtcgtctcctcacaacacacgtgaaaaactgtctagggtttgcctcctcctttgtactgtgtcgtcgctcgtagtctactctgtctcgctcaccagcgtgcactggcgatcgagagagtgggtttccgaaaccttcacctttgacgctctgcatcgggataaggtgctaataaggtttttaggaagcacttcgcgcgactgcttgctagtcttccacgatggctcgtcttcatctacacggatgttgcgtgtcgtcatcaacatcctataccacgccgttgttcatgtggtgtgtgttactccccacccttggcaaaccgatcctcttctgcagcagaactagaattgttggtatgtttcgaccatgttctatatattcgatctattcgtgtgtagatgtctcgtatacatgtctagatcacgtgattcggttatgctagtttacttgtttaatgtcatgatctatttacgaaataaattaaatatacatgtgtttatatttccaacagttccaactatgaggatgatgttgtggacggtttggaacttaaagtgacatgctagccatggtaactagggaagcacggaccaacccgcgaacccgcttgtagataaaattagtgggtaaccctactaatttgacatataaatgggtttatgggtcgactcacttgtatctctagatgcggcaagctggtccacgacgtggaacccactggttaccacttattttacatactaggtgaaaccctgcgttgctacgagagtttactatgataaaaataatgtgtaatatagcttaaacaacataagttgatgtgatttaaatttaagttgtatatagaatgatgattcaaatataaaaataaagatgatgtggctttatgagagaataaaagaaggaagataatttagaccatatatctaagggcttaaaaaattgagatgatatggcttaatgagataagaaaatgatagataatttgaaccatagattaatcatctaaagactaaaaacaattaatgcgatatgacttaatgagaaataacattaattaagtgaggatgaactatataggtatataagatattataaaaaaatgatagagagatatattgaaatattatatgaattgtgtgggatgattttacatgcttacattttaaatctctaaaatttaataaattatacaattatagataatatagcattcttgcatattgcttaactgtaatactactaattattagtggatgattatgtaacatatttgaattttaagttttaagaatcataattttaagttttaagaattacagggttataaattgggaaaaatacgaattaccccctgaactatcgcggtcgaccaaattaccccctaaatcacaaaaccggacattttacacccttaactagttttaccggacaaataaccccctaatcaatccggagtggttttacgcctacgtggcagtctaatcagcaatactttttattaaaaaaaagtcagtggggcccacctgccagattctatctcctctctatctctttcctctcccacctctctctatctctctcacgccgaaggccgacgaggaatccacgcgccgacggaggccgagaacgagcggcgcgccggcggctgcgagcctcctcgcggcagaggccgagtatgaggcgcgcgccggtggacgccggccagtcaagctcacgagctgggcctcagcgccggacttgtgcaagaagatggcgatggtcgatgagcggcagccagcgccggacttgcgcgagaaaatggcgagcgcggcggccggactcatcgtcttggaacgacacccacaagaagatggcgagtctgcatgtagttttcctatttatgttgataacaaaccagaaaagtagcagcagcagtacgcggcaccaaaatctcgtcttcctccgtgtactgatttgatccaatcttctgagtgtttgttggcagctagaagtaggttgttaggattttccgggcgtggctgacaaagtgtgagaaagcacgacagcggcagcgggctcgtcactgcctgcgcgcgagctccggctccgccgccgttgcatccgctttcgcccgagttccaccgttggccgccaggcgagcgcatgcaggagtgcttcggccgacaacgtgctgctgtgccgacaaggaggaggacgcccggccggcgagcttgacgggcttgccgccgccgcccgagctccgccgtgcgggagtacttccgctaccgcgtagcgacttgctgcgatgttatgccgacaaggaggtggaggcccggctggcgagctcgacgggctggccgccgccgcgtgcttcagcagcatcccctgagctccaccgatggccgacgggcgagcgcatgcaggagttcttcggcacagcgcggcgagatagagagaggggaaagagatagagaggagagagaatctgtcaggtgggcccccaccgacttttttaataaataattgctgtctagactgtcacgtaggcgtaaaaccactccagattgattagaggggttatttgcccggtaaaaatagttgatggtgtaaaatgtccggttttgtggttcagggggtaattcggtcgaccgcaatagttaggggataattcgtactttttccttataaatttatagtaagagataataagtaggttcgtgggtaagcccgtttgcatctctacgtgtaaccaccaataataggtatacctattgttgatggttttaactatgagctataccagaagcgtatggtatatttgaatctgtagaccttttaggtgacgtgcatatataagagaaataaattaaaataatgttgtacttctaatacgcttaaagcattatatacgggcataattaacatgcgccgattttctagtttattatgtgggccagtttcgtacttcctggttaagtaaactagccgcaatgtcgactttccaatcctcatccgttcaaattgaggtgcaccgtaatgtctactgcgcaacccgctcgatcagtaacgaactgatgagctgagcttggaaaaggaaaaaggccgaaaggagatactccgcagtactccctccgttttaacaccattgactttttaagtacatatttaaccgttcgtcttattaaaaaaatttgtgaaatatgtaaaactatatgtgtacatgaaattatatttaacaataaatcaaataatatgaaaagaataaataattacttaaaatttttgaataagacgaatgatcaaacacgtactaaaaagccaacggtgccaaacattttaaaacggagcgagtataaagcaagtcaaagcatccgccgacatgtgattaaacacttacaacgattatttgacattgagcagaggtcgcttttacatactccgcacaaagtcaaaccacatccataacaccataaccaacacgccgcttcagtttagctttatcgacgtattcttcttcttcaaacgcatccagatgacttgcgcattgtttgacaagtgttccacagcaagaaagacagagattcagcaatgcagattgcaagtggcttttcagtagtcaccatgttcataaataaatttcagaatatcgcagcagcctttgaactggtgatcggcaaaccagttgggcacttgagcgtgtctgcaaaccgaccaagcattggtcaactgaagttgaatcggcgagcgtgcagttggtagctcgcccactggggcagctacagctgctgcaaactgcatctgcaaaatactcctagaacaggtaagctgcacacaggtgagcattgcaggggggagcaggctagtctggataatgcaaatgtcaacggagactggtatgaaacaattgaattaacacaactgcatctataaaatgagatctatcttggacctaacaacagcaagatcggcagaagatctccaagctactagtagcatggactctttgcgtgtgttgataactgataaagtgtagagttccagaagttgactaacttcaaacaaatttctttcaataacatgacaaatattacttggtccatggactcgtggagagccggtgcgtggtaagcggcaatgccaacgtccaacggttgggttcttcagattagtcagacaaagtcgaggataaagtgcatgattgaagaaaaatatgaggatcagtgtgtttccttcaactgtgaactaaaatatgagctatgcagatagaacaaactgaaccgagaagattgttccaaaacagcaatgcatttatacacaaaaaataatagggctcccaaaataatattgtagtttcagtgtcactaccctaagatgataagattctacttactaccaggcaagctttctttgacttgctgaatcagcaccatggcaggcgttgaaccactttgacaaaagaggggaaaaaagcccgtgactttgcatcaattcagtgccacatgcaaaattgtaacagctcatatgcagcctgaatcgcaaacgccaaagaagaaacaataaccttgtttgttcgatctccccatcagaaggattttgttttgtattttgacatgtggaaattcgagacgatagtgcaattccgaaagaaaaaggacaacctatcaaactcaacgggccgtttccaaatttgctagtgaatgcaatatgtcgggaaacaagtcaacccaaatattgtattctgtatgtatggttggtatcaaactaaccagtatcgcatttgtctgtttgggccaacatgattacaatagcacactgctacactgaagaaatggtagattagtaggtaagacaagtacaaattgtttgttggaatatccagatgtgtgcttggaccaaaccaaaattacattttgccctacataatcaaatactaccagtgaatgcaatttcagaatgaaatttcatcccccgccagcaagcacatatttcgcccgaaattttcgggttttttttccattttttttgaaactggtcaaaaaaaaattcaaattcattcgaaattcgtcaaattttcaaaaaaaaagggggccaaaaaagtaccgaaatttcagagattttggttcttttggccacccccggcaaaaatcacaatgttgagattgctaaccctgactactacagcacccagcttgatgcatggctgaaaagccactttatcttgttattatgcaaactatgtggtttagactgtagagattgccaaaattaacaagtgaccaacaccatatcctttaacctttatcgatttgtgcagaaagagaactataattaatagtaacaaagagggaggggagggttcgcgaaccagtagaaaacggctctctttgccctgagcacgttgctcccgttcttcataaggattgggttgctctgcccggtgagtgcgcgcccctcgtgcgtgtgtagcctatctcctttcttctagtcggcgtgcacgcgatcacgccgcacttttccaactgcaactagtatagcaaatgcagtgagaattataaataaaatcgcatgcttttccaagtgcaagtaggcaaatgcagcgaggattataaaattgcatggaatggaaggtgagcgaaaggaatactgaatacataaacaagcaaaaacacgatccatcagagcgtccggcctgtgtgctcgcttctcgaccagtgctgattgaccaaccaaaacctccgatcaccttgtcccgtactgaaaatgctccgtttttgacttgtgcagagttcactatcgttgccacgaccatggtgacgatggcatcacactccgccattgcaatggacagataaatattcccccctcaagctctttgtcttctcctgctcctcccgatcccaatccgccattggtgggcgccaagctcagctcgttgctcttcttcttcttcttcttcttcttcttcttcctcactcgctgcccactcattgggaaaaatccgagctcggattgaggtttgttggtaagacggacagccatggaagcggtgaggtgttttgtggtgttgtgcgtggctgtggcggcggcgctggcttctttgggtggcggtgcggttgatgcggcggcggcggcggcggcggcgcaagagatgcggcgaggcttctcggcggcgcacgaccggtcctactcgcagttcgagcaggtgctgtccgaccccaccggcgtcttcgccctcggcttcctccgcgtcaactccaccatgctcgacctcgccgtggtccacctcccgtcctcgttcccgctctggagctccatccccgaccgccccgcgcagtggtccgcgcccgcttcgctctccttcgacggcgacctcgtactcaccgaccccgccgacaacaaggtcctctggtccgccggggccgccgccggagccggcggcgaccgcgtggtgctcctcaacaccttcaacctccaaatccagagcggcggcggcggcggcgacggcggctcgtcgcccggtatcgtgtggcagagcttcgatgccccatcggagaccatcgtgcaaggccagaacctcaccttcgcggcggcgctctacacctccgaccgccgtttctccatgcggatggggaccagctacttcgggctctacatcgagccgcccgcgtcgtcgtccggcggcggcggcgtcgcggcagcgatgtactggaagcacacggcgctgcaggccaaggccgcgatcgtggacggcggcggtccgacgtacgcgcgcgtggagcccgacggctacctcgccatgtaccagaaggaagggccacccgccgaagtcctctccttcgacaccttcaaccatggcgtgcgggcgctccgccgcatgacgctcgaggccgacggcaacctccgcgcctactactgggacagcaccggctcccggtgggtgctcgactacaccgccatcaccgatccgtgcggcctgccaagcacctgcggcgcctacgccgtctgcgtgccgcccagcggccggtgcgcgtgcctggccaacgcgacggacggctcgggatgcgccgccgcaaacgtcggcggcggcggcggcctctgcggccgcacgggcggcgaggtgggcgggctgtactgggaggtgcggaggcagcgcgtggagccggcgaacaaggaattcctgccgttcgagcactcgccgtcggcggcggactgcgaggtgcggtgcgcgcgcaactgcagctgctggggcgccgtctacagcaacggcacggggtactgctacctcatggactacccggcgcagatgatggtggccgccgacgagaggaaggtggggtacttcaaggtgaggagcctggaggaggcggcggcggcgagcgggggcgggagggcggccggtgtcaaggcggcgctgcttgccgtcggcgtgacggtgctggtcgccgcggccgcgttcggggcgtacagggtgtggaagcggaggtgccggacggccgtggacgccaggcggcaggtcgtcgccgacgacgaggggctctcgccgggcccgtacaagaacctcggatccttcagctccgtcgagctctccagctccttccggaggtagccagccagccacctgagatgtggtgtgattgattagatcgatgagatcgctgggaaacagacgccgtggacggagaaggcaaggcaaagggcggcggcggcggccgctgatcggaagaggcaggcccaaattacggtggcgatgacttgggctagtgggctacttctgtttttggagggaatgagggatgtctcttgtatgatttcggccagttttgatcttttcgttaggcccatcatattatcctcgggccattttctttcctgtacaaatttgcccctccatctaaaaaaaggaaatttcttccatgctatggtgatttgtgaacacattggtccccatcgtttggcttatttctaataagccaaaacgacttattaaaaaataaaaataaatttatagatgaaacttttataaatgtgttgtttgtgacttaaaagccaatgttataaaagaaactacgttgaaaatatcttaaaatcaatctcaaaattaagtttgaaaattcaaaatttggctttttttaggtgattaggccatccgatgggagccattataccatctcatcaagtcattattatgcaaaatttaccgtcagattatacatcatgcaaaattgtaatgtcagaatttacacggatactccctccatttcaaaatataagacacaaccacccttgacccaaagactaaaaaacaattattatcgcctctttgtttgaatcaatccaactaatacaatacatgaacccaatagaattaaacatattgtgagtgtacatttaaaaaacaataatttaggagaggagagatgctaattaattactatgcatacatgcatgcattatattataaaacacctttaaaaagtagttgtgccctatattttggaacggaaggagtaactgttaatcttgtcttaccaacgttaaaacacagggagcttaactgattagtcttgagcaattttgaacttaaaacacagggggcttgactgattaaattcggcaaattttgaactcaaggggcttaactgattaaactaacacaggggacttgactgattaattaaacttgggcaaattttgaactcaagaattggcagtgcttgctgcaaagtgcggaagggcctaactgctaaaataagggtaacttataagaaataaagtggtcttttatgcaaaagccgaggagctgaactgcaaaatccaaggagcaaaatttaaatttgaagaattggcaggggccgcgcgaacgcgtaccccctctaccacaaattatgacgtccactctcccacttggggagatggtaagccagcgcacccaccaagtgcaatgtgggccactagcctaggccatgacccttcatgatcggccatagaccccgtccaggtaagtatggagcaacggtgcacctggccttggttttatagcgtgctctcccgccccagcctcctcgaacaagcgatgtggtactaaaaaaacgctcctgcgtgctgcggtttggaagccggggaattcgagtccggacacagcatatgggccgtattgtgtgcaggccttctcgtttgggccagatttatacatacaccccgaagagcagcagaagagagtaaaaaggaataagttcacttcatgaccctcaaatgtgatcgaaatctaatccatgaccctaaactacaaaaccggatatctcgacccccaatctcctaaaaacggtgcaatttgactccctgggcagttttgggaggcagttttgctgacgtggcgcctacgtggcaatattgaccgagtctttattacaagtggcgttgacgtggcacctacgtggcggtagaaataaaaaatatgcgtgggacccgtttgtcattttcacacataaaaaatatgggggccactgacatatgggccccacatgtcatcctccttccttcttcctccctctctccttctctctctttcctccccttcttcggtgtggggagcggcggtgatggtcgatggcggtggggacgaggtggtggggagcggcagctgtggcggtggggatgaggcggaagggagtggcggctgtttcggtggggacgaagcagtggggggcggcggcagtcggtggccatggggacgaggcggtggggagtgacatctgtggtggtggggacgaggcggaggggagtgacggcagggagcggcggtcaggaggagtggcgatggtggtggggacgaggcggaggggagcggcgacggctgtggcggtggggagcggcggctgtggccgtggggacgagacggagaggagcggtggtagctgtgggtgtggggagcggttctccggcgagtgtcacgctcatggcgctgatcgacgagatggggtcggcgtcatggaggaagtcgaccggcgggggttgcccttggcgtcgtcaatggctgaagatggaggcggaggttgaaggcggcggtccacgcgctcgaagccagcggcgcagccgtgctggcgtggaagagggaggcggccacttggggccgctgcgagacgagcaggacggcgacggcggcgggccacaagttcaggccttcgagcgcccgccaccgtcgccgctccggccttccaccgctcgccgccgccgctcgagcccactgccgccgccgctcccgctgccgccacatgtgagaaagagagagaagggagtgagggaggaggaaggaggactgacatgtgggccccacatgtcagtgagcccacatttctttttgtgtgaatgactaatgggtcccacgtatattttttatttctaccgccacgtatgtgccacgtcaacgccacgtgtaacaaagacccagtcaatattgccacgtaggcaccacgtggcgccacgtcagcaaaaccgcctcccaaaaccgcccagagagtcaaattgcactggttttagaagtttgagggtcgagatatcaggttctatagtttagggtcatggattagatttcgatcacatttgtagggtcgtgaagtgaacttattccgagtaaaaataccaacttttccaatcttataaggacaacatgtgaaatgatcaaatcaagtccattggattcaagaatgtacatgcaagtatactacgaagcgggaaaaaaaaactaccatggctcgaactagaactgaaatcagaagcctgtaaaaacaatgttaataacaattaaacaagactggcccctacgtgatcctaaacacatcataatcccttctcgaccaaccatccatctggcgtataacagctggtacacgtgtcagactacagcactgcttcgctgcctctctatgcaacagtagtcatcgatggcccgcggcagcggcaggaggaggaggatgaggatgttcttctgcctgtccgccggcggcggcggacggcgcgggctgctcatcggagacgacgatctccagccggtcgtctgcggctgccgccggttggagcgcgtcggcgtccgacgacgaggacgcggtggcggagagctgctgctgctgctgccggaaggttgcacgcgcgggggccggggtggagggcctggcggcggcgggggggcagtagaggggcggcggcagcatggcggcgggggaggggg

SEQ ID NO: 77542 - DNA, 21414 bp, Oryza sativa
cccccaacagcaaattaagccgacatcagaaaccgtattgtcttgctttttctataaaaaaaaggatataaattgttttagaacaatttagagttttgttatttgctcacggcattcttaattcaattcggcactttgtgcgacaaggaacatatacccacccataaaaaatatttaatatatattgaagtgaaaaatatgtgcaatgagtagtacttaaaaaataatcatatttatcgagagaaagaggagttaagataaacggaaccaagcgtgggaagctaattaattcattgtattgatttctcattggcaatcaatataaattcaccagtatatacaaatattcatttaattaagatataagtaacaatacgacactataaaatgcttctctagagcaccacataattaatgaactattatgacgatatatcaggttccttttaaggccctttttctgctgaatggaatataaacgatatatgcaaaaaaaaattgaatggttgaataattggtgatacttatttaagagtatacacgaatttattaactattataaaatttaaaatggatttaaaacaatattttaagaatttcatatgtagctcgagaagcatgacactaaatagaatgcgacgtccatggctccaccattagataatgaatgtagtgaagttggtatgaaactcaagtgtgaacgtaactatgccgttgattttttttactcgcccgcccaacatgcggtgcttgcagcttcgcgaggcttctactggaagctgctagcgtcttttgagtactgaagtacgaatcgaacggttcatacagtttgctgcctgcatctaacggtggacaatttgcagcttacgtcgctaaattaggattcaagaaagatcaattctttcactactttagatttgccaagagacaacttcaaccattattttaacaacttcaaccattattttaagaactacattatgaaaaagtagtgtgcactatctactggtataaaacaatctgaatcattgatctcgtttgattagagggtttcagatatattactaccacctcaataaacaacaatagtagaaacatggagggtattattataaaaagaaagatgcaaaggggtataattgtcatttagccgtgattaaacttttttttctccctttttagcttttccgatagaatatgagcaaagccatcgcaatgaatgattatagaacgatttagccaagaaaaaataatacataaatactccctccgtttcacaatgtaagtcattctatcatttcccacattcatattgatgttaatgaatctagacatatatatctatctagattcattaacatcaatatgaatgtagaaaatggtggaataacttaaattatgaaacggaggaagtaatagttactcttaatcatggtattagtaaattattaatttatctataataatactggtagtataatactacagtattttaatatatcctctaagagagtgaaaactttacggaatacaattttacaggttgtgtcatattgcaacaaaggtaacgtaagttcaaagtaaaatatgtctattgcaactaaggtaacatacgctcaaagtaagacaacaaaagtaaattatccagtttaaaatagaaacattaattaaaatatggttcaaaatatcgatataaaagatggcccaaaatttacttttatagagaagtgatatgttcctaactttgaaagtcaaaacaacttttggtaggagtacaataaagggcaacatagtacactaaacaaccccctccctattaatataagccataattatagtattagtgaccactttcgatctgactttgtctctctggtacgtcaagcacaaatgcacaattgactatttctgaaattgataggccatcatggcctttattggtaagataagggcagttcgaacccagagaaccactaaactatcttgcttctgttaactaatatccataacccatcatatagtttccagtttcgaggtgatcttccccattttgcacttctacttcagtctaatggcaaaaaaacaggtttctgtgacttcgatcttacagaacattatattttttttcaagtaaagccaagtccagatcatcttgattcttaagtaaagctagctaaatccgcaaaattcttataaataaaaagcaaatccgcgcaacaagaccgttgcactctaaactatatttaaattaagagaacatgtgatttataccagggcgaaagctatcagccaatgtacctattatctctttatcaatctattttactctctccgttcttaaataatatttaccattttagtctaaagatttatctcataaaactttcttttaagtggacccattagacatttttaatacaacttcaatattcttcttcttgtttagccattgaaccagcaatgctccctcctcgtcgtcctcattttctcttcgcattaatgaataacaaagtaacattttaatctcttacttaatctacctttgactcgctagaacaatcgtcccttaggatggagggagtatattgctaagaaaagatagtgaaccatcacatttgtttcgagatcttagaaattactaaattaatatatgaggaaaacataaatatttgtaaaattttatcgcattgaatctagattataacctgaaaaatcgatcaatctatataggttatatacatgtatttttattcattatctaaaaatagttatatacaatataattatattaattatatttatagaactacaaataagacccccacataaatacaatttttttaaggaattaataaaattatttttctaaacaatttttaatctagctttctgtaattgtcaacgaaattcagcaagttgtgatcgatcgtaaagaaaaagaaatgattcagaaaaaagaagagctctctactgctaaaaaataaaaagaaagcggccagctgccgtaaaaggaaaagggccacacgaattttgtttcgccacgccatcgctagatacgctcgcgcacaaagcgaattcgtctcgcctgacgtgatgcatttctagctagctactgtactagctagttgttgttggtattatccgcgacgagaaattaaatttggtcgaataatcgtggcatgagcgcgtgagattaaagccaatttaaaacccaacaaaaagagggaaggattaattggtggtgccttaactgcgattcctccagcgccgccgccgcgcgaggccgcgagccgccgtcgccgaacttggccgttgggaagctcgtcaccaccgccggctccagcccgcggatcccgcgctccacctgcgcgcgcgcgcgccatgcgaaccgatcacaaacacgctcgtacgtacgtagcacgaacgatcaacgagaggatggggttgctgcgtacgtacgctgaaggccgggaaggcgtcgccgtgcgccgccgcggctgcggcggcggattggcccgccctgaggtggatgcgggcgcagagcagcctgacgaagatgaagagcacgaagaaggcgctgacggagaaggccatcaccgtcgtcaccgtgttcatgctcatgccgccgccgccgctcgtcgacttctccgccggcgaggacattcgccctccagcatctcactccgggctccaccaccaccaccacccaatccgcgagctcagctagctctggattggatggtatcctcctcctcctcctcctctcctcgccgtcggagaatcaaccaattaaccaatcaagcaatcaatcaaatcaatcgaccaatccacagctccccgccgtaataaagtggaagaggatgagaagggcggagcgcatagcgcatagcggcaacagcgagtgtgtactcgcctcgcctgcacccgcctcggcctagggaaattgttttgtttccgctactggtaataatctatggtcgtctgccgattagttgcacgctaatctatcatcgttgagacttgagaggctaataatcctcaattgttaagggggggggggtttagactgatgattacgcccactgataatcaatcaatggatgggttagtttaattaatgaacttagcagctgctgctgctgctaggtgggacctcgctttcagacgtcccccgcggccgcggcccgccccgctcgcggggtcgtggtgcccatgcacgcgcccgtccacgttgcgtgtgtgattgatgcgtttagcccagcgactagctgcttcgccgtgccgtgtccacgcgctcccctccatcgccgtcgcctcctcctctcctcgttttttatctagataattacatatttcctccgttttattatataagttattttaacatttcctatatttatattgatgttaatgatatatatgtctagatttattaacatcaatataaatatgaaaaaataatagaataaattatattatgaaacggagggagtagaagatacacacgcgtgaacacatgtacacattgattcaaagatacaccactacacatacccaggtagaaatgtaagtggcccacgaacccacttatatatcctacacacggccggtgacacgggtggcccttgctgacgtgggctatccgtgtgcggagtgcggacgtggcaagtacaaccggatcgagcggatggcacggcacggcggatcgcgggtgaaaaacggtgtccttttttttttaactgtggtttcattaatcgaagcgccaaagttcttttgagtaccaggtacgtgttcaagaataacatgatggttacaacacgtagtatgacaaactgccccgggacttgtcgatcgatgaggcgaggttggaaaacttataaaaactgatcggtcaggaatacgtcaacgtatttgatactgtttcctctgaagaatccagttcaggaataaagccccgaggaaaaaaaaagagcttgatgacacgatctgtcaattagtacgcatttgctgccaaattaatcctgtttcgagccctctaattgggaaaaaaaaggatttctcttgacaatgacgttgcaattaaactgaaccatacagaatagataaactcgtgatcccatcagctatatcaaacgcgacgacacatgtgaggtcacacaaatttggctcatcctcgtgtcataaaaaaaaagaagaaattgcacactgcaaacaagctctttgtggtggcagccatgggcccccaaaagcccaagtctagtagagggactctaccgttttgttcagctcttcgagcttcttcatccgcagctgctcgctctcgcccacaagctgctcaagatcatatggaaatacttaatgagagtataacataataaattcagaagaataaatatataatgtaccaaaaaacattactataagaactgcagcgtgtagtaatgatcttctgaatatattatgaaatgggtattataatacccacttcacaatattattcgtctagtttaaactttacaagttgttccgtgtttatccatcgagtaaattaagatatacaattgtgtatttccactgtctatctttgctataaatggtgaaaaaaaaaacttaattaattaacatatatcatctgctagtgggaatcttgctccattaacggtggttaggcatttagaggaagttttggacaaatatacattaggcccaaccttgttgatgaagatttgagacaaaggctggatgttgtcttgttgcttgggaattttgggctaggcccgaaaattataactggaccttgaaatggaagtaggcatcaactttaaacaattttggcgcaaaaaaaaaaacagaaacctccatttggtactccatgggtaggtgaaaatgattggaggattcttgtgattggttgagaaaagaaagtaggtaaaaaaattaaatagagaatagttataattgattaagagaagttggtaggtgtaaaaatatagcttccctaaaaaaaaggtgtagaaatagattcattttgagacaagtactagaaataactatattttagtacgaatgtagtatcaagctagctgttctttgttctcacccttaccttggactattctcatataactacttcggttttttaaatatgttttatcaataaaggtattttaatcatgtcttatctttttacatatttatactatttttttaataaaatatattatcaaacctcatgtcgaaaaatcaaagtcatatatttaaaaacggatggagtaaatggtactacggttgttagtttcctacatattttttatgcaaacatttccattttatatttagataattggaatcacaatttttttttgctccaaatagttcaaagaattttgaacttttcaatgaaatttgatcaaaattcaagtcagtcctacaactattttgactgaatatatatgctatctttcctgggtagctaaaaaccactgaaaaccgctcttctgtcactcacctccatcaacctgttcacaagcgttgctttctcgttgctcttctcgttgtaagcctctaggcacgccttgtattccttctcctgtttgtttttagaggggaaaaaagggttaacgcccggcgcatgcggttgaattcgtcgtaacaaacatgtatgtacagctatattgctgaagaagaagaagaagcagcaaaaaagaaaaaaaaacacaatggcatcctcaccttcttgaggcagttcttgccgagcggcttgagctggcggttcaccttgtcgatgcgcttccgtatcgtctccacctcccgccgcgtcggatccgacatcacctccagctcctgcaaatcaaccaacagtttagcttgcgatcagagatgatcgatcgccatggcggacacaggcatgcacggacgaacagtcgaacactgacctggcggatgaaggcgaggcgcttggtctcctcctcgacccggccgagcatggagaacaccttctcccgcacctccagcttcttccgctcgatctcctcctccttctccttgaacagcgacagcgccgaccgcgacgacgactggtcccactccgacgacccatcctcctcgccgccgccgccgccgccgccgccgccgccgccccgcacgcacacgatctgcatctgctgctccctgccgccgccgccgcactccatgcctctcgcctctgcaggtgcttctctgctgctagctgcaacctctctctctctctctctctctcaccaaccaatgctaaccttaccgcagcgagcaatgtgtaggaactagcagtagctaccctaagctaacaactcctctaccttccaagcctatttatctcttctcaatcttccttcctgctgccgcttggccatgttgatatgcaccttttttttttcttttgctgcagaggattaatggttgagtacaagtgtcctacctgcagtctcaaccttgaagcaagcagcggcagtgcgtattaacaagtttatcaatggcttaatctgactatatcttcatgcatgtgtcagtcatagcagctcatgtcaatgatatcataagactatctactagggatttgatggaagagaggacagcatgatttcacgtacatgtgatgtgagctggggagcaaactgtgttaggtgaggccactgtgtcaggggtcgagtagaagtaactcctgcgcaagccgcccaagtgtttcattctcatgtgagccaatgcctacatgtgcactgcaggttgcaacctgcctgctgcttccattttcattttgcttgctgcaggtgtatccatctctgacttggccttgcagcatcagagactcgagagttgttttcctcttccattttgatatgtccttgcgttgttattgggttaacatctcggagaggaaagctgagatgtctcttcagccttcagggatgggagtgctggtgctttgtgatgaagcatcccacacatttgtgtagctgtgctagtactcaagatgaagtagcagtcaaggataagcagaacagagtaggaccacacgacctgtttagaagctgacatggccaacaaactttgactactagaaaatctcaccttgaaatcactggaactcaaagcattttgcttaatgatggctaagccccgaacatgattctaacttttctttttgaaaggataaacatgattctaattaactaagcatcaagattcaagcatcacaagatgtacagaagtgcagaactatgtataactggcagttcgaacggtaccaacaaatatacggggttcatggtttcgtcgccgttcgacagccatagataattacaaataaacgtttctttccctcacaaactaaaactacaaattgggagcgcaaagcacaaaagcaagctgtctagtctatccggcattcatcgaagcagaacctaggaaagccgttcacagattgctggcaactagtttttcttgctccttcgcactagcagccgcacacacttgcatgctgcctcttggtgttctcattccgctggagcatagacaacgcaggttctgctaggagaataaactgagaacgagtagggcctgttgtcatgtgaacaatcctgcaaggaatgagcacaacagaggttaataaagagcacacaatatacggtacgcaatttcatctgagcaagacttacggcagtgaagtgctctgcagtgtgatggatcctgccaaatccaccaaagagtccagcatctgagtccaagaccacctgatagaaagcaacataaattattttgcagttcagcaaccaacacatccagttcgtctgtaagaagcatgaacgcgctgcaaaactgactagaggacttttgagtaatttttactggttattttcaaatatatggaaggagtaaactatggcagggtcaacataatgggcacgactagtgtaggtaaatatgaagtgttgatgattaccaagaacttctttgctcgtaattcctgatttaacaccaatcaataaataatggcacttgacatatcccagagacccagggagaaatattagttacagtacaattggagacgtacataacatgaaatttttttagtccacattcaatattttttaatctgaataggaaaaaaaaatgaatggttgcaatttgaggatccagacctaggactatcgctaacaaaggcaactccttgaccaccggggtgcatatgcaagcatagttgtcaatctattttattcttgggcagaaatcatacaaatccgatttttttggcattttgccattttctacttggttaacagtaaggtcggtaaagccttacctagtgaacaaaaactataattgatcacgggcaatgcacaaatagctgcataccttatatttccctggctttaaacaaccaacacggtagtcaaaatagctgttactccaatggaagttgaacacaaataccagatctcccttctcaaatataatcatcttatcctcttcatgctttcgagatatgtactggtggtctgatgtcatgaactgaaataacatagccataagaaaacccccatcagtgtcagagcaatgttaaaacaaaaccatcattttacttgcaaagtttttcctataaatacaaaaaagaaattctatgaagggaaatatatgcattatattattgataatgcatttattcatcaataaaaatataaaattactgtccacatagcccatgcaaacaagacaaaataatttaattggcatcgaacaaagctgtccattatttaacagtattgattactattgcaatgattggaagacatgagaaaacataatgatgcacctagataatgacaatgggagctattcctaagagtattggacataattgcataatgcacaagtgcagctcgtcatttcaccatatatttcaagtggttttggataaatagttgacatagcaagtatcagtaacaggacataagcataatggctcatatttgtgcaacccccagaaaaagataagtgataaatacaacataccccatatttttcctcgagagactgcatcgcgcggtcaaactctagcatgccacgatacctaagatagtccgcatcaccctgacaaagcaatgaaaaaacttactgatccataacaaaatcatggttcaatgttgctggcctcgcacaaatgttaatgtgaataaaaaggaattgatgaattagatgaattgtcataatgggaccttcatgattaaaacactgcagaagggggtaaaaagatatctaaattgaatccagggaatgcagaacttattttcatcaataatcaggtgacagagcaaagaaagttaccaggtcaaatcttcgacggcatttatcataactgttgttattccctgggatgaatttaccatttggaagtacttgtggagctcttggaaaatcaatccattctgcaaaataaaaggtagatcaatggcctttaagccaattgtttcccagaaaatactaggtgacaagaaccattgtcatcaaatgagaagttgatataaaataagaaacaaacatggtgtgtgattgttattaaatctcaccaggatgtccgaactcatttcccataaagttaagatagccttctcctcctaaccccattgtgataagtctaatcattttatgcaatgctattccacgatcaatgctaggtgttgccggtctgtccagagccataaaatcatacatatcctgcataagtacagtatgtgaggttctcatgccagtattcattaaaattcatacatatcctgcatgtatatgcattttctcaacaattaaaactcaaagaacaactctattatctcaagaatagtacggtgatacactgatacacaaatatgttttaagtattaaaacaaggaaataacattttccaaagaactagtaaagaatagaaaattcataaatacatgttgcaactaatacaagaaaaactgggtgtagactgcagaaagcctaaagctatccaacttaaaacactgatctagctgtggttttcataccgttcttactatccacaatgaatgcattgagtatatttgagtaaaatcagtacaaataattatcaaggatatattaaagagccattagttacagtcctaatcagtaaaacactaaaacctagagattgatgtgtggtaaccttgtccatcaaccagaatgcaatagttttgtcaccaactagtgcttgatcatgactttcagcataagtaacacacttctctgaccaccttctgttagtcagtgtgtgcacaatatcacccatcttccaagattcatcactttgcctgtgtaaaataaaaattgaaactctggcaccacatctttcaattaaaggatacaaaataacaatctttcccagtttctaaataaaagctaaacagctgacaaaaaagtgagatacgatgagcatgggcatttttataccacataataaaggagcattaaaaatgtaacgttgccaagtcaaactctataagttggtagttgcatcttattttatactaataatggaactcacacgaccactgttcatatgaccaaatccagcacatcacattggtaaatgcctataaccctatatatgagtgatcttttttttttttaaaaaaaaatcaagggcaggagttatgccaattaacttcagaagagaaatagagatatcatggtcaaggaaaccaatgtatacaaaaaagaatttaacacaagaaaacagtttatgttcattagatatgtaattagtatttctattaaccaaaatttgaaacacttacttgaggagttcaatccatttgtcaggaacagccatatgaaggcgataatcaaaaccaaccccaccatcttgaacaggaagggcaaatgtaggcattccactgacctgaagtagttatatgccatttaaccacagaacagttgaaattaagttatcttttgcaatagagttaggtttacgtatgggatttagagtattgttactactattgcaactctagaccatacaggcgacaggctgagcaagtggtctgcagaagtgtgtcttctgtgatcaaagtgtggagtcaattgaccaccttctaatccaatgtccagaaacactacagctatggtggacagttctatgcggcattggccaatcccattgcttcccatcaaatgagcagcccttcctcgtatggtggtgcgacagccgagacaaaatcatagcggcccaaagatgagggtttgacaccatcatcatatcctggtggcctggacgatacaaaaggagtggaaaaaccgggttttcaatggtcaatgcaagaccatgcaggagatagcggagctagtggcatcggaggccgcgccctggagggaggcaggagcgcgcatctaggtggagcatttggtcatcaaattgttccgcgagatattactatatgtttcccacacccatttttcttcctttctccctgtacatagttgctgtgcctgttctaacaacttttcccgatcttaatacaaaagatacgcattttgcgtattcccaaaaaaaaatgtagaccatacagagctactgtataacttgctttttgtacttcacaaacttccagggaggctggatttcccaagagaagaaaaggttatgacagtatggcaccatggaacatgcacagctgtttttgaggacacaattatactctctttttttacagaaaaaatgtactctttttgttcagaaatatgtaaatttttagaatgcacgcgttcatatttcaaacttctctaactcagaataatatataaaaacaatcaggttattcacatgcaaatggtgccattatattcgtcacgaatttttttcataacaatacatttgtataattctttactaacatactcgtataacattgatggtcaacttctgtactagagaccaggtggtcactaatctttggtaactatcattactccttgctgttttctaagcccaaggaaaacaatttcttgaaccagcgacataatttgatcaactatcaagatggggttaatagtaaatatgtaacactaagattggaaagctaagctttgggtatacaacattatgaactagagaaggcaaaactgacattagcgtaatatgcagtgcaagctttcaacttcttacttaagcatgtctagatgccaaaatattgctataaatgcatgctaaagaaatgagtacataaagacaaatatagtcagcacttacatcttcaccgatggttatggcctcaggataaagtccatgaattaaatcatttaccagcatcaagtaaactactgcatcagcatcagtggcaaatccaaagtattcactgtagttccccgtaaatgctacctaaaatagagggtggaatcataagataaaggttatgacgcaaataaatatgaaattgtaacagatagcaactgctaggtttgaccccatcataattaagaaggtagtgaagataaagtaatgaaaacgaagcaatatacttgtaatccatgatgagtgtacatcattgaggttacaccgtcaaatctgaaaccatcaaacttatactcctcgagccaccatcttgcattggatagtagaaatcttagaacctgtataaggataaaaatgttggcaaacacaatagagattaatgcatatgaataatgatactttgtaaagggaagtagcgattaacgtgttccttacttcccaattcccatagttgaaaaggcgagaatcccacatccaatgatggccgcgtgaaccactatgaaagtaatgcgtatctgtaccatcaaaaccgttcaacccatctagggtattatttgacgcatggctgcaaaaggaaaaaaaaggggcaaaggtaaagctattaggtatgcagctaaaaggggacttagtaaatcaacacaaaggttaatatttgaaaccaaaagggcttagaacccagaggccaatgagctaaactttgggccatggtgattgacaaattttggcatgtaaattagttctagttgttgtccaccagaaagccaacaaaagatgtcacgaataaaatattaatttgaattctcaaattcaataattgaatagaaaatatgaatgaaactgtttaattcattttcttcccatcctaagataaactcgaatgctagccaatttaaattgtgaaaactcttatactgcaataattcaagttaaacatgttgcataaaagagagaagatctacggttgtagattagtcataattagggttcaccaacatgagggctagatgtactttttttttatagaacagagaatcataccgttagctaaatacccatgagtagaagtggattttttttaaaaaatatcataaaaatgaaatgaactatgcatgaacttctcaggaaaaaaattgtaatttgtaagcaatttggaaccaaacattaatccacaaacagcctagccacatgcataaatgatctatttatccacagaagatcccacaaactcaagaggtggtggtataatggcagacttaccaccacagccttcttctatattataaggactttcttttatctctgtggccacgccttactaacttagatatgaaagaccagttaacaaatactcattctgttcacttttataacgcatattttgatttcagaaagtcaaactcgaaagattttgaccaataattagttgatatacaagtatatttagagtataaaacatataccactagattcatacctcaaagtattttcacattatattggttttatagctatgataaatatattttatgagaaattaattgtcaaatttcagtcataaatactttctaaaattaaaatatgccttataaaaatgagcagagggagtaattaattacctgtgaacaacatccatgagcacaactaaaccaagctcatgagctttatcaatcaatgactttaaatcttctggggtcccgaaacgactacttggtgcaaagaaattggtgacatggtacctgaaacaaaagtaaaaaatctgcattgctcacccataataaaagtcttaattgacaattgaaaattatctcaatagccattcattcaaaaggtggcgaatgtcatttgttacagttcaattgtaccaaaacaaaaggggaaacaaaaggggtcagtaacagcattgtttcatgagtataaaaggaagataaagatgataagaaagatgaagcagtttatcacattatacaaagggaacaaggaagatgaaagataaagtctaaaagcatatatatgtaaactgcaaagacaagaaataaatccagcaatatgtaatttgatcacccaaagcttccataatatgcatgctcttgaattgccattatttgcactgcattgtatccaagctttttgattcttggaagcacctcatccctaaagtttgcatacgtgttgatctttggctcctgattgcaatattaaaattaataccagccagcatagtacaggaaaatcataaattaccaacagacgcccaaaaaaaaatgtatacaaatggtaggcatggtgttattcgctattttttattatgtaataataaccgtacccgtttgtaagaaatacaaacatagattaattaaatataccctatgttagcagaaaacataaatcaaaaattatatcagtgtaaatatcagtaatttgtttcaaaacatcatatttgaatcaaccatccagcaaaggttatataaacggctaattgttgacgaatgtgcaaaaaatgtgctgattgtattaatatattattacagaggaaacttgtaacaacttatcactgcttagaagtagacagttataaaaattaaggctaacagcactttaatataattctagaatgtaagttaacttgaactgtatatggctagtaattaaaagaaaagatgcattaccgtgctactcattccaacatgagtttcgtatatccgcaatgactttggtcttttaggttgaggatgcttgaatatgtacttctcctgcatagtcatataaaacattttaataactagataaaaagaacaatctaaagatgccaacaaaaagagaaatttccaagagtccaaggacattacagaagtattcacaagtacaaatgaagcacttttttcaaggaacaagaacatattcaaatggcgtgtgcacgtgttgggggggggggggggaggtacctcttcaggaggatcataatatattccattgtatgggatttctcctgcggcctgcacagagtacttgatccaggcaggaatagaatcctttataccagatggagtttccattcgcacctagatgacaaaaggcatgcttgatacagggagatgctcacaggcccagagctaaaacactggccaagcaggataaggaattacctttacacgtgagccatgtggaataggagatgagccatcagcattgttaggcagaaaaatctcccaaacaccaaactcattctggaaacagttgcattagatatgagcatcggtaactaccaacttaccaatcatatggaattacaacactaggtccatgcattattagttacaacctcaagctactcatcttctcctatcaagtccacaaaaactgcaaaatacatctaggtactaaagaatgtacatgtaacatacacaacattaatgtactaccactacagtagcatcaaaaccgataactaacagttaactcatggcaacagtcaataacatataagagtgtgcatgatatatatatataaaaactcaatcggcgggttaagatggcccgcagcatgaagctaagttgagaaccccacccctgaacgcatcgcacaaccgggattgctcaacctcacatggggagcacgcttctgccagcatttgcaaggagggatttaattttttttgtgcgaaaatccaggttcgagtcaggtttaccactgcgctatacatgcgttcgcatgatatatcactagctcaactctagagtatagatgaaaccaatgctataaccaaataaattagttaaagaaatgtaaacaaaatatttttgaagaaaggaagggcatatttgtgagcctgtgggcttactttgctcatgcggtctgcatttggattccaattgttgaagtcacctactaatgctgcagactgcaattggaagcaaaaattagttcttaacaacgtctagtcaagtacattgacaagttgttcatctgagaattataaattccatacaatctggaatatctcagaatatatggcatggtaattatatctacatgtactagaaatatggaactaataatgtagcattttaggtaaatggtgagactatcaaaagaacatacatgtgccccgggagcccattctcgataagtgacaccttcagcactacatgggaagaaggatgaatatcactgagttattttgttacacccagagaagtgatgtgcggttacaatgtaaaagaaactatacctgtgattaaatccaaacttctcataaccgcgagaaaatgtttccagtcctccttcatactgatcaatgtctgaacgcagtctcctatataggctatatctgtattcaatcaattaaagcataatcaggtttctagtagagttagcatgggcatattgacttcatctatgctccctccatcataaaataaatcaactttccaagttcacgtacgaaagttgttttttctaggacagagggagtataacaatgatataaaagaaaggaaataaagttgttgtccagttgacagacgtcagcaaggtctaaaacccattatgtattttacatcatagataactttcagattaaatatttgcaaaattaatattgcatttcttagttctgacgccatcctatcactcttttgtttggtttgcagtaccgccccaacccagaaccactgtgaagagtactatctatgtattattagtactatttactatgtatgtccaatatactcatttgaccattaactttttttttctaactatatgttgacttaaaaattcttataatggtaaatctatttttttttcgcacattagtagtttaggactcttgttaaattttaaagcatgactgaatgatttctaaaacaacttccatttgagaacagatcagagtatatatgcaggactaaagataaaacttcaagagtctcatcagctgtgacacgtaagtagttatttgcatacatcttgtgaaagactgaacagatggagaataataaaaacataacctaatgaaactatgtgatctataaagaagggcggaaagccataccgatattcaagatggtacttatagccattaagcatagagtccatctggaatattttttgcccatctcctgttggtgggacaactcgtggtttctgctcagcagctaattcttcaaccactctcttcacgccttcaacgtcacttgctccagatgactcaatctcaacttcagctccaacctccgtgcttaattcatcatctaaggctggcaactacaacaatgtacaagagataaaatgttcagaagtaaaacataatgacaactgaacggaatgagcgacaacaagcaagactctagatcaatcctacgcatatggtgtgccctttgaggcctcatatagggtgctctagacctagatcatattatcattatgcacgcagacaactagtatggactaagtacataaaaaaggactgaatcactgaatatatcataatcccgtcacaaacagaaatcaacacgtctcaagacgtggactgcgtgaaatgtatatgatctcgtaaggtagcactgcacaagaacatgtctccattttcaaacatgacatgcaaaatgctgttagatatgtagcaatagtattgtcaaggcaggatgaatcatgatcacgcacctgcagatcgtctgaacctgctgaaaccggcatcccgtcgctctcgccctcggggatcatcacctcccctgacgcgcccgccgcgcgcacggccacgcgccccccggaaccccccacgcgaacggcacctggacacgagacgcaggcaaaaccaaaatgaagatcacgacgatttaccgcacccgcggcgcgacgcgacacggcacgccacctggtcgagccgaggcgcacgcgtggcgcgtcgcggcggacgagaacaacaaggtggcgcgggatcattaccggggaatctccggccggagagcagcgaccgcgacgtcgggagctccgccgccgcacgccagctccgggccccggctggcacggggaaccgcacggcccccgcccgtagccccgccgcgctcccgggaaccgcagacgccggcgccgccatctcgcccgcaccgcagccggatcggatcccccggcaacccccgcgctctgcttccacctaaaccctcctcacgcgagagccaaagcgaggaggcgctgcctggtggtcggtgtgtgggtgtgcgcgcgtgcgggtgcactggtgctgaagctaggaggagcggagggcgccgcgctatatagaggacgaggaggaggagctctggtcctgatggagcgaacccctcacgcgagagtggcagcgaggccgcccgagggtgggtgtgcgatgcgtgcactggggggacgggggcggaagaggcggttgcgcgtcggtccaacccgcggcgcacgcgagtcaggcggcgagggcggagggcgaggcttttcccctcccccctcgcggtgaaagcgtcggtttcccgtgcgcgcccgggcgtcgcgttgcgttgcgggggaagggagaggagaggagcgcgtccatgccatgccagccgctgctgccaggtggaaggtggagggcagcggcgcgcgcgcgcgcggggaggcaggcggagtcaccaccgatcgagttggcgtggcgcgggccgtgcggcacggcgcgggttggggaggaagaggagaggaaaaggaaaccaacggcggggaggctttccctctcgacccgtaacgccgcttgcgtcgcgtctccctccctgctacttgctactcctgtgcttctttttgtttttccttgtcctctttggtcgcgctttttgttacccagggaaaacaacaaaagggaagatgggagttgggctggacccaggaggcttacacgaaacaaattctcagtgaatggaagaacgcaacaccggtgctctgttgtttcatttttctgttctgctctgtcacctctgtgtaaacgttgaggagcacgtgagggagaagcactcgtgcgaagcgtgacctgactagcctagtagcctgtggtccatcatcctttctcgcggtgaacaatgggctgccaaaatggagcacatcctctagcagactggcgactccgcgtgcgtccagcggattgggcagagcgatttttctgttgggccagcccatgaaaccaagcacaccaaacgtgtgagttgagtacttaagaattcaaaaaagattaagttcattggaggtcccttaacttgacaccgaatccgtttatcctccctgaaccacaatataagatataggggtgggcattcggtctaaccgaaaatttcggtttcggtctttgaaaagtgaagaccgaatttcagcgcaaaatattaggaccgataaattcggtcttggtctcggtctcggtcttgactgaaattcaacaacattttcatatatgcaaagaaataatggaaattttcaacacaaaaatcacaaaaaaaatttcgtaagcacttatgagtaaagactcttattaggttgcatacctagaagaagtagggatgtgaaaattagagtttaatcctattaaacatagtgggttgtaggttgcatttagacgtttttttgataattcggttttttcggtctattcggttaaccgaggagactaaccgaattgaccgaacaaaattcggtctttcactacctagggccgaatttctcggtcttggtcttttcggtttggtcttttctgcccacccctaaccagatacaacgggtctctcaactgacaaaaccggtgcaagtaaggtcctaagacggtttggatggtgatttcggcttatgtggcatctacgtggtaagtttgacttggtcctcatcctacgtagcggtgacgtggcactggaagcaaaatttgaaaattaaaaattaaaacaaaaaaatgttggaccctcatgccatcgagcgtttggttaaaaactaaaagaatgatattggaacccacggccaaccctttcttttccctcttctctcccctatttctctatcccctttcctcatcatcgtggagctggtgacatgtgagggccgcgat

SEQ ID NO: 77543 - DNA, 1520 bp, Oryza sativa
gggggggttgtggtgggccaggagagtgacgtgtcggagtggcaccgcgtggggaccaccggggagtcgttgggagggtgggacccacgaagacgtggctggctgtgacagtagcacccgccaattttttaagtgtgggcatgttcggattaggacggtgatttggcttaaagaaatgttggacttgtatggttttgtaccctactaataagttgttagtgtcaaactctagtcaagttttggcgctactaatattttgataggtggaattgtaaatgtgtgtctttgaatttatgctaattgagagataaattttaaattatggtaaaaaatattctagtattatgccaaattaagtataagtattaccaaacatttgtcttcaaaccaaatcatcacatttactatttatactaaaaaaattggtatgataacactttggtatcaaaccaaaacgccccgttaagtatcagtgtatcacagtggctgcagctcacgtaaggggaaaaaaaagtataatcgctgatttaactctatgcctcttgactctcggtctctcgggtataagctacggagtacgagaggagctgatcctgctattacgagtcgctaaagtagcactgttgttacgagtacgtaataaatgtcgtattaggtatgcgaattttagtccgaaatgcacataaatgtactgttgaaatgctaccctagcacgaaccatgttgaatgcattgctgaagcgtttcgaaatgagcattttaaatgcgggaaaattttcgattctaaaatgttacggtacggtgtggagtaagagcaggtacaatagcatactataaactaactataaacatatattgagcagataaaaaaggaaagagaaaagcagcaggctacagatttgtaactagctgcagcacagacttcaatacacaacgtgtatatgacagatgagactaggtattagtagtgttatatgtttatagctaactattatatgaattggctattaaattaactatagataatttgaagctactattttttttgaacagtcagggcgttgccgatgttttatataaaaaaagaagtgttccattttaagaagagaatgggaccaaaccatacaatgcacaattaattaggaaaactgggcaaaaaccatggctatcgagacattccaccagctaaactaagctaccaaagaaacgagagcaggacaaccaggctcaacactcaacaaaaaaagttcacatgaacatgcaacaagctgaaaagaaaacaagtttcccaaacattggcaaatacgcaacgttatcgtcatcatatcaaaacttgggcgactccgacttcgtcaagaacactagggtcaggacagcaacctagcccatgccaaagcacaaatcaactaggctcatgtcatcgttgccacacgtcgagccccaccgacgtcgcagctccaacttcgcgaccaccagtctcgttaaagcaaggcctggccaaatcgacaaaccttgtagcct

SEQ ID NO: 77544 - DNA, 1037 bp, Oryza sativa
tcctccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatatattgaaactcgtcaagaacattcttccggggggaaacaaattgcccgagacaacgtacgaggctaagaagatagtctgcccgtta

SEQ ID NO: 77545 - DNA, 677 bp, Oryza sativa
atcccgccgtgcccgcgcgccataaagagggggaaatcactccccgtgattccctccctctttccccccacttttccctctctctctctctcggattcgtttggaaatcctcccgcaaacttcgccggcgtcattgatggagccgagatcgccgcgccggtttccttcccctccggccaccctctctcgcccccggctctatttaagcactccccgtgcctccctcctccgtttccgacccttgccgctttctctccccgtcagaatcgagctcgcgccgtcgtcctctctctccgccgtcgccgccgagcttcggttcgccgccgccgtcgccccggacctcctcccgcttcggcatcgcctccttcggcttcgccgcgtcctcatcgacctcgtccaccccttcgtttcgcccgccgaccgctggaacgccgccgtccccgtctacccgagccgtgccgccgccttcctccgctccggtcgccgttcccgtcgccgccgtcgacccggggtgagccgtggaccgccgtttcgcttcccccttccctcccctctctcgggcgccgctccgccgcgccggtggtcaccggcggcgaccatcggggcgcgggtgcgccgcctcccgtcggctgagccggcgtggccgccttcgggcgtgccccacgacagccatgtgg

SEQ ID NO: 77546 - DNA, 9859 bp, Oryza sativa
taactcgaattttggaagcttcaaacacgaaatttaaactttcaagtcaaatttttgaaaacatttgactcagatttgaagattttcaagtaaagatttgaaaatattcaaatcaaatttcaaaacattcagccgaaatttcaatatttgcgaattgcaacccaatttcaaaacttcaactcaaaagtttgaacttccaaatcaaattttagaaaaacaaaaaaaaagcgtcgatgctttgcgtggcgaattttttggcgcgacgtgaaataggtcacgtggcaacattttttgtcgcgaagcgtagggaaaggggaaaacgccgctaccctagctcggtcaacgtgcgaatgacttgattggttggcgcacacgcatgccatataggagcccccagccgttgaaccactcctcacgacaatgatggccttggcgaatgatcgccccaatgcatccatgccatgggcaagatcgatgacccactcaagctcggtgaggagttcctggaagtaggctcacatggtagcagcaaagatttgtccgtcacaggagaccttggggggtgcagtaggctgcgtcaccgttgctccgcctcgaggctgctatgtcagctgcggaagcggctccgtcgaccgctgttcgagcctgtcaccgtgtggcattgtggtgaaatgagaggggagcaaggaagagaaaagatgggagaagaaaaatgtggtgttggcatatggttctcataatgattcagctggtcgaaccaagtgaacaagccatgtaacaaatacaactatgaataatgccttggaagtcaaattagatcgcttttaataattggaggggggaagatacctagtattgtgattgagggatacaaattatattaaacctatatttaaggaaataaagtggacttattctgctcgtaaattactgtggttgagagatacaaattagattaaacctatatttgagggaaacgaagtggacgacttattccacccgtaaattacagcggcacgaaggtcacttgttctcctacaactccactaagtgtgaaacgcatgtacagtcaacagctttaggagtcattgggggcaacaagggtaaatggtgcgcacaattaggcctggtttagttccctaaaaacatcacatcgaatctttggacacatacatggagcattaaatatagatttaaaaaaacaatatagataaaaaaaactaattgtacagttggagggaaatcgcgagacgaatcttttgagcctaattagtctatgattagccgtaagtactacagtaactcatatgtgctaatgacaacttaattaggctcaaaagatttgtcttgcggtttccagacgagttacgcaattagttttttcatccgtgtccgaaaacttcttccgatatccagtcaaacatccgatgtgacaccctaaaattttcttttcgcgaattaaacagacccttagtaatgttgcaagtagcaaccttttcttttattgaaggctacctgttgctgccctaccatctcatcacatttcatcaggtgaaaacagcaaaacaaagggctacctgttgctgccctaccatttcattatacttcatcaggtaaaaacagcaaaacaaagggcaagaggaaaaaaaaaggaaaacaacacacacatgcacagtaacacacacaaccacatctgctcaggtgaaatgacgcatccaaatactgcctccaccggtagaacagatgtatagttccactatgacttgcaaaccggcttggaccactccttttatttctggtacaaaacaatcgaataagatgcacagaaattgctatcgcaatgatgaaagcattgtatggatttttatatagaacagtctgattacaaaaccttaaaaacttaataggataatctgaaaagcttaagttcctactgcaagtcactgggaattggctgcatacatcctcatcctgtttggatgtagaggctctgttttaatccattttctaaaagaaaaagtcactaagctcctatcaaatgttttcgtcatatgccaacaaaaggagaaatgacaccaaatatgcatggattgcttaacaataataagtttataagggaaaacctgacaaactatggttgtgagtcattgtggcctacaaattaaaatgccttggggagtaactaaactgtaaaatgttaaacaggtttcttgggttaagaaacgcgtaaaatgaacatcttcatcagatgttcatatcattctaaacatgaggcgaaattgctctaagcatcacccatgtcagatgtatgtactttttagaaactactaacaagataaacttttacttcaagacatttgaccaattttgcagtagagccatcattgtcaacctccactactatccaatgattgtgcgcagatatgacaagtaaaattattggcaccagaactatgaggacggcactaatgtaaacaaggatattttcctaagttcttaatgtctgcattaggaacgaaaacagattatatcattgagcctatgacaaggcagtaccacaaagagcaaattagattatccttagttcagctgcttcagaagttccacatctctaatgataatcctcttacacagcacatagttcatggtcctttaataataagaccaagcaagctctttattgtaaatattcaaaacaaataaagagtatctactattagttgactctaccagagaaataaatgtcttagttgcgtctgagtctatgacagataggtcatataacacaaacaatcgaatactatctgatgctgccgccagcctatcatgctcaaactaaagatagataatgcttacagagactttttaaaataaagttgctgctatagtataccttgtttgacaaaaggagagccctctgcaaagtacttagtaatagagtgaacctgccagtagattatagtcagtacacaacttcacatgtatttcgtcatgtataaattataaacaatatccaaataatacataccttgccaccaatcacctctggtagccagggagccatctggattctgctcctgctccttttgctggattggacatacaaagagaacataaaagtgtcagtgatacaagcaaccagaagctgataattaagagtgtcaatttctacgcacatttcctggtgatgcatcaccctgctttggtggagtgttgccataaaactcccgagcaccgtaatgcacagaagagccaaaatatggcgactccgatgactcgtttggatatgattgtttaccatccttgtatgcaccacgagctttagtagggctgtgcgatttgccatctgcatgacgaaagattgcagttaagcggctgctgtatcacatagaaatggagaatctcctctccaaatcaagatgatgcattaaacatggttgaaaaatttataagaggtagcaaaattactacaaagatcaatgtgctttgatgttggatcaaatgcaacagcgtgtgtgcgactgtgcgtgcatgatcgttgacgttagacataacctgaaatcctaaatccatttctcaggacaactaatgacatgaaagatgattatcctactctgttcacaagtttagccgcaattaaatactagtgtcaaataaaaaggatatcacacaaactacctgcaaagccaccgccattctgccctttggagttctgcttgttcagcatcgcgtacaggtccgcctgcttcgcgtctttcgtatttgcctttcatgtaaaaacaagggcagcaacatcagagggatacccaaataagatttcctagaaaccaagaactcatccaacacaaatgaacccgcccgaaacaattcccgaattcccgaattcagaacaacaaaaaatccaccaaaggaggagccaacctctcgcgcgacaatcgcataacagaaacagagaacaatccttaaaaatctcacgaatcgaaccaactacgagtctacgagggcgcgagaggagagagacgcggtataccgtgggcgacgcggagaagacggtgctgaagtacccgttcgccgccgccggcgcggccccggcggcggtggagggcggcgatttcttcctggagtccatacacgtcggtggtttgggtttcttggcgctcgaggagaggagaggagaggagagatgaacctagacttccgtggaaggagaagaagaagaggaggacgagctcgtgagcgaggaggcggagaaagatagggcacgtgaagtggtcgttataggcggcggcgcggctcggggtcggaggtgggaagcgacacttctctgctcgcctcgtggcgccctgctccggcctccatctgtgcccgcggccccctccttataaagggctcgagtcgaggaggggcgggcgaaccccctgttctgaattctgatgtttgtattccgtagatctgcaggggctgaattgccaaagtgcgatcgatatccgaacttctggccgccgtgagtacaaaaccggcgatgtagtatttttttggcaaactttttctacagtacaaagctttcaatataaatttgatcgcacctggcacattgcgaaacgaaaaaaatagggcgatgtttcattccttatgaaagaatgttgcagcacttagaaaaaatatttcagatctttaaaaaagtgaaacacaattggatcatcagataaaacaaattatttaatgccattgaaacatcaacaagatccgagtgaaatcgaagataaaaaatgaaataccataaaaacccagtgaaacatacatatacataggccaaaacattaaaacataccacccccggggtaaatggcaccacgatctggctaataaccggtagttagccagatcatcagtggcatatatcggagacatggctgacgatggcatgtagctgctggagatagtgatgggaccgacgatgacctacaaaccatcaccatccactcctacagtctctcatgacaatggagacatcgtcgttgtctctgttgtcacacaaacttagccaagtctacgccaccaccgcttcaactgcctaccattgttgcccctatccgccaccgtcgttggcctgctgctgtcttgctgtgggcttctgccttttactaccttatcgctgcctctgttttctcacagataagagaagatagaagatagaggaaagaaatggtggtcagagagagaaaggaggggagtgaataagaccaagaataaaatgagagaaaggagggttgttgagcgcaaggcgcacaatatttttcttcctatcggtgtccgaaccaaagcattttcggataaattgacaataaattttgctttagaggtcgtaaacttctgaaggagaaaagaggacgccactacaaattgaatgtacgatcttttttaaaaattgattaatgtttcatcacacgtagagaaatatttcatagttagcccaaaaatatttcacacacatgcaatatctcctaaaattagttgaaataattttctacatgaaacaacaaagataagttgaaacatgaaaaaaatcacaaacatttacacgcccgtaaacatcaatacacattgactgaagcatcaaaatttcaataagataccaatacacgctgctctctcctcttcggtggccaaattttcggctcctttttctgagccgaccactcaacagtgacaagagttggcacctccctcccccgttaacgcagagaggcacaatgccatctagaactcgtgccattgcgactgaggcaaggccacggtgacactaagtgcattggctgctacaacctgcttggtccgcaccaacccatctttgacaagctcccaccccagccactagctgcagtcccttctttgcgacctccgcgcatggcactaggtacatcatggagttcatgggtatgaaggttagaaacggcatgttcgacctaccagacttgagaatcgatcaattacgattcactaactacgaggttgcattgcacgcaatcatgaagtggccaatgacctccctcacctcctacatcgaggcgaaggcagccacacaacggtaatgatagcagtagatagcactgttggtagcacgggataggggagagagaagagggcctacgtagattggagtacctgataaaataaggggcgacatcaggcgaccgaatgcaagcatttttagagaacgtggtttaaatttgctaattaatttactacacatgacaacgttcgccatgtcgtaacaacagtactcgatgccactttgatatctcaaataataatgtagcattcgatctatatattcattttagatcaaacggtataaaatgccaaccaatgcacactattgtgaacccatagaggatcccaatagctgagaagtcgtcatcagtaggtgtgcgtggcggatggatgataacaactgaagatgctgggtttcccttcttgtgtggagtgtagtgcaaaaggaggaaaggggggaaaagtttctgagaaaatttgtttttccggagaaacaaagaacttgccgtttctataaacctccaatctcatcactccctttgtcccttataggaagtcaaataaatgcacatgcttctgtccttatttcagttctttcagtttgatgacgtgccattttttcccccaaaatgatcgtaagaattatcgcgttccagttcttttcccatgcttgacaatctcacatttaaaaccggtacctatctagctctatagtccatgctagaccaaattgacaaattccttccacggtttcatcagcagcatcggctgctgcacacgtgaaaggtagacaaagcacgtgtaggctgcataggatgataggaacatggtacatggatatcggatagcacgctagcatccgtcacttggcttcctacaccctataattaatcgtgtgcactctcctactacatgcacacagaccaaaagcagaggctggttcagcgaacagatcagcacgcaagatgctgccaattcctttcacctacgaccacgagcaagtggatgatccatcaggggtagggtgctggttatccatctgagaactttttgactaaccgatcgagctcttcttctactgtgctggtctcaacgtatcactcatcggcatcatccctccaaatccaaatcttaacgatcccgctcgatcggagagatcggcatcgatgcgggcggcgaatctttgcccccggtctgaaaagctactacttcacaacaataattcagtgaacaggaaagaaggttctgagctcggtttctagatattatcacgcaattcacaacaagtggtgtggggttctcccagctgtagatatctcgctcatctcacccagacatccacgagagagagagtgtgtgtgtgtgtgctcactcgtcacagatgcgagcaagcaccaataattagctcatccttatctcacagaaatttctcatgcttttctccatcgggctgaccagcattgataggtagcagcagggggccagaggccttccctttttatcctcttgccgtccaaaagcggctgcacgatgatgcaccggattagcttagcatccagtctttacctatcgcgctctctctctctctctctctctcacttgctgcatgcgtttggtggtgtggttccctgaaccagtgagagacgttcagatttgggttcaggttcgaaaccggaaaagcgtcgacgaccccaccaccaaatccggagcggcgaggaggacggaactcgccgtggttatcgcgatagccgactagccgaagccgatacgatcatcctaccgggcgcgcgcgggcggggatatgatacgcgtgacgcgcggtcggtcccgggggataatctagtttattgcgcggcgcgcggtggtttttatcctgatctgcacgtatcttccgcttcgacgcgtcggaggagcggaggtcgtcgccgcgccgccgacggttggggcttgatgggccaccaccaccccggttgacgacgcgtgcgaacgcgtcgctttcgcgagcgagctagcaagcgcgccatggggtgcttgctggatagatgaggcagtgtggcgcgccgaaaagttggcagtgtgcgtgcgccgctcacacgcgagcgagcgatctcgcggctggcctcgttgtcgccgcgacgtgagcggcgtttgtgtgtcccttggcgctgcggagggacgcggctaagctcgtcgaaaaaaagagatggtccgtcatgggtcagcgtcacacggcgtggggtgcatggttgcgtcgctcgtcgcgatggagactgtgtgggaggtaacgggttgatattcgtacgtgtcgaagattttaggctcgttcggagaggagctctgagccatagagactactacctacggtacagaggattatttttgttctgtgagaggagatgaatggaatctgagaagtttctcattacggcatggggtgtgtttacttcacgctaaaattagaagtttggttgaaattgaaacgatataacagagaagttggaagtttgtatgtaggcccatcacgtcaaaactttcctacacacacaaacttctaacttttctgtcacatcgttccaatttcaaccaaacttcgggtgtgtttagttccaaagtttttttttccagactttcaactttccatcacatcaaacctttcatacacacaacttttcagtcacatcgtctccaatttcaaccaaattctaaactttgggccaatctaaacataaccttcgttccaatttcaaccaaacttctaattttagcatgaactaaacacacccgtagaagagggcaaaaattatatgtgagtgctgaaggtcgaagactgcgacaaatgtgtcgtgtgaacagcatgaacaggtaaccgtgaacgcctcttggttagacggtggaattgcgaacactactacagataagtaggcgtagtttagttttgatgactgtcactacgtatagataagtaggcgtcaattggtacacagtataaaatactatgaagtttatgaatttaattttattcttcgtcagtttatgtatgtattgttgagaatatagacatataatgatttaatatattttataaataaatcatgatattatagatgtatactagcattaacgcatcattagatctacacatgtaaactaagcagtaaaatatgaacagatgaaatatgcgcaacatgtcgaacacgtaccgaggtggtggaaagaccgtttgctcggcaggaactactcgcggttgcgagcgtcgacgaaggcgcgcagcacgcgagcgaagaggaaggcgagccgtcgcggacgaacagggagcagtcgcgtggagcgcttcccaaaaaccttattgccgtcttctcccggtgcaggacgtcgaaggcagaggttccggagacctgctctcccgatcgcaggtgcacgccggcgagcgggatggagtagtctacgagcgacagcgcagcacagaggaggaggcaaaccctagattgatttcgtgtgttttgcgtgaaggcggcgcctcggtttatatagagataggacgcttgatcaaggcgcccgcacgatctccactccgcgtaaccgaaccggataagtcgcgcgtaacttatccggactccacaccgttttcacgtaccggatttttcggaatgtttccaaaacaaaacaaatccgaattttccagcagcaaaacaaaactgcaaaaggaggctgcatctgcgcaatggtgaggatccaattttgcggaccattcgacgcgtacgtcgtgcacgcacgccgcctgccaggcgaggcgagcgagcgcgcg

SEQ ID NO: 77547 - DNA, 661 bp, Oryza sativa
aggaaaagtctagtttccctccctcttttcttttcttggcttttcttattcaaaaaggatttaattaaatcttttttcctttagacccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttttcccgtttcgcgtgtagtttcggagcccgaagacccgcagtgcgaggatttcgaggatcaagctccagatctcgagcaaggcaagccacctttgaacatcttgagcctatatttgaaattaattatgttgcttgaaaaatattatgcattgataggatcgcacttaatctgttgtcccgcctgcaaggcagattggcggacctacctaattggttgcatttgatccttcctttgataattgttatatcgtgtcccctggtaaccatctagttgcgtctcgatattcgtgcaccctgtgcgagtatcgacggacgccttcaaacttaaaatctaataaaaaacttcttggataaaacttgggttttacgaaagacttggaaaacccgacacctgggtcggtgcttgcgaactaaatgaattt

SEQ ID NO: 77548 - DNA, 5359 bp, Oryza sativa
ttgatttcgtgtgttttgcgtgaaggcggcgcctcggtttatatagagataggtcgcttgatcagtgtgcccgcacgatctccactccgcgtaaccgaaccggataagtcacgcgtaacttatccggactccacgccattttttcacacaccggatttttcggaatgtttccaaaacaaaacaaatccgaattttcctgcagcaaaataaaactacaaaaggaggctgcatctgcgcaagggtgaggagccaattttgcggaccattcgacgcgtgcgtcgtgcacgcgcgccgcctgccctgccctgccaggccaggcgaggcgagcgagcgtgcgcgtgtgttccccctcttctctccaccacacatgtttcaagtggctaggagggcatcctcccttttaaggaggccccctctcctagaataagtaaggtggtactaaacttcacatgcatgccataccatgaggtgggcttttgtgattttccaaagaattaattttcgaatgggccttagcccatctattaattccaacaatcccccaccaaatctcaaaatcccactgagatttgctttttccaatgtacttttatataccacggttcgatggagaccgatcaaggttgaacatccgcctagaactctaagctacacttactcacaacttgaacaatggactacgccttgaattgcaagtcttgtgcaagcaagtttcattcagagtcttatctggtactagaccgtctgtagactacccctcgggtggagcgtataagtcatactcctaggtactttagtaagattcctagaagattcactcaaaatcttcatagactgcgaccaacagtcaagcttacaaaggtgagttctttcaagaatgctctgcaggatagcatattcgctaattaaagtcagcagaactcattaaggcatagcctacctgccttgcagctcacgagagtacatgcatcttcacttagagagggtatagattggtactctcctctagtttactaatggtttgttcttcccaggttctaattcacgggatctccaatcacatagactgggttaccaccatagtataactcacataggtctcaaacccatctccttcgatgcattatctatcacatttcgtgatagtcccttcgtgaaaggatctgccaggtttctagctgtttggatgtaatccaatgttataactccggagtttctcaatttcctgacagacttcaatcgtcttttcacatgtctagacgatttcatattatccttagaactattcactttgacaattaccgtttgattgtcacagttcataaggatagccggcaccggtttttcaacaataggcagatccattaatagatcacgcagccattctgcctcaacagtagcagtatctagtgccatcagttctgcttccatggttgacctcgtcaaaatagtctgtttgcaagacctccacgaaacagcagcaccacctagtgtgaagacatatccactagtggctttgatctcatccacatcagagatccagttaaaatcactatatccctccagtaccgcagaatacccagaatagtgaagccccaattccatagtacctttcagatagcgcattactcgctcaagcgcacgctagtgatcatctcccggattagaggtaaaccagctcaacttgctcacaacaaaggagatatcaggcctagttgcactagccagttacatcagcgagccaatgatttgggagtattccagttgattcctagtaattctcttgttcttgcgaagcaacaagctaggatcataaggtgttggagaaggcttactatcaatgtagccaaagcgattcaagatcttctccacataatgggactgcaagagtgtaatcacattctcacctctaattagcttaatgtttaagataacatcagctactcccaaatccttcatatcaaaattttgagacaagaatgatttaacctcatttatcacctcaaggtttgtcccaaatatcagtatgtcatcaacatacaagcacagaataactccctcaccccaccatggcgatagtacacacatttatctgcctcattgactgtaaagcctgcagatgtcaatgttttgtcaaatttctcatgcctttgcttaggaacttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattatggtcaatctagcaacaggtgagtaagtgtcaaagaaatcttcgccttctttctgagtatagcccttagcgacaagccgagccttgtacttttcaatagtaccgtcaggcctgagcttcttcttgaacacccacttgcaccccacaggcttacacccatagggtcgctctgtcacctcccaagtcccgttagcgataatggaattcatttcactacggacagcctccttccagtagtctgcatcaggagatgcgtatgcttctgaaattgacttaggagtttcatccacgaggtacacagtgaaatcatcaccaaaagacttagtcgtcctttgtcttttgctcctttgaggagcttcactgtcatcctcctcagtaacatgttcatgtgtatattcagtttgttctggtggtgtgattgaactgggaattatttcagagggttggctagaactactatgtgtatcattcattgggaaaaagctctcaaagaaggtaggatcacgagactccataattgtaccaacatgcatgtcaggtacctcagatttaactattaaaaatctatcggcaatgctgtggtgagcatatcccagaaagacatagtccatagtctttggtctaagtttgcgcttcttcgttattggtacattgactttcgccaagcacccccatgtgcgcaagtaagaaagtgatgattttctccctatccatatctcatatggtgttttgtccttatttctgttaggaactctgtttaacacatgattcgaggtcaacaatgcctccccccaccatgccttaggtaatcccgcggtgtccaacatggcattcaccaagttggtcagtgtgcggttcttcctttcagcaatcccattagactcgggcgaatagggaggcgcactctcatgtataatgccatgttcctcacagaataagtcaaactcgtttgagaaaaactctccaccacgatcagacctaagtctttttatctttctatcaagttgattttcaacttctgccttataaattttaaaatagtctagagcctcgtctttcattttcaacaagtacacatagcaaaatctagtagcatcatcaatcaacgtcatgaaatatcgttttccacccttcgtcaacaccccaatcatttcacagagatctgagtgtaggaattctagaggtgccaagtttctctcctcagcagccttgtgaggcttgcgaggttgctttgattgcacacaactatggcacttagaacctttgacaatggaaaacctaggaattaaatacatgctggaaagccgagacatcaagccaaaattaatatgacataaacgtgagtgccatacattagcctcatcatccacactgccacaaatatggttcacagacttattgcagaaatcagaaagggaaaagcggaacaggcctccgcactcataacctttaccaataaaatatccatgtttagacatgactactttattagactcgaaaaccaacttaaatccgtctctagtcagacgggagccactaacaagattcctgtcgatagaagggacatgctgcacgttcttcagctgcacgatctttcccaagtaaactttagatctaccgtgccaacaccatgaacagaagcatgtgacccattccccattaggacggtggaaccccgtgtgacctgataagaagaaaacaatgagatgtcagcacaaacatgtacattggcccctgtatcaacccaccaattagtagactgattaactgaaaaaacagtaggtaaattaccatacccgcttccatctccagtgttgccaatggtcacattagcagacttagaggtctgccctgcaagtgccttcatcctcttgcgttgtggacacttcctggccagatggtcaggttgatcacacacaaagcaagtcctctcatcctgattagaattgttgttgttgttcttcttcttgaagttggtggtctgctgagctttgtatttccccttgctcttgttttgggccttgtgcacaacattggctgtggactgcccaccatcgcccttagacgcggcatctttttcctgagctttctcctcaatatcaagagacgctatccacccctcaacggagtattcctgtctcttgtgtttgagtgcagtaccgaaacctctccaagatggaggtagtttcgcaataatgcacccggccagaaatttgtcgggtaagacacacttaaggagttcgagttccttagccatggtttgtatctcatgagcctgttcgactacagaacggttgtcagccatcttgtagttatgaaactactccatgatatacagatcattgctagcatcaatagcaccgaatttagtattcagtgcatcccacaactccttagcgtcggtcatatgcatatacacctcgaccagatgatcgccaagcacgctaagaatgcatcccacaaagagagtagtggcctcatcgaattctttctggtgattagcattaagaacgcccataggcttgccagtactcacaaagaagcatttcatagttgtcagccacagagtgaccctgatctgccatctcttaaagtacacaccggtaaatttatccggcctcagtgcatcggcaaaaccagccatagtaaaatcacagcgcctataataaggtttttggattgttgagaatatagacatataatgatttaatatattcaataaataaatcatgacattacagatgtatactagcataaacgcatcattagatctacacatgtaaactaagcagtaaaatatgaacagatcaaatatgcgcaacatgtcgaacacgtaccgaggtggtggaaagaccgtttgctcggcaggaactactcgcggttgcgagcgtcgacgaatgcgcgcagcacgcgagcgaagaggaaggcgagccgttccggacgaacaaggaacagtcgcgtggagcgctttccaaaaaccttactgccctcttctcccggtgcaggacgt

SEQ ID NO: 77549 - DNA, 2882 bp, Oryza sativa
aggacggtgatgcgggttcccgggttggggtcgagcagcatcttgatgagcttccgctgtagcgtccgctgccggacctccccgaacctgccttcacgcggaccggcggcgctccgattggggggcagcgccgaccacgcccgccgccgccgtcggaactcgcctgctccgccgcccacccgcgccgtcctctgcccgggaaggagagagagaggggaaagggaagaatagagagaagggagagggaagaagagaggagtgaggctgacatatggggcccacgtgggccccaccattttaaatttttttttgtgcagctgacatgtggggtcacgctttttattatttttccgagatataattgccatgtaagcgtcacgtcaatgccacatgggacgaagacctagtcaaacaagccacgtaggcgccacgtcagctaaaccgcctttgtaggatcaaggaggccgactagagggggggtgaataggcggttttaaaacttaatggcacttaaacaaaactaacctaagttgctaggcaaggtaaggtgtaaggttaactaagcaactaagttaagttttgcaaacctagatgatatgggctcaaatatgtctctatgaatgtaaatagcacaaatgtaaatgcaacaaataaatgaggcaagagacaaggaatttttcaccgaggttcagaaactcgccggtttcctaatccccgttgaggcgagcccaactccaccgctcaaccacgaagccaccgcacgcccccttcatcaaggggtgggcaaggcgggagccggcccacggagaggactacccaagcctcgatcactcggggtagttcttccttcactctgaaggtggtgaactccaaaccactcacaaacggcgccgggcctcctccacaatctcctcggagaggtcaccgggcaacacctacacaagccgtctaggaggcggcaacctccaagagtaacaagtctaggatgcttgccgagaatgatcaagtgtcacactagctaaaaaaatgaagcaatgcagttggattggcttaactcactctctaacacctcactagataaactgtcgcgaccgagaaaattgccttttcccgaacgctagtgtattaatccccgtcccaggaaaagccggggtacaccacacaaacatgatacaaaaggcacatctttattatatcgagaatatttacattattacagaggcgcttcaggcctggcaatcaaaaataaacagcagcggactagcgggcctacggctccatcttcacaggcgctcaactggggaataagccaggactccacctaagacatcttctccaaagcttctcttactgaatgggggaaaagattgagcaagaatgagtacaaccacagtactcagcaagccacaccggagatgcgtaattaatgcaagggagtacaaggggataataatataggggttaagttttgcagtaaacagcatttaaaagtcacttagttgcccaaagccattttaaaaagacgatcctagagctacacagtattattaatcagggtcgtgaacccacacgagcctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacctccgggacaggcaggcaggactgagcccctagcagcagggcaccaaccctgtgccatgacatctcgactaccgggccgcagctcgtgtagccttcatttgtcctagagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccggaaaacagattttaggggctttgaaagaggaagagaggggtatgtccaattccaccataagccaaccattccatagtgtccaaatgatatgagaattcccaaagtctaaagttataaaaccacctaatgttgcctaattaaccagcgaagcatctacctaaattcataccagtggaaccatgaatagagtacccactagttggggttttattttcctagggtgaacaaggtaataataacaatagcaataataatgtcttaacaaaggtaaataggcatggctaaataaaacagtgataacgcgggaatttaaataaagcggtaatgcattaatttaaatcaaaataattttataaactgggattcaatatgctcaaggatgatgtgacttgccttgctcgctttcccaaacgccggcttcaacttccatgaagagaggatcttccgaagctgcagcgtctacacgaccaacggaaaagaaaaggcttttactctactaaactccatataacaagcagaaacaaagcacaaaaatgggttcttgacttcttaaggaaaaattagagacttgaacggtccaattccgagttcaaatggcccagttatggccatttgaaatttatatgctcctttaaatggatatttac

SEQ ID NO: 77550 - DNA, 9927 bp, Oryza sativa
cctccctttccgctcgctcggaccagccgctccacccccgaacaccgtcacttgctgctcctctcctgccagccaccgtgctgaccaacgacgacaacttcaccgcactcgtcgacctgaccccgacagctgaaaacctcgacaccaccagctccttcaccagcccgaccactcccgtaacgctgccttcctctactgctttcgccgcttccacggcctgcacctccttagcttcctcatccaccacccccgccacgtcgactagccagcctcggttggtccctgctgacgaaaaaaccgcgctcggccgatggtgccgagtctgtgttggcgcgaactaagtcaacgaacacaacggccagggagatctaattagctccagtgcaggtccaaaagttgatgagatgcaggtgtgcctatcagtttgttcctgcaactgacaagatatacaaatagcagatcaatgagccaatcggctgacaagccgatggaataattccagccgatgccgatactagcctatagcgataaggttttgagctatcagctatatgtttgatgtagaatctgacacttgatgtaaataaagacaatcagctgatgaaaacaacaatttaatccaatagaaactaatcggctaataatgatatgatataataagcactgatccaaaggttaaagcatacatcggcttagaagtccgatgtcataaaatccacaagattagataaacagtgaaacgtctgttgccgtccgctaaatccaacttatgtgcaatccttgtaagccaatgcaacgtccagataactcatcggctgaaaccctgatgaaacccttattggcaatcaaaaagcaagctagggattatggtttgaagcacgacttagtagatcgaacttaactgatgcagcactaagtatgaaaagaaacataatatctagacaatcaagcccttgattgattttcagggtggtagataccttagctaatctaatctggtaaagcgatttagccgatatcggcataaactctaaaatgaatctcaaccgataaaagtaaatcgaactatcaaactagattaactaagatatatgatagataggtgcttacatggacaagatcagagtgttgaagccctagccccgccgatgcaagcaaccatgacaagtataaactcatcgaaaaagtagaaaagtaaaagagtggcgatgcgccgaaattgtattgattgtgaagatagtttacaatgaccccgggtgtacatatttatacccatgggtagatactagtccttgttggataagaaataaactttcctaaagataaaaggaaaacataaactccttataggacactaaacacactttcctaaagataaaggaaactacaaatgctttctaattaatagataaattatcatgccacatcctccttgaactcgatattttatatataaacttcgtttaattgattaatttccttaaccgaatatagtgacgacttgataattcccatcggccgattccagaactctgaagctgatattgactttatgccaatgatgacttcagggcttaccaaatttcactatttacagtcccttccttccccgccgccatcgctgctgctagagatggtaatgggttgacgagctgacatggatgcgggtggagctcgtcatctccttcctcatggcgtcgcagcgtagacagcaaatgacgacgagctactccacgacaactctcctcacgccgcctatgtcgcggccactgcccttgccaactccggcggcttgtaggatcgagatgtcgactagatggggagggggtgaataggcgatttaaaaactaaatgacacctaatcaaaactaacataagttgctaggctcagtgagggacaagtctaactaagcaactatgttatgttttgcaatcctggggtgatagtggctcaagtatatctctaggaaagtaaatcacacacctaagttaagtttttgcaatcctagggtgatatggactcaaatatgtctctatgaatgtaaattgcacaaatgtaaatgcaacaaataaatgagacaagagacaaggagtttttcaccgaggttcggaaactcgccggtttcctaatccctgttgaggcgagcccaactccacctctcaaccacgaagccaccgcacacccccttcgtcaaggggtgggcaaggtgggagccgatccacggagaggactacccaaacctcaatcactaggggtagttcttccttcacttcgaaggtggtgaactccaaaccactcacaaccggcgccgggcctcctgcacaatctcctcggagaggtcaccgggcaacacctccacaagccgtctaggagacggcaacctccaatagtaataagagatgacccggctcggagatgatcaagtgccacactagctctacaatgaagcaaatgcactcgactcttggctaattaaccctcaatcacacctaatggatgaacacaagaactagagagtgtgagagagtgtgcaaggggtgtatgtaagtgaagcaagtaccaagagagttcccttgctgctggtgggggagtatttacactcccaccaactaaaactagtcgttgggggcgaaatcccctaactcagtgtactgccggtcagactgccattgtgtggccagtcagaccggactactatgtaacggctagttttttagccattacagggcaatcaatgagcaattctgaataggccggtcagaccgcagtactgcggccggtcagatcggccacgcctcggtcagaccgacatcggctcggtctgaccagttgcggctctggattggctaccctagagcatagctgccagcctccagggggccggtattggtatttcttaatgacattactaaaagtataattcccagcaatggcgcagaaatactcctagtatattatggttacagaatttatccgcaagcgcacggatataccattgtagcatttcacccgagagtattccaagggtatcgtatttatttaatcccgtgggaagattatagtagagagaaccatactaataacttatatattacttgtaataatcatagtctaagcaggggttaatataatccataaggtagaatgacacacaagcatagaactacttattctcatactaaattgtctaagctaagtggaaagaaagtagaaaagaatctattcctatacttctaatatacatagtatacacacattctagttatatgattaactagctaataccctttttccgatgccctcctagtacttcgagaagccatcccttactgtcgagttcctcacgacagcccgtcatgaccatacaaacagggctaaatacggaggagtaccctctccaggaaagtaacttaggagtatatacacgcgtagaggaataccgtgttgagctgtcaccaacagcggcctacctctcatccgcaacatataaccccaaataatgatatctaataatctagacaccacgcctaaactaccagatactactctaaatcgtcatgacatagaataattgcataagcaaacattatacccgtacctatgcatctcccagataagctagcaatataatcagtataacatgaacataaagtaaaattggcatttatatactcggaaagtatttcaatacaaaaaatgtataaagaagaatattgtaaataaagtacaaagcttacaaaataggaaaggagagatactagatccatacccgaactcttccaaagacttctggactccgatttctattctattcctactccactagcttgcgaatactaaactaaacttgagagaatatgagaaagcttttgcttgaagtgtgtgtagaaatggagagagtgggctccttaaacaggcaggtaatgatggttatggcggttgctaaggtcggtaataccgtccaaccgccataggaaggcaatccacaccgtccagaagaagtcctgcatccaacggcgctgaggggggttcggccgaaccatgggctggcccaatctatcccattttcggctggcggcctcctcctccgttgctcacttcagacttgtgaattttgtcccaattcgtcgtttcaattctgagttcttggcccattcatacataagtctgattctcgacatcgtccgattgatcgatcgtctaatttgatgtcgattcccctccactttatggttattctctgcaaaaggttagtaaatctaatactagtggaatattattattctaactcaaatatgcattgcaaacataactagttctcctctattttgataatattgatggccgaaactgatcgctaacgaccgtcaacagccggtcagaccggggctcacccgacggtcagaccggccactacccgtcagtcagaccggcatttgtgcctcggtcagaccggccctggtcagaaagtctcaaatgaatataaatttagcaagtctaaatgcaaatgacctaatgtggcattttgatcatctctttgtctaggtcattacccctcttaatagtacggcaaagctataaataaactagcacaattttgatcgcccaacttctcgatcaatttaaaatttaaaacactagtttaccgtcttctttcctttgctttgcaccatcaaattttaatcctttggtaatcatccatgcacacatatcacgtggtcctaactcaaaatatataactcaatagaacggttagtccacaattagcgcttgttattaattaccaaaattaaccacgggggcctagattcttcatgactaggggccctcctccggcctctgctctagaccgccgccgtcctcctcaccaccttacgccggctgccgtcctcctcatcagccgccactgagatgggaacagaggcaaagcaggaagaaagagagaggggtgaagagatagagctgaagaggtctaacatgtgggcccacattgaatcattgcttttgacttgggtcaaattgccacatgggacaaaaccaccccactatgttgccatgggacctatattacaccggttttgacgcttgaaggactcgttgtatctggtatttcggttgaaggatgaaaattgaactcgctttcaagttaagggacctaaaatacacttattccattcaaaaatagtattgtactccctccgtctcaaaatacaagggatcctagtccatattcatagtattagtatgtgtcacatccaactcaaatctcttatattttgagatgaagaaagtaataggttactgctccattcgtctacaattaactatttgtgttctaaaataaagctcatgtcccttatctcgatcaatcacaatcattcttcttttaattttttatctactttctattatcaactaatcactactttctaattttcacatatttttttaatgtttgtgcctaacttaaaaaatactaacattttgtgacgggagatatgcgtatgtactattgttgttaatttttaacaaattttcaaaactatttagatagcatgtgagtaaataaatggacattccttgagagattaaaataggttctcaaacaacgattttaccctgtacatcaaaaaatatctcgattagtcgcaagaaagccactgaaatgcatcgatagaagttttgaattgctcaatgttggatccaaatgagtccaagttatttactttcttctctgttaacctgtatcgttacgtttgattggtgtaaatgtttggcgtgtcacatcgggtattatatagggtgttgcatggggtgtttgggcattaataaaaaaaagagtaaattacaccttagaccactttttcttgccattgttgcaatttggaccggggaaaaacaaacattttcactttaaaccacacatctttaccagttgattcagtttaggctagttattgttaccttgtacctcatgctgaccagctccctcttctcgaatgttctctccctccaaggccctctctttgtatctcttctcgtatcaccgaatcaagcgagcggtgagtcggtgaccccatcatgaattgtggcgctgtgaccaactcctattcgaggggttgatgccgtcggggtgaacaaagtactgtatcgcccccaatttgtccatggtttgaccctcatatatagggggatgatgcaggataagcctagccatggtgagagccatctcgtggctgttgcacaaatcggacgctatcgcgcatcacaatgatggtttccttgtagaggacatgctccaacaatatcacatcggctagattaaaacctccctggagttgccgcgctgagagcgttttgaggctgcgtgttcgattccgctgctatccacgtcgctacgcgccaccagccagacggcctgcccaagctccaatttcacgctgctctcggccgtcggatcgcgcgcgaaacgctgtgatgtgctggtatgttatgttaggcattaggcagtgtcccaacgattggtcgacacgtgagcctaggcccctacaactgctggttggttgctgcaccctgtgtggtttgcattagtccatgccatgtgggccctgtgtgtttgggtgctgtgcaacgagtgtatgcagggctgtggagtagggtagtggcctaaaatttcagcgtgttgcgtgacggtctagaagagtgtgcgtgcgtgggcacggtgcatgcgctgccgtagggtgcacggcgtatgacgagtgggtccacgcatcatctatcttcgtgagccaggtgtgcaattactcgacgcctagaaatccacgggtgtatcaaaagcagtgaacgggggtgtacgccactgcctcgttacgtgcggagcatccatggaccagtccgtggttctctgccgctgacatgtgggtccagttatggctctatgggctgcgctagatgcaccgtgaccatgcatccggttcttgcattgagacgtgggttctggaccgggtgaagagggagatcgtgcacacagccaaccatgagacaacacattggtacccatggctgtttgtactgtggaaggcttgtggtgcgctcggcgttgtgagctcggttcacagcattggtttccatgacaggtgggccatgtgcatgtgtcttgaggcggctatgctgtagacaaggtttatacagctaaaagtgatggatttgttgctttcgtgtgcttttagcagccgtggtgtgggtgagaagggagccagagctcttcttaatttgccagctgcttgtgtgttctccttgccgatcccttgcgctagccatcttccgcgaaaaatggccatcgtttggtgtgtgctgacgccttttgctaaatgtttcttgctacgatgtgttctttggaatgtgctcatctctgtcttctctactctgtaggggttttcggttttgttgtgttggtgtggttcttgctgcttgatttgtccgcctgagttagctgacaggatcttgcatgctctagaccaggtatgtcgctggatgtgattcttttagttcacttcggttgttgttacgattcttgatcttattcggtttttggttgtattggatagattttctctattggttccacatcccgcaacctcttctttgctccttgctgtgctgcttctgtctttgaaggtgaggtttgttgcttctgaggttctacattcgtagcctgcttatagcttcttggtttatttctttggtttgttttgcagctcacatttcttcgaagggatttcacgctgtcggctaggctgcgctacaaggtaaagacattgtttctttctgtgccttaccagtgcattgcttccttgcatttgtgtttgtctccgatggtttcttgtgtgcatgtctcctgatgtggtgctgctctatggacccagtttgtttctttgtccttgtgcatatttgttggttgtgctactatagtattatatatatatatatatatatatatatatatatatattaaatgcacagtatatgctccttgctgtgttggtgcgtgtgtgccggtagagcgagaagagtgttggctacaatcttccttctggtcttggcctaccactttctctcttcttaaagccttctagccgttgtgcctgcctcatccttttgtgtcgctctcctctctttgtgctcctcttctctttctctgaaactttcccctgcttactttccttcttttcccgttggtagtattgtaggcaacatgttcgctatcggagtgtcacacgtatctctgctaaatgccgctgctcagcactgcatgctacctagtcttgcctacttgtgggagttcagctttgatggtacgttgttggctggagttgaggtcagcgttccatcagtgtgccactccgatggtttggaaactatgtttttctgggacatggcctcagctccgcttgggactgcacatgaactggtcgctgagcgagcattgaggtacctccagcatcgatatggctttttagtgcacgattacaatttaaactcaatgttggcttacagaagaattgcacagaccgctatacaggttgctttgtcagcctcaggttgtattgcgcattttaggtcctcttatggcccactggcgccgtgttgtgaggatgttcttagaacatgtagctcattgtattttagtttccatgtagaagacatggagcaaatgggttcttttccaatgtaggggaacatgggtttctggggttctgtgtggtttcttgccccattgtaatcctatttgttgtttcttattgttgctttctgttgtgctcatcctacttggtaataatggaatgttcttttttgtacaaatttttggtggttgtataggcattttgtgtgcatgtccaaaagatctgctgatagagtgtccagggtccgtgcaagtcgtgaaaggcgcaatgcacgtaccttggccccccccccccccccaacttgcttgcaaaatgaacttcccctaccaggtgggacaaagagaacacgttcccttatggattttaagcccgctttggcagctttcaataggcaatgacggcgtttgcttttaggaaggagttcttccttagtttcagatgaggacagtgcacatggtatattagctttctcatgggtttatataattatgtgtaatgttgattgtttttctgatagtttagatttggtgcagctagcagtgggtttcatagaggtagttcttcgcggtcacacaaggatcatgctgaggctttaaagggtttgtacatgttcagtccatatatagttggcagttttttaagataagcttatggtagaaatatttggttttctttgtagcatcataccctaggaggtcttattatggtgcaccaacatacgagtgcccatactgtggtgccgtgttttggtaccaggagagagttaagggcgcttctgctatttcaaaacgaaagatagtttacaataagtgttgcaaaagtggtaaaatacagttgcccaaactatgtaaaccccctgagcctcttgctacactgctaaaatttaatggcgatgcacgctcaaaaagattccttaggcagatacggtccgacaactctatgtttgcttttacttcaatgggtgcagctgttgataaatcaattaacactggaaattcaccttatgtcttcaaaattaacggtgttgttcatcacagaattggtacacttttaccgtcacatggaaagcaacctaaattcgcacaactctatatcttgacccagaaaatgagacacaaaatcgaatgaacatatatgaaaatgatggtagtaacgctgatcaagctgagcctgttgtagttgatgctctctgcactatgctagattgtcataatacacttgtgcaaaaatttcgctacgcta

SEQ ID NO: 77551 - DNA, 8952 bp, Oryza sativa
tacaatcatgattatttcttcttttctgatgttaacagttggagctgaagttgaccatggcaagatggagttactcttgtctcaactggctggtaaggatatcactgagattattgcttccggtcgggagaagtttgcttctgttccatgtggcggaggtggcgtatctgttgcagcagctgctccggctgctggtggtggagctgctcctcaatctgaggctaagaaagaagagaaggtggaggagaaagaagaatctgatgatgtaagatacattgctctatgcttgagttcatggtatcctgttgatcagcatgagtttcttcgaattgcttgttcatctattttatttgcactatacactgcagtagtattccttttgggttttctatatacgcgatcaaatcatgtcatgaaattggaatggtacatacttgtatcagttttcatctatagataattttactcccatcaatgtctaggctgcatcgtgccattccattatgatggtagtacttgtttccatatagtatactttccagcatacgtatcatattgtttttggcatggtactagcatctgacggattgatgactgattatttctttttaatcttgtgtgtgcaggacatgggcttcagtttgtttgactaggaccattccttggattatacccatttttggttaacttgggaaacggcaacctaaacacgctttttgaattactccattttgttctataacaattcagatgcaggatattgcactgatgactatctgtcgaaccatagatttgttagaaggtttcattaccaatgatttgtttcagcaaaatcagcaccgaccatgatatgttgagtttatatgcttccctcgctgctctttactactgaagaattcacgtttttagttgccatgtttagcaaatgcttatatgatatctggagtagtttccgtttgtgcacaaatgacgggtgaatttagcaaattattccgttctatgcctagatacatgcggagcctgcgtgtgctgctttcgtcaaattggactgtggtcagccaacgttgtctgacctgaagcagatgcaatgggattggaatttctgccgtaaacagctgcgcctacggcgatggaattcccaccgtagttgatcatccaacggaaagaggaacaagttgctgttgctagttgaaacttgaaagattgtaagaaagctccaagaccgcaaggagaggtgtactgtcgtttactcgtggttgaacgtctgcagtagatgcaaacgatgatacgagtttggatttcagacattgcgagtttggtttaggaatatatggcatgagaggtagaatattttcccgaattaaaaaggtcccctccaaatgggttattccctccaacacaaaatatatatatagcaacatcttaccatttctttttaagaaacactctataaaggtaggcttccacaatgcgcatacactcgtctctataaatacgcacacgcataccatcacctccggtacccctatgatcacctccgaaaaactgggcatcttatatatttttaccaatctattggtaatgctaaatttggaggcgctatatatttttttggtagagtagaatagtatcaattgtattgatatcgcaaaaattggaagtgatccaaacatatgaaatacggtattcgaaaattaccaaatatttggtagagtaagttttgacgtcagaccaaagcagtttctaatacttcccctgtcctaaaatataactatctttaagcggatgcgacacatcgtagtactatgaatctagacatgcatttgtctatattcgtaatactaggatgtatcccatctatttaaagctggttatattttgggacatgtgtagtattagataagatataacctggtatgttcagaatcatagtactgtggttttattcagatccatagtattaggttgtgtctaatctctgtccagattcataacatatttgtctatattcatgctattagattatgtccaatatggatatttactgggttgtgtctcatttttactaattttttttagtacagagggattagtattatttccatttgttaccttagcgaacggcacccctgtaaacgctcgatttttaggcaccgacgagcgctcgccactcgcgggagggcaaaccgcacgttccgcaattaattccgttccgaatcccgagccctctcactaaacacacctaaaacaccaactccgttctcggcaattcagcatcagtcaagtccaaaaacagacgacacccacacacacccggagagcgagcgagcgcgtgcgcaccgcacggcccaggaaacaggaaacgcggcctggctggctgcgacaccgcgccggccgaaccgccgaagccgaagccacccagggagggattcagccgcgcgagtcaacggccgacagccctctgccccagaagccaacaataacgggagaaaagaaaaaaaattgagccgcggaaggccggaaggggactccccgtcgcctcctctcctccaaatcccaacccacctcaccgatcccatctcaattctcaccgcctcaccgcgcccgcgccagcgcctcgcccatgtgatgtgagtgagccactcacactccccctctctatcgccgcgcccccgattcgcgagccgccccgatccctcccgcgcggctgataaatccgaggcggctagggttgggggtggaatggggcaggaagggatggggtacaacaacggcaaggggggaggaggcggtggcggcggtctaccgatgacggcgccgcggccgcgtggggcgtcgccgttgagcagccacggccaccaccaccgctcgcgcaagatccaccgcaccttcaacaacgtcaagatcaccgtgctctgcggcctcgtcaccatcctcgtcctccgcggcaccatcggcctcaacctctccctccccaaccagcccaccgacgccgacgcgctcgccggcgccaaggccgtcgaggacatcgaccgcatcctccgcgagatccgctccgacggcggcgccgacgacgacgccgccgccgccggggacctcgccggctccttcaacgccaccgcgctcaacgccacggaggcggcggcggcctacgcctccgctgtcgaacgctacgcgctcggccccaagatctccgactgggacggtcagcgccgccgctggctcaggcagaaccctgggttcccgtccaccgtcgccggcggcaagcccaggatcctgctcgtcacgggctcgcagccggggccctgcgacaacccgctcggcgaccactacctgctcaagaccaccaagaacaagatcgactactgccgcctccacggcatcgagatcgtccacaacctcgcccacctcgacaccgagctcgccgggtactgggccaagctgcctctgctccgccgcctcatgctctcccacccggaggtcgagtggatctggtggatggacagcgacgcgctcttcaccgacatggctttcgagctgcccctctcgcgctaccaagaccgcaacctcatcatccatggataccaggatctcctctttgagaagcactcatggatcgcgctcaacaccggcagcttcctcttccggaattgccagtggtcgcttgatcttcttgatgcgtgggcgcctatgggtcccaagggattcatccgagatgaagccgggaagatacttactgccaacctcaagggacgcccggcatttgaggctgatgatcagtctgctttgatttacctcttgctctcgcaaaaggagaagtggatgaacaaggtgttcatagagaattcgtactacttacatggcttctgggctggtctagtagataagtacgaggagatgatggagaaccaccatccggggctcggggatgagcggtggccattcgtgactcattttgtcgggtgcaagccatgtggaagctatggggattatcctgtggagcggtgtctcaggagtatggagcgagcatttaattttgccgataaccaggtgctgcggctctatgggtttgctcacaaggggctcgaaagccccaagatcaagagggtcaggaatcagaccacaaagcctattgatgacaaggagaatcttgatgtgaaggccaagatatcgaccacttcttgaaaagtcctgatgagagttggtatggcaatagcatacttgctttggctctcttcaaggtcagagcattttgtgacttggggatggtgttgttttattttccactctttttttctattctttttgttcatggaattgttattgttatgtaacagttagaggttgcaatctaatgtttatcatggagttaaatgtgataggggctcaaatcagcagaaatagacttgccttttatactgcgttacatctcaatgctactatgctagcttctagtgcaacaagcatatactgatttcgtacgtggtggtggcttgagtttatctatctcatcttcaatgctatatttaagtgaagatatgaagtaaaattttagtatggctaactgaagaaaaatatgattctaaaacttgacaggaggctaggaactcaggtcagaaggaagtagcctcaccttgtgtattgcattgcacttcaatgctagctttctagttcaaccagcatcaccaatatactgattttgtactggtttttgcttgagttcatcacttcatctatctttaaaccatagtgcatttaagtgaggatatgaagcaaaacatattgcatggctaatttgaaatgtataacattcaaataagttatacgcagaactttatatctcacatttgcaatttagttggtttagtgaggaaaaaaaagaagacatattccattgttatggaacttgcattaccaaagagtaactaccaatggaaatataatattttataattcgtacttgttttttaatagatatacaagaaaatatagcatggtgttgttgtttttttttttttactgattttgctcaagtgccacgttttttttctgcctgacgcatcattcccataagtcctaaaaccatggttttgacttttaagcaggaaagtgtggcatcttagttttatttatggatctgatgtctctggtgtattattattgtacaaaattacttaacagtgatggttcattcatacctggttagtgaattatcaagcttttgggtttcccccaaactttcagaggtatgctaccggtttggtttcctctcgatttgccaattcattgtgttgcgtacatctatgtccaatctatgatcctggagtttacttttttttaggcatctggatattttatctcccttaaattgttcaaaactggctagctgttaggaaattacttgttctgactgctaaaaatcaggcttcactctttttgtcattttgttttaaattatgatgcagatggaattaatccgagttgatgaaatgcgtcccaacatttcttaatgtaaaacttaaggctgggaattccaatagttgccattattttccggagctcttgagaaaaacaatcaagaatctagagttgataccctttgaattgcataatgtccattttctgtctggaccatataagtgcaagttgttatgtaacaggcatactgcttactctgagttgcttatattcttcatgtactctctgtatcagttgctgctgttctagtgctttagctcttgctaatgctgggaacaacaaattgcttgccttggagttgggtcatctcagtaatgcccctgttttaaaaatctcagtccatttttgttcttgtaacttttggtgaaagcctcattactgctgctgtggtatgttactcagttcatgcatctagttaatcttgcgactagacagtgctctgtgcagaaaaacaatttaagatgctttcagcattattctggcctcctatgaattttatcaaactcttctggagttctacttgttttggcccctggaatagtggaattgctggctccctcaggcctgagcggtgcctgctatgtacctgtttttttttttagatgggttaataatttaatcaacccaagatgctgatttgatcatggacagcaagcaagtcaacggtccaactaaaccactgatcaatatttactaattcgctaattatgctagctcaggatctgatcatgcaaagcagctatttctagctggagacttcagctgtgatttgttcgatttgggttaggctgtgtttagttcagcgcaaagtttggattttggttgaaattagagatgatgtgactgaaaagttgtgtgtgtatgacaggttgatgtgatggaaaatgactgaagtttagatccaaattttgatctaaacacagccttaattcgactgctgctagatactcgatgtcatggagatttgggacatggatctcaagaaactgccagcaacgatctgagaagaagacccgagcatgtgcatcatctgtcctatgaaagccaaaacgcccccatacaaaagggttttgaatctccaatcaaaattcagaatccgagaggtcaacatccggtcaaacttttcaaacattaactgtattttaaaatgcttagtttgaaaacataaaaatgatgtaaatatatttgtcttgaaaaaggcttccataatctataaacttgttaggttttatgaacttaatctaacagaaaaaatatggtcaaaatcgcatctcaaaaaccataaagaaaaggtaaatctcatatttttagcagagacaatactttgggttcttttttcctgaagatgaagattaagttttttactcaaaacgaggtggcattaatatacgattgattgagttttaattattacaaacttgaaaaataggttaatatgatattttagagcaactttcatataaatatttttcgcacgaaacacaccgttttgcagtttgaaaagcgtgctacgaaaatcttaatcttcatccaactcttatttgacgcacatgcctagattcattaacatctatatgaatatgggcaatgctagaaagtcttataatctgaaatggaggtagtagtatcttattaatagtaggtaggagtaggagcttcaggatattgatggataacattcagttgaattaaactgtttatttatacaccattggttagccggtaagcagtgatagacgtctgtttacaagtaatcatctgatataatcccttcgtttctaaatatttgacgccgttgactttttaaaatttgtttgaccgtttgtcttattaaaaaaatttaagtaattattaattattttcctatcatttaatttattgttaaatatatttatatgtatacatatagttttacatatttcacaaaagtttttgaataagacgaacggtcaaacacgtgctaaaaagtaaacaatattaaatatttaaaaacggatggagtataatatggcctacaccaacataaactaactgtttgcacaaaatatttgaatgagatgaatggttaaacggatatgaaaaagtcaagacgtcgtctatctattatattattaaaacagctttgaaagaagacaccacgttcgctgtgggggctagaaattcccacattaatcggagaaaaagaaaagaagagtccaagtagaaatacaatttaaaaattgcttgaaattcgaaattaaaaataagcaatattgaaagaagagtccatataagaacccaatacgagattaatcaaattcagaataaaaataaaataaaatctaaaattagaaaagaaaaggagagtctaagtagcaatataatttaaaataactgaaattcgaaattaaaaataagaaatattgagagaacagtccatatagtaacccaatacgagattaattaatattcggaataaatataaaaataaatctgaaattagtaaaaaggaaagaagagttcaagtaagaatacaattttaaattaactgaaattcggaattaaaaataagcaatattgaaagaagaatcgatgtaagaaacccaatacgagattaattaaaatttaaaataaaaaataaaataatatccaaaattagaaaaattaaaagagagttcaagtaggatacaattttgaaataactgaaattcaaaaataaaaaataaaaatattaaaagaacactatacggtattaattaaaatttgaaaaaaaaattctaaaattagaaaaagaaaaaagtatttccgttaggaatataatttataaataactaaaaatggtgataaaaaataaagactattggaaaaaaagaccatctaaaacacatgacgagataaattaagtaattataaaggagtagagtagtggcagttgatacgacatataaaaactgttaataaaacaccaattagaatcctaataacgattaaaaggtggggcgacaggcaggccgtgaaagcaaacggacaatgcggttgccgggacctagaaagtaaagaaaatagacctcattgataatcatatccgacttttaaaatctcaatgacaataaaaaggagaagcagcgggcggggtgtatagtagtatagttgcagagccgccgacggttggcgggacttctaaaaaataaaaaatgaattcgaacgatagttgtgttcgattttggaatcccaatgataataaagagtaggcggtggatgggccgtagaggagtatagcagcatcgtttgacgggacttctaaaaattataaaaaataaaacctaacaagacaataaactctaaaaactacaaggcccaatttttaaaggttccgaacttctaaaatcatgtttgattttaaaatgtcaattacaataaaaaagggaggcagcatgcgagccatgaaggagtacaattgtaaagccgctgacggtttggtgggacttctagaat

SEQ ID NO: 77552 - DNA, 9129 bp, Oryza sativa
aaataaaaaggatatgacggaagtaaggggtagcagctgatatgacttttgaaaactatataattagaaatacggggatgataaggtttggtctttcaaagttttaagacaacgagatagctatttaataaattttaagtaaaatcatactgaaaaatatatgatttagtttgggggctagccacgcaattgcgcgggccacccagctagttattataaaaccgaaaaagcggtgagagtattcgtattagttcaagtaacactcttttctttttttttacataagttcaagtaacactcttgaggatattacttgtctattaaaatcttatgcaagattgcagtattctctaatttcttccaaaggtaattccgttgaggatatagaaatgccttttattgtcctggaggctggagaacatacactgaagaacttcagtaagacagcatcttttgatgtcaacaatatgtaatttctctttctcatatatgtacatacagtatacaactttgatcgtcaagaaaacagccatcgtgaaaattaagaaacagaaaaaatatatatgcccccggtaatacaaaacaaaacccagttaattgataagcagaagctgtgccagcgaggacgactcttttaacattttccccaatgcactgcagatcaaggcaattaggcaaagctgatcgtcccatgtttccagcctacttctcgattagcttgcgtgcacgttggtttgctcctttcaccctcgagttgagttcatccacatcgccttgcagatcatccagcgctttgttttgcctgaaatgtatgttggttaacatagtgaaactccatttgaaaccactagcagaacaggagtattatcctatcttgaactattaggtgttgggtgttacaggtgttttggttgctttgttattatcaggggtttagtgtagctttggggaatgatctttatgcttataggatagtgtttttagtgtgaatcttttcttaagtctatgtgtatcttttctttatcaataaaatgaggcagagcttctgcctttgtgttcttgaaaaaaatatatatttcaccggtaaaaaaaaaatctgtctttttctgaataaattaaggagttaactcacctatcaagctctgaacccatgtcacaagccatgcccttgagctgcccaagcacaccactgagatcatctagggcatcatcctgcttttgtttctccacctgcaaaaccaaaaagaattgaagataatggatgctagctatgctagacaaatctctgattttttttattttttttgcgatggcggcagagagatcgagattaaacctgaactttctccatggcggtggtaggctcggcgtagctgcgattagccgacttcccactagggctcagccctagcttctccctctgctcgatgtggctcgccttctttttgaaggaatcatctgaaacatatcatatcgccatttatatgccaaagaacagtgagagcacatgatcgaactgggaattgaatttttcgatgcagatatatgtttgagttcgtacccgagacatgggctggacccttgatctgccttgttttcttgggcttccatggcttggagaagaaccctccaaggctccccagaagcgactcgccctatacacaagagcaaagccatcatcaaaaccatcatacattctcacatgaaatcctcaactttggcacgacattggcaatgctaactgaattttgtcaggaatcaagacggcaatgcattatacttctcactccgtttcatattataatcgtttgactttggtttcaaatttttttaagtttgactaaacttatagaaaaatatagtagcatatctaaaatatcaaattagtttcattaaatctaacattgaatatattttcataatatgtttgttttgcgttaaaaatactactatatttttcaacaaacttgatcaaactttaaaaattaagtttgattaagaaaaaaatcaaacgacttataatatgaaacggatgaagtacatagcatgatcattttttcagaagggaaaaaaagattcaaaatcaagctattgaccttggagaggtcctggtcgatttcgacggccttctcgtgggtgcggctgatctgctggccctgcttgttgagggtgacgagcgtgttggcggcgtcctccctgatgttctcggcgatgcggaggcagccgcccagcgcgtcggtcgtctcctcggccttgtacgccgcgtagttctccagctcctgcaccgactgctgctccagcccgcccgagtcgcggaagtcgtccttgtaccgcgccttcgccgcgccgctgggcgccgtgtacgcccccggcttcttcttcgggaccaggtccgagtccgagtccgagtcgaaggggtcggccttcgacgaagcggccttgccgccacgtgacaccggcatcttaatttgccgttaactcgctaattataatccctagggttcctgcaaaaccaaacagcccatgcatgtcacactgcaaatttgcaaaaaaaaaaaaaagactccaaagatgaagaaattttcccatacaaaaaaaatggataaaattaaagaggaaggaaccatcacagcacgaacgattaaacaaagcaaatacatgaactgctggagatattaattacaagacgagaaattggcatgagagatcggccaaattaaacctgcagtaattctttttgtattgtttggccctccctttctccctgatcctcctccccctggagggcaaaagagaggcaatagatctccctttattagaaactgaacttctttttagcaatgcaaatccttctctcttatatagtggcctcgtttaccaaacgaggtgttatttttgggaaactctcatggtccatcggtgctggagacacgactatattcgggggttttagaaagaacgtgcttctttaatttatcacatgctaattaattagtccaattaatgacgtgcaagaatgtaggcgacaataagattgtgagcatgcattttcaagatatagcggagcaaaagattgcattcttaagagtataagttgatgccgattttatgcagagaaggtactactgtccatgattatgtttactcgtggtatccttaacttgagcttagcaaatattcaggggtagatatagctgatttagaacattctattaactcatggttgcatgcatgggtggtgctggaccagactacctgagcatgagaagtgtgctggtgtcaactggttacgtttcttatggtaaaaacatcttcttctaagttcaagttttagatttcacgagcgctcacattaatttaagatactaggtgaaaccccgcgcattgctgtgagaatttagtatgataataataaaaaaaataatgtgtaagatagctagataatatcatattaagtagattaatgtggttcatgataatttaaatctaaatagtgtgtagaatggtgattcaaacgtaaaaaagtaaggtggtatgactttatggaagaagaaaagtagggagatagtttggaccgtagattaatcatctaaagactaaaaacaattgatgtgatatgatttaattagaggaaaaaaggagaaagataatttgtaccatagattaatcatttaagcactaactaagtgaggatgaactatatgagtatataggatatcataaaacataataaagatatacattgaaacattatgtgaattatgttgggtgataatttaacatgtttgtatttgaaaagctcttaaattataaaaactataaagatatagcatgtttgcatgatgtttaaatgtgatgattgttagtggatgatgatgtggcatcttgttaattagtggagatgatgtggtatcttattagtggatgatgatgtgtcatctttgcatgttaagcctaaggagttagtggaggataactttatactaggatagaatacccatcgatattgaggcatctgtggtgacttcgctaatctcaagatatatcggctcactctttcggatgcatgtgctcattgagataggttgtttgtatgtatgttcgtagagatgagtgtgtgtgttgtaagtatatgtgtttatagtgcgtttatataaaaggaattgtgttattgtgtttcatctatgatgagaaacggaatttctggaaaattctctggttatttgatcatatattaccatgtataactaatgtcttgtgtattgtttttcttgccaaaatgtgaaagaaaaaggtttccaaagcttgaactgttaacgagacaagtattacgatttcattctgttgtccaaaaataggtactcctttgaatgatagaatttattcccgcctttgctttatccagaaaatacgtataaatagaagtggtgagaatactaactaggttaaggttcaaatgtggggcatcggagtctcggagatcttctcttgtatagtctctcattttcaccagcgccggatccttggcaatatactctcactttaacagtaagttgttttttttaaaacattttggaacctcaaccctattgcaatattaggtactgcaaagatactcccataggctttggaatcagtgtgtagaaattcataacatcagtatccattcagctacccagatcgaacttgggcggaatctcagtcccaactatagtgattccgacaatttaaaacactatccatcaccgtcagcaaaacaagcatataactgtaagtcaatagtatgggatcatactgcttggcacagaatttgtcatgtcaaatggagtatatggtaaactacaagaggcaagtctagtgtacaaaaattgatgaaagggatacaattgagaaatgcccaggcaagtgctttcttgcaaaagccagatgcatctacaataacagcatccaacagcaggcatctctccgtccaaacatatcctttcgtgtatatatacaggaagatatttcctataacttaaatgctaacttaaagaaccaagtgatggatcttttgcttcaagaactcatacaatgaatgtcttctttaacactttcttgcctcttttcctgtttgtgctcaaagcattaagaatttctgaatcctcgtcgttcgaaagaattctagcagcatcaggtttgtccagcagttgcttggccacaaggtacccagcaatagaccaggtttggtaaagacgagactgtttcccaatgaagcgtgctcgtttggtgtcatagtattcaggccatttgtcgatagcaattcgcctctcagctacctctacagcttttgcagcaatctctggtctgttcatcttgatagatgctactgtgagctgcacgcaaagaaagtaatttctcagcaactatatgttgagcaaacaaatcatagtgaattgtcaattgttactacaaactgtctgcatcaggtaaaaacaaagtcagcaatttcaaccacaaaaaaaaaaaactttgttacagaataacgaacctgccataacaatgttggccaggatcctccattatgatatgaccaaggcctgaatcaatagatattactaagaagatgctcattggaacttgaacatgtacatagatgcaaagataattattccgaaaactcacgtattctttgggtcacttccagtaatgatcttccattcctggttctctagagcaggatagcatatcttcaatggcatctctgccactaaatcagaccatttggattcaatcagatccaaaatggcatgggattgatgagttgttgccaagctgcttactatggaccataaattccccagagaaaagaaccggaagtccatgtgagctggctgcaggttcccaatgaagtaacctcctttaggaggtatccactcaacaagccacggagaaacctgatcaggatatatgttgaacttgttcacagcatcataggaatattcttctgttttatatcgataaatctcattcagcttctgcatgtcaacccaatagtactctctaatatgaaaggacagtgcgataagcctattgtttagagcacgtattaaatcagctgatccatcttctggggttaacatttcacgcgcgcacaggagagctgaatagaacagtgcctacataaaacaatatttacgtgagtttgctttatcacaaaagagaagctgtaatgaaaaatacaggaatactcaatgtcagcccctttttttgaaaaatattattatagcccttaccttgtaaagttacgtctgaatataaaatgtaagtgaggccttggattaaggtgatgaatgtattcagttcacttaaactaggataaggcagaggaaagttattaggagcatcagcaggagaagcaggccatcctcttcatcattgatgctgattattcaatgtgcacacctatgaactaacattgttgaggacgacatcacagttattcctatcatcttgttgcattcaaactttttcaagattgactttggtccttatatcttattacgaaacttaaatagaaaatatactctattgcaacagaaatttactatggctaattgcaattgtttttaattttgatcgtgagaaacttgtaggaagtgtccaatttcaaaagtttatatttgttaatcatccaaataactaccttagctgaaatttctgatatgccaacagtaacccagattaattagtactcatacctcactgccatgtgggtgacacatgatacagcaggaactgaacaagaaaattacatgtttccatatagtttttgcaaatcattgaaatggaaatactggaattggaaaattaaatgaaaaaaaaactatataaatcttctgtgtgttaaaagttagatattatgatgttacaagatttttctaattgatgaatcttgcttcagttttaaaattaagttccttgctctacatgctcctgactttaaacttctatcatttccatgcccattttgtgagttgactgttaagtggctatgaaaatgaccattttgtgcgttttgagtcaagtcagctttcagttatcttagcgagccactttcatatggagatcgctgaaaaaactcaggggattggaaaagataggtttaacttttgagggtacacatgcttttgattgaatgggataaaatccattcacaaaagacacagaattgacaggagtatcgtaaaaaacctgaatttcaagtggatgcccatgaattcccattcgacgatcaatcatgcatgatccatcagttaccagtaatgtagggaacatgtcaaacccatcagctaaacaaagctttaatatcattttaattccagtctgaacatcaattctctcctgaactgtcagatctcctgaacactttccatacgccctaagtaatatgatccaccatagacctgaaaccatcaatcacatatccagttaagagttagtagaagcagagtagcaaaaaagaggatgtgctagctatctccattagtagctctacctgaatcaacaggtgccacacggcctattgctgcctccccaaaatcaggatccaagacctcctcagttgcatcttcatctccatcgagtggaattgttcgcaccttgaagctagcaggcattaagccctgtcctggactatggcagtccattgtcttctcccagctctacataacaaaatgacagcagaacttgttacaccttggatagggcatacaaattcattttgttgctacggtaactagaagagatatttgccaagaactttaaggatggcaatctcagtaagccaacacatttaagatgtgtaattgtatcattgtgcatcgacttttacatgagaaagcaagcacacagccaactttctgtcaacaattttatgtggaccaaagcagctcataagaaacaggccttaccatcgtgcgcacttcctcaagagatcaagctattatatgtctaaagaaaaaaacctagagcaacatattcagatggtcacaacatgaattgaaattatcaaagctggctcatgtgaaataattttattaccggaatgttcatttacactgtcacgatcaatacaaggcctggatctaaaacacgatgcaacaatgaggaagcaacgaagcaagtacctgaagctgaagggtgtgcaaaatgaaattgcgcacaatttcgtactctcccttcaatagaaacgcgatgccagatggtatgaaatcccgaataaacacctgatcataattcatcggattggcatcattcgggtcgttggcagcaatcgtcccgaccggactaccacaatagtaaaccacggactcccgcaagagctcccaagcttcatcctccacagaagacgccttccgccgctggggcggaggcttggcggcgctcccgtttacgctcccattgccacctacagcctgaccaggcaccctcacatcaccgagagcatggcttgccttgtccaccgcatccttaacccacgccccgttcccttccgtgaccctcgcaaggtcatcgatgcgctggcactggcactccacggcggcccgcagccccggaaacctgaccggaccttggagcgccctggagctgtgcaacgaattggcgctcctcctcctcctgcccctcgcggcgtcggccgcgaggggcaaattggatgccggggagtgggcggcgaatgcccccggcatactgtggagggccacctccgcaatccccattgccaccgtgctcccaactcaaatgggtgactgcaagaagcaccgcgcacggccatgtgttagataaaagctaacaaccaccagaaacgaagatcccaaaccgaaacgaattccgcgataatcgaaagaaaaaaaaaccaaacccaaattccatgttcgctacgctcagcatggcaagaacagccgcgcgcgagggatcacatgaacaagtggcgcaaatgattaacgcgaggaggagaggaggcggggggggggggagcaactcaccggccggaccgccacggtacgttgggaagcgcgagtggccaccggttcgacggagaaggcggacgctaagggccggggggagggggactgggtggagtggcct

SEQ ID NO: 77553 - DNA, 13020 bp, Oryza sativa
  unsure (1)..(13020): unsure at all n locations
gggaagaggagagaaaggaaaggagaggaaaggaaaagaatagggaggagaggaagacgaaggaaggggataaaacgaagaccggagacgaaacgggggaggcctggccgcccggggcctcaacgccaaccatcccatctctcgcaagtctcgccacgcatcctattttccgtttttcacatctcctttcttcttttctttcctttttttttttacacatgcgtagtaggaatcttttcgagttcaacgcgaacacgcaccggcaacaacaaatatcccaaggtccgaaatcgcatcgtttgaattttgtgacgtataggcaggtttcttttttctttgagtttttcatccactttgatgattattctcaaatgtcattctctcaagtgacttctgatcatttgtcatccgaatccaccgagtcgtttctattctattgtttttggctaacatctaataataagagtgatgaataatctctccacccctaaactctcctcaccccttctctcctgtctttatcttcatctcatcgctcggacttaagaatagcagccgaagagggtggcgttgagctcgaagaagcaatcgttggaggagaatcagggttcgtatcgctactaggagtgcagcgtcgagcaagtccagcgtgtcgagtagcaacatgaggaggtgtgagtaggacgcgatgtttgggaggaagttgtgcttgtggaggagaccgaggagctatagagtgacgggtgggacgcaacacggcaacggacacggcaaagggagttgagtagtggcggtgacggcaggttgcagagcaatggtgggaaggacagcagtagcgagtgtaggagcaagcgtctggggacgaagaacgagtgacaaccaaaggttgagctggaagtacaggcggtggtagtggaggaaaggaagcaatgcgaaagagagcggcattaacgtgttgctggcacgtaagctcgtcggagttagtcggctggatcctggaggatagtagaaagggggaaggaggaaggggaagaaaagggtaatttgatcctaataaattagaaaatgttgtgaagggtatgcagtggtatatatgtaataattgtaaaatcgtaatggcatggttgtaaataggtcaatagtgatggtatatttctaaaccacgaaatttattatggcacgaatccaattaatcctattattgtcgacgtttgatgtcgcaattctggtatttgcatagtatggggatcgtcggtgctaggatatacgcgagaatgaggtaaaagagacggagacagggatttttatacaggttcgggctctcgaattgtcaggtaataaccctacatcctattggccgaagccggtattgctcttattcatgataatcacaccagtacaatatttggggtagcctatctaactgttgtcgacatagcagtctgacgatctgactcgtagtcgacaacaaggtaaccttccacctcgaatccgtgcccgacgagatcagagatagcgctttcgtctctcctgacagtatccggagacaccgtagggtactagccgtgcttatccctgaagtcgatatccggcggcgtgtcttggcatatgtaggcttctatgttgtggcttctatgtcgattgtgttgggtgttgatcctccccctctcctcctaggggagcttgtatttatacccataggtgtccccttgtccaggtagaactagggaaaccaatatggatacaatccgagtagtccttgtcgtttccacgtagaactctggttgtctttccttatccggaactcctcctatatccgcaggttatttccgtataggacatggtatgtggtgggtcatgccgagatttagtcaactactattaggtatgtggtatccataaccctgacaattatatatgcccttttatggaatcaaattatcaaaaagaaccataatttcagcaggactccatgttgcttggtcccttacatcgctcctaagtggctaaatgggtggcaacctagggcaccacgccacctcccccacagtcctccctttcctcctcaccgtcgtcggagttggacactgaaaattgagcaacggcaagaatggcggtagtagggcttcctcccttccccggtgccctaggactagcatggtgaggatagggagtggatctagcgtgcgtgagaaggtcaaccgcctaggtacatggcggtggcgtaggctagaggtggtggcaacgactaaggtgtgtgcatccagaggcgaggggatagttggatctagttttcctaggccaaatatggtcaaggaaaccagatctggcaatgttgaccatctctatgcgtcaggtgtggcagcgatgggggcgaaagtggcacaagtatggctatgtaggcgtggtaaggtggcggtgcaggtggcgtcgacacaaggtggctgcggaggagtggaactggagtagggtggagtcggcatggacacatggttggcaggtggggcacggtcatagacatagctggcagagagctggagaggcaacatgaagaggttgcatggagagataagaggggcgcttggagaagacaccgtagaagggtgactcggatgcgcacgattgctggtgcttcttgttgggcgaaaggccaagtagtggctcaagcaatgaggacacggtaagcaatggcatggacaacggcttggatgatggctagcaagtttcttttgatagattggaccacttttaccctccttggagctcctcctctctaatggtcggtctacttccggactctggtcacggggagctccatggtgatgtttggtctggcttgaggtattatgcttggtggaggatgagtagatgttagcatcgacaatgctttgaaaggtcttgtggtagcgagctaacccatttggtggagatgcggtgcacgaggcttccatggctcaaccatgcattggtgtgttagagtagagtcagttatttagctgagtgtggcaagctcgacaatgataaccctcaattattctagttttggggacgctaagaagttgcggtgcaagtggtttcttcggtggctgtgcactgacttgttatggtggagtcggagctacttaccggggatggcaatgacaagtaacaataaccttcaactacttttatcttggcaatggttgtcaagatctgtagtaggcatgtagtaggagttttggccaaaaaccttgcttagtctaggactggtgtcgacgatgtcaacgtctatgggcatcgtttcccttctcaaagtcgttatttttttgcttttcacttttctttaggtgaaaatttagttccggtgttcagacgggctttgtaagtatcttagaagatactttcctcctcggagtgttcgcccaaaaagccctgcctcgtgtgttcgggtttttaagactgttgttcgttatgaaaagttggagctacttgtttagctaggcaatgatgacttgttctctgcatgggtttttgtcggtttttctcgattaaccgtgtgggtataagatttttgagcctagtgctcctcataaactgagcaagtctctttttcttaatgaacacatgaacttcctaacctcttttgaggttttccttaaaaaaatatatagtcaaattattgattattagctgttaatcattgaacatataagccactatacgatttgtttatatgtataaataacgtgaaaagaacatacagatcagtcatctaaatttctgtttaagcgcttagatagtacaaaaatgacaggaaaaacaaaagaatgaccccaggcactactagaaaaagcattttcgctgatgttgggtatttattttcgcaggtggacatgaccctgggagccaaatagctacctacaaaaatgtaaactagggtgatgctcgctgtccgcctacgaaaatctatccacctgcaaaaataccgcaaaaatacccttcatttttgcacgcggaccaattatgtggtctgcctacgaaaatagatttggaatataaatagagccaacccaggggcgacttttttctaagtcctcctccctcactcctcagtcctctcccgcgcgcatccctcccttccccctcacctctcccctcccctcacctctcctcctctccccggtcaccagccggaggcggtggcggctcccagcggcgggcggcggcaactcccggcccctcccccctccctcccagatctggtcggaggagggcagggccggcgacgctcccctccatcgcgacatggcggcggcgctcccatccctcgcgacatggcaggcggacggcggcggggcgcagcgggccggggcggacggcggcggctgccctccttccctcccagatctggcggtgacggcgagaatggtggaggcggtggcgtctgtcctccctccttctagatttgtgacgatgaatgttaatttgtgatgtgcttgttttgattgtaaacaatttgtgatgctttgtgaatttgatttggattgatggggaatggaaactagattagatgggggaatggatgccaatttttttaatgctaggagctcttttcgcaggcagactagttatacgcatattttcacaggcgttcatttacatgcggacaactagtctaccagcgaaaacaggtttagcacgcctgtgaaaacctctttgatagtagtgaggtcccagccaatagtgctcgagtttttatccaaaaaaaaacatagggaccagcgatactgaggccacgaaccttaacatcacgtcttccagattccgactatctccttcccctttatccatccgcagcgtcactgtcatcacgcgattgatagctaatcctatcgatcaatcgatcgatcgatcgatctcctccttatcacggactgccgcggcaagtgattggcacgggtgcacgtagccgcgtacgtagcctgaactcctctttcggtctctgttcttgtgatgctaaaataattaaactgatttgtttaaaaagatcgcagctccctttcttttctttactccaccatcagcgtcgtcgtcgatccgctcaaccatttggagttaaattacgaatcaggctgtcagctagcagcatcttggcaataatgcagtgccaattaggagtaagctcgtagatcgtaggcgtagagtcgttcaaaagctcctaaagttcagttaaaaatacagtgaactggaatcagcagaaagcatttcgaggccaaaaggccaccactcggtgtgcttttccacgcgggacgaaagcagtttcctaataccatttcgaacgatttccgagtattcaagtttgaaacagtaaactttacaaaaatttgtattgaaattttatcaaaaaaccatcgttcagttaaggttcgaggggcatgtttgtaaccaaaataaatcttaccaaattttggcaatatttcttacgtactactttgtccctaaacctttttagtccctgtcacatcggatgtttaacactaattagaagtattaaacgtagactaatgacaaaatttattccataaccctgaactaattcgcgagacgaatctattgagcctaattaatctatgattagcctatgtaatactacagtaaacattatctaattatagattaattaggcttaaaaattgtctcgcgaatttgctctcatttgtgtaattagttttgtaaatagtctatgtttaatactccaaattagtgtataaacttccgatgtgatatggactaaaaagttccagtcccatcaaaacacccctttaatgtgttgtataacaaatattcttttcttctaatatattgacgtgcaatccttttgtacgttcgagaaaaaaaaagcatacttgcatgtgcaaggatgttcaacaatgtcgttaatagaagtatagatatattagttagagaaaatagtcaaatacaatgtaaagataagatatattctagagataaaatagagtcctagagatagaatcctagagataaatctactattacttgtattatagtctaagtctttatcttctatatactcctgtatatacctcttaaaagggttgatataatatataaaaaaacataaaaaatacaacaaattaaatttttctacagtcgtgctcacgctgcataccggtaactagtcaagaaaactatttgataatgctgcttacgaagcaccgtatattcacattctgtttttccgattacaacgatgtacacccacttattagtattcattcaaaatgatagaagcgaacggtaaaatttagccccactaaaatcctactgaaaacacacgtgtaagtttaggacgtgactagatgcccggtgtctaatctagtgcaaaaaaattggatgtttaaaatattgcggctgaccattagtggaacatcaagttatacattgttaaaataaaatagtcatataaatatttgaaaaatatgtgaaacacagtaacatatatgttgaatattttttctatcaaaataccattatatgatatcttaaatatttaattacaatgtatacaatagtgtaaactaattatgtaccggataaagctgtgtttgcaatcccatgttcccaatccctcttttgtttttcgcgcgcacgctttttaaactactaaaatgtgcgtttcttacaaagagtttctatacgaaagttgcttaaaaaatcatattgatccattttttaaacaaattagcaaatacttaattaatcacgcgctaatggactgctcagttctccgtgcgaggagtttagttcccaacttcccatatccgaacacagccttaagttaacgaagattcatgcatgcaggaggggctggcctggtgagctttgcacaaagagaacaggaggtgcatgcatgtagtgcacatttggtccaaaaaaaaaatgtgcacgcacacgcagcaacaaaccagtagaaacattttccgcgtctttaacatgaacctaatgaataaagtcatatactccattcctaacccaatgactagtatgatatccatagtattaaataagctaccacctaaaataaaaaatgatatggcaattgagtaaatgaggaaagagaaaaaaagcaggtcttgcatgagatatggtttctacgcaacattcaagacattatatgaaataaatacattaaatttaagtatggaaagatggtgttcgcattgaaagagtagtgtctagtattaattttttgataatgtgaagttttatagaaactatgtctagtgtcttgggctctcaccatggtgttcagaactagtgatcaatcgcatttataatcgaatccgagagatacatttaataacagtacatagttggacgaattcttatctttgaactgaagataaatctcttttaaataaacactaccttgacaagcaaacaataaataactactagactctgtctgttgttacaatcagctgttgtcaatatatatgttgaatatttttttaaaattttttataatcatttagttaacatgtaataaacgaatgaacgtctatccgagtgattagaatcatctcacaagtcttacctaaacttttgcatcgtaaattgcataagagtaatctacaatatttccttttcaccgagtaatctatcactatggtcaaatcctatagcgaagagactaaaaccttgtggtcatctcgctcgaggagtgtcagagatattaccagctaccgacgacgcaacagccaacagagcatgagttgcccatctgattttgcatcaaagccagcatgttacagcttagatgagcttgtgatagctctgggagtggcatggcaccgtctagcaactgcacgacttgccgtatgcccggacgagcactgggcagaggatgtaaacaaagcaagcatagtttcagcaccaggcttgcttcttccacggcaaagtcgccttgcagcggtgggtccacagcgtcagtgaccgtcccttgccgccaatgctccagcaccatgtccaccaacaagaggttaccgccgtgttcgtgtcttgtgagacaggcctccgtccgcaagtaacctctagcatgaacacaccgaaggcgaagatgtcggatgcctttgatggcctgccagtgtgccctagctcggaggctaggtaccctattgtgctgaccacgtgtgtgtggtgtgtgggtcggtgccacgatcatataaccttgcaaggccaaaattacctagtcgacagttcatttcggcatccaacaacacgttgcttgtcttgatgtctcgatgtagaacgacttgttcccaatcctcatggagatacaatatatactcgatgcgatgcctttgatgattctaaacctttgagccaaactcatgattttgctgttctcagcatacagatacttatcaagactatcatttggcatataattatagactaacagtagcttacccatccgccagcaatatccaagcaactgcacaaggttccggtgccgaagttgaccaatactccctccgtcccaaaataagtgtagttttgcattattcatctctaatatttgaccgttcgttttatttgaaaaatttttatgattactatttttattactattagatgataaaatatgaatagtactttatgtgtgactaattttttaaaattttttcataaattttacaaataagacggatggtcaaacgttggacacggatttccacggctgcacttattttgggacggagttagtactaaccacctcggcaataaactccttcattccctgcctctatagagatgaagcccaagcccttcaaggagtgcttcatcactgctatcaattttcactgcaaattcctcgtgcttgctgctacccctacatacagaaaaacacacacacacacacacaaacacctgacctgcttattcccttcatccgtgccagccgactgctatggcggcatgttattcttttgttgtatgttttcttcttcacatgcacttctataaacatatcattggagtatgagactcatcattgtgccacaatagcgtatcatataatcatgtgattgttcaagatgttattcaaattcgttcaagcttctcctgagcggcacaagaaactcaggataggagctttacccttaccgtactgatgatgattgctcaaaaaatcagacatacagggtgtgtttagttcgcgtcaaaattgaaaatttgattgaaattggaatgatgtgatggaaaagttgaaagtttgtgtgtgtaggaaagttttgatgtgataaaaaagttgaaagtttgaagaaaaagttaagaactaaaccaggcctgtatatggttctcccttgtgtcagttagtagttcttgccaacacaagtgcacatttgcgtgtggcagtttcatggcagagcgtatatgcgaatgcgatccacggttttgggtaatattatctagcttttaataagaggatggatgtgctgcttcattacatattctatttttattcatctatcaacaaggctgtgatcacacactttctattttgataccattgtacaaaatgaaaaagggtaggtaggtggcttctattatttgcgagttgttgaccttggccattatatttcttagctgttttatgttgcagtgaattaggattcagggtcaaatcgtatatatggaacaccattcttgcggtattcctatatcctatatataaatagtttaagtttcactgccggcctttttttcttttcagcaaagttagcttcagtcaactctgttctgaattggtttgttaagtactagatggaccttatggatcattgaattccacggaaatacactgaaactgatgagacgtgagactaaatcaccgactagtcgactacttttcgttcggccattaattgaaggccatatttattcgggttaattagattcgtaacattaaaaattgtcggtttggaaatatatcattactatttatgtatttgtaccgatgccattgatgctggtttgtaatctcagtgatgccactaagatacgtatttttgcatgtattaaacaaaaataccctcatcttctacctctctctccccttgtcctctcctctttctctgctcatgctcctctgctcctgttgttggcgatgcttctctactgctctctgattgggtcgacccgtctgcatccgccgccggagctcgcggcactggacaacaccgtgcaggtccaccggtgctcttcacgaaggccgtcctcactgcgtcgggctcgggcatcgaggtggccatcggtgacgaggtggatcaagaggcagttgctggaccagagaaggcaatgatggcgcatcgggcagctgcgagcgtggtgagggaggtgcaggagctcgtcagagaggagaagtggccactcttcaccgctctttccttggtcctttgctgcttcggcattgtcgtggccatcgcccagggctccttgctgcgaggagaggcggacggatctaggataccatcatcaccatctccatcaagcatcggcctccatcttccccgtttccaccttgctagccgcagagagggactaggggagggaggagccacattgtcggagtagttggaggaagatgccatcggcgatggggactgagggccccatggcaacgttgtcgtttgtgtggagctctgcgtaggaggacgccagtggcggcacgaggtgcagggagacacggacatcctggcttaaggagcaccggagaggaaggagatggcgggtgcggtggccttgtccatcgttggtcacgcttgccgctgccgttgctaaactatcgcctgtctctcacgccatggaagagaggaggaaggaaaaagggaaagaaggaagaaggggaaaagccacaggttggttcatttttttttaaatgaatccaaggggtaagtagtggctataaggggtaagtagtggcatatctcaaatatgtgtaaaatttcaatggcacggttccaaatactattttgaaaccaacatatttttaatgacattgatccaattaacccatatttagtttgtttatgtgttgcttgaattttatgctaacatgctagtagtatccatgttgtcaggtcattctgttgataaattttcgaggagtaatcttccagaaatggagaagcgcaagtaagtagccagtctcctgttctcagaagctggttgaatttggaagcttgaaaagcagtggtaattgcaggtacctggttccatgtaacatgccagttgggcactttattttcatacttcattccaggctacatttgcctccaggaacagcgttgtttgtgtttgtcaacaacactttgccccagactggtgagttttgcatatgaagtagtgttttttttttgtcccgcttgaacctctgttgaagcttcagacatacaattttgttgtggctgcagctcagctgatgggcagtgtgtatgagtcatacaaagatgagggcgatggcttcctctacttgtgctacagcagcgagaagacattcggttgaccaactcctccgtggagatctgctttgctgtaggtttacctcgggcgtcaataatatatgcatgtatatatattagtatgattagaaattacaatgatgtgttttatatactgtacattgattgatgtgaatgaagtgttacaaggaggaggagaaaaggttcataccgaacttaattatcccacctaaatttgtgaggcaaattaagaagaacataggccgtgtttagttgattaggtgtaaaaattttaaagtatacggatatatatttaaaatattaaacatagactaataacaaaataaattacagattccgcatgtaaactgcgagacgaatctattaagcctaattaatctgttattagcaaatgtttactgtagcaccacattgtcaaatcatggcataattaggctcaaaaaattcgtatcacaatttacatgcaaactgtgcaattggttttttttccgtccatatttaatgctccatgcatgtgtccaaatatttgatgtgatgaaatttttggaagtttgaagggaactaaaaacacaggcatagatcactcattttcaaagcaggatacagagaatttaagagtttaaatttccaaagagctttgtccgagcaggcgagcactctatcataagcttgcttgtacaatacaaggcttgactcaaacttggaaaatggcatccatgtatatatgtgtatgtttnatcggaaaagcgaacgcgcgcgtgcgcgttgncggcgagagtttccgatagtttagcttaattaactaagtgattagtagataatgacggtaattaagatatgattttcttttgtccggaagatttttttactaaccgattgaaaacttttgaagcaaattttaaaaactttcaaaactcaatttgaaaatttttaactcgaaatttaaatgtgtaagataaattttgaaaactttcaacccagatttgaaaactttcatctcaagatttgaaaactttcaagtacagatttgaaaattttttaagttaagatttgaaaaaatatgaaaactttcgactctgattcaaaaactttcgactcagattcgaaaacttttgactcatattcgaaaacttttgactcggattcgacacctctcaactcgaagtcgaaaactttcgactcgagattcaaaaactttcgactcgaattcgaaaacttgtgactcaagattcaaaaactttccacgcagattcgaaaactttcaactcaaaatattttgaaaaaaataagtgtgctaaagattaaaccaagtaataagaaaaaaaatgaaaaatcccgaaaccacgcaaaagaaaaaagaaagagcccatcgcgaaaaaaaagaaaaaatggctgatgggccggaaggcccggtagcagatggcgcgtgcgccaactagcaatccccatgttttatatactagtaataagt

SEQ ID NO: 77554 - DNA, 2688 bp, Oryza sativa
tatattcctaaaatttggtgacactaataagaattcaacagggtcaagacgtaagcactgcccaaacaacctctggtgggttcaattgagcacaggcagctttgcatcagcaggagaattggttctaacatgcatggtgcagggacaactgattctacgaaaagccaggagtaggaacaatcattaccaaagctagtactcacgtccagcgcaactacatatattaaggcaaataataacaccacagaaaggcaaaaggattacattatattagattaaacctaagatgttgtcatgtatttgcgagaaacagtaagctcttaaaattactaaatatgcccaaaaaaaagggaagcaaatgttaactagagataacaataacctgataacaagccatactgtctgggtgacgccgcgagatacaaatacagttgaccataaatattaaggaagcagatacagtatgaggaagtactctcagagttccaattttctatcatacggtacgcaatctaatggagactgaatatcgattattgcatcatccctttcacgatttcaaaccatgagatgccgaaccctacgaagaagccaccggcggagatatcagcgcaatatagaagcgttacgccgcagagtttgaacgctcgtataaacgtaggttccgcaagcacctcaaaaccagactcgcgcgacttaacgcctaccacgaggcccgccagctgacctcggaccaggaaagcgtgagaactgcagccgcaaatgggctgaatcacgatcgtgttcgtcaaacttataacctgcaaaacgaatcgtgttggtttatgttttttccaatcgtcgtgtgagcaagagtacgaacctcaaacgcgcattccgtgcaatgaaggatacgcatggaaagaccaaacataaacaggaataggacatcaagctaagtttaaatcgtgcagtatcctatagtgagctcattcttagcagcaaactataaaatgtcacctctagaagacacaaagcgcatcaaaacgtatgtactatgttggcattctgcagtgggaaaattgtagatatttcccaattgatagccaacttaatgctaccttgaagtagaaagtttaactaaataagaaagcaatactatgaccagtttccaagaagcgaggttagagaaaaagaggaatgcacacatatacgtgacagatgcatgttttcaaagtgaagagtcatattatctgtaaaacaacacaatccatatctacaaatataagtatgttcaccttgcaatgcttcaagagcaagagtagcttgcgcagggttatcaaaatcaacaaagcacaagacatgaggatctcctccaggctgcagaaaattagacagttaaaaagagatatagtgagagcacagaatttcatagcaaaagcatattaagcatacgtgtcttgactccttgttgacaagtctgacttcacgaaaacctacaaaagggcgaaatatatctgcagagcgaaaaggtcaaggagcaaaagcatatacctattgatagccaaaaaagaaatatgccaatacaccaactcatagagctattaaggaaaaaagaaattagaatatcaaacaaaacaaagttgagttgttaagggaacgaaatttagagtagaatacaagtacaattatacaaggatacgtgacacctcccttcgtgtgcagtttgcaggcaggccttcaacgtacagagtgcttgatgcatctgctgggagaggaggctcgggccttgcaccatagcccatacctctgctgtccatgccaacaccaatcatccgacgatcatcaacaggatagcctcccattccacccattccacccataccaccaacaactggcctattggtttcagtggcagcaacagaaggcatctgcaagcatagcatgcagactaaaagttaaggaactatcaactttaaaataatgcgtatatttatacagaggaacttgaagttgtaccccattacgcaagtagcgatcataggatgctccgatagcctcattctctctcagtgcatggtaacctgtcctgtcagtctcacgtggataataaccagtcatgtcttgtcctgcaggcacatctgcaaagtaataatattaagtttaaaagacgattccaactatctcatataattgatacaatcaatacaatggtaagttcaagatccttcaatagataaattgatgagaaaaggaggaaacgatattatagtaacaaggaaaaggatatgatgacataaattatgccaccaaccacaactaccaataaaacaacatgcagtaacttagatactgaaggatctatacccaacagaatctattgaaggatctacaccctgtcagaagatagcatagaatctacacccaacagaatataaacatctgcaacttatatatgctttgtgtaaatcatttcccataaagggagcagcaggaattcttcccaaggctccaaagacaatgaaactagtgactcccaaccggagctccttagtcaagaccataaaaaataattctaaacaggcacatattgtgttacagggctgtaacactgcatggaagatagtgcaataagcatagttagaaacttatcagtacaccttcacccctttgaaagttccgggaagattgaaactcacaaataataaa

SEQ ID NO: 77555 - DNA, 1683 bp, Oryza sativa
gggaaaaaggactttttagagcttttctttttataaaatcattttaactttgtttatttcttaataattattatttgtgctctgaaaattccactaaaatttgagggctcctttagaccaaggagaatttaacaaaaattctccgggccacatttgagtttttcttgtacgtattttagtgtttgccaatttcttttcgaattttaattaattctattattccttttagcgaatgatttttaattcgggatgaatttatcaggacgtgacataaactaagtgcacaagggtgtgagagctcttgaaagggttcaagataatgcaatggagtgccaaaaccttacccttgctgctggggagtgggtatatatacccccaaccaccaaaactagccgttggaaacgaaatccccaactttgtgctctgccggtcagaccgtcgttgtgaggccggtcaaaccggactactttgtaacggctagaaaactagccgttacagggcaatcattgagcccactcaacctggccggtctgaccacagtgtagtggccgatcagaccgtccacggctcggtcagaccgccatcggcttggtggggccggtcagaccggccttaccacgccggtcagaccggcctaaggcccacggtcagaccgcaggtcacttttcagctcaaacgaccattagtaaaacgactatatctcttaactcggggctcataatttggcgttcttggactttatggaaagcttattcaaagggctatccaacccatgaacaatccatccaagaaacacaacttttctcagggagaaagggctcacactccaaaggatactccaccggacataaccacatgaggctacccaaacctataggatttgcccacatctctctttgtttaggacttgagaaaactcaacacacttggctagacaagcccaccaaatacacctatatgcatatgaactaatatggcacaagatcatccacaagctcgcttcatagacccctcttgatagtacggcgtctatctagcaaatccggtctacaccaaacaccaagaccgggaaaagactaagaaaacattcttagctacattatacctttgccttgcgccatccatcttggggtcaagcttgagtcgagatcaacacttgtgaccatttgattcaaccatgtttataccaaggtatttaccatcatttgtcaagactttcttctcatcacaagcttgatttcattcttgccaacatggcgatgtccttggcatggtgaccattaacccatggtgtcatccattagcctcatcatagtgggacctattccttttcacatctcaaaggagaacattagtctcaacaaatcggttgtcatccttcacttgatgaccaaccggttgcatatgaaagatatgtatatgtttgttgagtattcattaacatcacaagtgtcatatactcgtatgcaagctcaagtgcaaagatccgatataaataataggtgaacaacatggatctaaaacatgtacaataaatgtataggatttgctccccctaagtatatgcatacaaagaaatatacaacagagacaagtgtatgcataagtaaagaagaaccaatgggggtttatcctatacacatagagaaggcatatgtagtaatgatgaagataaacaaaaaa

SEQ ID NO: 77556 - DNA, 25493 bp, Oryza sativa
  unsure (1)..(25493): unsure at all n locations
actggctaaatcaaataatcatactgcagcattagatcctatattgcaagctttacgagacctaaaagcgagggtaaacatactgactgttacatacaacgaacaaagttcgtatagaaatttcttgtagatctcgtggcgaaactaagggtaaaaacaacgtgaaatttcaactagatcttcgtcaataatttcataaatcatggcacgcaagcaatatcggggagcaaaacaaccaccaaaacgaggatatagcctaaccccctagtacagatccagatctaagatggcgtagagcgcgagcaacggacgaacctccgtagtcggggcgcgcgcgcttgagcggcggcgcggcggcggcctgctgcgccatggcggcctgcgggggcatgcccgccgcggcctggccggccgtcgcgacagtcgccgccgtgggggccatccccgccgcggcggccgccgccgccaccatggcctgctgctgccgcgcgtcggcgaacctccagtagttctcggcggccatcgctgcctccctctcctccgcctcctatccccctaggtcgtggatctcgcctcgcggcttggtgagcttgacggcggcggcggcggcgcgcggctagggtttcgcgaacacgacacggggaggagtctggttcgggcaagaagatgagatctcgagagagagaattgatggggaaaagaaggcgaaagcgttggaagggaatacgtattaggacagggtttccctcgcaaaaatgccaccgcaactcgtgctcgcgtcgatctgggccgcggaattccgatcgtacggctgagggagtcggccaaaataggtggagggttccaaagggtaaaagcgtactactgcagggggtttaacgtaaaacaacaagcgctacctactaccacgatctgggccgtggaatcctgatcggttggcttgtgaggaccaaattaaggattgctaccaatggtaaccacactattgggccttcacaccctgaaagtttatatgggccgaactggagcccggtccccgttaggtgggcctattcggccttagatgtgcccatttcggccggatgagacgttactctacaatccatgggccttttagagatgatttgtggccgtacagtgtgtgggcttctgtctaattatcgtgtcagtcacttcgcttatagatatgcttatcatgcaaatgctaaaaaaataaatctttatctttatcttttatttatactattataaaattgaatatgtttttgctagtactctggtacgttatccttgtttgagtcggtttttaatgttgttcgcttttggaaatatggattcgtgtttgagtcggtttttatgtttgttcacttttgaaagtataaaaggagtcgtataagaaatatctttaagaaaactcacatgctaacttgagacgaaagttggactcctaattgcagctcataattttctaaaaaaagattaagcgaatttctagtgtaaattttatcttagctaaactgtataacaataataagattaaaatagccttcacccattgcaacgcacgggtattttttatagttaaaaattaaattttggtttataggtataaatataaacgaagcgatgggatttaaaaaattaacttgttgcaaaccggagttggtgaatcgtccttttgcaactttggtcatttggtgcatgagcgcctcgttttacttgctcctctttatgcttacatcctacctaatagctatcatgatgaatttgttgaatgccttagaacagaggaacaggaggttcccatgtcaagcaaaagggaatgctttaggcagatcatggagataaagactctatagaagcagcacacgtgaacgattcttgcgtaagtactccgccataatttctgacgaagatcggtttactaataggaacggacctttgtagggtaagtgtgcgtgtagatataagtgctcgcgtccatactacttcctctgtcttaaaaatataagtattttttatagacacgagtatattaataaaatatgtagaaatgattggataaggattgtgattggtggagaagataaagtatgtcaagacaacaacagttgtaaatgtgatctggacataagcatccactcaaaatcccttatatttttgggacggatggattagtatttatcaaaaatagaaaagaaaaacagcaagtaattagtaaggatcagctaaaaagatcaagaaaagcaatagtacgtgattagtaaagatttgctcattaaaaaaaagtataggtacgattacggtgaagaagcggagaaggtgattataaaaaagaagaagaaaggggcgcatcaccttcacgttccgagatgtggcacgaatcccgaggactgcagcccgagatcgggcgcgtgtcccgaggcagcatcggcgccatcaaccaacaacaaagatagtactagtataacaactaatcccaactcgcggagcagcgagatgagatgacactcttcttcacttgctgaacctgatagcgacattattcttcctctcaccttgccccttcacactcgtcactcgctccaaccagccgcctgagctctctcgccgtacgtcggcgctccatcggccggaattatcggcggcgatggggctgctgtcgcaccgcgtggagcggtcggagatgaagcccggcgaccacatctacacatggcgcgccgcctacacctactcccaccacggtacgtccctctgtcgatcgccggcgccattgccatttgccgacgctcccgtttcaattcgctcgccttccaaacccatctgaattatgcgagtttttttccggcaatctagccatatcccgtgcgacctcaatcgccggcgccattgccatgtgcttgcgcttccgtttcgccctccgaaccatgtgaattacgccgagtttttctttctggcaatctagttaattagcttccgagcaggcaagcattttcagtttccaggggttatgagatcagaattcccttgctcttcttctatactctgtagatgctgctgctgctgtgatacttccagcaaaatttttcagtgaatcgctgctgcaaattatttgctaggccggcattgtaacctgcactttccagttcagtgatcatcgatcgcatctgcagtcatcggagctgaatttttcgtgctaaagctgcgcaatgttatctccggtatgctgcttcactaatggatgattcgcactcctgccgcaaccaaatgttggttttacaaacatggttaggatatgatttaattacggttatatctaaccatatatattatccaagccccagttggctaattatttaattgatgactatttattactatctgctagatacccaataccaatccttgttaaccaccattcagtaagctgtgatcaaaggtgcctgcttttcttttaccatcactttgttaccaacacgcatcagcttcttccagctgcgttgccttacactctttttactttgcatctctcacttttacatgctccattgatttaatctctttattacttcaccgacgaacgacctttgatctctgcgattggaagaagcgtaaaggggctcgcctgtgtcgccgcttgctgctaccttccttcctggacggcatggggccggcgttctcgccatgagatttgcaggtgtttttgcttccgatcattggcatatgtagggcagcatcgacatggtggtggttgggtttctccacatgactgcctgcatccaaaagatgcggtgtgtttgcgagctacgatcgagtactgtgtctagtctgtcatttacaccttttgcaccccctccagcaatctctctggcctgtaaaatcttcgggtcagatcgatcaaaagaaaatcttaacttcagtaattgtcgcatgattaccatgctaactaagagtaattttattgtcggtactataggtatcacatcttctaaggtgaattttgatactacctctctcaataccttaggtatgactgaaagaaaatcttaacttcagtaaggaaaagtctatacatactaaattctgtctaactaaacacttattactaaaattgcgtgtcacattattttttttccgaatgtgtaaaagtcttgcacgccaaaatagtacatctagatttcttataacttccatctacttaaatcaaacggttgattacaacttaccattactgctttagttaaccgttagtatattacagaggattaaaacaacaaaaaaattctccttggagatcatgttgtgaacttgggtgttgcaatattcagggatttacgttggagggagcaaggtggtgcatttcacgaggaagaaggaggcagggacggcaggtctggactcggcgatcgccatctccagcctcctctcgcagggctcgccggagtgccccaccttcccggactgcggcttccagctcccggacagcggcgtcgtcctcacctgcgtcgactgcttcctccgcggcggctccctccacggcttcgagtacggcgtcccgccggcggtgttcctcgccaagctccgcggcggcacctgcaccaccgccgccgccgacccgccggacgccgtcgtccgccgcgccatgcacctgctccagaacgggttcggcagctacgacgtgttcgagaacaactgcgaggacttcgcgctctactgcaagacgggcctcctccccgccgacgagccgggcagcatcggccggagcggccaggcgtcgtcggcgatcggcgtcccgctggcggcgctcctctccacgccgttcaagctgctcgccgccggccccctcggcatggccgccgtcaccgccgggatgtactgcgccggcaggtacatcaccgacatcggggtgaggaaggacgtcgtcaaggtggaggtggagaacctgtcggcgcatcttggctggcgtcgcgccaaagccgaggaagaaatggccatgaaaaaacagcagccttcatcacatgatactaaggtcaagaagagtttacttcctctcaagagaaaacgtgacaatttctgcgaaattattacgagctgaaattctactacaatttgtatggttttgtgtggataggttttggagttaaaatgcaataagtcctggaaatatatgaagcgtcaagtgtgctttgatttaatcaagcattcgctgtctctgtgtgtgtgtgatagatagatcgatctgatcatgaattgggtgtgccaaggagattggattgctgtaccactatagtattatagtcagaaaatttactctctctctctctctctctctctctctctctctctctctctctttttcatttgaaccatctagtagtatatatctctgtattctgataagcaatatctcaataacaactttcatgcagagttgcagaccattgtctactagtggtgttgcgagcttgcattctttgacaatgtgtgatgagctgttgatttgccagtgttcagtgagctgaactgtgctttgttcatggatctagccaagatgttccaaaccacagtacatttccagaataataaatctgcgaagaggtccccgtcgtcatttcctgaataattcaggactcatgacagtaacatgtcgctactgtctacttgcagctcgtatacaatgtctgtactcgtcgtcagtagatccttctccccggacccatgattgttaaaatgacaagttgtggcagaatcaatatgaggtcgccgacgaaacttcatcgcctttactccatgtgagaatgtgagaagatgagatctggattggatgaggaggaggaagaagatggtaaagatgtctgttgtttcttctgaaattacactcgggatcggacccttttcctttcctctgtgcttgttctgcctttaatgattggtttcatagaccctctcgtcagtaaatgaaaaggctggccacgttgtgtgatttgtgagatctggggttgtgtgttggttgagccagacagaaaagtaccagttacagactggttcacaggggaggcaaccagaaatattctctgcacaagagttacagtttacagagttattactacagaaaaatgatctctttgcctgaattgtgtcagtgcatgaagatatggagtagtagtatgatgaatatgttgcagatgaaattcagtcaagacacaagtagaagttcatttggttggagcctttggagagcatgtgattaggaggtggttgattaattgttccaatttccaaactgctctcttcgtctagctgaagtagttcttgttcctactatctgtttgcatgagggtaggtaggtgaagaagagaggaaaaaaaaaacgctgtaaagttgaagcaatggcgatgaggcgacgaagacctacccctagaagggcacgaaagaaagaggtgagcttgtaaataatcgatgattgccagggagaaaacaacaagcaatgccggtttctgttcctgaaaggttgtgctcaacactgtttctgtacgctgcacagctgcagctggaagaattccttgcctcttatatggatccaaggagcagagatgtatggggatccatgtggccaacgggaaaattgtttcattgacggtaaaggatgtcggtaggctgatttctctgatcttgtgtttcagattggacaaaataatctcattgttttccttgacaggtagcgactagcttcgattttgctatatatttattgataaattttcttttaaaaaattatcacacataaatacggtataattgtagtgtaattacattataagttgtatgaaactataatgttacttaatttgtatgaaatttttgcataatttcaaaccgttagatttatttcattcatgcaagttgggaagaaaaaaaatcataacgggtatacgggtgaggagatttggtcttgcgacctccacttcatgaaaatagcatgttactgtgggattttttaaagttatatacaattntattatagttatatgcaagtcatgattgcactatatttatatctgttaaatttataggagaaaaaatgtctacggatgtacaggtgaccgatgggaggagcatttacgtactactgatcttggtgagcccatctaatagtgggccaggggcggttgaatggataggccactttgggccgcctgctatggcagtccatcttgatattccgttcctgtccgaaatattgacggcctatggagtttggtgtcaggctgtcagcttacgcgatgtgcggaagcttagcaggctgggccgttttgtgggcctcttttgcttgttctgtgcaaaacaacactaacaacatctccactgcacccatctctcttgcaggctgcagccacccataagtacttcttttataggcaaaatttactaaatgacactaaaaatttgtgtaatttattggtagatatcgtaaaagcgtgtaatttattttttactgtaatgttgtgtttaaaccatgtgattctaggggcattcttgtccttctcaagaatttgtctttacaatcgagttgaaagtgtcatccatcaaacaaccagtttcttaggatgtcttttaaccgtgacataatttttcgatatctatcatcaaactactcaaaatttagacgtcctgtagcagattttacctcttctataatggttgaacctactgttactgcaccaaccagctaaacccatgaatgctgttacgcactattttgataattaaccaactgtttttcatatatttatatttataagctaaattttacttcctccatttcatgttaagtgcaaccatgagttttcgtgtccaactttagtcgttcgtcttatttaaaaaaaatttaattagtatttttgtttatatgagatgataaaacatgaatagtacattatgcgtgacttatgttttttatttttttaaaaaaatcaaataaaacggatgatcaaaattagacacagaaactcatgactgcacttaaaattggatggagggagtaaaacataactatagaactattttttatagtttttgttacagtttattttacaaacctttaaatcagtaaaaacacatacataaaagttttgatatttttttaaggcaatgaacgaggcccaacgaatactctacagaaggatgtacagtacagtaggaggagtctatactctatactacgctccgtacgcacattgtttgcggcagtcttcaagacaacttttttttttttactgccatgaaaggaagcaggcttgcggtgaaagaaagttgtctgccgatgacgatgccaatgccagagactttcgcacagtacagtaatccattgcggtcaactagggcctacggtcaactctgcagggtgccagggtacaggcagatgcagccgaaagccgttcaaaggaaaggaaaaattactacaagccgagcagaaacaaagctctttcaagttcacacttcacactagaggtgtgtttaggtggtgtttgaatccagtgacttaactttaattcacactaatttagagtattaaatatagactacttataaaactaattatataaataaaagctaatttgtgagacaattttttaagcctaattaatccataattagataatgtttattgtagcatcacatatgctaattatagattaattaagttatagattcgtctcacgaattagtccaagattattgatgagttttattaatagtctacgtttaatatttataattagtgtctaaacatccgatgtgatagggactaaaaatttttagtcccatctaaacaggttcttacttcacgccaaaattggaagtttgattgaaattggaatgatgtgacggaaaagctgaaagtttgtgtgtgtagaaaagttttgatgtgatggaaaagttggaactttaaagaaaaagttgggaactaaaccaggcctaggcctagttggcaaaaataaaaattctttgatgtcacatcgaatgtaaaaagtttttagacacaaatgaaaaaaactaatttcataactagcctggaaccgcgagacgaatttattaagcctaattaatccgtcattaccacatgtgagttactgtagcacttatggtttatcatagattgtgtaattagtttttttatctatatttaatactccatgcaagcgtataaagatttgatgtgacatttttaagaaattttttttgaactaaacaatgtctaaaagaaagcccagtcacaatttaaaacttaatttagaactattccaagcatttaaattttgaaaattaattcaaaataattctaagcattttttttcctattttcagccttgaccttaaaatcactaacgcaaagttctttttttcaccttcccaactaatctcttgcttttcacgcgcacagtttttaaattattaaacggtgtgtttttttaaaatatatataaaagtttattttaaaaatgatgttaattgattttttttcagtgttctaagctaatataattaatcacgcattcaaaaggaacacagtttgtcgtaccgggatgtgcagtaactcccaaacacagccgaagagtagaaatatgaaaatcctacccaaaaagcatttctcatcatcagtgctacagtacctatatgtgctattgacggattaattaaatttaataaattcgtttcgcggttttcatgttagttatgaaattagttttttcatttatatccgaaaacctcttccgacatccaatcaaaacgtccgatgtcacaacaaaaattttcttttcgtgtcaccctcatttgtttttctacggtttgtatttggaaggtaaccaatgtgacactgcatcaagcagtcaaatgtcaaataatggaaaatcaatccatttccgtcttctgcatgctcagcaagctgtccttgcctgattggctcgattccctcgggtttcccttgaccacttctgtcggaggcacatgtactccagctgcacggtcgttagacgtctgaagtctgatgtatagacggcgcacgtctccagaccaaaattccaaaccaatccaacagaacatgtgtgtagaaattccaaaccattccaaacctttgttggcctctcggtctccatgttcagactgattaattaccaactgacactagcctaaactctttgacactcgtttcgaactttcgatctcaagtaggataaaaggtaatatgctccgtgagtcattcccaacccaataactaggataatttccatagtattaaataagctaccacctaaaataaaaaataatgtggtaagtgaataaatgagaaaaaaaaagaaaccaaatcttgtatgagatatggtttctacataatatacaagatattatatgagataagtagcattaaatttaagtatgaaaaatagtgtttgtattgaaagagtagtgtcaagtgatagtttctcgatgaggtgagtttatagaaactatatctactgtgggaccggcgttagtcgaagcacactgcacaaaacagtagtatatcaacgcgtaaacaccaatcattatgggcataaaaccgtcataaataaagcacacagcatgtactacagttaagacctactcttagaaaaaaaaaactatagttaagacccctcctgatcattcttgcttcctagataatcagggtgccaacagaaaaagaaccacacgtttctactctcgagtaattgaattcaatcaacaactattggtgttcctgcaaatgaaggcctggaaaatactctcgtgtaattcgctcatgaacacatgtctgtatcacccagatagtgcgagattaaattctagcagaacatggcatcatctactccaccattacattcctatgcaccaactgtttttggtgtagacgcaaaatatcagcgacagacagagaagggaacgtactagtttgtatgtgatcaaacgcatcgtcttcagatcagatcagatcagatcagatgttggatttccagttgtacttacggcgaccaaaaaatatctgatccggcggaccctcgttcagcggctcaggccatcttcggctgttactgttgggaaagagctagctcgttctctccttggctactactagtagacttgcggagtatttccgaaccgctgcgttcaagatggcaacggtgaattcaccatcgggggtcacacccgcgtccccgtcatcgcggtgaaaaaatttcaccgtccccgttccagtcaatcacgacggggctacaatttctccagccccgatcaccacgtggtgaacccgtccccggttaaacaacaaattcatcaacaaatcatataaatgcaatggaacacaaatcagcagtacatcacattgatatttttccaaaataatatactcaacaaactactggtcatatcgacggcgacgaacggcggaggaatcaatggcggcggatggcgtgctggccggaggcggtgggtgccgcgaccacggtctgaggcggcgcgtgcgcgacgacggccggaggcgctggtcggagcgatgacgtccggaggtggcgagcgcgcgtcgacgacggccggagacatcagtcggcgcgacgacggcaagaggcgatgggcggcgcgacaatagccggcggcggcacgcgtgcgtcgacggctgggggcaggaccgcgcccgcacgaggggagacgacggccagcggcgctatgcgcagtgccgcggtggctggggagatatttggagatggggagggttgattagggttagaagatatatatacatggttactgagcttcatttttatgggccaaaacaactgtacagtctagaattggtccctagctacattacatgcgggtcaccgcgggagacggggatggtgaatggtgcaccgtccccgcccccgccatccccgatggtgatgagttttggaccattagattcaccatgggtggtagatatcaaccatccccattctctaatatgtgaattcatcgcggggaatcgatgatcaggtccccattgccatctctattccttacacaagttttccaagacttctctttcgttttccgcgtgcacgcttttcaaaccgttaaattgtacgtttttttaaaaaaagtttctatacaaaagctgctttaaaaaaatcaaattaattcattttttttttaaaaaatatctaatacttaattaatcacctgctaatgaatcacttttttttccgtgcagtggagttagttcccaaccccaagtatcaaacacagccctatatagaactttactgataatcaaatgaatttaattttgtatttttttaaaaaaaataatatttaattaatcatacgcctgattatatatctcgtttggtgtaccgcaatcgtttcacgagccacgtctggttcgaacaaagcctaagtttttaaaagtaaaatactccatcacacaaagactcatttttatccgcttcatttgtccaaaaacacttaatcttcaatacaattaatatattggagtttaaaaaattgatagacaaatgtgttagagtttaaaaaattgaagatcaaatacatcgagtaaactctttatatcggtatatgtgtaaaataggagtaagcaaaaataaaatctttttgggtgaaggtagtacactctaatatcaaattaatacgacttccattgtaaaatatagtattcttgtattttctccaaactaaaatgaaatgtgacatattttataatagaaatctgagtttcatcatatctagaatcaaattactaagatatgtcgtatctgtactaattttttttgaacgaaaaagtactatatataaaagtaagaacgcgtagaaaaaaaatatagggcctcatcttttcgcttatgcttatacttattagtcaaaattaaaaaaattaaccttaaatttagagctgattcgttaggaacgtgtagggcttgtttggtttagtgctgtaccaaaacattggtaatgccaaacttaggcatgttttggtactaccaataatttgctagggtagaattcttactaatgtgtttggattgatatgaattgagagccaattttttttatggtaaagaaagttctagaattataccaattttagcatgggcattaccatctatttgtattaaaccaacccatcatatttactattcaaattgtataaaaaaaataagcatggcacattttaatatcaatctaaagtgacccgtatttttaagtaaagaccgagatattatattttattataaaaaaagtgatccgtatgtaaaagttacccatggctccgctatatgtacaatatggacaagcaagcgaagcaagacaatcagagcaaacacagtagcagtagtatgtaacgttatccgagctactagtagtagtgttccagtacgtgactggctgtgcctttcctagtggaggcccacaccacacccacgaaacgtgtccctgattcccccgcctccaacgaacgacttgaaccttccagaacaaaccaaatccataaaaaaagacacggaaacttctcgcactttcccccacccattctcccacctcccgcacgcaacccaaccctccctccgtccgatctcccgcgcgacgcccatccaaccgccggtcagtcgccgtgacacgaccgacttgctgtgttagcccctctttagattccacgctaaaactttacccccttattaagcgaacatttgaacatatgcatgaagtattaaatataggctaaaataataactaattaacagattacgactaatttgcgagatgaatcttttaagtctaattactctaaaatttaatatggtgctataataaacaattactaataatggattaattaagcttaatgaatttatctcacggtttattgacgaattctataattattttttattaatgtctaaatattttatacgaaagtctatatataatgtctgttgagacacgctaaaattttactaccctaatctgcacacccccatagtttatatctctcccgcctcacccgctcccacctctccttccgtttcctctcattaacttcctctctcgcttcttttctccacgccacgctacccgaaacttccagaagcaaccagacaccacggtgtatccaggccagatctgcgcggccgccggcggcggcggtggcatggctgaccagaccgctgctgccgttgtcgtcggaggaggagcggcggcgacgatgggggagccatctccacctccgccggcgccggcagcggaggcggcgggggtgggggtggggcagcagcagaggacggtgccgacgccgttcctgaccaagacgtaccagctggtggatgacccggcggtcgacgacgtcatctcctggaacgacgacggctccaccttcgtcgtgtggcgccccgccgagttcgcccgcgacctcctccccaagtacttcaagcacaacaacttctccagcttcgtccgccagctcaacacctacgtacgcctcgccgccgcgttttcctttctcttttccgttcgatttcgatcagctcgactaatttttgtctcggcctcgccggaatggattggattatacagggatttaggaagattgtcccggacaggtgggagttcgccaacgactgcttccgccgaggggaacggcggctgctctgcgagatacaccgccggaaggtgacgccgccggcgccagcggcgacgacggcggcggtcgcggccgcgatcccgatggcgctgccggtgacgacgacgcgggatggctccccggtgctgtccggcgaggagcaggtcatatcctccagctcgtcccccgagcccccgctcgtgctgccgcaggcgccgtccggctccggctccggcggcgtcgcgtccggcgacgtgggggacgagaacgagcggctgcggcgggagaacgcgcagctcgcgcgggagctcagccagatgaggaagctctgcaacaacatcctcctcctcatgtccaagtacgcctccacccagcagctcgacgccgccaacgcctcctccgccgccgggaacaacaacaacaacaactgctccggcgaatccgccgaggcggccacgccgctcccgctccccgccgtcctcgacctcatgccttcctgccccggcgccgcctccgccgccgcgcccgtatcagacaacgaggagggaatgatgagcgcgaagctcttcggcgtctccatcggccggaagcgaatgcggcacgacggcggcggcgacgacgaccacgcggcgacggtgaaggcggagccgatggacgggcggccgcacggcaaggacgaacaatcggcggagacgcaggcctggcccatttaccggcccaggcccgtttaccagcccatccgggcctgcaacggatacgagtacgaccgagccggcagtgaccaagacggttcaaactctacctaaaagttgtgtgttagacccgtctcgtttaatcaatctactctagcaattaactacttctactcctcgatagaaaaagaggcaatcaaccttgggatttacctagtcccaatgtctttgtagtgttcttttttacttgtagtatgtagtactcctactagttttttttttcagattattatcctttgtatatatactgctgctgctagtgagaaggcataaaagatcagatcgagttcacttgctatttctaaccttttgtttggtcatagacggtgtggagatgtgagatttggctgccggattaagatattccaagggggggattagtgatggcgtttgttgtgtaacggggaaaatatcttgcccacacggcgcacctactagaaggtgcgaaagccacttttcttccaagccaaatcgggggttttgattttattgcgatttggacagtgacctgtcctgccagccagccaacggtcgagaccacaggattctagtatgggcatttcgtttcccagttcagtttcgttgttgttgttgttaggagcgagtcaaattagtcaaagacgtcgagtaaatatcatttttaattgacctggttaaaatcatgttagttctaccgaacattgatggttaatttttgagtattttttaagcaacatagaagcaaaacggctgtctgatggttttgtgccattttacactttacagttacccgttattatatgatacagtaaattatagccaaagggaatgaggtacaagttgtgaggtgctactctgatttgagtacttgagaccattttaggcacgactcaaggttggaggtctcaaagttgatacttggcgctccatctgcttgtacaatgcaggtttactataaagatttggggccttattacctcatggatggtctaccaatagctatatcgattcaggctgtttttagttcccttcaaactttaaactttttcgtcacattaaatgtttggacatatgcatgaagcattaaatatgaaaaaaaaagcaattacacagtttacatgtaaattgtgagacgaatcttttggcctaactacatcatgatttgacaatgtgttgctacagtaaatatttgctaatgacggattaattagacttaatagattcatctcacagtttataggcgaaatctctataatttgttttgttattagtctacgtttaatatttcaaatgcgtgtctgtatacgttaaaaaagttttagacggagaactcaacacggcctcaatggagatcgacacagaacattcaaaactggtgggagacaaatacaaaggagtgcccaagaaagatctacgcacactaattctcctgattgtctaggagacctggaacgagagaaacccagcgatattgcagctccgaatctactgagaaagattaagcaatgacttaggctctagtaggagtatagctgctacaggattggagctattacctagtaactttgtatactctatgggtgtgtttggaagataggttaggagaggttgtattttctcctctttatttaaggaaaaaacacaatctcatactttttttttcaaaaattgatactccagcaatgatttaatcttttcttgagctataaacgtgtcctcctcacattgctcatattttttcccttttgaaagttcacgttgtctcacacctacgatccatggctgccatcctcaagtatgcttcatggtggccatgcagacatgatgtacctttaccgtgtacgatgtaacaaagagtgtggagccaagccgagcaaccaggacaagaaagatgtgagcactgtgtcgtttaatcctctctctcgaattctcggagttcattgatcctgacaaaaatgcagttaggctgtgtttggatctaaagttttttttttcaaacttttaacttttctatcgcattaaaacttttttacacacacaaactttcaatttctccgtgacattgttccaatttcaaccgactttcaattttagtgtgaactaaacacatagcttcttcgacggtgggttgttctgatttctgaatctctgcaactgcacggccgtcaagttgtgggggctgtgcaagaatggcggcgcgaccgtcgtggccatcgacggcctcctgcaggtcacgttcagttgcgtacttgcgtcaacaacctcctggtcaccggcgccggcaccctcgacgctggacgagagtacgagaccaactccctacccaggccacgacggtgagatcttagggtttgtttagttactgaagtttgaagaaagttaaaagttcggaaaaaaaagttaaaagtttatgtgtgtagaaaagttttcgatgtgatatatgatgtgatggaaagttgagaataaagcggaaactaaacacggccttattaaacttatcgatactaatttactcagattatctcctcttatgaagaaagtagtggggaaattctcgtacatcctgcagattctgaagttggacggcgtgacgagaacacggtgataagagcggcggacatgagacgcggggattccacatttccgcgtctccatgacattgttatggccgacgtgtctacaaccccatcatattttgaattcaggttgtctagcccaccaccttatatagctaatcggaagatccacgggcgtttctcgaccaacattactcctcgatagccgcccatggcaaatgctccaacgccgccaaggtgacaagaacagagctttccattgccaattcgccgttgttcttgcagctacctctggtgcagatcagcgagacgtgacgtccgagaggatcaacggcacgccgaacagcaggaggaagaaccaggtcgatcaatcagtctcagttgtgaccaaacgccggctataatgcagcgcaaagaacagcaacgacgtgccagggatgcccaactcgttgggccaagcacccagcccggtcgcctgagcaagacgctgatgtcagagtactccaacactgaacaaattcaagtaattgagttttgttactctggtgttcaagtaattgagttttgttactctggtgtgtttggttcacgtttaaattggaacgatgtgatgaaaaagttaaaaatttgtgtgtagaaaaattttgatgtgatggaaaagttggaagtttgaagcaaaagttatgaactaaaccaggcctctgatgatagagagttaagggccggaagaaaattattaattgagcggcgaagtgagcgtagcttaactgattatattttttaggtgacctatctgggttcaagtgttagacttgatactgatgcttatatagttatatttacgactaattattcttttagtggtaagtgacatacccgtcgactatgagatacctataatgactttattaatctcagtatatatatcagttcagtttttttaaggtgattatatagataagatacatgcgtgtatattcgtagggacgagtgtgtgcgtgttgtgagcacatgcgcatgtgttgtactatgtttaaaaaaatattaattgtatttataggatttaaatttgtcccaaaataattgtcacaatagagtactcgtaatctcattaatcatttctcatttaaaatatttctaattttatcctcaaccacccatccactcttacctacaaatcatttaataaaagacgtcacaatcttttttcttaaattttaatatatgctaaactatttagaattataattattttgggatgcatgtagtaagtctacttttaacatccgactcgtttggaagtaactaaaaaccttcaaaacactacactactttgtcattagaaatttttaaatgctcataataaagttgggtggcacaaacctctcttcataataatttttactaaatgcttaacaaaatcctatctcctcctgcctgtcaccggtcaccgaccgatggtccccgcaatccaatccagccagccagcctcgcatccccccctcccccactcgccggcgaccgctgccgtcgccgtcgtccacctcattccccacctcgtgcctcgtctcccttccaagccaagccaaaaacccctccacgagccgcgccgtacgccatcgccaaccaccactccactactacttccccccacactcactcactccactcccaccacagcaaccgcttgctttgcttcgcccatctgagctataattagctcgaggagagagccctaacccgccgcgccatggcgagcagcagcggcgaggggaagggtgccggcggcgcggggtaccagtacgcgccgtacggcgggtcgtactacgacgaggagcggcggtggtggccgtggctcgtgccgaccgtgctcgtggcctgcatcgtggtgttcctcgtcgagatgttcgtcaacgactgcccccgccacgggagcccgctccgcggcgagtcctgcgtcgccggcttcctccaccagttcgccttccagccgctccgggagaacccgctcctcgggccctcctccgccacgtacgtaacgctcctcctcctcgctgcttgccatttgattcgattccccgttgcgcaattgagcttggaaattggggggaattttaggtcccgttcgaatccactaaaaaaagtggatttagtcaagcgtgtgaagctggcgtctttgtcgttacaggggatttccttttccgctccaggtgtctaggagataaaagagagagagagagagagagactgcgatggcgactacttggatcttttcaactaccgttttcgaaagagaaaattacaaaacctttagcagcattgcattagattatcttgtgccatctatacatctgatggagtattaagatttattatgctttgtgccttcgtagaatggagcaatgcaaattctggaacaattcggttggcacaggaatattttattcttacatgatttgtctactagtagtgtttacgtcacttgcaggtttcccaaattgcagtcgtgaaatgtaggtagtatttttatcaattagattattagaattaggtgattggcttttgtattggtactactaccccttgcaatccaggattatggaggagtgacgttttttttttccaacacatgttaaaaagggtgaattttgtttgttctagcctgcgaatttcatcacatcggaagctttctgaggactacattatctatcttcattgatgcatactgttctgtaatacgcctgtgcagtttatttattttgatagtgttaagaacaaggggggttcttagtgctaacaagttgtttgctccattggccagtttggagaagatgggagcactagactgggcgaaggttgttcatcagcaccaagcatggcgtctcattagctgtatctggctacatgctggcctaatccacctgattgtcaacatgctaagcttgctattcatcggactccgtcttgagcagcaatttgggtttggtaagcttctacaagtacagaatcggtcctttttaccctcagcacagcataccgtttctgtttgaagcaacttggtttactatctttatacatgatcgtcccgtcttttatttgcaattgagttctccgaggtagttttgacttggcacttttagaagtacttgtcgtaccctatgttactcattattcatattcatatcagagtctcaaacccatatattaccattgtgttaaagccaattaactggttagattgccatgttatcattttgtaggcattacttacaatgcaaggccattgttctcacaaatttgagaatgactttatcttctagtcttcatataaagatgtagtcaatttacatatgtctatattctaaatattggacccataactttcatatgtcaatgtgtacccatttctcattttgagtttgaatctggtaatgttcctgcacactgacaacagtttccttacttactagtgcgtattggaatcatctacttgctatctggctttggcggtagcgtgctgtctgtgctgtttttacgtaataactacatctccgttggtgcctctggagctttgtttggcttacttgggtctatgctctccgagcttattatgaactggactatttattccaacaaggtcagcagaacagagactgtacctatattgtttactccaattcagttgttccctgcaagtttcagtttgttcactcttgcaggcagcggcaatcataactctcctgtttataattgcaatcaatttggcgatcgggatactacctcacgctgataactttgcacacattggtggatttgtgactggattccttcttgggtttgtcctgctggcaagacctcaatttggttggatggaacgtcatgagttgcctcagactaatcaaccacgaaagtacagagcataccagtatgttttgtgggctgttgcactcttcttgctgctagttgggtaagtctctccacttcatctaaaagcacagtgcatgtgcatagttaatactcgttcacatctcacttttgtagtaacaaaagcatagcgtcgacatatgcaatgctatagactgacataaaatagcttgaataagcaacagtttgacaattcatcaataagaagctatacctgaaacctgacagaggtgaattactgatgcaggtttgtgattgccctggtgatgcttttcaaggggaagaatggaaacgatggttgtcactggtgccactacctgaactgcataccaacatccagatggaagtgcagtacttagatgcttcagaattccgttagctcttctccaaattacaaatattcttcgggaaccattttcaagcttgtgtgcttgtagatatctacaagaaatttgccacagagtcgaattctgccctttccaaagtgtagtacaattttctgctttgtaatttgagattgtaacagctgtttatttcagcccaactccatactgcattgctcaaaaaatttgtgatgttcaattggattctcttatatcatctaaagttcgaaacaatgttaatggttatggagtctaaacattcttctttcaaagtttcaaggccttctctggaagactagaatgtgggagtttctactggtctaatggaattaaaccaattcatatgaaactagtaataaattgaaactagtaatatgcccgtgctaatgctacgataaaaattgatattgcaaataaaacacccaaaacattggtactttcagcaatggaacagatagttaaaaagtttacgttagcactgaatttttttcggcaaaatattatgtattacattttgtagtgggtactaaatacgcacacaagacaagccattcctattttagacagaaatcaagctccactgtattttcctttgaagttaaaaaatggaaaataaacacaacttctcagcatgcaaccagaggacaatatggaaagaaataaatgattgcagtgaaacctcatttttatttccatacaaaataaaaattaatgtaaaaatcagaaattcactgagcagaaccacatcaatatctttacattagatgaacaatatctttacattgttcttaatgaaaatacatcaatatatattgtggtaacacctaggaggttcaataaataaaataacttaagatcttgcaacatgtgtcactaatatttaacaaagtggaacaattgccatgtaatttgtctattcttcacttggaggttggtgatgctctggtagctggtagctggcaattgagtgaaaatagctataagtgaaaagatttgccatattctcaccaaccttaaagtgcaagataaaatgttattttgcaaggtaatatgtatcaattgtgatgaaaagaaaaattctcagcatggaaattaaaaaggatgcttctctaatgccaccttggatcctttggaataagatcatttcaaacaatttattctcaaatggtttgcagaaaaaaaaacagtaccaagctagcgccaacatggccttgcatgacacagacacactcccggtgttcatggaagtcgaggcaaattatcatggggtgtgcaatatctcagcaccttaaagcaccatagcccttgcaatctttaagcttgacaaaatattgtccctcaaataattcctaggtgacatacattctaaacacagaactaaaaactggagtcattacctcacttcttttttgagaaagtagtgatcaattgaagtgaaaaatattcattcaaactcatttgtttttctgaatcaatgatcacataaaaatggtttgttgaagttcagtgatccagcactgtaaacaatatttattttctcataatgaggagaaagttgtttactttccaagacataactgcacaacatcttctcgttactattgtacataactgcacaacatcagaacccgaaacacttcctcgttatgcgtgcgtggaaaatcacttctcaaactgctgcaacgaacgttgtcaagcaatctccagtatggcagtatgtgatctttggtgatatccaaacctaagcaattaaaaaaccagcagactccgaatcagctccaagaaactgtagttcagaatggaactcaaacaacaccgagaaagattttttaaaaaaaattaggaatatcaagtgaatcaggaatggagtatgtgtgctgtcaaaaaataatgtcattacaaaggaacaactaaatctttgatgtggtagtagtacaggtcttactttaaatatttccaaggctgaaatgaaccaaaacttctgcaatgtattgattgttttgcctcaggttgagcgattaaggatagcagatctgttgacaaacaatatgggtaagagttgatgtcaggagaccataccaccaatatattgcccaaaattggatatttttgcaaatacacggttttcagatagcaaatagtgcatgcggcattaaatctaacaatttcccttttcttgagagggagagagattctattacatgcagtacaatatacacatttggtgatttgataatataaatctgttatttgttatataaatttcagtatatacccctataggaaataaagcagcatataccatctctataaagaaaaatgcagtatatatgctcgtaatggtgaataaaaaaatagcacatagggaacattgcagtaaatacttctgtatataaaaaatcagtatatgcatttacaggaaacattcagcatatgcatctacaggaaaatttagcatacaaatctgaaagcatgcaaggactgacctacaaaatatccatatatagaaacataaagatattaaatctaatggtctcctaataaaccactgggaacaataaatctaatggtctcctaatcaaccactggcaataagttttggggcatacttttgactcaagtgataaaacgattctcctcacctgcaaacgagtagaaaattttagacactgtgaatgatcttgcattagaaaaacacctgtactaacctgctgctttgccacatgtacgtgaatactctgctgctctccttcagatgtgttcatcacatcgggtcaaaagaaacccagatggcagccgggctgatgtggtgacgatggcggaattcaacaagtcaatatatcctgcaacgaggaaaacaatggtgtcaactgtacatcattgagcagacagacaaacaaatcaacatgttgttgatgaatgtcgcaagcacagattgtcatggaggaaggcgtgcgacggcgatgcagatcctggtgatgcagcgtgcgacggcgaacaggcggcaggatggaggggaggggcggtgctgggttgggcgttggcggcggggtggacggggaggaatgcgtgcgacggcgacggcggtggcgttgatctggccgagggatggactcgagcggggaggggcggcggtgggtggggcgtccgcgataggcggggcatcaacagcggtgtctgtggg

SEQ ID NO: 77557 - DNA, 24816 bp, Oryza sativa
  unsure (1)..(24816): unsure at all n locations
tgattaaggtccatcaccaaagaatgcatatctaccacatctcattatcgggaaataaccttgttgaaaacttatgtaaaagagaggttaatcccataaacatcggtttatcatctatcaccaacgtaacaattacacaaattgtttaatccaagatctttcaatcttttctctcttttgtgataaataataatccgatataaacaatacaaagaaatgagatgaaagataatttcaaatcaaggtagagatcttataatgaacaaaatatagaataagctccccctcaagatgtgcatacatatggatatgaaggaatgcatatgcacataatcaatcaagatcaatgagggagctcacactatattttggatccacaagagagacaaagttagaatatgtgaagtttaatacatacctcccatcatttttactttcatatccaaataagactagtcaaagaaagactcataaaaacgttagtctcgtataattagatttgtcattaatcaccgaaaccaaattaaggcacttgaacttacagccttcaaaaccaccgagggaccatatttacccggttttcgtaagttgaaggacggatcatacccggttttgcggtcgagggacgaaaatcagactgagcgacaaataaagggacctaaagtgaacttattccgacacactatgtatatggaccagacatcggaagtacattcggctaagcatttgtagttttgggcttcatctacacctcaccaatgggctcttgttgggctatcaggatgaagtcttcattgtttgctgaaaattccagggcaccttttgtttgctcaaactaaggttaatatagtgtgaagacgtcttctactcttttatactccctccaacctataaaaaaacataacttagaataagatgtgatattttttatgtttagattcattgtaccaaaaaagttacattccatcataggttagttttttaatgagacaatcagagtacgtgcttgaaaaaagtactactgaagtttcaagttacagtagtgttttttccgaaataagacgaatatcttctaagtattccttaagaaacaataaatattaatttacaaatcttagtaatagtacttctacacacagattgtggaagatcgaagaaaaaaaaaacaagcatagaagacggatcctaggcaatccgcatgcctgcatgatgcacatcaggaaaatttcacgactgccgccgcgcatcgggatctgaaaacgcacgactcctcccgtgacaaaacgtccatcccttcgacgccgcacgccgctgttcccgttgaaaatcaccaggacgaggtcggcggcgggcgtgcggcgcacagctgccacggcacggcggcctcgtcgcgcggttggtagagacaggccggcacgtccgtcgtgtgaatcgcgcggatgccgcgcgggtcaccatcgcgatcgaccgataacatcggcgcgacaggagatggatcgccacaacaccaccacagcggatttgatctcacatcacgtgacactacccgtcacccgccatcggattaacgacctctactcgacaccaaactagagctcctgctcccgtccgctcgatcgcgtcgtcctggcgatgtaacggatcggtcgatttgcctccccaacgcgacgctgacatgggaagattccgtgccctaccatatgccgacttcaatttttactcggtctatctttgacacaagcgatctacgaatctcatcatgcacaagtacagaagctagccggtccgtgcatgcatgctgcaatatcactgacgttgcgaagagaggccggaggtgggtactaccgtactagaatcttatcgtgacgtgaatgtggagttttccttcacaatggcttttacctgtgcaggttagacaaagggttgtaccaaaccaggtcgtcggatggtcgctattattttttttcccgtttttcagaaccacttttgtgacagcaactggcagctttgcatgcgttggaggcggtaggccggccgcgagagcgagagaatcccttctccccgacgcagccactacgtgtgcaacgcattggccgcacaactagcttaagccggtcggcccggctgttgcctgttgatggcgccgtgtagactaatcgatctatcagcaaaccacccgttgctgtcattggccagggtcgaaattaggtacagtactccgtacgtccccggcactgctgctcgacgtcacaatgataaatgaccagcgtttcgccgagacattctggtcgtgcgtgcgtgcgaggggcatgggccaccatgcgcctcgtagttatcggcaggaacaggcatgtgacgtgacacggccttgcccggaggaggcagcgctttgatgggtcgaaagatatgggcagcgtccacggacgatgtaacgacgcccttgaccgtgcgtgacgcggtactacaccgtaatagtaccgtaatatcaactatagccgcctcacctgtccggttgattacgccgcgcgacggctgtttcttgccgcgtcggcaggtccgcgcgccgcgactgacgtgatgatccgatattgcaggtgtgtcatttggggtgcgtccttgcattgcatgcaccacatgaccgtgtctagtgagcaagatcaggagtaatcaatggctaggctgtttgtttggaggggctaattcataagtccctctactttagtcccttttagcccctaaaatactaaaaaaggagggactaaaagaggctaaaactacctagttccataagttcctgtgggaggtgctaatagctcacctactattgaatggatgaagcatataagtgccggatgaaatgctcctagataggtcatttaatgatgtttcagtcccttttagtctctccaaacaaagtttaacctctctttcaaaaatataagtccctcccctagagacttatggttttgtgagtttagcccttctctcccaaacaccctctaagtaggactaaagaggacttatgttttagtcttagaactaaattttaaccctaggacttatgtaaacaatcggggcctaaaagttgctgcaactgatagcagctgatctagctttcctttcccatcagactagcgataccacagtatagtctcgttagagaattatgaatttcgcaaaattagttaggagtagtctcgatggttaattcaaaagcttactccaattactaaacgtaccactgtatctgctagtctaacatgaaaattagtttactactgcctctatcccacaatatatgtcgttttaactttttcatgcaacgtttgatcattcgttttatttaaaaaattagtataaatataaaaaaggataagtcatacttaaagtacttttgataatgaagcaaatcacaaagaaaataaataataattctattttttttaaatagacgaatgatcaaacattacaaacaaaaactcaaagcgacaagcaatatgggacggagttagtaagtcccataaaatcaaatctattatacgatatactccctccgtcccaaaatataagaacctaggaccggatgtgacattttctagtactacgaatctctgtcccatccagtcttagattcttatattttgggacgaagagagtagcacattctaagggcatccacaatatagtctaaaactagtccataagcaataaaatattccattcagccacctaacaacattgtggaactagtccatagcaagaaaatagcaaaagccacccataagcatatgggctgaccatatagaataatatatgttatttctctctatttcctctctcctcctaatactagttgctatctatatagattgtgaagataacaatagttatggtccatatgtgtgggtcccatctatatggactatttttgctatatacattgttgttgccctaatactactacatatctaatattagaatatatcacattgaagtaataaatcgtaatagttgattaaccggggctctggctagctcagtcgttggaagctttaatactccctccatctcaaaatgtacggatttttaggattgaaacgggtattaataaagtaggtagaactaaataggtgaagattgtgactggttgagaagtgaaggtaggtgagaaaattgaatggtacggtggaggattgtgattggttgagaagagaatgttggtgaagtggttatattttgggacaaatcttaaagagctaaaagttgttatattttgagatggagggagtagaagatataagtattttgcagataaactaagacatatggcaatgttttttaccctgtgtgttgagtacgaaatactatctctgccgccatcaaaattttgcccttctgtttttttcactgttccgttaatatttgtgtctcttttgacactgtcgttgattaacgaccatggcatttacttctactagtgtacgtgatttgtcacacgtaattcaattctacaatataagtaacttattttgtgaaacatttgagaaccaaatcccatggtgcaatttcaaaaattatccaattgtacaccttttttcccaatctattatctttgaagcggccataatttagttttgttgataactttatggtatttgttagaagtacgtgtcgagtgctgcattatttttgcacgtttacagggtataatggtcttttagaggcaaacgtaatggtgaaacgtctttgaagctgtggtgccctggtttagaaaacgtacgtacggcaaatgaaaaagttacagatgtggaagagagaatacagtcacaacaaatggcaaaaatagaaaaactttcccgctggaaaaataatagagtaaggccctgtttagtttccacgcaaaatttttttatcctgtcacatcgaatgtttggatacatatatggaatattaaatataaaaaaactaattacacatattacgtgtaaattacgagacgaattttttgtatatctatttgtactagcacaaatactactataagtataatcttgtgagattttgtgcagacattgacgccaatagaaagcactctttccgctaaaataaacttaaaccttgtatcggagtacattctacttatatgaatatgaatagagatatatctaaattggtactctatttgtcccataatataagggattttaagtttttgtttacaccctttgatcactccttattcaaaaaattttagaaatattatttattttttgtgacttgctttattatacaaagtactttaagtacaacttttcgttttttatatttgtataaattttttgattaagatgaatggtcaaacagtgcaagcaaaaacttaaaatcccttatattatgagacgaagggagagtaatgtatcaacgtccagtattatcgatcggttcttttatgtgataagggaagtaggcaaagaaaaaagagttaaaggcgcaaagaaaaaagagttcaggccgtgtttagttcgtgtaccaaaatttttgttgaatcatacggacacacatttaaagtattaaacatagactaataacaaaacaaattacatattccgcctgtaaactgcgggatgaatttattaagcctaattaaaatgtcattagcaaatatttactgtaacaccgtattatcaaatcatgacgtaattaagcttaaaagattcgtctcgtaatttacatgtaaactgtgtgattgtttttttatttatatttaatgctctataaatatgtttaaatatctggtgcgacgaaatttttagaagtttgaatgtaatgtctaaatctggaggctgtaatgatgaagagaagacggcgagagtttacgaaccgtcttgtgcttgtaggagtacgtcaagtcttcaactcttcaagtcacctactgctactgcatgcatgtcaaactctcacatcggcgtacaccatacaaatgtaaccctgttctaaatttttttttcgaaacttcaagctttccatcacatcaaacctctcatacatacataatttttcaatcacatcgttccaatttcaccaaaaaggttatttgggaactagttactaaactttagtccctctcacaaaaacataagcccctcctctagagacttatggttttgagtttagcccctctctcccaaataccccctttcaaacttcagtgtgaactaagagggtgtttagatggggctaaaactttttagctaatgtcacattaaatgtttatatgctaatttagaatattaaatataaactaataaaaaaactaattttataaatgagagcttatccgatgcgacacagcttgccgggaagtttacgtgctgagtttactccaagtaccacccttgcgctttgattaccactgcagttcagagaaccatgcatgagagaaaggcacctcagattagacagcgaaatgattgccgtcagctgtctacacgagggaggaaatgagtgaaggttgcacacactcctacaggcagcagtggtttcttgtagcgccaggcaaaagaaagacaggtctctctcagggagtcagagatgacagaatcatttctttctcctgataatcacagttaaaccagctagtagtagtagaaaactctgcctcggtacttccgctttttccacggagtgaaggagtatagtagaaaactccttcgaattatacgtacaaaagtactcctactatactcgttagttgttcttattagtactaaacaatttttgagattttcggatgccgtttccggtttgcgcccatagttttagccggtagtattaaataattgtgagtgttgaaaatgagaatagtaatatcttctgaaaataatagtggaaatcaggaaatggaatgaaggtttttctgcccgtttggtcagaaacctgttcgtatgttaatttctgttaaaattttgaaagtgccccggcgatctagccagctcaacccatcggaaagccctaggacatggtatgtatcctttgctgaattttgatcttctcaacttatcgattttgaagtattgttgaatttggtttatactgttcgtcaaacttattatcatatcattaattattatataatgatgtaatgtagagtgtgatgattataagaatgaagctttaaaatcattttaatacatagttaagtgcgtgattatgccacactcttttttttcatacatgaatttcgatttcctaccaatatcaatagatttcattccaacggttcagtttttgatataataatattaccgatatcgttatcgttttcagatcaacatttcaattccgtttcaaaaaaaatataaaaatgaaaatagtagagggttttccgaccgttttcatccctagttcctactcacgctgatgtgaatatacagtagtaggagtgttatagtgagctgtgtttagtttgtgtgccaattttttttaaaagtatatggacacacatttgaagtattaaacttagactagtaacaaaacaaattatatatttcacctgtaaactgcgagacgagtttattaagcctaaataatccgttgttagcaaatgtttactctagcaccagattgtcaaatcatggcgtaattagactcaaaagattcgtctcgcgatttacatagaaactatgcaattagttttttttgtccacatttaatactccatggatgtgtccaaacatttgatgtgacggaaaagttgtaagtttgaagaaaaaattttaaatctaaacacagcctgagttacgcaatgtaggtttgtgaagtggtactactggtcagttgcgcagcgcgagaaaacgttgctcatatagctgttgatatcgaccacgtaaggaactgaccaaatgaaaaacaagtactaatattatgtagtgagattacccatactataaatttgaacatcgtaatattatatagtattacatacctttaaaattttttatattttgaaacgggaagtatagactagggttgagagaaatagtagttagtagtaaggtactaggagtactactctttttatcctaaaaataatccaattctaaagattgcagcttctgtcgcctgttaagcgagctcgtccgcgctcaatctgaatatggtttatgttcaaattaaattgtagaattaaagatttttatgggaggaagaaggcccggtttagatgctgaaaattttcgggtctgagcgaaaagttttggcatggtccagttttcgcgttttgggaactaaacggtgaaagatttcggggtactgtttatgggtggacgagtagtacccctcaccctgcatgcaagcaacaacaacacctaggagagcattaaataggggcaaatcaggcagcattaaataggtccccaaaattttatgccaaaactttggctgtttagttcccagaatgccaaaaccccaaaattttttcctccgcccaaaaattttggccaacttttatgatgcctgagctcactgagtcacgttcaccggctcactgcctcccagtcttccagcgatgcatcggcgaccatcaatggcctcatcgtcctccttgcgccgcatgccgacgccacgaacgtacgccgcgcgcatgcatgcggggtttctcgtgacacgcaggccccacaggcagacacggcaaggacaaagccccatgggcttgcatgcacagtggccgtccctgtgcgagacctcgccccttgggggtcgtgtcatgcgatcgacgggaaactcgggcgcctctgcactctctctctctctctctctctctctctcaatgatcttggtcgagtcgaagcaaaagatcgcgtgtctgtcgagtgtcgacaagccaagctatccaaaggagtccgaacgtgtgggggtggccgtggccagtctcccgtgcatggcagtgtctctgccccctgactgctcgccactaccaggccgggccattctctctctctccctccgctagaagagattttaaatgggtgtgacacattttaatactataaatttaaatatattgtggctgtgtttagatccagttgtaaaattttagcgtatcacattaaatatacggacacgtatttaaagtattaaatatagtttaataacaaaataaattacagaatccgcttataaaccacgagatgaatttattaagcctaattaatccgtcattaacaaatgtctactatagcaccacattatcaaatcatggtgcaattacgcttaaaaaaatttgtctcgcaatttacacgcaatctgtgtaattagttattttttcgtctatatttaatactacatagatgtgtccaaacattcgatgtgaatggtgtaaaatttatcaagggatctaaacaggtcctgatctatgtccagatttattgtattagaatgtgtcacatatatttaaaatcagttatattatgcgatgcagggtgtatctccttgccgcgcgagatgacgggtttctgccaggtgggcaagaaaacaaagcaagaccgggcgggcgctacgtgtgctagcttagccccccggctacactacagtcactcacccccgccggcccgcccccggccgggcgtccttgttgtgatcgatcagcggcacacggtggcgcccacggtgcgtttcccccggcccgtgaccggtcgcaggggcgggcacactggcgcggtcaccgcagcaaatgcagcggtaggacgcgtagtttatgtgcgcaaaactgatcggaaccgacggacgtaagcaaaatataaagagaacattgcaaccacaacaacgtcaaacgtgaaagttttttcagacaaggcataaaaatactaattcctttcgtttcagattataagagtttataatattatccatattcatatgagactgcctatacatcatgtgataggcacacatatatatctagatgttaatgaatatagacacatatatgtataaattcattaatatatatatgaatatgaataatgctataaagtcttataatataaaacggaggaagtatcgaactataaaaattttctacagaataagaatctacaatactatatttgtctcacttattacctcctatttaaattttctgcaaataccaattttattcaggggcaaagtcaagacccggtcactatggacaagtgcccaggctccgcccgctgcaaaagtacgtaccagctgcttgattaatcgatctaacatgttatgttagatttagtctactatattacatctgggttatgtcatttttcttctataaatcgaaatactccctccgtattataataaattcatttttaagcctttccatttatctcaatataagtttatttttttaagtaatcattgtatcaggagtttatgaaagtatatacaaatgtattgggatttgataaaatagaggtattatagttatttgggttttgattggtatgtttgggataagtaaaaaaataaacatattttaggactgatggagtatataattttatgaattttacatatgcttagggcatgtacaaaggtaaaatttaatatgagctctttatattaattaatatcactagatattgtactcctataatagataagatctctaaacctttaatgcactaaataattttttttatacttcttttcttttctccaccctcatgcaataatttttccattaataaatgctaatagtcgactatgagtcgtcgtcatgcatagcaacgatgtttctcttttcttccttttctttcttcaacgtcaccaaatttatctgcattacaatgaagagaccccgttattagacaatgaagagaccccgttattagacaccctgcatatgccctatctcgtttgttcaggctcaaaatacgtcattgttcttaccgtcaatcactgtcaccattttgccatgtttatcctcacttattaaaggcataatagatgtcttccttttggacggcgttgtaaccattaacggatttgctatcggagcttttggtttgtgggccatcatacgagtgtcaagatatgtgctaggtatggaaaaaaattcattgcacatgcaaaatgctagctattattatattctgtaacggaggaaatagtcacctgttttttcttgtttatgttatgacaagttacatataaatatatttcagttatactataattatacttatactatatttaccttccaaagttttggactaaaagaaaaactgtcgaaagtctttagatagtctcaacaattaattaagcacttcaatgtaatgtaccgctacttgcgaacgtccgaattgtgacggatcggatcggtttatgcttttgacagtttttcacccgtgctagctgctgcgcgcggtgtcgtgtagtcgtggcggagacctggagtaaatggtcggcgttctacgtgcgtcagccatagcttgaccgggctgcgcaggcagtacctccttgacgccatcgacgattatccaacagtgccgcctcagtgcacctgccaggtggggcccacctgtccacgtgatacggcactgttgccttgttgtacacacactgttgctcagtgctgctttgagtagctgggtaggcatagctgtacaggacgcttagcaatgaagtgggctaggagtagggtagagtacatcggtgctacagaaaaggctacagttgcagcaaaagcccacccacggaggactagttcattcacccagtccagtccagtgccactagtactaaaacacctcctctccgtatctccggttctgtctgcaaagcttctaattgctgtagtttcttttaaaatcaaagttctcctagatagtttagcttttgattcagattaaaaaaaactgtaattataaaattcaagtagtaataaatttaaagccagaagtcagaaaacctagtatttctagattatcggaaatagctacaacgtgttatttttcagaattttaaactctccaaacgtgcctctctctctcgggtgacgggtggatgcgacgttaaatggcaacagcggccacgtcacctccgacgcctacaccgccgtagtactcccaaacctgattttcgtgtccttgaccgtccgtcttatttaaaaaaatacaaaaaaaattaaaaagataagtcacgcataaagtattaatcatattttatcatctaataaaaataaaaatactaattataaaaaatttttatataagacggacagtcaaatattgccacgaaaatctagggtttgcctttttttggacggagggattagacctcaaggtatctctcatgatcccctttcccaatactactgcgtactcctaccgtattttgcgtactccctccgttttcaaaataaaataaacgtagctataaatttctctgtgtccaattttaatcgttcattttatttaatttttttttaaaaaataaaaaaacataaagcacgtataaaatattatttatattttataatctaataataataaaatactaatcataaaaacttaaaataaaacaaacaattaaaattgaatacgaaaatttatatttgtgtttattttagaaacgagggagtactgtactactactagcggcgtagcctagccctggcctggtgatgatgatgcaacggcgccggggatttgacacccccggagacgtgacgaccgtagtgcaatcccggggaatctgcgtaacaatccccctgctgctgctgtcctgctagcctaaccgggggtggagtagactagtagtagtactaccagtagcagtgtaccacacgtagatcgggccccgtgtgacagggagagcgacgccggaggggggagatgggccgtgcaaccgctgcttatgtggtgtcgagtcgatggtgggggctaccggtcgggaggggtctcgctctcgcccaccccaccggcccgtcgtggtgtacagtgtactcctacgcggtggccaatggagagtgtgttttagggcagcgttaatggccaccgtacgtgtggtttgccgatcaaatcaaaaaccttgcgctggaattttgtggactaaaatctgtgttggcgactgcgaggggtggaagatgacgacgaacgaacgaacgaacgctacgggctcactcggtcaagtcaagggcatgccgtgctcgttttggaagttttcgatgttcatttcagggactccggagggacactcgtattgggtttacgaataggagatggcctaccgttccgggcttaaatgaaatgatggttttcacgaaatccggtagaaaatcagtagattcaataaattttataaaccaaaatttgaatacaaattccctgagtttatcgataagctcgtgaaaaccggtcggcttgatgaaattctgagcgaaatcatcgaaatttcaatcggtaactagtaaaggaggtaaactgatttttttcctttttaaattcgttattcttttctttactactgtaaatttcagtaaatacacggaatatattaatttttttgaaaatttatattccaataggttctataaatatcgttaacttctcccgtcccaaaatatagctacctagtacaggatgtgatattacctagtactactctcggtgacatggggccgggggtatcgtgactagaggcttgggtagccgcggtcacccacgtggcctgacccccttgggggggtcgggcccgagggtgacgtggccacccctccctctgtctccccgaggggtcgggtcgctcccgtttcggccccgagggctggggcgccccgaccccctgtggttttggcgccacgtgtgtgggttaggtgagcacagcgggctcacctaaccgcatttatagcaggttggacgagcgcgccacgccgcatttaatgcggcgcagcgcacgcttatccggtccgtgaccggtcgcggtgtgtgaccggtcacagaccggtcagatcgcgggttaggtggcaacaggcggcctgtcacacgcctcgccccgtcccgtcggaatgataagagcttcctggctctcgtccctagccggagctggtgtgctaactcctggagttggtatgtcagtccccgtcagattcattccaggcttcagcgcaagtatagcaaggaagtcgctggccattaaatgaaggttgaaatgggcgtccaccgggaaagcaggcgagcggggcaggaggcgtgtgctctgcttgtcagaggtcacttccggctgtgactagccctgattgtaaaaagcatgtttcccttcttaggcagctagaggcccatgtggtgacccctgaccagataaaaaggaggcccaggcctagaaaaaaaggggagagaggaaatgaggggagtggggactctggcgaagggtttctagagcctgaactctctttcgctctcggcctctctgtattccttcacgcacagatccaccagaacacaggagtagggtgttgcgcttctcagcggcccgaacctgtctacgtcgcccgtgtcttgcgcatttcctctctcgctgacgttcctcagatcgagggcgaagaacctcacttagcgcccccggccgaaccggcaaaggggggcctgcgcggtctcccggtgaggagccccacgctccgtcaactacgaatctggacaaccctcaaaatgtagctaactaatataggatttgacattacctagtgactatccagattcgtagtacaaggtaatatcacatcctgtactatgtagctacattttaggatggaggtagtagtattcaatttcgcaccagacatattgtattccgaccaccatagcagtagtgttttatttcggttgagtttaggtcatcaataatatatgtaaagagatcaagtagtagttcatagaaataaaacccacactagtgattttattgttttcattttcataatatatgtagatagcaattaacattaagatatgaccacactccaaaaaatttcatatccaaataccatggttctctcgtgcagaagaagcaagacgagaaagagagttttttttatctatatgagtaatctttatagtcatgagtagcttatcatatgactctttctaatactacatctcacaatgacaatgacaaaggtaccagtatagagttttaaggacggtttcttatcatattgtggatgcgcttacaaacatcattgtatactgtactacacggtaatttttcttgctgcctcccaagtggtaaagctaaaaaacgattagagcccaggcaaaccaaactatatgcagtgtttactactccgtattaaaattcttctaccagtattttcaatcacaacagttacactaggagcaagtttaacagttacactagtgtttactactccgttttttaaactaactgccaactatttgttcatcttaaaatcaaaatatataatagattaattagacggttggcttcagtttttttctcctctccttttctctcggttatacatttaatcaatttatcttggagcatgtataaagctagttcttacataagagccaacacccttatttaatattgttacctctcctctccatataagtttacagtagatttatagtttgctattatccttgctttaaggttgtgttctttctgcttccttcccaacttacctccctctcttttcacgcacacgtttttcaaaatactaaatggtgtgttttctgcaaaagttttatattgcaaagtttctttaaaaaaatcaagttttttggttaattcttaattaatcatgcgtttatgactagcactgttttttgtacgggtaggttatcgccgttgtgttcctcgccggctacaccttgctgcttcataggtttgtagctagcccaccaagattcggagaagagaggaaaggggaaaggaagaggtggacggaggaagaagataagacattttagtccaaaattttgataagtgcatgcaaagggtaaatagtggcatatctcgaattggtttaattaaaattttaatggcactagtccaaatacataaattataatggtattcttgtaaccggaaaagttatagtggcacatatccaattaatcctttcacaaatttgattcaagttggtacaagaaaatgaataagggtgtgtttaattcatgctaaaattgaaagtttggttgaaattggaacgatgtgatggaaaagttgaaagtttgtatgtgtagaaaagtttgatgtgatggaaaacttggaagtttgaagaaaaaatttggaactaaacttcggccttaaaaaaagaaagacgagggagggaggaagaagcaaccacaaagtccacaacctcacgcgattctatcacaaagattgttttcaggttttttttccccacaatggagcccacataataaaaagcaaaatcttactttgtcatctctaggttttgtgatggcaacccttaatgacttgatccagtagtggagctacaatttttccaaacctagagctcaattagttgaatgttatgatttttcttttatattctagtttttgaagttttaaaatggaatttcaatgaatatttaggatcaggagtagggctacagccctagttgccctactcctatcttcgcccctgacttgatacacatactagaaccacatgagggcaagagtgctcccgacgggtggcgccatacacatagggcttcataaggaatntgggggccagtgaanaatataaaactactatgtcctcttattcaatataactagaaagataattatgaatacaatccgaatataccttgtagtatcctattagaacttcatttctccttttttattcagaacacatccacatatgaggcttgatttcatattggatttgttatgtgatgggtcctatcgagttttagtacataagtaatgggatcccgtatttaggatactgacatatatattcactaaagttgcataatatatcaaggtagactcatgttttcaattaacgctaagaagaactatgtctagatgcagcgatttagttttgattaagtgaataaatggaaccttaacatctaaaacacaggttcatattgtcgtcatgatccatagttctttaaaatagtcatgattactatcaaacatttattagagctgattctttttcaaaaatatgaaaaaagtggtctttaaacatgttggaacttggaacacattggcatgaattaaaatatgaaaataattgaagcctctaacttttgggggcctgttatacagatcatctcgcacgtgcttatcgatggccctacatacaccatagcctaacctcttcaaaattgacaacaccacaacaatgtattgagtgctacttactttgtaacatactgtaagagacagcttgtgagttccttcatggattatacacatgagaacgtttgaaatagttgtttggatgaaacacaaacatatagtaattaaaaaactaaaaaagggaaaaaaaagctttgttcggaaactccaatgaaatatctcaaaaggaaatttgaagagtcacttatattccatatgactacctataattatctacgagatttaaattcttatggacacaaattcttcggataaatttacttgaactttggtgaaagaaccctaaacacatgtatgcatccagacaatggaaagcaagcgtgccatgagattttctatttgggccgtgtttagattaaaatttttttcttcaaacttccaactttttcgttacatcaaatgttaggacatatgcatggagttttaaatgtggacgaaaaaaatcaattgcatagtttgcatgtaaatcgcgagacgaatcctttgagcctaattacgccatgatttgacaatgtgatgctacagtaaacatttgctaatgacagattaattagacttaataaattcgtctcgtcttttacatgcggaatctgtaatttgttttgttattagtctatgtttgatacttcaaatatgtgttcgtatatttaaaaaaaatctagcacacgaactaaacacaaccttggatggccttctaagactgtctccaacaagtgacccataagagcacccaaacccaaaatgggtctccgatagtactatttcaacaaaagacccattttgcgtgctataagaggcataacctaaatctgagtatcctctctcctgaagacctatttgcagtaagtgttctcttttaggtcttattgttggagaagaccaaaaatatgtattgaactctttgactgtagcgctatgcaaacgtgaaatggttcttgtattatgggtttcattgttggagatagcctaagttgcttatccggttttattgcctgccatataagaaccccatcatccacatccgaagaggacatatttttgttgcaaaactttaaaattataataataatgtaactacaatataacataactagtacatgtaacgtttgttcaagcaattatactactaccatagtacgattgcgtataaagtttttcaattcaaaaatgttgctgccgttttctagatggtgaaaaacaaacttcacccatctccgacgaactacaaaaccctcagctcgatctccgcacagtcccgggccacgcccacaccaccctgatccgctcaccccttccaccacagggtccaggaggacctcgcccccctcctcctcctcgtcgcacgaccagaccagcagcaccaactccctttctgcctttcgctttcactgctcagtgctgctcctacacaccatttccccgtccgtccttcgccccccgcgtctcttttccgcacccatctgctgcagctgcgcacctttaatttgcagaaagaaagaaagaaagaaagaaaggaaagcaaggcccccccgagcgcaacagctagcccaacacacctcctccatcaccaccgagaaggcaacgcatatcaaaagcgcgggcgcaaagcaaagataacatcagatcaggtcggcgccccccgctcccggctgccgcaaagcccacccgatcgatcgatcgacgcctcgttctcctcctcctccgaggctactctctgcagggcgctcgcttacgtctgcctctgcgtacgtgcaccgcccagcgcgggcgccatgtcgtccgccgcggggggaggaggagggtacgggggcggaggcggcgagcatcagcatcagcagcagcagcaccacctgctgcttgggcaggcggcggggcagctgtaccacgtgccgcagcacagccggcgggagaagctgcggttcccgcccgaccacccggcggagtcgccgccgccgccgccgcccgggtcgtggccgctgcccccggcgttctactcctacgcgtcgtcctcgtcatcgtactcgccgcacagcccgacgctggcgcacgcgcagttggtggcgcatgggatgccgccgggggccgcgacgagcggaggggcccagatcccgagccagaacttcgcgctgtcgctgtcgtcggcgtcctcgaaccctccgcccacgccaaggaggcagtttggcggccccggcggcggcggcggggccgccgggccgtacgggcccttcacgggctacgccgccgtgctcgggcggtccaggttcttgggccccgcgcagaagctgctcgaggagatctgcgacgtcggcggccgccccgcgcagcttgacaggggctccgacgagggtttgctcgacgtagacgccatggacgccgcgggaagcgtcgaccacgagatggacggcagcgatcgcgccgtcgcggacgcggtcacggtctccggcgccgagcagcagtggaggaagactaggctcatctcgcttatggaagacgtgagtaatcgcaagctatatttgttgtttcatatcgctgcttctgtttttccaaagaaaatactatactagactttacttttgctaccctgcattaattaacttcatgaataagaatctaataacgaacacctcatggtcacatcatggatgcacttactgttgttgcacagattatttcttgtgcttgtgatttgatgagggttgatctggattagtgacacatctcttctcttttggatatatttttgttctttaatatgtctcaaatcaatcaacagttcaaggctcttttaagctcccttctaaaactagcaggaggtgatccgcagtttatctataatcaaaaggtagcatacaattctgtgaaaatgcacgatagaagctaaattcctcaggatgctcttaattacatcataaagaaaaattcagtttgctagtacttgataagattccagcagtttgtcctctttcacgagataagattcgttgagtttgtcagcagaaagattctgattatatagttactagtacatactgaaaatatgttgagcaccagttttttttatttgcaatggtgtcaaatatgatcctcgttccttaattaggaagcttgcgttggtgtagtgtccacatgatcgtaaagtaggtctgcacaccttgatgtattattaaacaattaattgggttacatatcgtgatgtcctcttaacagttacaaaaaaccttgtaggtttgcaagcgatacaggcaatactaccagcaactccaagctgtagtatcgtcctttgagactgttgcgggtctgagcaatgctgctccttttgcttccatggctcttaggacaatgtcgaagcatttcaagtatttgaagggcattatactgaaccagctgcgcaatacgggcaagggtgctacaaaagatggtctcggcaaggaagacacaacaaactttgggcttatgggcggcggcgctggcctactaaggggaaacaatgtgaattcgtttagccaacctcacaacatatggcgcccgcaaagagggctaccagagcgtgctgtttcggttcttcgtgcatggctattcgaacacttcctgcacccgtaagtatatgatataaatcatcgcaacagaatttttctttttaggtatgctaatctggaagcacataactgaatatgcgtattgtgcactaattggaaaaataaaaggaaaaaggactttatggtatatatactgcatgttgcatttttacaccgacaagggtgtacatggattcctattagtggagaattatccatagaccctacaaatgggtaatatgaaggatattgcaaccaaaccgttggtgaaaattgttattttgctttattgaaatcttggattttttttcctcctttagatgcattaaaatgattgtggttttagtgcatggtttacacaagtcattgttgtgcacttacaggggagtcttggtctccatcacatataacctttattgttgtttcaattttagatgtgattgccgttgaacaatcattagttgcatgttatgtttattggatacctgtatgggtcccaattgatatttggtttgagatgatactacaacaacttgaaagtgcattttattttccaccaatttagggcaaccattgtgtgtagtttctatccacacataccatatcttcattcttcttggcaacttctattttggtacagtttttcctacagtaaattcctccttttgtggccctgacgaaccattaattcatgtttgtactacatcagatagaaaatatatatagtagtacacagtttcaatttatacacgtggtcttgaaaacttcaatgtttactaatgcctattggatggatagtttactcgaaaagtgagtaccatcacatactaacacttgataattgtgtgtaccttcattttcattgtggttattgccttggcataatggaggagaatttttgccataggacatccaactgacttgctgacttgcacatggcaacaacctttttgctgtaatttaattaatttgttccatgcaataattgttgaaaatattgttttttaatctagaattctttcctatcctactacacgtaatgtgcaatgagggttggcttgttgtttatgtttagtttcatttgttcttccatattttgtatgtggtgcttcatccttgtgcaattgtgtatgtaccggcattctaatgttggtgcttgatttcaggtatccaactgacagcgataagcagatgcttgctaaacagacaggattaactaggaaccaggtaaacaaccatttcaagtttttcttttcccaaatttatatcgatgtaactagctagtccgctacagttgtccactagcaatatctttgggtccataatgttactagcgttgtaaaacattttgatatctcaattcttgagcaggtatcgaactggtttatcaatgcaagggttaggctctggaagccaatggttgaagaaattcacaacctcgagatgaggcagctgcagaagaatccgtctcttgacaagaatcagctctccatgcagcacacccaacattcgtcggacagcagcgggaagccctgtgatccatcaaactcgctgcaagggcaaagtagcagcatgaccaggaatcacagcatctccgcctcccggcacatcgaggacggcctctcccagatgccccatgacatctccggtcaggtgagcttcgcatacaacgggctcgccgcgcatcacagcatcgcgatggcgcaccaccaccaacctgacctcattggcaccggtggtgccgcgaatgctggcggtgtctcactcacccttggccttcaccagaacaataaccgagcttacattgctgagccccttccggccgcgcttccgctcaatcttgcccatcgtttcggactggaggacgttagtgatgcctacgtgatgagctcatttggtggtcaggaccggcatttcaccaaggagatcggtggccatttgctccatgactttgttggttgaagagcagatatgattgtttcaccaaggagatcggtggtgattattgtaggatgcagatgtatgatctacctatattgtagttggaagtaggaggtgaagaaaagaggggcattggcacgcctgtcgtagatccacgaatgcttgtcgatatttgacattgtggggctatagagagcatatgactatacctttgaagacctgtttgtagtgttgttccctatttgttctgatccgcggttaagccgtgttaaccctgtactattcatctgacttgcaaatgtggttgctcccactctggcaaataaagggtgctcagttaatttgtcgccagcaagatgaaatgtttattggcagtatacctatacagctgaaggccttaagcatcagcgtgtaggtctaaaatatgactgggtagctaaatatttcatcttactccatggttagcctttccatgtgctcctattaaactaagcaagcaaatgacagagtactaagctgtgctagatcttgtatccttagatggagtagaacctaaagtttagacaaaaccatgatttggccatctgccaacctttaactggctttgtcatcaccctaaccatatctgttagggctgagttgtgcctattgtaggttagcttttgccttgatcagtgcactaaacagctggccaattagccccatgaccatgatggagctagccaagcccttgttcttttttcacttctccccagcgtaaaaagcccatgttacctgggatcagttatccatggccctcggtgttgcagcatctgatttgatgtacactttggcaagcactgcaactagtactagtataactagcactgcaacagctggggggctccatgcacgttctttttcgcgtggagggaatccatgcacgtcaccgatcactactactactactacaactgctgctgctagtactcgtcctatacttctcccaaaagtgagcactgttcctgtttaaaaagggcactgttgttagctttcaattctaggctctggttcctgcatgggtagattattgcggtctgattctacatgccaactgaagaaatatgattccatgccttttccttcgtggataaagctggtagtaagagggtatgagctatcattaccactcatggaagctagcagaaactggagtttagctcagagctccactctcttcgtttgggagagagatgtgaaaaagaattaaagaaggctgcaagcgaagacactcttttctgtttggctactattaccactgatcattcctgaagtgaagctgagcccgctgtgaaatcaaaatcacgtgctaattcctcacatcagcagtgcttgagctcttcggtaatggactggctagttcaggatgatgagagctgtttgaattttggagcattgaggggcatctcgtgatgggatagagtttgctggttcagttgctttgttccttctattattgtcaaattttctcctggcaagaaatgacgggttaacatagcaatccacccaatctctatcatttcagtttgccaaggcaggtgtagaagaaggccagaaatgatcatccattgcagtgatccttgacgaaactgatactcctacattaccagcacaggcatccttttctcctccagcttcctgtacctccttcaagtacagataattattaacgcttttaaaatgaacctctcatttcttctttttttttctctgttaatcatgggccaaggggacaggagccaactcgaaaggcaaatggcctttttccgtagcctaatcttggagggtaatggggcggggttctcgttaagcatatgctctttccactcgttaagatatgggcgatttgatgatccgt

SEQ ID NO: 77558 - DNA, 12071 bp, Oryza sativa
attttcagccgttggatttgatgaatgaagtatgaaggatgtaaaagccggttggtgaattatagggtagaataatgtaaattttttgcgttccaagtggaggcatgagagcatgaaatccgacgctaaaatttataacgtgatcgaagatgtttacatggggcgtgtttggttgcccggctcgtacttggctcgcatctcggatgcaacttgtaggatgtttggttgactgtacatgtcccacaactaagcccagcggatgcaaaaactccctcgcaggcaggctaaggaggaacggccgaaacgagcttcgctgcttgtcctggctccacgcatgcagccgcgctgcacacacgcgtgcaagcgccgcacccgcgcatgcagggagaggcgatggggtcaccaacaccaacctgcctccctcctcatttcttccgtcttctctcttcgctatcgccggccacagccacaagttgcgaccatctccatctccaccagccagatctagctgcaagtcctgctcctccgtattttcttcaacaatgggccacgaagagctctccgcaagtggatccgaagggcatgagctcactactgccagatctaccagtctggtagcgttgaatatggcgggtgctcatcaccactttcctcaccccagagagaaggatgagctcggctccaacttcttcatgtcattgtcgtcgtcgtcgttaccagcgccaccaccttcctcgtcggcttgagctcgtcgctgcacgaatgcccccaccgcagtcggcagctaccttgaatctctctcctcctcacctttctttctttttttttttgagaacacttcctcacctttctttggccggattcagaattaacctaggaacttaggcccgccagatccaagtagccacaagctcctgaccgccagacccgctgcacccacggcggcgaacatgcctggctgggtggcacgagcggctagctaccggcggcgacaagctcctctgcgagctctcttatcattttcttttttttcttattctttcttttttcaaccgaatgttattaatcactaataaatatacttgatttactgctgtgtgaccatatatgcttttgacagtgtcttaaattattgtatatgctcatctgacagtgtcttaaattattatcgccaggaactccaatatcaattttttatacattctgcttatattaaatctgctacaatataccgtaaataaatagcttttacatgataagaattttcactctcaaagaaagtaagtactcgaacctactttccatacaatcaaccaaacaaaatctctttcaaaccgtatcttcgatgcaagcaaccaaacaaaatctcactataatccagctaaaccaatacaaccaaccaaacagctgcatgtgtatctacttggccaggctaaactcggtctggacgagagagatgggccaggctaagaagatgcgatcaaccaaaacacacccaggagatgggccaggctaagaagatgccatcaatcaaacacacccatggtttcacatcggagaaggcaaggtatattcgactaggggcagaggaggtgcagcaaaagtgctttcttttgtgccttcttttgcttcggggagatgcctcgcttctctccctttcctcttccacaagaagatgggcaaagcagcgagtgtagtattttacctccatgcccctaacactgccccggcactgcttcggcttgttcctacccttcggagggtaataacgtaaatgaacctagcctagtgggctaaaccgctaaagcagttcacggcccacggcccaacaaaccttaaactacggggaaaagaaaagaaaaaaaaaagaactcgcaacttgtcaaattaaaattcttcacacacacacacagcctcgtggcttcacaactcctcctcctcttctcatcttgggtttctctccctcctcctcgccgtcgcgtcgccgcggaggcggaggcggagagccaaggccgcggcggtgcagccgccctcccctcctcccgccgccatggtgaggccgacgcaggacgcgatcgacaccttcgtcggcatcaccggcgccgatgaggccgtcgccgcccgcaagctcgaggtgacgcccacccgctccgttcccgtttgttccccccatcacccccccccttctcctcccttcaccgtcgccattctacgcctcggaatgtgtggggcttggatgcgtcgggtctcgagttaggtttgttgtgttagatggcgttgcgctgcggcgggggatgggtggtgcgggtgcgatgcgcgatttgcgggaggtgatgagaacgtggggggggggatggggttctagggtgtttagagttgagaacattttggggattggggattgtgtggtgcaatgccttcgaattttgagctttttagtgatgcatatgctcttagttttctcttcagcttgcgcggtcaggaatgctgaacacattagtggattagtttatgggcattgctatgggtacgattgtgaattgtgattcacgcggtaggacatccaactttgtttatgttatggaactttgttgacacaatcctacttggagtaagagttggatggagtaattcctattttaatgtttttttagggaaatcctattataatgtcttggtcttccattttgtaggaagaccgctgttgtcactgaatggtttaataaatgtttgcagatctgctttctgtaattttattgaacattgatttatctatcgggcaagatggtctttattgatcaatagtctttgtgagaacaattttcagattatggtccattgagtttaagcatgagaaaattactttattcaatctttatgtggatttttgactagtacagcaaataagcattctgcttagtgaatatttggacaggttagttatattgttgttgttgcaataactcttgccaatcattggtctgtttggaaatgctctgttggagtgctgagtgaagtactgctttatacttgtttcttctggttgcagtaggaataacttagcatagtaccttctgcacctctgccgaagatgctgaatcagagtctgttgggccttagcctctttcttcttcaattatgagtttggaaagattgttatcttattttgttaggaatcatatatattaggatccttattacaactcctctttatataaaggaaatatcaggaagaaataatgcgagcaaagtattacgctacttcttctgcctctcttccactgcatttcttctgcctctcttccactgcatgcttctgcccttttccccgttacccttgagtactacttcttccgttctgaaatataagcatatctaggattcaaattctgtacacaatataaggattcctagaatacttgtcccattaatcacctttcattcaaattgtcttcccatcttaccacaaccacccctcatttaatcaggacactatattcttctctcctcaaaacttaatctatgctaaacaacctagaactgcatatatttgggaatggagggggtacaacacacagaggcatacacaaagtccttacacaagtagatatttcaaaacgaatttctaactgactaaaatcattctaccaggaacatcatggtgacctaaatgaagctgtgaatgcctatttcaatgaaggagataggaccaggtacgtgttttttctcctagcggttcttatgtgcatttattgacctgataccatgttgttcccgttgttatatttaactgactcatacaattttcagcaccagagccaatgaaaatcctatacctaccggttatgatgacatggagttggatgaaccatttggtcctgttcctacatttcacatgcctttgggcaaccctttttcacttctggatcaaggttttttagaacgagctgctgctgtgtatggtgagggacctcatattacacaccctagggaggtgaggcggatagatgttgaagttaaggacaacaatactccagcaggtagttctggtcatggtcctgttattgaagatgttactggacatgagttttcacatgggccggaaattcgtgggactgttctgattgatgaagatgatgatgatgataacttgccatctgctcaagatactcgtctcccaagcaatccttcaacttcaaactattctgtaccaagagctcctccaattgctaatgttagtgactacaacaatgacatagaagaggagatggttcgcgctgcaatagaagcatcaaaaagggacgcagatggactgacaaatgtaagactgcttatcagatatctacttttaaaaatttggaacctacacatcttttttatcaaaacatttggtactatgcagggtctaagaagtggagaacgtgaaaatgcatcacgtggcagagatgatgatgagattgctcgggcggtttctatgtccttggaggtagttgttgaacacacaaagttctgtttttatgtgttctgttttttgtgtgttatgctgaattcatttttttttgtgactatttagacagcagaacaagagagagttctgcgccaagtgggagcgcatgtgtctgatcattctgatttatccgataaggaagacattgaaggagcaactgggacagtggaaaggtgtccatcaaatatattgtctaacaatctatgcatgtgtgatttttcattatatttggttattcatatatcaagttttattaggttcctagttaccaatgtccattgttccatgaatcttgagttctcttaatggtttcagcttcataaaagcaatgcattcttgcagctgcacctaccatattctttggatatcttttttgttattaagtttgttgtgattagctgagcatgacttcttctatctagttgtgactgattcattgtacatattatttcttgttgtaggcaagtaccaacttcagggaaagttggaacatctgatcagttggtagatgaagagaatttccaggatgatgacgttgaggaacattcttttgttagacaacactctaggcgtgtaccatctggaaatgatgagtccacagaagcacttgaaagggccaacagtcatccatccagtctcctccctcataacattgaaaacaatcagcagttcaatggagtttttccatcagaggtggtattttaatccatcacacctgtaatgagatagaatttaaccatactacagcttcttcactgcttacaaacccgttaatttttgttgcaaagtggggtggcatttcttctgaagaacatgatgaagctgttatgcttgaagctgcaatgtttggtggaattcctggaagagcagcatatccattttctctcccgtatcatcaaaactcaagtcgctaccccacggttgctcatcctccgtcaccaacattaactgcacaacggttgttaagggagcagcaggtatagactttggagtagtatctatctgtgggataacataacaacggctgcatgcaagtatgttaacctggtgtttgaattgtaggacgatgagtatctagcatctctcgaagctgaccgagaaaaagaattgaaggcagagcaggaggctgagctccgcagattagaagctgctgctgaaagagaagctgctattgcaaagcaaaaacaagaggaggaagaaaagcgaagaaaacaactcgaggaagaggtaattgagttagtagttagcgcgtttgagagttgaatggatagtagtcatagaactgttcatacattagttatattggcatataaccatgctaatcatatcgttatggtttattaaattaaagtcatgccacactgttggcaggccagtgtgcttgatgaattttatcattagtgcagatacgattgcatgtcggtaacaatgtctggattgttgcaagttatattgctttacttgtttcttatctggaggacttctcagactaactaactccttaggtctgatgagaaacattcttctgtattcttctgtaaattatgtcattagtagtaagaaaaggtagttaaaagctagcactatgatctgactgtgaccatctttaccatctacgtaatatcaaataaatgataaggaagtaattatgtgtcctttagaacttgcctactatgccttttccatggtttgtgttattttcaccacacagtggtatattgattatgttatttatggcaatgtgagaataggaattggagtccaagcttgcagccaaacaagcatcattgccaaaggagccattaccagatgatgtaggggccgtcactgttgtagttcgcatgcctgatggtcgtcgtcagggaaggcgctttatgaaatccgacaaccttcaggtaacattcttttagttgccagaatacctaatgaaactcactggtattccctcaataaatttttggaattcttgcaggtcctttttgatttcatagatatctccaggactttcaaaccaggaacctataggctggtaactttgctaaccttttcatttttttcatggtgtttcaggaatgttctatacacagaaatcagtgtagtttaccattaacctgttgaaactggatttgcactagcacaagctggttatttacgccagcacaaaaagaaaaaaaaaacgatgattctgcctgcttttatgtcattatgtgtcagtttattttgctattagtgttatcaagtatcatgtaccattcctagaatagatcaatttctgaactatgtgattttaaaagatttaacatcaatactggaggttgtctgatagtcagcgtactcatcccgttgagctaggtcaggataatatgcctgtggcatggtagactgtaaagagattacattgaaaccgcagcaccagctattttttagcactcacacaacatttagtgggcatgctttttattttcattcctctgtttaggtccctaagatttaggatcttgtttgaatatcgtatacacaatgcattctagcttgttggttttgccatgttgtgatatttggattataaaaaaaaactagttacttaagtagcctgtaaacaggggaaaattaatgcatgggagatttcatgttgtttctgttttatagcatttttagatgttgctgattgaatcttgtggtcctgaatattaaatataaatgaaaatctacaatgtgcaggtgaggtcttatcccaggcgtgcattcaccgactctgagtctcagatgtctttaagtgatcttggcctcaatagcaagcaggaagccttgtttctagagcagatttcaggatagggggaaaccgggaaagagttaattgcaattaacacaacagggattcacagaatttttttttctttttacttatgcctggcacatgttcgtgaaaatattagcaaggttcgcatgaaacttggcgttaaggtctcatgaccctcttttgtgttttggaatggtgactctcaagtaccgggtttcatgtgatactcaccctgcatatttgaacagtcagaactcagaatgtacatagactgctgctttcagagctaccgcaattcatcaattcattaatctatgttcgcttgttcaagatagtatctgcactgttggactgtttataatggcatgaatccaattaaccctagtaaggtactagcatgtatgggtggcctcttggcccttttgtccctgaacataacttacctgctccattgattcgagatgtagccagccagagggtaggttggatttatgttcgagagtgcatcgctggtgctgttccacggaagtcgattcttccaggaacgcaatattgttggcttggatcgtttaacataagctgagaaaggaaaacacacaaggaaaacaaagaggggcacgatagccaaaggaggtcatcgttaatgaaccagcaaccgggcattacatgattgttccatagtacttactggtattattcatcgacatcaatagcaactgcagtacaatctgaagattttactaaacgagacacgaagacaacgacggcttcgtcaacaccttgattattcttcttccatggcgtccggggttaactctcgtctcgtcttaggcagctgcacacagcaaaagaaacaatgatgattagaggcaatcatcatgagaaagaagccgattagttttaagagggggttacatacagcagttgatctggctgaggtggcatctggaaggcaggctgttcatgatgctgatggcgctgcaggcgcagccctgggagatggagctgagcgcgctgcagcactcggcgctggggtcaccggcgccgggcaccgcgtacgcgcggcacgccagcagcctgttcagctgcggcacgcactcccccccgccgccgccctgcgcctccgcgcccacggccagcagcaccagcacgagcgcgcacgccgccgccgccgcgttccccttgctcgccgccatatctcccctgctcctgtgcttcttcagacgatgctgcaaatattaccttacctttgctgctgctgctttgctgtgcttgccggtgacggtgaggagcggcgggttttatagggggtggccggagcttgggggcgcccggcgagctttgcatggctcacctatgccggtgatcgatggagaagccgagcacggcagtttgtgcgcgtggtaccgaacatgcgtcacgctcttggactgtgagcctcttccccgccgtgcgtctcggccggggtcggagaggaagagggagcgcctgctgctttggtgaagaaacggcccatcaacccttcgggccccgtgtgaactaacacgacccaatctcgaaattaatgggccatattatatgggccacgtggagcaggtaatgcccaagtagttctttgcaggcctatgttagcttttttttttgggccttcccagctgccgagtcgagtatattttgcggattaagtccactttggctctctgaaaaaatgattcaagaacctaaaccacaaagccggatatctcgacccccgaactattgaaatcggtatgatttgactcccttagcggtttcgctaatgtggcggtgttgacctaatctgtggggttgacgtgacgcttaagtggcatttgaattaaaaacatatatgtgggacccgtttggccccgcatatcatcctctctctttcttcttcatcccttctctctctttctctctctctctctctctctctctcccggagtggtaccgaccagcgggagctaaagcggcggcggcggcagcgaaggaggagaaggaggcggtcccacgttgtccgctcaggtctccccccagcaccctcaggccgcgccgacacccatctcttggcccgccaaagccatcaaccaccgtccccctactcgatctcgttggcgtcggctctagctcgtcgtcgctgccgctttagctcccgccggctaccaccactccggccctcgcccgccgccgctccagcctgtgctccccgtcgcctgccgaaggggagagaaagagaaagaaagagagaagggaggaagaggggaggaagaagaaagagagagaggatgacacgtggggctcacctcacaaatttttttgtgtgtgaatgtcaaacaggtcccacatatatgtttctaattcaaatgccacctaagtgtcacatcaatcccacagactaggtcaacaccgccatgttagcacaatgtcagcgaaaacgccctccaaaaccgctaagggagacaaattgcatcgatttcaatagttcgggggttgagatatccggttttgcggtttagagtcatggattagattctggtcacttttcaaggagtcaaagtggacttattccatattttgctggacttattccacacacgctgacgctgtgtagtagtgtagtaccgtacagatctgaacacaatactgtatttctgatcaatgtacaaaatacagtgtgcgttcagttgacagaacaagtggctgttgctcgcattgtgccatgcatcaatttgtttttctaagcaagctagcacacacgcatctctgcagaagaatcccacgacctttggcatcttctctgcatcgtccactgaccagcggtctgaattccggctcggctcatcctttcccggaaagaaattctccatgtgcggtggccactggatctgtatcatgcaacacgagggactaattaatttgatataagcttaattggaactaaagtatcagctggaatcaggacgtcaacttgattagatagccaggtattatcaccttattatttctgtccattaggcatgaaccaggaacatcactctgatctcccatttcagtactgaaaaccttcaccaaagcagaccaggccgttcagattgtatttatatatgctcttcgagtgcgattctgaattagattatatcaaaggagctaggtacacaactacacagagtatctcgtaaagcagatcaatgagcaaatcagtgatcactgaataattgcagggcttttttcttctcctttatggtccacatattcttgttcgccatggtccactttagatcataaatatgtgcatgtaaccattacaaaataaacgctaatccagtgtcttttttgtgataaagaacgggccagtcggcaaagatatgaactttattcggatgccattacattggtcatgaacagtgtaacgatctaaaatctttttcctatgatatcctacatgctagcgatgcaactcatagtgactatgagcatacataattgagtgggcaggcacctaggagtatctgtatatatcaataatatcatcgtctaacagttcatttgtcactcttttgtcagctgatcgttcaacttcatgtagctatataggagttgatgttgcaacttaattattaacccctgaaatcttaaccagtactggccaaagtaatctagatgatctggcagcgcataccgtgtggagttaaattggtaggtgcctttgatgctttcacgatttcacctatcgaaatctcaaacgaaaacgatctttttggtgcggtttttctcctggttcttttgtgtactttataccataaccaccagagatacacaccaaagcgatgaacagtgaaaggaacagcaacatccttcagacttgagagttcagtcttccagatcagcaagcgaactgaatttaatcaaatgtactagtactgttttctggcggagctacaactgtatgatccaatgatcagcttgttggtcgtctcaagcatcatatcccaaacaaaaaaagaaaaagaaaaaagaatcagtaaagtacacctctcgcttgattgattgcaatggtggaccaaaaattacagtttgatcgatgtgaagcgtgttgcatcagtaactttttagtttttactacgtactctccttttcatcgaaagagcgagatcgagaaaggatgcagtgtttgcaaattgcaattgacgacgagaaatcaatcgaaaacgaaataattggcagtacggcagtaggtctgactcacgcgtccacgaaaattaagcgacgccaatattcttcaagctccgtttcgtcttcgtcttcgtctacctctgtcatgtgcctgtatcgtacacgctcgtgcgcggatcgagtacacgcgcgagcgatcgagccgtaccgttgtgcgtacgtacgctctcgcgcgaccggtcgccggcggccggcgaccggtggccggctggtggttgccgcgtcggcggcgagggtggggcccccatcgatcggtctcgttcacctcgcgtagtaggttacggcgtccctttccgatcacgtacgcgcgatcctctcgcgaagcaaagaacatcatccttgtgatggaggacgtgggtgcgcgccgacgtggacgcgtcgccgtgctccacgtgtgccccggctgtcggtggcctcccttgcccgaggaagaagatagtgcagctctcgctgacagatggcccccacctgtcataggcaagcgtgcagcatccgactgtacggatcacccgc

SEQ ID NO: 77559 - DNA, 6851 bp, Oryza sativa
caccaccaccaccaccaccaccaccgcttcttccttcttcccgcggatggcagtggcgcaacgtgcttttgccttggaaatgacatgcgctacagtcccgcatagaatatggattgcttttctcgggaaatgcaggcgatatggagactgcagtggagtaggagtactgaactgcagtgcacaggtgcaagtgagcgcccaagaaagcccaagtggattggcattggaggatggcttgttgttctgccagcctgcctaattagaatacggatttcagaactccttttttttactagtccagggaggcagggacaaccggacaactatgcggcattcgtttgagatttcttaccaaggtcaacgattcatcctgtaatttttcgttgtcgtgttgctataatgttatccataactaatactcaaactgacagctttaattagttctagcaaaaattaatattcaaactgacagctttaattagttcaagcaaaaactaatatttttagcggagctgaggagccctagtttgctctatcagccgtaaaaaataaacgaagcaaccagaaataattaaaaattgctatatgtaccacggtacgattttggtacgaccctcgtgcattattatccattggccatggaaacatgttgggccatatatttaaacatcgatcgcatgtcgattgttagagattttatcatatgtattgcagtgctcaaaatagtttatgttgaaacttttatactatttgagttcttaatgaaaccaatacttaaaattaaacttcgaccaaaaaaattcctcaaaattaattaaatttaaattttaactccacccgataagctaacaaacaaacgatacgtttgtagatgtaaacagagctagtaccagtatataaacttatgaataaaaataataataacagggagcgagtggtagcaagctctcattttctactcgatggtttattatagctttaacccaaaattaaaattaaaattttatcagggttatgaataacacatacataatagtagtcaattaagctcggcaggacccatcatatatcaagtcttatatgaaatcatatatcgtatataaaaggagttccggataagaaagaacaagaagagttctatatagaaactagattactcgaattgtatccatattggtctccttagttttacttggacaggggatatctatgggtataaatacaaggctccctagaaagagaggagacacggaacaatcagaatagacaacaatacacgtccccaaacatcgatataagagataagtctagacatacccaatctagtgcctacgaaggctgacaaaagggatctagtgctatctctgatcttgccgagtacgtattcgagaaggaagctagactacctcatcgtcgactacgtgttggttttccatgctgccaagtcgacaacgactagataggttattccaaatattgtacttgtgtgattctgatgaataagtcgacgacgactatataggttacttgtgtgattctgatgaataagagaaataccggcttcggccaatatgagtaggactattaactgattctaatgaataatgggcccgaacttatataaaaatccttgtctctgtctcttttatctcaatctcacatataccatggtaccaacgatccacataccatacaaataccgtagtcgtgatctaaagcattgacaaattttcaatttgatttcggggttctttttttttatcttagtctattttgccatctctgcttttaaaaccccagtaacataaaatatatataccaatttataaattagcatccatatgcataggtcaaaagatgagagccggccgtgttcatgtaaaaatcaggtggagtttacgttagcaataccatccggcatccaccgccttctacccagcatctgcgtgtttatgtttagatccatttgaaatggcaaatagtaaatgataaaaaatggcaaatagcaaatgataaaaaatggcaaatagcaaatgataaaagttttagtggtaaaagttttggcattgcaaaagtactagttggtgtttatgtttagatgtattctaaacttttgccattctagcactttttggtggagagagagagagagtagtcctaaaacacttttttgcataatttgctattataaactagcaaatggcaaattgccaacttttactactagtgtttagattcaaaatgataaaaggtgctctaaaatagcaaaacttttgctattttggaggatctaaacagggccgtagtgtgcttccgtaattccttatctgccgcatgatcgtgtacattatccctgcaaattttttttcgttgcaagacttctccgatatattagggttgtcaaaacttgacgcatacaataagctacttagtgcatgtacaatggtgtctaacaatgggctatcttcgttgccatgcaagtaaatttgatgatgtggaagaaagagagggaaggaaagacaaacatcgttgctatgcataacaatggctcagagtcgactcttagtatttattaatgggaagtttgttgcatgatggtggagaaaaaggaaagaagtataataaaaaaaatatttagtgcattaatgattaagagatcttactgattctactattgtatgaggatggtctctagtgacataaattaatatagaaaactcatatcagactctacctttatacatgcccttatagcatttcacagaaagccagatcatttttcgttggctggccaggttacgatcacacgaccactccgcagaattggcaacaagaaaccgggcccgcccgcggggatccaatttcccgcttctcgacggaaagcccaaccgaacacgcggcgctcccgtacacggggcaagggcaacgaagcaaaagcccacacctgcgcagtgtgtaccgtcgaacgcggcccatgcggcaacgggccgagctttttcgccgggccaacggggccgagctaacacggcgtacgtacaacagtgaagcaaacgagctcgccgtgctgcccagcccagtaataaacgacggatgaaaaaggctttcttgatagatgattctggaggcagctccgcagcagtaggcttggcaaggggagcaaggcagcaacggcttatgcgtcatggactcatggatgggttggcaaggtcgatcggtttcgatggcgcgcagcagatcgatcaaaggtagagcccgactgggatatggattggattccggttggatgagtttggataatgtaatttgatttggtaattatgttttctttaacgactcgcaatagacagtgtgaagtttatattgatagagtaggaaaaaaaatacaagattataaccctaggatgtcataactagggaaaaaagaaaaaaatgaccatcacccacgcaccgacagcaccaatacacatatctgggagaaggatagcaccgaatcggccatcgctaagcgtgactggccgccactaggccaacaaaggagttacaaccaggatcgcctaatgaccaccataacaaacgatgcaaaattacactctatccacgtcttcgggattgaggaagagggggtgagagagaagaatagaaccgctctcccctttaggtcctctgacatggccaacttgcataagtgttgacggtcattatagaccattttcgaccatcaacataactaaaatggaggagaactagctatgctggcaatgcatatctattttagaataatatattttcacttgtacttggagtatggagtattatttgtttgcatagattagcacataaatgaagaaaaaatgaagaaaaactcactcctaagcaagctcaaggaaagaggggacccacatgtcaggtgtaaccgtcctgaaacccacatgtcaggcccacctgtcaacatctctgccaaaattggaggcctgctgggtcagcccaggttcagccgaaccctggcagtggccgttcagctcgggcttacacgtggacgtataggattgcttgctaatggcggttgcggagcatttccgacatttcacatgctctacaaccgtcatacctacctatttaaggagttcttcatttcacttcactcgcacactcaagcaagaagctttgatctctctctcaagtttagtttagtgctctagtgctaagtggagtagaatataacagttctcggagtccttgagtcttcggaaggtttcgagtatggctctagtagtttttcttttttcttttgtaagactttcggaattaatagaatattattctttatatactttctatcgacgagtgatactcatagaccggatgatttgggttttggggtacgttggaacgaggatctacgtaatacgacatcaagcaaacagaagataaggattatactggttcaggcccttatcaggtaatagccctagtccagtttatatgaaattgatgacggaaaaccacatattgcaatagtagacgaaactggcgatactgtcgagatcgtagtcgaggtactctacgagatctcccagcgacttggttccgagtactccagcttcataaactatagtgggtgtgttggcgatgagattcaataccttgcacccctccctaggggtcccttttataccgtggatcatcttaattcccaagtaagactcggagacatcagatcttgtacgatataacagaaactctatcccttccgagtaagactttggaatttacttaacttgtagagatattttccataatttgtaacggattccaatgggaacaatctgcatacgtgaaggtatgccatatccgcatattccataagtcgtaggataggatgtatgccttatccgtaaccctgacactttcagtactttactttgcctgagtactggctttaatttatatttgtgccgatatagttgtatgactagcctaccagagaggtgtagtggtgtgggtttaatgttcatgcgaatgattgctccatattattctcgagtgtatagagtagtatttgataatcaaagcatggtgcttagattattagatatcattaattgggcatatatactatgggacagtagaggcgggtcgctgatggtgacagctcagtacgtgtattcttctacgttagtatatattcctaaggcactttcctaggaggatactcctccctatttagctccgattggatggccatgacaggttgtcgtaagaaactcgacaacccagggtactgctagggggtattggttacataactatatactagcaaatgtaaactaaagttgagtgtatattagaaatataaagatgattacctttctatctcttcttccacatagtctagaattatttaaacgagagaatctaagtccttctactttgtgtcactctacctttatgaactgaattaacccctacgcagactttgatacatacaagtaaggtatataacttattagcatatttctctgttataaatcttcccttgggattaaataaatacgataccttggaatatttctgggtgaaatgctacaatagtatatccgtgcgcttgcgaattgcttctgtaaccataaatatatcagggctattccgtgctgggaatttatatttctagtaatgtctttaagaaataccaacaataagctagggcgccgatataagaggtccgaaatctaaagacaacttttggaccggaagtctggaaggaaatcagtagggggttgccaagacgacgtctctagggagaggagtgacgaaacactgcgccgctgtccgtcaagggctcaaagtacacagagactgggttttcactcgacagcaccactagaggagatggaacggcacaacaacaccctcaaaagggaaaacgactagggatggcaatttcccccgcggggccgggtcccctgcggggacccgcccctacgggggcgggggcggggccgattttcaacccgtgggtgcgtcggggacggggacccgcatttaggcggggaggggacggggaactgatttcacccgcgggtgacccgcgggtgacccgcggggccccgggggtacatatagacctcaaaatatagatcaaagaaagcccaaaaagcccagcccactaaaaaaatccttaaccctagcagcacatccctcaatctctctcctccccacatccattcccttcccctcccgtgcggctgtggcgtgacctaggcggcggcgcgcgctcgtgggcggctcgcctttggatctcgccctctcggcgtcgccggcgcctgccagccgccaggccaccatctcctctcccctcctctccagtctcccctccggcgtccggcggctctagctcctcctctccctccggagtccgcggcggcggcacacagggcggcgccgcggcgggccggcggcggcgcacaggcgcggcggggaggcaacaccggcagcaagggcacggccggcggcacacagggctagggcggcggcacacagggcggcggcggcggcacatagggcggcaagaacacataatgatggatatcattaatatgtgttcttgctgaatttttatgatgaaattgaagtattcatgctatttttgatggtgtgtttattatgtacaatatttctttttgctgaaatgatgattgtgttgtattttttgagctgattggatggagatgctacccaatgcggggccccggtcgggttgcggggccccgcaggggtcgggggcgggggatgttttcaacccgcatcactggtcggggccgggggcggggggtgaagtcgggggtcggggt

SEQ ID NO: 77560 - DNA, 12097 bp, Oryza sativa
tcgattcattcctgtctccaattgaaggtcacaattgcagctggcagctagctcaaatttccattttttgtttggttgtctctcggcagcaaagcagatatagagcagaggaaagctaagctaaattagttagttagattactagtctctggcagctgggtgatcttaatttgatcaaagaagaagaagaagaagcaagtttttttagctcctgagtatattataggattaactactactaggatagtactcctatatgagaagaagatgatgcgcgggaaggatcagaaatttccggcgatgaagaaggagacggcggcggtggcgaaggaggaggtgtgggaggtgcggcccggcggcatgctggtgcagaagcggagcccggagtcggagccaccgccgggcggcgcgccggtgccgacgatccgggtgaaggtgaagtacaacggggtgtaccacgagatctacatcaactcgcaggcgtccttcggcgagctgaagaagctcctgtcggagaagacggggctccaccccgacgaccagaaggtggtgtacagggacaaggagagggactccaaggcgttcctcgacatcgccggcgtcaaggaccgctccaagatgctcctcctcgaggaccccaccgcccaggccaagcgcctcctcgaggagcgccgccattgcaaggctgagcgcgccgccaagtccgtctcccgcgtcgccctcgacgtcgacaagctcgcctccaaggtagctaccccgctgctttgctttgcttgtcttctccgactccggcgtcgttgagctgtttggtggtgtacgtgcaggtgtcggcgctggaggcgatcgtgagcaagggcgggagggtggttgacgccgacgtggtggcgctcaccgaggcgctgatgaatgagctggtcaagctcgactccatcgccgccgacggcgaggtcaaggagcagcgccgagtgcaggagaagcgggtgcagaagtacgtcgaggccccgacgccatccgtgccaagaccaagaaagcggcggcggcgccgcccaaggcccggccgccgcacctgccgccgcgccgccgccggcgcagcagcagcagcgccggcagttccagccgccggcgcccgccacggcgaccgcgccggcgccacagaccgcgacggccagctgggagtcgttcgacctgctctcatccgtgccgtccacgtagtcggccccggtgaccaccatggcgccggcgaccaccaccaccacctcgccgtcgccgaggttcgagtgggagctcttctagacgatgtggggcccacactggccgcatgtgtgtacacgttcattggccggtcggtacctatgcctttcttgcatgttcatctttggtcactcatggtgcatgtcaattgtcattcttcctttcctctctctccccaattctttctttctttctttctttcttttttgaattctgagtgtatattgatctctacaaaaaaaggggctaaaatgtcaagtgagtgagtgagtgtgatcctcatgaagaagacaacatcaaaaccatgagacactctgatgatccatggtctgcaaaaaataagtggtggcctttgagatgatgatcaaaaaggaaatttttcatgacaatatatatgtacagtactgtatactactactagtgtacatcaatggtctcagcatatgttgcctgtctcattcatcttcttctacactgtatgtatgtattatcatcacttcctacattgtacaaacaatgctgctactactacatttctggtactcatattcagtagaattcagctgtctggaaatgcaagtgcagcatatgcatcacagctctgaatttcagattgattggctgaataattgtggggactgatgggcaattattaggcatctgccagtgcagggtagttagcaatttggatgcattcgatcggcggcataaaactatgtgctctctcctccatgctttggaccggccggattttatgtacatgccatggatcaaaagcctccatttttctgcacttgtttagaagctctgtttggtcagcatgacaggtagcagtagtagtagtagtagtagttgttgttgttgttgttgttcagagttcagaatttgtgtgcaaggagacaggggaagctaataatactgggcttgtggggtttgtataaagtttgatacatactttcattcatgtgatggccagatcagcctatcaattgtgagttgagtggtgcagcaacaacaacacttctgctatactatagtgtactctattacaagtagatatgatcctctgtcccattttttcagctggcactaatgacatgatcactgcacaacttaatttgttctgttccatgctagccattctaccagctcttctcttcccttcacctgaatacacaagccaaaatgagagctcaacatttgcatcacgagctcttttcggacaatctacttgggttggtgtgcacacaattgtagtagtacctgttgtgcagagggcagtaattggtgttgtcctcaagttgcagactttgcagagatgcctttcttcagagaagcacagaaagaaaggcaggctgagttggaagcttcatgcccagctattagaaatagggagtctaggagatcacagtagtagtagtagcagcagtagctcatttggtagtaggataaaaattaattactcaattaaagagaaagaagctgcttgtagtagtaacctaggagcagcatcataatcgtattggcttcacgttgtacttttgccgtcaattcgttgcagatgcgtagtcgctatctgcccgtaacttgacaccaatggctggctcgacagagacaacccagcttataattaatcaacatcacagaagaaaaagatcattagcgtccgtcagttagtcctcaagtacgtacgcctccctgttcctttgcttgcacattttcgtgcagatcagaatcagttcagagcaaccaaactttcgtcctcaacacacacacctgcagcctgcaagcttgcgtttttctgaattttttcagtcggtggcgtctcaacagctcggtaggtgcgtgagagagtgaggaggaaacgtcgcatttgacttgtgaagctggtcattccttttggcttttagatctgcgtgtactgcttgggcttgatgctttacctgccgctgatgtttgaagtttctgctaattaatcaggctttgctcatcacagagaaaacacttaaaacacccacttgctgaagctggtcaatggtgattagctatactatttgccattgcagcatgtgatgctcgccccgttgatgtagtatatatgaatactcgagtcaagttttggagcaaatgagaatggtgatctgcattgtcaacggttggctcttcctgtaattatattcactgttcagagctaacacatgctcggccatcttctgccatgtctttcttttgcatttctgacagatcttctgccatcagccatctctagtagtagtagtagtagtagtagttgctcagtcgttagatccattgcaagccaagatttgtagcatgttccatgttgtacattgctgacagaggattcaacacacgattttgactgtgcacattttatatggaaacaacgctcagtcaatcgacaactttcgtgaccattttcacccagcctgccatccacgatccagattagtaaggcagaaatgggctagaatgtaatggtgcttgtgttagagccacacgttgcagctgctctccacacggtacagtggatgagtggaatacagtgtgttgccgtcagcgatcgagtgctttgtggagttcgtgtgtggacagacttcagcaattgtgtagtagcagctggtggcaggctggaccattctgtttgggccggtcaagctgttgctgtactttagatgggccttgcaccatgaaacgaggtgtcaaattttggcacattcaggcccatgaaaaccatcccgggctataaacactagcataaacagtactggactcacagcccaaacagaggaactgtttcagcccacaaagtcaaacagtactggactcagcccaaacagaggaactgtttcagcccaaaaagtcaccagtagccctgttagtgttagcccacgcatgaagtcatcgtcggcccattatcttgggccgtgtcagcccatgaagtcatcgttggcccattttctggagattggaatttccagtcctttttgccctgttctttttcagcccattcactaaattattaaaataaattatttgcctcacgtttcaacaaatacgtttattttttccaaaaagttttcttgcactgtcttgcgtagatcacttgttttaaactatttgttatgtttatttcttaaaatattttattttgctctatagttaagtagaatagtagatactccctccatctatttttaatagttatattttcaaatctgaaaaatttatttttatagacatatttcaatctaacaacctatcatcttaatgacttactcagatttaatgcgtaaatatccattcttccacacaagattggctacatgggcatcgagaaatgtaaatattaatgaatcgcttgtttacgaggaatgactagtagcatgtttaaatagatgataagtagaattacttatctttggtctgtgtgccaagatgaaatatgactatcaaaagtagatggagagagtaattcacaaacacaatgcttttttaaaaaaaataagatattttttttgaaaagatgacaaccacaatgctttcaataatctagggcctcgcaccaaacttccctcaaactcccaactttccatcacaacacgttacatctaaaactttcctactcacataaactcctaactttttttctaaactaccaactttccctaaacttctccccaatttcagaaactaaacacaacctagattaaacgagacagttactttcagtgattcacctagcagcttccaggtgtgtatgcactatgcacacaagcagttgcactgcaggttcaagtgccccatttgtgcagcactcttggtgaaacagtatcagcttaagcatgcacacaaacatgcagtacagtgtatcactggtgatggatctgtggatatggtggcatcaggtggaccagtactacacattgttggtatgtacccctccatttttatatcataagtcgtttaacttttttgttaattaaatttttttgagtttgactaagtttataaaagaaaattctaatatttttcatataaaacaaacagattatcgaaatatatttaatgttagatttaataaaactaattcaatattgtagatgttgctaacctttttttataaacttgatcaaacttaaagaactttaactaagaaaaaaaaatcaaatgacttttaataggaaacggagggagtacctcccaactgtagccatgcatcatctctgcacattttctcttcttgagcccaagaactgaacaaacaaacatgcagactagatagctcctagcattgcctgcatcatcatcattcgtgtactgatcaatcttgttacgaatcatgctgcaacagaggcgacacccaacaaaccagagccatgcctcagatctggtcgattcattcattccgatatcgatcgatgcgtccaaacctgatcgagcttgcctgcaggatcgcccctgttgcatcatgcaccatacatgatgcatgcaattgcaattgcagctgcaaattaatttgcaattgcattcatcagctagcttagcgaggctgcatatgcagtgaaatgtgcatggatggatggaagcaagcattctgttcagtctgatcaggagacccagcaagcatgtgcctccagaaaagcagcttctctaactaaccaggccctgttcatccatcagactttcagtggccagcttgttattatgggcctctctgattatctctttttcttgccctcgatctctaccgactgcctgcctcatcctctgctgtgtatgtgacgttagctcctcgatctcatcaggcaaagatttattacatcgccatgcactgaacatgggagactagcctacatttgctaacaacttgtggcgccgatttggaaaagataaacgggcgaaaaatttggcaatttgcactctaggatttggatgtcacaagaagaggttaggcaagagcaccaagcagtcaggaacttagataattaattattgtcccaagaagtaagctaagctaattctattgccaactagcaagttaattggtctgtttgatttagattattaagtgaattactaattctcatagattatatattcacttaattagaaacaaaaaaaatattttaagtaataattttaatgaatagattaaaataagtggtctaaaaaatatagtaaaataaactctctctttttttttaagataacgcatcttggaaacatgggacaaataatctatttcgataataatctgaaaagagcgcatgaaccggatgacgcatattaaagttcatcatatccactctctgaaatgatcgatctgcttgctaagatggaaatatccagagagtgatatatgatccaaagcagagactatttcccggcttttttggcacagtgaaattttgctggtccgtcacctcatcggtcaatcggcgagagagcatgcatgcagcaatcatttcttgcgtcctggactttgattattgatgctaactgctgcatgctctcgatccagctcccaactttctcaaacgaggtgggctactaggtacaggccagatcgatcggaattatattcattcatgcagcaaatataaagctagaaaaaaaagatcatctcctagctactagataaagtgagaaaaagacctgtagttttggactgatcactgaacaatataggtagctaggggagttacatttcacttggaaaactctgattgatcgatcatattcatgtagataattagatattcttgcgtgacgcaagaatataccggattagacgcacctaaccgaacaattacccaaacagtgcagggatccataaccaaaacaaaaatgcgatgacaaaatggctaattaacccgcccagaggattgcacatctatccatcacatcgcttgtgcatgactcggcacaaacatgcacatatcagcagtggtagctagcttatcaagagacctctaattaatcatgctctttgtgccatgaaccggggaaaattagtaatccaagaatgccgattctagaggcagcacacgtacatagatcagatttgtcaggcaaagaagatcaagaaggagcaagcaatcaatcataaatgggcaggcatgcacctgtgcgtgtaactgaatattcagctagcgtttgcatcattcagatgtggtagtagcagatagtagctactccagtagcatacatcgttcgtcaggatgatggtcagatacatgcatggttaccgactgaattcaattggaccacagcatcgatctcctagtgtttctcctcccccgcaaggagtcaaattcatccccaaggatgacgcacgcgcaagtgcagcccagccagctactatccctatcttgtactgtctcactttctagtgggcagctgcatctaacgaggacactggacacacataaggtgtgtttaaatgcgagtggatgatggacattggcttcatcttttcgtttatacttatgcttatcagctaaaattttaatttttaatcttaaatttaaagctgattttgatgttttctttatcgaagtttatttttcagtctttgcttttagatcgctaagaacacatatataaaagttttattcacaaattactttttgtttgcaaatatgccgtttggtttattccacgaaccaatgaattaactactagaaataacataatccgccatccgttagctaaaaataacataaccttaatataagggtccgtatatgtcagcgcataggctataccaaaaaaaagagatgttggatgtttatgatgtcatgacatatacgatcttatagaaattgaaaaggatgattttaccatccttgagaaagtattaggaggtattatattttttagtgtaaaatttggtaccaaaaattttagtataaaatttaggtaacttgagatactctctaaaggatcataaaattactcaattaaaaatgtttgaaccaaaagagcttactccctctgttgtcaaccggtgggagtaactgaaagattcttacaatgagaattgttttttagtttttgagaaggtgccaagagatttttacattttatagtataaaacttgttatattcaatatttgatatactagtggtactaatttttaccataaaaaagtggcctcgtggtaccactcaaggaccgcaaaatcactcataaaatattcaaggccagtcccttttttttaaaaaaaaatagatactcaaggctaattgtgtaattcaaagggcttcataggaaaaggtcccacaaagtttcaataatgaaaaacaaattcttctcagtaagtactgttgctaatattcgaccttgacatacataggtcaggctgtcaaaactaaattatcatggccttcatggtttcaggcctaactactagggagctgtacagtagcatggaaaactttcagtcaggccggccaaactgttagaggcctgtcactgtggtaaactatgaaactgatgttactgttgtctgttgaagttggacaatggacatacctacctgtgctgtatcatcaacattatagataggctgattttgtttcctttccatgatttgtatagtactagtagtgtacaataataccaccaatgtgacaaattcagttggattagacgtatgagcgagcctagcgaatatgtagacagtgctcacctacagtgtcctagctcgtcctaacaacctgcaaattgggctacaattgggtgccaccacacgatggataagaggaggtagatctatcggggaaaagcctgcctttcctctatctagatcgaccgatggataacaagatactattattcagtaaaaacactccaattttcagttctgacagttgtgtacttccacgttcagaagaacaagtcaggacagcactgtaaatatgacagctagtgttcactgaatgccaactcggtggtatagcaattcagaggtcagaacaggaaagctagtgtagtggactctgaagattggcatgatggagaaaagaaagttcagacttctcccatttcctgggagcatatagctagcatatgcgtgtctcattcccattgcatctctgtatcgtcttttgcaccgaatgcacagcgcgatccaggcaacgatcgatcaaggttgtcaatgaaaagaggaggataagaaaagctgtgcaaccaccgggccactccatgtgtgcatcgatcccaaaccaaagtggaggaacaacttacacacatcatttgccttacagcatgtcacacttactagtgacagagactgaaagttttcttattatctactttgcatctaaattttgttgagagttatatataaaatttgttttaagtactaaggacataactcgatttcattttgttagtagctccaagaatcaaaattagtagttactagaaaattatatgtagaatgcatcctggaatatcttaccaaaaaactgcatgcaccatagtacttgtgtactccaagatccttatgtacggaattttgcagctacttctacttaactgtcattcatgtcattttcagtcatctggagcagtatagtgtcaatgcctgcttgagaggaatcttgggggtcaggtaacttcacatggagacctcatcaccgagcctaattggccttctccagaatagaagatgcaaaaagaccagcataggattcactgcaaatcatttcgcacgtttccaaatagctcttacagattaaattacgagatgttcaatcagtctgcaataacacccagttgtttctgccatttcatgacaagaacattaccgtatgttcggtgtgcattgctatcatggagtccgatagttccaagccacaaaatttcagaatccagggcacttggattagtatggttgagagcgccatgaaaggaaagaattacaaactgttgcttcttatgtactttaggaaaagcagagagcatcgtaatggttgtgtgttcgtttcccgtcaccagtcacactgaaatgatgcaaaccccgcttgttggctgcctcttatctttttgtttgattccaattctactaatcatcatgtttcttgctccaaggtatctctatgctgactctgaaaaaaaaagggccatgcatgcatgatagtttcagtttctgaatgtgtttttccagatttttcacatactttggtctttgcttagctctgcctgcatggttcgttgactagcataaattggttcaggtgtctccaattacattgcacgagtcctcgtgtgtatatggatcagggtttggttcgaaatttcagtaatttcgcctcccccctcccactggcaagctcacatctcgcccgaaattttcccttttttgctttttttttgtaaatttggttaaattttattgaaactcatttaaaattagtcaaattttcaaataaaattagccaaaaacttccgaaattttgataattttggtccccaccggcaagaaaactaattccaaaatttcaaaccctgatatggatctggccgtctaattgtgcgctataagatttgaaactaaactttttgaaatttagtttcaggaagacactctcgatggtacaataatgtatcaggtcttttgcaccccaaattggaaaggataatgaggtactccttctgtcccaaaataactcaacctaggatgagatgtgatatgtgacccattcttatccagattcgttgttctaggatgggtcatatccccctaggttgagttattttgggacagacggagtatgatgcaaatatactcttctttcgatcatcaatagcagcataaagcacctgaagaaagtaggggggggcttcaaatgaaaacgttttagtattcagtattcattccgagggaacttacttcctttttctttactatacacggtacaaatacaaatgcttacaaacatacctcataagatggtgggctagctagcctggattcaaagtctcaccttttttatttatttgatattagatctttccctagtgttcgcatcttttttttaataaagtcacataggcagctcgctatcgacaaacacgtcgtatacaaccaaaagaataattacttgaaaatacgagttggaacctgtgtatacagattcagcttcgcacatcaatctaatttcacaatgaagatgcttatagagccataattaaaaatcttgaatcctaaaactaagaagagaagaaaaagaaaaagttggaagaaaaaaaaatagaaatgcctttttttctgtgggccccatgtgactttgatcatgtcagcagggcaggccggctggatcagttataaatagttccaagtccctcataacttcctctccatcagaaaagcatcactccataacatccttaaccatttgcacccaagaaacgccattgatgatagggtaagctgctgagctaagagtaagagctctcacattagctagctgtaccacacactacactagcagctggagcagcacacacatcacactacaatgtgccactgctcgtccaaggtcgtagccgtagcacaatgccaccagcctctgctcccgccaccggaggcatgccccgccctgcatgaccgccccaggtcggcgcgcggcggcggcggcgcgatcgccgaggtggcatccatcgtgcggctcgccatgccgatggttggagctgggctgctgatgtacatgcgctcgctggtatccatgctctttcttggccggcttggccgtctcccgctcgccggcggcccctgcgctcggcttcgccaacatcaccgggtactcggtgctg

SEQ ID NO: 77561 - DNA, 6055 bp, Oryza sativa
gtcgttcccaccgtcgatgatgcgtcacctcgcctcgacgcccgcgccaccgcttcacagttgcaccctaccgcctccacgtccacgctgcctcctctgcatccgcgtcaccgcctctgagggcagcctcccgtgccagggaggccgaaaccgaatctgccggcgtcgccacgccatcgtacgccacttctgcctcaggatgccacggtctgcaggcctccgcgcggcgcgtgtagcaccacagcgccgcgtccgcccacagctcaccggaggctcgttgacgctgcccccgcgcgcagcaccatgatgcagttgtcgcccacagctccactcgccagaggctcgtcgtcgcggccgtcctctcgcattggggaggccggatctaggcgggaaggggccagatctggcaggggcgctagatccagcattgccgcctcgccatcgccaccccagtccaccgtgacgccgacaccattgctcctcttcaacatcggcggccaggccgtcgcgccgtcactcctccttgcatccgcctgtcgccgctgcggctgtcgccggctcggagctggccgaggtcgttggcgccgaccctgtgcccatggaggagagagagaggccttgccgccgccgtccttgcaaccgtgtggttgccggcggcccgctcgggtagcggcgaggcggagggagggggtgggggtggtggcgccgcggcggcggtcgcctcccgtatcgcccctgcccctagagcgacacgggggaaagaaaaaatagaaaaaatgatttggtaattatggatagaatcctagtggaactagagttgtacacttataataagtaagatttttagtataaatagggagggatactatgtttttgagggtaagctatatttaagagattatagagttgatagctctttgtattatggaatgggggtgtatgtttagtagacggtccactgcaacatatgatggtccgatgtttttcgacctctcggtcatccgatccgttgttgcgtccttttgagtgtgaaaaacaaaatatgtgatatttctttcgtatacttcatgtttctagttaggcatataagagcccttttgaatcaaaggatttacgtaggaattttataggatttaaattctataggaaattttcctatttggccctttgattcaaaggattgaagctttccaaatcctatgaaattcctatggaatggcatattgcatgtagattttggaggaaatttatcaagagctccaacctcttgaaaaatttcctttgagtctatctctctcatccgattcctgcgtttttcctgcgctctaatcaaacgatcattcctatgtttttcatgtgttttgtaatcctctgttttacacttcaattcctgtagaatcctgtgttttttctatttctttgttttttctaccctgcgatttcaaggaggcctaagaggtcagggcggagcattttcctcgaggagaaaagagaaagagattaagatggaccatccatccagggggaatctcatcattcgacggccccggccggccatgccatccatcacacaccgttggcaacgctgggcagtagcagcctcccaaattggccaccgcacaggtcaatgacaatgataaagcctatactactacacagccatctgcatcacacacagtacacatcgcccaagctacaaccttctcccggatggatgcatactggacaagctatgctactacaactattctagacgactgctctagaaaataaaataacaaaaatactccggcctttggcttggcaagttgaccaccacatacaggtggctctggcccttggctcctccgaaagcctaatcttaaaattagattctggaagctaagcaagtcgattaggttaatccaacccggacaccttgctcctgccacatgacgattatattaatgcgtctcttggaaggcgcgtggcgctggtgcgatcccggtattactccctccgtctaacagcataaggattctgagttttgattacaacgtttgaccactcatcttatttaattttttttaaatattaaaaaatgaaaagttatgtttaaagtactgtaaataataaagtaaatcacaaataaaataaataataattttaaaaaaaaattaataaaacgagtggtcaaatattgcaagcaaaaatttaaaatctcttatattatagaacggagggagtattaaacctatcatcactactactctactcctcactagagcacaagcttagaacaaatgcttcagacagttacgagaatagccgtccgtcggatcagagatcaacggcggagattgccgttcgggtgtgaggtcacgatgactagccggtgatgtcgcgacgctgtgcgtgtgcgtggggaggtgtatagtttggtctcgaaaaggagaggcgaggaggacgccacgctccgcgcgagcatttgctgcgggagaggagataggctggcggtcgtcgcgtgtggcgcgcgcgcgcgtacgcagacgtttgcgtcgtttccttgcggatggaggcatcgtctgttgacgtactggttgatactacgacgctgtcaaaattcgtaaagtgagcggtgagcgctccaggttggaatcgtaaaaatatcttttgtgttccaaccgggattgacatatggaggcgtgaaggcatcaaggcaccatttcaaataaaagagtttgttctaattctcatgccaattggacagcgtgcataagagggaaattatgtgaggaacgtctagagatcttcctgctagctttataaggtggtgggctagacggtttagattcaaaacatcgtcctttctatttatttgatattatatcattctctaatattcgtgtttaagagggaagttatatgaaaacatttgagttttcactcttaggagggcaaggtttgaatgggtcagaaatgttcttttggtttaatttaccgtcttcttaattgtttttaggtaggagtacaacaacacgacaaacatatacggtttattcacaagtcttacaaatcgactgatttgatcggatactaagcagaacaacgtaaaaaatgaacgtggtttttcctttataaaaacaacttcaagtaaaatccctgcaaccacttaacgcatacggtgttcatggaatacgtcatgtaagactatggaccacatcagctcaccactcaaaacgagagtaacatgtacaccgagacgcgcacaatctgcagtgtgacagaggttaaccaccacaaacccctcaaccacattacagcagctcgcaggattccctgtccccgaccccatctcctccacgatacacacaatctccggcgaagaaaaatttctagaacactagctacaaaaacgttctaaaaacacaagcagcccacgcggactcctgtgtggactccacccacccacgcacgctgcatgccacgggcaggcgattagccgatacaattaacaacagcaaagaacaaaacaagaaaaaaaaaccgcggaataaagccgcgcgcaccaccaagacaaccaaccgagagaggaacccaactcccgcgattaaaatagcgattccgtcggaaccatccgctccgtggcccgcggggcccccgtgccgtgctccgctaagctaaaagccgcgccctttcgcttgcacccagcgccactactgctactgcgccagtattttttctatctattcgccgcgcgcgcgagagccagccaagccaaagccaaagcgaagaaagagcgcgtccgcgtcgtcgtcgtcgtccgcctgcctgcctgcctacccacgtcgcgctcgcgtgcgcgctgccgcttagtcgcgccaaaaaggcggggggaggggaggcgcgtgcctgcccccgatcgcatatcgcattctccactcgcttgcgtttgccgttgcgtttgcgttttgcgtagcaagggaagggagagagctcgtgcttttggattggccgcgatgagctgcgggggcgccgggcagagcgggtggctgctcgagtacgggctggtggaggaggagatccagggctccgacttcatctacatggtcgacgaccccgcggccgtctccaggtgcggtttcccccctcctgcttcctcttcctctctaacctacctctgctggtgtttgattcggatggattgccgtggattgcagcgtgctactgggcttcgacgttcccaggaaggaggacggcagcggcggccaggacaactctgcctccaagaaaaggtaggtgaaccctgataatttcctcttgttcttgctccgtccgtttcatattataagactttatagcattgcctatatttatatagatgttaataactctaaacatacaatgttagaaagtcttataatatgaaacggaggaagtaaacgtccgaacacttactccttccgttcaaaaaaaaaaaagataaacccatcgtggattcaaactcaggtttgtcttttttttttttgggagcggagacataattctgccaaagtctgatagtattgtgctatttctgctttgagttcgccggcaagttgtccggtttaattgagaggaaaagattgcagtaggtgaaaatagcctgtatgcatgactcactaaagttcctgattacatgtcctgttccccccatgtcgttgaatttaaaatatgatagaaagcatcatagagaatatctacagagtacagactacgtgcaagttcggtcgatgatagagaacaagtacatttacagaccttatttttattttttggatgattgggttgagggttttgttttgggttttcgtgttagctcgttgttcccctgattcaattaacttaagcagtccaagctgaaactttcaacaaaagaaatagaggctggctgttttgacaagcgtagtcgcccctgttttccccttgtgctgattcagtggtttacagcatcaagtcaagggtcggaattagctaggaaagttctactaaatcacggatgttaaacgcctaatgcattcacaattcacaaattctaggaccgtttctgcttagttgaaacccatgaccctaacttaccttttgttcttctaccggcagatctcgtccagaatcgagcgcaccgccgggcaccaaggcttgccgcgaaaagctccggcgagacaggctcaatgaaaggcatgtttcacactttcagttacatcacgttcaaaacaaagaaacttcaaagcatttgccactccaaatctgacgagcggctgaattatcttcaggttcaacgagctcagcgcgatcttggagcccggcaagccgccgagggccgacaaggtctccatcctgagcgacgccgcccgtctcctgagccagctgcgcgccgaggcccagaagctcaagagctcgaacgagtcgctccaggactccatcaagagcctcaaggtaagcagctgacacacacgttgctctcccaactgactcgattcacctgaagaaatgagagctgaggagttcactgtcactgcaggccgagaagtcggagctgcgtgacgagaagacgaggctcaaggccgagagggagaggctggagcaaatgctcaagggcgtcggcgccgccacaccggcggctccagcgccgttcgtcccgcaccacgccgcggcggtggcggccgcaccggcgtaccatccggcggcgttcgcgcaggccggcggcaagtacgtgccgtacgccaccagctacgcgccgccggccgcgttctggcagtggataccgccgacgtccctcgacacgtccaaggaccccgtgatgtggccgccggttgcatgatcagctgctgctgtcaccgaaaatgccgtagaaattgaccaaagagcacctgatgaaagcctcgggtgcagttatgtgattgtgttgtggataaatgatcaaggatcaagggatcaccagaagaaatttcctggtgatcattgctcgccggagcagtctatgtaacaacccaattgctaaagtaattaaggcaattattattacatcaagatggtg

SEQ ID NO: 77562 - DNA, 3424 bp, Oryza sativa
tagaagaaaagctgaatctgctagtagtaccaaatatatacatccacggtgatatgtcctagcatgaatgagaatgtggtatacaaagttctcagaactggctgcgttcgggaggaggcacgcaaaacaaagcatattttattgtataattaattaagtattaactattttttaaaaaaatagattaatatgtttttttaaaacaacttttatatagaatttttttataagtttaacagtttgaaaacagtgcgcgcgaaaaatgagatttgtgagttaggaaaacttggggaagaacacagcctgattttactttattacaacattggagcagcggaacctccaaaatattgctcagaactgaatttatttgtagtgtcacgtttgaaagcggaaccttctcagaactgaaagcggaaccccacaattagtgatgtgtatcagaacaaaaggggaagctcaagtagagcctcagctgaggaatctatgctaccaaatatatgcatccacggcgatatgtcgtagcatgattgaaaaagtggagatagcaattagtatatgtgcaatcacagatgttagtatcgctcattacaagcaacatagcgcgttggtacacaagttctcagaactgaatttacttattacatggagaagctgaacctccaaaatcttgctctcagaactgatgaatttatttttggtgtcacatttgaaagtgggacccccaaaatcaataatccatcggaatgccgcaataagatgcttgtacaagatgacaaaataaagtagtcaatccattcttaaaaggatattcacctactcctgaacaggctaaaaggagcatttgacctgcaaagtagtttcaggatgagtttatttatctccacttctctaatatataacatataaaaataagaaagagtcatatagcatatcatatgactgaaactgtttttattaaccaaactgcaagtatagcatatcatttgagtaggtaaacatggtaaatacactttctgtgaagaaggaaatcttgagaagatcacacattcaaagcaataagtgtattacttgcctcattgcaaaggaagactcttatgggtgtacacgacatccttgtcaccattcaccacttgcccacgccctcgcaagatcctgcatatcaaaattaatcataaaaatcaccaaggaaaacacgtcactttttaaccttctatacgatccaaaagcaacatataaatgtatatctaacataaacggggtgaattgccatacaaaaggcaagatgagatactgcaacagagacgattgattccataccatcgtgtagttaagagaccttcaacacccactggtccacgggcatggatacgccctgtgcttatgccaacctattcaagatattccaataagttcagcaattaagaaagaaaggtaaatggcatgtaaaatttgaagtacctcagcacccaatccaaaacgagccccatcagagaatctcgtacttgcattatgaaatacagcagcactgttcaaattgagaagtagaacagaacattagttaaacatccgttcatcataagttgacaggaaaataattgtgcatcaatagggaacaaataatgtaaccattaagtaataagggaattaatgtttaaacatacctatcaactctgcgtagaaaagtctctgctaccttatcatctgtagtgacgatacaatctgtatgagcactgaaacagatagaatatggaaatttgggttacattgaatctcattttttgtttaagaaaacaactagtactatgggataagggggagacaggagtcacaactattaggtaccttccataacgatgaatatggtcaattgctgattgaacatcatcaacaaactcaacagtgcaggccatagaactatactcatgatgaaatgaaacagcttttggaaatcccagagctttgtgcgcaataggtccaccataaatattaactcctgaaatatacagcattatctaagaagcagggagaaaatcatggccctgtatatacaagtaaaaaacaatccagtatccagaaacatactacatctgtgattatgtcatgttactttggttgcttttagcatcgaagtagtttctatatacatgcttgttaaccaatcacaatgtaaccaatcaaacttggttggaaattgttgccataagagaagggtcgcgtttgtattcatatattttcaagattttttgttgtttgtaatggtatttatcaccattaaatcacagtggttggtaatttaaagttgcaactgtttgtgatggtattgagcaaaattgcttcagaggggagccgtttctatagtataagagagtagaaaaacaaaccttctgtttttagtgctactaatatgtcgtcaaggcctggactcttcataagatccttatgaactagtaaggtctcctgcagaacatacatgtaaaataggctgttatctgaatataaaaaatggctacatgatgttcagaaaaattataaggtggaattatcaacatgctgaaaacagtagaagactatcaagatatgtagctaaattttcttacaaaggaaagaggaagttactactttgtaagaataagcattatgcaatcacaatataagtagttataaatcaatttaaacaattcaaaagtgcagttataactatcatctatcaataaaaatagtttgcatgagatagaagtggaggggctgtaataatctcaacagtactaaatgcatttttcagatgccagagaagaattgcaaccagagcatcatggttagaagagaatttgaaattgtccaaaatattcagtgaaagatactccaaaaagtaactgaaactgtaaaagcaatctatttgaatactatacacggtagcaaactggatagataccattgcattgcaggctgctgggtaatcaatttttgcatccattacaatatgttttgccatatccatgtcagctgatttgtcaatatatacgtggcatataccatctgcagtggggaaatatggaatgtcagaaatagcaaaaagaaaaaaaaactcaacatccaataaagccataagagtggtaagaacttaagttcaaacagaatttaccagcatgcccaagaacaggaatcttagttgacgccttgatttgagagacaagcttattacttcctcttggaatgacaagatcaatgacatcatcaagctgcacagtgtattacgggtttagccaaattggtagtatcaacgctttgaaaatatagaattgcatacacacctttagcaaatctgcgatctcatctctagttgtaacaaggccaataagtttttcaccaacattacgaggaatagcatcagttataacctagaaaagaataaatcgatgtt

SEQ ID NO: 77563 - DNA, 5753 bp, Oryza sativa
catattaacaaataataactccactagaaaataaaatcatccatataaatatatgatggcctaggctcacgagccaaatcgagcggctcgcgagccagctcaggcttggctcgtttcagaaacgagctgaaaatgaggcttgggcttggctcgtttggcattcaagccgagccgagctaagcgagctcgaaccaagcccgagctgagctcacgagcctaagcttttttttcacccctaccgccaatgcccaatgctacgtccttgaacgatagatagacgacgtcctgcatgagcgcttaggtacacatcaatcataatgccctatcacctaccgtctctgttgggggaactaattaaaattctaataactagctggttagtaaaccgcttatgagaatccagagaagctgaaaaatctagtttctgatgtagttcattttctaacatctatacctacatattctcagaatttggataagagggagctagatcttctagaagaagttgcaatagttagaagttctcctaaatagggctatagatgcgtactgagacaacttcatttcctaaatttagattcatccctctgtcttacaaaaaaaataaaggaaaaatgttgagttaattccccggactatcacgacagtacgaattacccccctgaaccacaaaaccagacattttaaacctcaaactatttatactgaacacattacacctggtccaatccggagcggttttggtcctatgtggtgtacatgtaatgccaacatggcaatgcaatcaagaaaaaaaaaacatggacccatatatggagtacctctctatctccctttttccccctccccccccggcctgtcagttgtcagcattggggggtgtggcggggagggtggtcggcggtcgggaggagaccacgggcgcaattggaagggcacggtaggcggcgggcaccgacaagttggtgttgaggggacgttgcgggcacattcaagagggcgggtggcgaacgatggccaggaaggaactgctggcgtggcaggcactagcgaggaggatgttggagacgatgggtagtggcgaggtgggctgaggtggcggctcatcgatcccaccagcaagagctcgagcttgcttagaggacgtcccccgaggcggaggtggcggcttggcgatacgctcgatggggaatgggtaggtgagctcgaggggatggcgcatgggttcgtctgacagggaataggtggatgcaacaccacggaagcccgagtctggcaaagccctaaaggtttgtggcatgctccgaaggctaccgcattgcccaaacgcccacggtctcctctaaatctgcccatcgtggtgtctcctaggcctccccattgcggcgaggagatgcctggctgagctcaccgcagcgccgaagttcccccttccagtgccggtgtgaggcgaactccaatggggaggtgaggaggaggtgggaggtggtggagagtttaccagctgatagacgccgataacaacataggaaggagttggtgtggggcaaactccggtggagagacgaggaagaggtaggttgtgatggagagaccaccggctgactggcactgatagcaccagaggaaggaggcatggagaggagggaagaagaagaggaaggactaataggtgggcccattgaatttttttcctgattagattgccacatgtacgccacataggaccaaagtcgctccgggttgagttagggggtagtgtgttcggtataaatagttcaaggtttcaaatatcccttttgtggttaagggggtaattagtattgtcacgatagttcagggggtaattcggactttttttaaaaacaaacctaggacgggatatgatatattccaaaatgacgactctagacggtaggcttgtccagagtggtgtcaaaaacatatctggcacctatctgaggttacctaccagcactaattaggtttattgtactagtatttctactatctccttccgtcacataaaaaagaaacctagtacaggataacatattctaatactatgattcactacttaaaaaacaatttttcatggcacttctcttttatttttctcaggcggactaaaaatagtgccgctaatgaaaatcacatttatttttactagcggatgacataagcatccaccagtgaaaatcacgttatctttactggtggacgacataagcatccgcaggagaaaatcaattttacaaaatatatgtatttatatctaactttttcataaaaaagttggatgaaaataaaatttataccaaactaatgagatctacaactttttagtaaaaacatttccatttgagatcatttagggttcaaaatattcgttataagattgaagatgtattttacaaaatttcagatacatgattcaaataacctccaatatacacatcatctatgtcaaagttgtagagctttgcgagatcttacaacttcgtagttcatgactttttttatttgaaatcatttagaaaggcaaataagtattttaagtttcaaataatgaaaatcaaaccaatagcattctgaatatacacaacaagtgcttcatagtgagatggtaatataatacatgtgtggagagagatcttgtgttcgaatcctacaattcacatacatgtgattttaatccaaaaaaattgcctaaattgtcaattaggattcatagttgtgttatagatgccgataaaaatcaaaatatgtttttgattttatttttgcacctaaaaaattaaaatgaaaatgtacataaaaaatcaaaataaaaatgtggaaatcgattttcattggcgactgcattatgtggcccgccagcaaaaatcgattttcaccggtggtcggatgccgctagtaaagatcgttgattttcactaacctttaatcgttggcagaacgtccggctgccaggaaaaatatgttttagccactagaaaagtgtgttttgtagtagtgtctagataggcctaccgtcacatcctagtactacgattgtggcaattgttctatgttagcattatatctctaattcctctatgttagcattatatctctaattcctatctaaggggctatttagattgatgccattttcaatcataccatttttttggcaaagttgtcaaaaaagtgcatacgtttagtttgttaccaaactttggtaaatacataagaaatcctgctaaaattttggcaatattatcaacttgccaaaattttggcattagcaaaatttggtaaggtttattttggctacaatctaaacatgccctaacaagtatccaaatagacgaatagtaatggtatttttcaaaatgaaagaagttgtaatggcatgtatccaattagcctaagaacatttcatgtaaaatgttattgaaagtaactcttttattaaaaaaattactggtatttgaagactatgtacaaactttaccataccaagagaagaactgcacaagaaaccaagggacacatccaattgaggcctccatgcatgagaggttgagaccacctcatgagaagaacccgatctaggtgttcgatgggggcatttgtgaccctctccccctttgggtctagcgataatcagtcatgtatagcgatggctggctcagtgctaacttagttgtgtgaggaggtgctagcagatggtagtggtgtgtttgtttgcttttttctgattaacctttcagagctataatcttgtaattttttttcttctacgtatcagtatgaaactttcctgtgctggtttgttgtttcgaaaaagaaattaatgtcttactataccgtcttatttatttactagaaaaaaataccagtgcgttgcaacggggtaaaaatgttttttttatcctatacattaatactctcttggttttggaccgaaagctcattcattcatttccagctccagtcctagcccactccactaccttgctctgctcggcctacctctgctcgtaccataacagagccgatcttcccatcaaatctgataatccggtcaaactcgcatagtaaatctggtaatccggtcaagctcgcatagtcccgtgaccgtacgatgacggaaccgatcatctccatcaaatccggtcgaatctttctcgatctccaaaattgttgaggaattttgatccactcgatcttctttttcctttttttctatcaaaatcccaaaaattgttgaggggaaatgataagagagtagtgggaaatcttctcgatctccaaaatttactccggtcggccccgtgtacatacgatgacagattagatgagatcggaaaaaaaaaaggtgcgggaaacaccggaaaaaaagaaactgaaaaaaaacggtgaaaagaaaaaaaaaggaaaaaacgaaacggaaacggaaaaaaaaggaaacggactgggggaaaagaaaaaaaaaggaaaaaaaagaaatggacgaaaatattggcggaagccttatgtattttttaattatatatatatatatatatgtatatatgtatatatgtatatatatatatatatatgtatatatgtatatatgtatatatatatatatatacatatatatatatagattgtgttattacgtggaattttttttatttatacttttttttattaaaatatttacaaaaataattttttgtttcgaaaatttacaaatctaattgcctgccgccctcaagaagggcgatttttaaaaatcgccctctcaaagggcggcaagggacctaaatacaaaatttttatttgtgttcaaacccttcccaccggttttaattacttaaaaactaataatgcttattcgatactccaaatgattttaaatggaaaagtgataaactacaaagttatagatctcatcaagatctacaacttttatataaagtttatctccatccaatatcgtttgaaatatagatctgagattttttaaaatgtgttttatattttgtaacgaatatttggatatctaaaacatcttaaatgaaaaagttactaactacaaagttgtagatctccttgagctctacaattttgatataaagttttatttcatctgactttatataatataattttaaattgtaaaattatagagctaacaagttatgctggaaaatttacatttaggtcccttgccgccctgtggaagggcgatttttaaaaatcgcccttcttgagcgcggcaggcgattagatttgtaaattttcgaaacaaaaattatttttgtaaatattttaataaaaaaaagtataaataaaaaaaattcttattacgtgggcggtgggctaacatgctttaatgggcctcagggctcctctttgcgctggcgggccttgttagtcgtaccccatcggcactcgacacccatccatccgcctcctgcctgcgccgtcggccgactcctcgctacttcgcccgccacgccgcctccccctgcgccgatttccatccgtatccctcgaggttgggtgcccgtcgtcctgctgctttccgcctccggtgagcatccatatcccatcgcttgcctttgtagcagtaatctttgtttggagcgtgattcgagatcgaacttccttgttccagaaaaaaaaaagaacgaaaaatgtcaaaaagaagaaaaaagaacgaaagggtggagttgagatttaaggcacccgattatgctacgtggaaaaag

SEQ ID NO: 77564 - DNA, 12858 bp, Oryza sativa
  unsure (1)..(12858): unsure at all n locations
acggacaggtttgtgaaatgagatatgacataggggagcatgcaatacgtagctatagcattttttcattatcagttaggttgcatgtaacaaacgggtggacgtccacccgagagattggtggtatgtaaaaaatgggtggacgtccacccgagagattagaatccatctcctgagtagtagcagcagcagcagcagcatgcagattggattttggttgggttagatggggcgtccctgtcgacacacgagtggcacagtacgtagttgaaaggagatcgatcctgccgttggcgagaggcgccagaaataaacgtgcgtcatccaggctatccatgcgatgcatgcatggaccaccaataatataatccactcgtgctatagcctccacctgagacagtgctcttaattgacgcaggcgtagatatcagtagatagactggcagccctctcgtaagtagtagatccagcaacagatgtacgcgcatcgcatcatggttggacaagtatgtgtggtgcataagagcagggtataagccagctgctaacatatatgagaaagatcaataagtagaaagaagagcaccggaatacatatgtgtagtcagctgtagcaaggatatcaatacacggtgtgtgtatgatatatgggaccaggtattaatattgtagtatgtaactattgtatgaatgagctattagattggctatagatgaattggagctagtagttggctatactgttaaacttgctacaaatcatctatagccaatttaacagccaatttatacaatagttgtttattatactattaatatctggtcccacctatcatacaaacattacgtcttggagtccgtgctacagctgactacagatctgtagcccgctgctcttctcactcatcttttatctctttaaaatatgtttatagctggcttataatctattattgtacctaactatgtaagcggaccgacccgtgaacctacttatacgttaaataaagggtaatttatgggtttttcacgtcgtagagatgcaagagtggatcaacccataaattcattaatttatagattaaattaattagtaggtaatccacaccgcgtgttttactcactagttttatctataagcgggttcacggtaggccttgcatctctatcagttgcatgccgcgcgtgtgtacgaaatgaagaagagaagaggcatatatatgatgtcgatcccgaccggctggcccaatcgtgcggccgccacgcgtgcaccggccgacggtatgaccaatgcctatatatagagatgatcagatgaccacgtacccggctggtgtatatacatatagctagcaagatagacataataagctaggagagcttagtgacacatcatcttacagatgcacgcacgcacgcacgcacgtacagctagtgtacaccacacaaattaatctcagatggatcaatcgatgatgccaaattgccccgggccaatgcgtgcgcgcgtacgtctacctatatatatcatcttcatctccaactatttaacatgcagagatatatgcagatgcaggcaggccagcatgcatgttacatagtccttcgtccgtttcacaatgtaaattattctagcatttctcatatttatattgatgttaattaatatgtctagattcattaatatcaatataaatatagaaaataactagaatgaaatatacagtacgtagtatatcccactttacctaatgaattatctatatctagcactttaatgcacgagaccgaaagagacatatatggccaaccggccgccggggcctccatcgccaaccgatcgaccggttgcgctgaaccctgtgcacgcggaggcaggcaccatgaacatccatatgcacacaccgtgtcgtcgttgcgtgtcgcccgcctcgacgcacgttggtcgggacggagtcctagtactattccacaactgttacgtttgtgctgcagccagctagtgtctgacgtcacaagtgttcgtccgatccgtcgcgtagctaccacacacgtacggggtacaccttaatttgccggctccaatatggagtacgtgtacgtcttccagggggaccaataatcatccacacgcatgcttgcagcacacactactgctgcactctactcacctgcatgcatatgcctctgcacacacgagatctagtcgagagtaaactaaccaacacgatcgatcgatgccaccttaattgccactggccggatagcgcgcacgacaacacgttggtgaggatctcgatcgatcgaagcaaattaagatgaggatagctagaccgggaggttgatttccacatgcttcgcgggtaaaacatacgtaatccctcccgtccaaaaaaaaaagccaacctaaaaaatatgatcccttctaatccagatttattatactagaagggaacacatcccctcttaaattgacttatttttggacaaagggagtacgtacgtactcgatcgatactacctagcggacctgtacatatgtcttatgggtggcgggcatacatggccattattcatttgatcgggagctaccttgggaaaaatatatactgctaactttaaaaaataatgtaaacctataaatcattgtactatttaaaaaatatgtatacatatgatcactctaattaaaaatttgatgtggataaatttaatacgtccatttctcaatactccctacatcctaaaatatttgacgccgttgaattttttaaaaatatttgaccgttcgtcttatttaaaaaatttaagtaattattaattctttccgtatcatttgatttattgttaaatatactttcatgtatacatatagtttttacacatttcataaaagtttttgaataagacgaacggtcaaatatgtttaaaaaagtcaacggtaccaaatatttaaggaatgagggagtactatgttagttttcagtttggcactataaatatgcgattttcattacatgttttcgatcccttccctcccagctttgcaccaataataaacacgtactccagctttgcacgcctgatactaccgtgagcctgtgcatttcgggcctacagctacatataacaacacctccaactgttttgtaaactgtataatatttttgtatcttcgattctcacacgagcactttgattccctgtatgtatatgttcactgatctaatttactcttacgggaatagtaaatgaacgaatgatccatgctatgagcaaacgggcacagctagctagaaatggctcttcgcctgctctgaaactcatcgcacgcattgcttgcttcatctcctgttcttcaattaactatacataatcatcaatgatagactaattactatacatgatcatcaatcatagactgattactattgactgtatttaatttgagtacttgttgatgaagtcatattcgatctcttatatggttatctgaattttttatggcaatgctgcatgtgattctcgtacaaacatatattcagccatacatcgcgtgacactggttatgtataatacatgtgtgaagttgaccgatcagcgaatatgtgtatcatcacggatgaacgcataagagatcaagttttgacaattgggcgcaggagactgtatccttatctttcgtccaacaactagcttcaaaccatgcatcacgaatgatgttatcgccttatcgggggataactaatatatttgttcgtgaaatgcatgattaattccattcaaacaactaatttaattttggctacgattaattagttaacttctatgttataagtaatgtgttgaatgattgcaaagtgaacgtagattaactggttagattccttgtggtagaacaagcctatccggttcaaattttcgacttggcacatgatagtctacgtacctgtcgacaatgagacacttgtaatgacttcgttagtatcaagaatacgtggtccaaccatagaggtagggtgtacgtgattatatgagctctaatatttgtattgtgttgtatgattgtaagtagacatacttgctagagcggcatgatcacatatactccctttattttatattgtaagacacttttttaaaatttaagtttgatcaagcttatagcagaacatagtataccattttcaatcaaataaacatactatcgaatatattcaatatatattacatctaatgaaactaatttggtgttataagagttgctacatttacttataagctaagtcaaacttatataagtttcttttaaaagaaattaaagcgacttagttataatttgaaaagcggggagtatttgctaaatgtggatcagcagagcatcaattccgcgctggtgagccggtagatagtcgatcaggttcgtcgcagttaactaaaaaaaggaaaatctatggctacctgactagatgaacaattatgcaaatcatgatctcgtcaaagcctaatctctacatctgttaatttaactcaatatgttggggtttcgcctccattgattccattaatctacttgctggctgcaggcccatgccattatataacagcaccattttccaagtatgttaagcaagaggaggcttatatatgaacaaaagatcttttgcagtcggcattgattgtaatccggagttcctctagctgaagtactctgtcccagattaattaatgcgttatcgagatttggccttaaaatgctattgagatttggcctgtcttttaactattagagcaagtttaataatatagccaactactagcttcaaataatttagagccaatataatagctaattcatacaatagctgcttactatactattaatacctggtctcacttgtcatacacacgttacgtcttgaagtccgtactgcagctggctacagatctataacccgctactcttctctctcttcctttatatgtttaaaatatatttatatctggcttatagcctgctattgtacctgctattaaaatggagctgtagatcgagatcgatcgatcatcagtacgaggattcagcatgaggaagtacgtttagcctgctgaacatttgcctatatatattcagatcatgtaccaaatggttttaattaataatggaggcagatcttgtaccgatatatctatatctgtatgcatcgtcaagttgagcgcatcggaacatgcattactggctctgtatgatttggcagaatctgaatccttgtccatatattgctagctagctagcttgacataaatcgatcacatgtatcctcctacttgtaaatattttcttttccttgctcgtgaagcgaatctagcagcatgtagtcccaaaaaagatctacacataattatcagaagcttaagataatcctgctaagaaatcaagcttccaggttgtgtgtactagtgtaatgtttggtttaccagatccaaacaaacagcttgaggttagcacttaggagtggctgtagcagtgaagttcttcaggtaaagaaatgcatgggcaaagtgatcagcggtccttatattgggccgtacagtaagcccaatacgacccgtgcgaactgttgacttggccgctagcaatggtagcggcccttttgttgatgggccaaacggaggcccaacgttttgcttctaggcctgctcagccggagctctcagggggttcggagaaaaagatgccgaacccaataaacggcaaagtatcctacgcacacataggcttctcgtgtacactctctacataccaactagtaaatgtcttagaaaattttacaaaaaatatgacatgtactcttaataatactacacatattacaaagtcttacattcaaattcattgtattttagccgtaacaaaaaagagaaaaatctaacaattgtaagagtaaaaaccagtaagaattgtcttttttttttgttacggctaaaatataataaatttgaacatgagatttcatagataggtgtaatactattgaaagtatgtgtttaattttttatataattttctgtgcacgggaagcttgtatccgtagtatatgttcccccaataaacacggattcaaaaatgccggcagcccggcactggtgctctagcttgttcttgggcatcgttcaattggcagcagcacatatagctgcatacggctatatatgtattatttcatagatgattgatgatttctgatcgatgtcaatgctagttaatttgtttttgcaatttggacgagcttggaggtccctcccggccctctgcttataaaaacaatctttttgtgtttgcactgtatatgtatagatggttgctttttgggggtgtgatttgaaactctagaaagtatatctcctcgtttttagagcttttttacggtacattctactgctagtatatactaccagtatatttgatctgacggtgtaaatttatctgatttccctcttaattatactgcaatataaattggatagggtatatttgtctttttatctttttgcgtgggagggtatttttgtaaattaatgcgaactcacttagtcagatccgtttcaccacatcgactcaaactgaatccgctcggctcgcatgggcgaccgccgccgctggcttctatgggcgccgcccccgccgccgacagccacagtcgccgccgccaccgggagccaaaatcggcgccgccgccatcgaaatcgattcgatttccctcctcctttcctcctctcgtgtcttttccgtccacccaaaaccctatctcttccaaaaaatccccaaatcggcgccggctgctgggtctacgggagggcgccggctgctgggtctaccgaagggcgaagcctgctggggaccttgtctgccgcagtggcaggggcagccggccagcggtaggcggcagcggcaggggcagcaggccggcggtaggtggcagcggatggctgtcgcggggcagaccctcttgttcggcgcgggagcgatgtgcaccaggagcagcgacgctggaaacgcgagatgtatcgagaagaagcagatgacgacatccacagaaaaaactaacgaaggaaaattaatccggatgaaattaattctctaatttaaaggaccaaaaagccattttcagacttttacctaataccaaaactacccttgtatatactggtagtatatactagcagtagaatttaccgtaaaagtcctcttattttatactaggtatcaactcaactgtaaaattggaaaataataatgatatgatatattaattcacaaacattaagttcaaatataattacaaacatactttaatttgctaactaacattgcattataacatacttttaactttcataagaaaagctgcgagacgaacatcagccagatggccaccggctgcatgcatgcgctactgcacacgctctgttgagcgatcgccggctagcgggagagatggatcagaccctgttaacaaatggactaaataagtagtttagtcatgcgtttggcaggtacatcgatctcgatccagacgacaaaccaaatactcgtagctatttaaaggcttaagcgctctaattaataatcacccctaaaccatatacactcctgtaacctctgcctgccttaagctaagccgatggagatcaagctcgtcttcttcttcctcctcctcctgggttttggcaacgcggaggaggaactcgacaccgaaacctgcgacgtcgccaagctgtcggccgagattggcacctactgcgaattcgaccaagggaggatgtaccccggccggtgctgcgacagcatcatcgacgccgcggatgggcacgatggcggtggcactcagtgcatctgccgcgtctggatggaggatgcggtgagaaagaccgggatcactttcagagagttgttgcataagtacattgattgtggtggtctgcagcccagcctacctcatcttgccgactccgcttgctcagctggtaagtaattaagcattaattgcgtctccatctcgaatcgatcagtctctaattaacttttgttgtttcttccttttctgatctgtctgattaattcacttgatcagctcctgagatggtaggcacacttccaggtccaggcaagatcagcggtgcagacaccaccaacgtcggagtcatcttctccgccatgaggccggccattatcgtcaataaaatgctagctagtacttgatacatatatatagcgagtgttcgttggggtatttgttaagttaatttagtgttattgccggctaataatatatatagtagagaagctatgagtttgatgtcatattgcagtgcattacatcgttttgttattatattttgaaagcagactgtaagttccctgacgctctatttgagagataaaaagattattatgccgaaagagatcaactactccctccgtcccacaatataagggattttgagtttttcttgcaacgtttgaccactcgtcttatattcaaattttttttgcaaatataaaaaataaaaagttgtgcttaaagtattgcggataataaagcaaatcacaaataaaataaataataatttcaaaaaaaaattaaataagacaaatggttaaacgttgtaagaaaaaactcaaaattcttatattatgagacggagggagtagtagtctagtaccagcatgcagtgtgtatgtttgtgtgtgatgttgatttgttttctaattgcatggccatcagccccatgtcttaggttcaggtgtcccgtgctgaatcttgaaagtgctactagtttgatggctcacagaattttcataaattcggtcaccatttaatgcatgtggcccttacaccacaactgtaatttaacagatccgatcaaacagctctagtctacggatttacccagaaacatgggtagcggtttaatctatggattgatagtaactaaaatatatgtttctgttaaacttttgtgcttgagagatgttctagttgtttcttttttagctgtgtgtattttatgcagaggccgggggtgactcagtttgattatatcatcttgatgtaaataaagcttccattatcttaaaaaaaaacagctctagcacttaggattagcggtgatgttcttcttcttcttcttcttcttcttcttcttctttttaatcagccgtgatgttcttcaggtaaagaaatgggtagaagtgatgaaagatcagaccgagacaggccgtcatattgcgctcctactacgcagtaagcccaatacgacccatttgttggttcggtcgatttgttgatgggccaaatggaggcccaactttgtgcttcttgccctgatctgacggagcgctggggtcggagaacaagacgccggcccctactcatcatagctactgattgaatacaattatcattcttctacattcttgagttcctacttgtaacagtctcgaccgcttcgtgcgacgttgccaagctgtcgactgagattaattggcacctagtgcggttcagggaggatggacggcgttgatcagtgctgtgacgccatggaagctcggtggtgctcagtgtctctgcccgtcgtttctacttgtgggttatgttaccgatgaaaaaccatatacatgggtcctcctattcgtcgcagttatactttatttgttaagtttagtgttaattattgtctgctaacagtggagagctatgagtttgatgtcaatgccgcattgtcgttttgttcttttattttgaaagcagacagtaataagttcgaacggattctaaatctctcaaatagagcttcagatttaatgttcagtattatgctagtactaatgttttaattatgtgatactcctatattaacattgaataatgtgactgcaagcaattagcttgtcaagataaaatcatgccatgttgtgttagagctgcatttatacttagaagacagcatgcagctgttcatacaacccccaaagtacaatccctattattgtgtccctaaccagccctttgatgagtgagcttgcncaggtatcagatgatgctctaccaacaagatcacggaatctcaagtctccttgatcagaaatcagtgcatacaccacaccattcatatgtccctttccaatgatcccaacgacagttttgctcttgtttacagctttgctcctcttcagagaccatgcaaggaactgtaaaacagacgacaaattagcttcagatagattgttcaattcagagaccatgcacttggaagcaagatacgtaactaattaactttctgcgtatgagtgatctttctgcaggttgtaaaattcagacaagttaccgaggaatataccatgtcacgctcatgtatcagaggttgcagtagtgagggatatgagatgctcagtttctcatacaactcgtaggggctacctgcagctttctcatcctgctgcattaccactcaaacaaggatatcgacgtaaataacgcgaaaattatgttttgcaatgaaatgatttagaggaaattacactcgtgtaaaaatgcaacactgctgagaacagagagatacttctaggagtatttagaacttacacttgtgtcagttgtagaggtaattccacggaacaatgaaactaccaatttagtcttctcatcccagctaagggatttccaagctcgttcaagctgcaacaacaacttggcatgagcttcagaaaacttatcatttatattttgcgcaactgcaaatcggaaaagagttcgcagatatatagtagtagttgtatatatacagttatttcaattggacgatccccaagaacgagctgagcgccaagatcttcagacaccttcctagccgctcggaactagcaaatgatggagtaaaagaggaattgttttcaagagttgaattaaatcatcagaaaaaaaatgaaaactaatgacaggaataatttaattacacctcttctccgaagggccggtttgcaccagaagagatctttgaggagaaaacggcaagaagcagacgcagagcaagtgcagtctgcccacctgcaagcatcgtcccaagcagaaaagaattaccatcttctggctgattggcagtaggattatatcattgtagagtgaaaaagaatttcaattacccagattgatgctccggttgacggctccgaagaacttggagccaccgagagagaacatgttggatttgaggagcggctcgccggcagaagaatcggtggtcacgtacatgattccagctctgcagtgaaggctctgcaatggcagcaattagctcaagaagagatttcacggccatgtctgactgagcaggcctagctaacgacgatcttgcctgctccggcagagctcgacgacgacgttgtccgggcggacggcgcggagcacccgctcgacgtcggcgacggactcctcggagaggtgggacgtcccgaggatccagacgtcctctggctccacgaactccggcggccgccacgccgggacgggcccgaaccgccgccggggaacgcgcaccagtgcgcctgactcgaccagcgcggcgagcgccgggtccgcggcggtcaccgcggccgcccgcgtgtgccccagcatggcctccctgtagtcgaagcacggcggcggcggcggcagcggcggccggaacgacgccgccgtggatggggtgggccccgctgccatccctggcgcggcgcggcgagaggaggaggatatgagagcgcgacgcgacgcgacacggcggtggcgagccgcggggtcatacaacgttgtggatgacgtagatgggctcgctgcctctcgcaactaaagatttttttatccctacttttccttgatttttttaattttatttattataaaatatttaaaaaataattttctatttgaaaaatttacaaaactagtcacccatagccctctataaaagtcaccctcctaaaaggcgattttattggcttggcagatggctgtgggcccttccataacggttggccactgaggacgccgaaattctgcaggcggcccccttccgctctcgaggacgatttttttactatgcgactgcctgcaaaaataccaccccctaccatcctttaagcaagtggcccctcgcattggaaaaaatcatcctcctaaagggcggtaaggagaccgcctgcacatttttggctcttttggtggctggccgttataggaggttcaatggctgtatgccacgtcggcaaaatcgctctttgggagcgataggcgactagttttgtaaattttttatttatgtaaatattttaataaaaaattcacttttccttaccggcaaatgggccgcattttttatgggcccgcaagttcgtgtccgaatccggtccggactccaacccggcccaacgagcaagagtttccgatcgatagtgacgaaggattaataagtagaagaagctgaagcaaggaaaggaagaggccggcggaacacgtacggcgacgttgatggaggacctgccggacgacctgttgctggaagtcctccgccgcctcccgccgatcagcctcgccgcgtcgcgcgtcgtctgcagcgcatggcgcgccgccgtcgacgccaaccgcctcctgcgcgcggacctcctccccctctccgtcgccggcatcgtcgtcaaccccctctccctgggctcgcgcttcctctgccgccccaatgccgcggcgaccatcgccgacgacctcgacgacatccgcaacacgagcagaggcatcttcaaccgcttcgatttccgagtca

SEQ ID NO: 77565 - DNA, 1110 bp, Oryza sativa
aaaacatcacatcgtatctttcgacacatgcatggagcattaaatgtagattaaaagaaaaactaattgtaaagttatggggaaatcacgagacgaatcttttgagcctaattagtccatgattagccataagtgctacagtaacccacatgtgctaatggcggattaattaggctcaaaagattcgtctcgcggtttccaggcgagttttgaaattagttttttcattcgtgtccgaaaaccccttccgatattcggttaaacgtctgatgtgacacctaaaaatttttatttcgtgaactaaacagaccctatgtagtttctactcataaattgctactcctacgctcatgaatcactgaagcgtcatgtttcgaatgtttcgacgtgacgactgtgatgcttcagtgacttttcgaagcgtcatgattcgacgtgacgcagttggtttggaaaagtaacggtgatggcatgtctcgaattttaaaaaatttcaatggcacacagtagttttcacaaatagtagtggtattttttcaaaccagaaatttgtaatggcacgagtccattaacccaatataatataagggtcacatcctccaaaatctcttatattatacgatggagggagcacggtctactaatactgtctattccctccttttcaggttataatgtaatttgactttggtcaaagtcaaattgttttaaaattgactaagtttatagacaaatatagtaatatttataatactaaattatcttcatcaaatcaataatcgaatatattttcataataagtttgttttgggttgaaaatgttatcgttttttctgcaaacttgatcaaacttaaagcagtttgactttgaccaaagtcaaaaggtcttataacctaaaacgaatggagtattaaagaaattaatattcagatttattaatatgtaaaaacgacgctaatatatttgtcaataaaaacacattcatatggttatatctttagttaatgtttttataaatatattaaaaatattaaaacatgaatattgcagacaccgaatgttctgaacgatgagtataaaacagagatagtaatagtacattgacggag

SEQ ID NO: 77566 - DNA, 17287 bp, Oryza sativa
gcaatctaacaacaatgacacaaaattagttacttagaagtatatgtattctggaaaagaatggaacacagtgcattgccagaacaaaatacctgaaccaaggcatcaggtcgggactcaaaaacaattaagagaacacctaatgggcaagatgttttctcaagaactaaatcatcagcaacctggcaaaggggaaatctttttgttaaaatcactatggatatatcatctagaatctagaatttctgtgaaatctcatagcagatttctattaaaaagagtttctattaaaaaggctggcattcacctctgtctttttaagtatctggtttatagggtcttccatatttgcaagggtacgaatagattttgcaaggcttgctatctgcaaaaacataaaatataatatgagttaaacaagacaacatacataagaaaagagaagtgtcagatatttaacaaatcagttaatttggcaaggaaaatgaggggtccacctttcctggttttatagtcaatctagcaaccaaaggcttctcatatccagcaacttgggccgcagctacatcagcttcattctcagaccttattaaatcctcatttgcctccaaagcatctgcaacatctagcaatatcttttttcgttcctctgatgacaaattctgtttcaaacgaacatatggtatcagactagtatcacgggtgagcaaaaatagtgagctaaaacttgaaatagtgtgtaactccactgggcataacagagggacaagaattacgtatgatttgacaaagatatatacctgtagatgccttgaacaatctcttgcggcaacagccatctcacgagtactaacatccttagatgattcccacaaattcgcattcttgtgaaagagagtaccaattttttccccatgaagaactttaagaatgctccgattttcaaacccacttcaaggatagaaaaaaataaactatttctccattcattaagaagataaaaatagcttgcaactcatgaacttggttatctcagtgataattagcttcaacacaacaagataatcatttgaatttgatgtgcagtacattacaagcattaaatgtctgaaccatcataagcaaagtttcaacgtaacatgcaaggtcatataggtctcaaaacaaatcatttttttagcgtaaactaggggtgtttaaagtcagaacagctcatccattaatgccacgaagctaacattcaagcactggactgcatctcattcaagatgttataattgaggccaagtggagttgttgggattggatgtcttgtaggacttaataatcttcacattagaaataaactcatgcaaaaaaatctggcaatgacataatccaaccagaacacctgcagatggtactgattgctagttgcacttgacaggaaatttgacaatacatatataatggagtgcatctgattgatgctagcagtcatatccattatactctagggaatagattgtttaccttgtaataaccacaggtgtgccgctatttgaagccaagacagcagccttcacttttgctgtcatgcctcctctacctacacgagatttgtctccaaaagtgatttcttgctgatgcttttctttaatataagtgtgtatgatttttgatgatggttcacttggtggaccactatacaacccatccacatcactgagcagaataaggagatcagctttcagttccagtgccaacagtcctgctaaactgtcattatcccagaatataccagatgaatcctgtaaaagaattataggtgagtgtggttagaaagtcatggctatttgcatatacactgacaaggccctagggctaggcatacaagcagtataacaataagtagcagctaaagagcagcaccacgcaaaaactgaagtttcatacttttccaggagatgtatggtatgaaacacacttacatacctcatatggagcctttctagtgctgatggcatcattttcattaaatattggtataactttaagatctaataatgactcaacagtttcagtgagttgctcccggaactttgggttctcaaaatcactgtcggtgacaagaagttgagatgacgagacatccagctgcaatgcaagaagttcaaggttacaaaaagatacaaaaagtaacctattcatttttgttgaagttgaatgccagactaataaacacacttggttaaacaacatatcgtaaagagccatcagtccactctgaccaacagcggcacaagcctttccatctaactccatctgtggcttttgcagatcagcaaagctgctattgacaagcttccggtacctaagtcgctgtcgccccactccaacagcacctgaggtgaccaaaatcacttcgtatcctaaagagttcagttccttaacctgcattgccacttttctttggttaggcacctgccaacatatccaacactacatagccattgcagaacagctcacaagatcaaaaaaatggatttcttttacctgctcgcacagagctccaaccctgcccaaagccaatcttccatcttgtctggagacaactgcagtgcccacctgtcatgcaaaaaaggaattagccgcacagagataaaaacattattattatattattattatgtactggtacagtggtacatcttgtgttgaaggtattgcgttgaggttccacaaaactgctaggcttttctaaagcctaaacgcttttccaaagcctaaactcaaaagcaacggtatttgattctacattattcgattctcatcacctttccaattcagacattatttcaccagttccgcatattttttataaaaaaattggaaaaagcatgggatttgaacaaataaaaagtgtcacagatgaaacaaacacgaatttgtgagagcgatcgcaagggacagaaatttgccgaacgctccaatataagatactatgtctcttttctatttctgtgccattccacccaccaattcccatctgacagaaatccgctgccccgcagcgaaatagccaacagttttcccatgatgatgcctaccagagtcgaaagattggcaacttcgacataggccgtcacatcaagtaaaccacagaaaagcccaagcaaagccccactcctgataatctaacaacgagaatcccaaatcaaacgtctctcgagtcttcaactctgaacaaaacactcgcccggtaaatttgatccagaaacaatctcacgaatacggagaagaggagcgcaaacaatgcaaacagcgcccaagcagacgcgcacgaatcctcggaaactagatctatcaaggtcaatccgtgacggcgactcctgcgacccagcggccaaacaaaaatcaccttgatgatgacgcgcttcacgtccctcacgaagctccgggacgggtcgacgctcgccatggcgaaaccgcttcctagcctcagcctctcctcctccaccctctccctctacctgtaaatccctctcccacgtctcgccgccttgccgccgcagccgcgagtagaggggggatagataggaggaggagaaaagaggaagggtttatgaaggcagaagtggctctggctcccgtgaccggaaaggcggaaacccagggcgcaaaatgcccaacgacccccgggatcctctgcgcccgcgcccgccacacggtatgcgtgttactgtgacttgttaagctgttaaagctgttaggtggcggcgcaccgagatacaggggggaatggggtcgttggcccagaccgatccatccgtcgttttggcacgagaaaacgtgagccgctcagccgcgcgagcgcggataagccggggaatagatatccatatcccggtgcggggggcgcctcgcgcgtgcgggtgcaggtgtatggcgcgcgtgacgtgcactgtcccgatcgcgcggcggcgacggggcggagcgttttgtaccgtgacaactgacaagcccggatcggacgggggggcgaatgggctcgtcgcacggggagcggcggcacgccacccagaccgatcgatcctgctagaatcgttgttttggcacgagagaacgtgaggcacgcatgcatcgagcaggggccgccgcgtcacggctttgggagaggatttccgcgcgcggatgagcagccgggatatatgcggtgacggtgagccggtgcgggtgcgcgcctctatcgcacgggcacggtgcgtgcaggtgtatggcgcgtttttgcttgggtgagtttcgtgcagcgatcgatcgggcggggaggggaggggggccgggcgctcgtggtggactctggactggacgtctggacacggcgctaccacctagtactcctacagtcctactagtactacgctacgcgctgcttcgctgtgcacgcgacaagagttttggtagagacgggagggaatctgccgcggtgtgcaagccgacgagagaggccgcgcagcggcgcaggtgaggtgaatggtgatatgcctgacaccggcgggcggcaacgagatccacttggagcggctgatttggcatttctcggtaaaccgcgacaaaaagtcgcaggactttgctcgcgtcgcgttgaaggacgtggcagcagcagcacgtacgtcgccgctcgacgactttacgagcggagagtcaggggctcacggtcacggtattggccgcggtggaggcgcagcctcgcataacacggtgccattcacgaaagcgtaccgtgggttcatgccctctccatttaggcccggtttcttttaacttgggattattataatctaaattattaggagtaagttgaaagaaacagacaacttattaaagtagtttattataatttaaagcctagcttattataatttgataagctcatttagatgagcttttttccagattatttggtgaaaaattacccaccataccaccccactccttctttagacttgcaaatccaataatctaggctctaataatctagaaacgaaacaactaaccgcttattctactacagattataacaatctagcttatagtaatctgacctaataatctagattataataatcttaagctggaagaaacagggactttaataagcttactagttaatatcccacgctttgctacagaacatattgatgaacacatgttacatattatagaaatggtacatgtatacgtttaaataatataaaaataatgtgaagataacgacttggcattgcttcgatattgaattatgaaaataaaacaaaattataaaataaaacgtatgtcatatttacatgatatttaaaataatttaaataataattactaatgggtgatgatgtgacgcacttgtatgtgatttaaaataccatagataataattgctaatggatgatatggtacacttgcatgttgagatttaaaagttagtgggcatcaactttatagcaaaacatgggtatgtttcattaatcagtaagtagccagaaatctaaaaaatattatcgataagcgctccaacgaatccaactttttaaaaataccatcgtataagcacatttatcccaaaaatataatcattgttaggttttcattagcaattattcgttaaagtgttataaaaagatcatttttacttctacgaattgttaaatgatgattaaaatttttgctctttttattagcttacattaatttggaattaaatttaaaatatactgttcatttgggtttttttaaaaaatattcgacagcgaacggtctcgctacttccttccttgtgcgacagcgaatgttttgcccagtgagctgttgtttaattagtaactaattacccgattaataattaattagtaattaggaataattattataattaacgattaattgataattattaatcattaatgaggataattaatcaatttgaatgttcggtctcgctcgccggtaatgcgagagcgctcaatttaatcatttccgtgcaacggttcagcgagatcgatggtatattttcgttaaacaatttgcataccgaatacttttttaaaaaagccaaataaacagtaaatttttaaatttaattccattaatttgtatgttgctatttatactaaattattgtaagttgacgtaaatagcaaaagtttttatcagcttttaccattttgtagggttgctaacggaaacataacgaaacccgccgtagtcacctccttgccaccactgcctcggtgccagctgtgtcctagcgacaacggcaccatggacgacaacaagctccaccatggcaaccttcctcgtgccgcccattgcgtggtcaccacccttgccaactccgcccgttggggggccatccttcggcctctgctctagaccgctaccgttgtcgggtcttatccataacagtatagtggggtggctttgtctgacatggcaatttgacccaagtcaacaacgctgagtcattgtggacaacatatgtcacaacctcttacctatctctctcttcctcccctattcccatctcagcggtgcctggtgaggaagacgacgtctggcggcgggtcgacgatgggcggaggtggcaatgaagggactacggcgggtacttgagggacctgttgtgtctgatatttcggttgaagatgaaaatcgaactaagctgtcaaattaagggtcctaaaatgaacttattcaaccacctaaaccagtccgatatcctatttgccaagctcacggcccagtacgcgaacccgtccgtcgtccgccacggggccaccacgccgcccgcaccgcacgcgcacggcaagcaagcgaaccaagcgaagaaaagcacacatattcctctcctccctgttcgattcccctcctctccacgcctccgcggtgtccaaactccagactcccccaaaaaatcccccaaaaccgaagggaaagaggaaaaaaattactcttcgctctcgcgtcgcgcacgacacgaccgagccagcaaagccgcccatccgccatcccgccgctcctgcaatctacagccgcgtcgccgcttgtccgcctgcgctcgttctcgctagggttcggaagggggagggtggggatcgcccggcgatggactggagcgcggtgacggcggaggacctggtggacgcgctgcgggaggtggactggtcgacgccgccgcgccccgtgccggagttcttctcccgcttcaccgtcccccgctcctactccaagtggaccagccgcctcaagtgcaacctctactagtacgatctcccttcctcacttcctaattgcccgtcccacgatttgttgggaacttgggggtttctatgtcgagattggcgttaaatccgagcggatttgagcgcggagcccgattgttggtgttttcagtgaattagtagtggatcgagcacttcttttcctctctagccagtagaatagtagaataagggtatatgcgtgcgcatcgagacctattttgtggtttgatagcccaaggaaatggtgttgtaacgttcaggtaatgtagccatatagtaggtgaatccaacatcgtattatgctcagcatgttcaatggggacaaaaggaatcacataaacggccagtatattaccttattaggctgtgagctagttgtttcgaaatttctgatgaattcatagcatgcgaagtaggttatgcttgtttgtggcatatgatatgttggagtagtatttgatgaaaacacaaaacaaggtttgtaggtttagcttccccaggctaccatcaactatcggttctaattatgttatccatgatatcatgatcttcagcatatttatcatcaactatcgattctgcttagtggcaattttagccaaggcgctaagcgctagttaggcagcagaccagcacctggcacctaattggtgatcatgtggacctaagcaggattggccagccacctagtcaggataactcaataggcaggctaggcgtccgtatatgcaaggaaattgtgcattttgatgtaagagcaaaatttttaattgttaggttaacctgaatcttatttcgttttgtacttgttccggagatgctgggtgttcttgctggagtgctgtactccatgaaatccgtgagatgaacagggtgcattagaatttttatttatttactacttacttaaaaatcagttgaacacagaatctcagattgaagatggtaagtggtgcaaccacagtttttgctgtacttaatgttgagacattaagtgtttctgataactaaagtgattggcaaagtagtgtttctgtcagaaaacatgccatgttgaacatacatctaagtcaaatgttcaaagctgtgagtacgaaaatgttttaaatgtttggggtttgggtttgatacataaaaattcatatctgtagatttatcttgaaagtactgtcagatatttccataaaaaaactttcagatactagagttttattgggttttgcacatattttacgttataattttttgctttttgtattctggagaacgtgcgaatgtccaaaaccacatgttctcattactggatgttgtattaactatcctcctaaaaggcaccaattcatgtgttcagactttttacaagttcctcacgacagatttaagggttgtatagttatcattttatcttgtactgaatttccctcatttatttggtctgcagctacaggacaaattacttcatcttgatcatgttcatccttggtaggcaaaaaaagcttgaatgctgtctcttattcctcattcggttgattttgacatgctgcctttgttatatgcagggataggcttcatttggaagccggttgctatacttgcagcctttatgactggaatcagcattgcatttcttaatgacaggtacaatttacttaactactctctccgttttagaatttaagatgttttggttttgtactaggtcaaacttagataagtttgatcaagttagtacgaaaatgtaataacatctacagcaccaaattaatttcattaaattcaacattgaatataatacaaagccaaaacatctaacattctggaacagagggaataataccatcctttttctctagaaaattcttccatttagatgagtaaagaacaatattttgttttcttaacaaaggtagtgtatctttgagataaaacataattacatcaaatatttgtctaactgtcctgaaatattgctaaggatgtgttgtcttagcactacttccaaaaggattagtgaataatacatctgcaggatgtttttccttgtatcagttgtgatacagttctcaaattccttagtcatctccgtacattattttgtgacaaactgacactgagtgatttacactttgatcataggatgattaatagactaattatcatgtttgatacttcagctttgcagtcactttcaatgagaaagtcacgaggactgtcagacaattttcaccacatttagctgcaaaaatgaggccaccaataacgtgaggattttaatttttcatattctattttctttattttgtcgtgattcaccagagtgtgttattaatactattctcaacatcatcgacagccctgttcttcgtggtagaccaagttcaaagaggtcgattcatatttgtgggcgacctcgctggctatttgtgctgttattttctgcaggtgtgcaccacagcaaattgtcttcgtattatcttatttcacataccatagttttgaaaacctgaagctaatgctttttctatttttatttgcagttagttgcatgctctggttgacttcctgcagtctcctcacagttctatgggcccttttaattgctatctttggtaggatgattgagattttgaattttcaaagatagatatacatcttgggactgcacttatagttcttttttttgtttttttgtttgcagcaactctgcttcatgctagcttcagaacacctaatctgaaagcacgtctgaatacattcagagaagaattccgagctgtttggaggaattatagtgagctttaaggtccgtgtgtatctaaccctacgtttgtgcaggacctcagtttgtctatacctaatgctttatgcgccatttcgtgttgtattgtcactatttggttaaagttggttaaaacttggagcttgtttggtttctctatgcaggttcatgtggtaagaagtgcttagtgctgaaacttcgtgctgtttgtgaattgtgtttgtgggagataccaagatatgaacaatggtgacaggcagctgcgttctattgtgattacttgctcgttttggaggtgggccttgactgtctaagtacatgatgatgttacacttggtacgccaccttccaaatcactataattgttcacatggaattctccctaaccaagcattggaaaaagaacagcatgtaaaggatgtaaacaagtattctaatcaacacagcatatattgtttgttgaaatgtttgtttcatgtttcccccagcagtttgaaccattctagataaattcgccaccaaatttttcggttgcctctcgggaagtattagatcgtgaatgttgagatgaagcaagatcgttagctaaaaacagcgcgtcagcttcttcaatcattaaccatgagctattcgacacaccaacagtactgccttgcacattgctttattactctgattggaaaaggcatcgtcaacattttttcccatggagtatcaagaaatctgtaagatataattgaaaacattaaacatgcatattcccaacaaattgtaaacgtggatggacgtgaactaatcctatattcaacatgacaacacaaaatggataattacaaaacgataagttccgaagggagaatctcgaacgaggcaatctacaggtgaacgtgaactcgactgttcctgactcccaagtcaaaagcgctcgaatcctcggaaatttcagcttacgccaatccctctcgtggaggtagaacagcagctgcgataattagcatagttaagtcgcgaagcttctatcgccggcatctcccaaccccggaactatgaacctgtgggaacaaataagacatggaagttattaaaatccactgaaatatggtcacgacctacaggcacgaagcatattttgcaggataagcagataaatagaaattcataagttaccctctctcatcaacttcagaatcaattgttcccgtgtacacatgaagcctagaacaaaaaaaatcgaaaaaaaggtaactctatttagtaaacaagaggaacttgtcatgcacacaaatatgtcttgtgttatctattcttacccagggaatttgttgctgagcttttgaagcgcaggaggcgctgcaacagcagaaacctgcatcaggaatacaaagaagtgtcaggttgatagaatggacaattaatacccgaaaacatgtactccctcctccgtttcacaatgtaaatcattctagcattttctacattcatattgatgttaatgaatcattaacatcaatatgaatgtgggaaatgctagaatgaattacattgtgaaacggaggaagtaagtttaatgaacttacgactttaatctgcttgcttgtaactccacgttcaaccaacaagtcaatagcagcaacaattgtcccacctagaggaataggaggaataggtcaaatgtatctcagggaaaaatgactcattatagttatgataggagaaacattctgcttacacaagaccaatttatatttgtactagctactaacaccaataattaggttatgaaaagttatatatgcaatggtacaatccacgaactttgcagtatggtctcaaaaatgctatagcactgcaataaacagagcaagagtgccacgagagcccaagatttagcacactggagcttagcatttgaccacaagaatcacaacaatcagctgtttaaaatgggttcatgagacactaaactaaaagagttgcaaaagcaaatcttagtgtataatctatagtctaaaagatcataaacacaattgtttgaagttgaaaagtttgtggtgataaaaacttgctggcagaataccatgtctcacgtgtagaccaatgaagggcgttttgttttgtgttagtgaagcaagccaagttaaggagtaggagtatatgggatgaggctagaacagaggcttcatgatttgagcattatatatttgtcaaacattgcatgaccaatccaattcgttttcaactcagttgtaaaggagagatgctgttctttcctaacagaaatggagaatattcaaattctcatgcctcaggcaacacattgactttatgccacatttggcattcctcagatgtattcagtacttgagatgacactctgtaatatgcatgtaacatagaacaagaaatacatttatcgcttggttttgaaattgcattgcttattcaagttatttattgctcttgtgcatacagagcttgtgaattgcaaagaagaaccttaggcagcacataaattgttcagaagagctaaaaattaccagtggccagcattggatcaacaactagcacacgagtcccctctggaatcttgtctggcaagctgcattaaattagagtggaaaaggggaaatgaaagttactggagaacaccaattggcctggatatttaaattctttctgaacaacaaggaaaaaacagcaaaacagctggtatgaaagggaaaggaaatttattatcacaatccatcattcttactgttacaagtcaccagtatatataatcaagatagcctaggtttctcctatagtaattttaccacagaactaaagaacgccaagaactttgcattttgtaatattctggaatgcaattgagactagagcctggccatcaagcatatacacttttgtgaactaaaatcaaggatggcgatttacaaaagcagtatgaaaactagatgtttgcaagaagagaaggaacttagcacatacttgttcagatatatcgaaggttgaagtgtttcttcatccctacgcaggccttcaagttcagtgagacagacagataagaataattgcacatagttttgaagatgtatgttaatttggataagtagttgacaaagaactatgcaatattggatttaagagacatgcaaataacttcgattagatttcttttcatactagttgctaaatgcaaaaaaaaagagcttatttttcaaaaaaacatcattagaaagcagaataataatgtggcttggttgaagtagaaaatatctagggtctattatgcatatttcaactttatgtttctggcctcatccatgcatgcatatccagcattggtacttagggaactaaaacaaatgagtgattttacggctcttgaagaggtaccacattttctactgtaaaatttaataccctctcgatacctccggtactaggaggtaccaaaatttacattaaaaatattggtacctctcggtacctctcaaggactgtaaaattactcaaaacaaattgggttagattgcatgagtgtcaaccgtgcaatctatgtaacagctatgtgagcacaaaagttgatatactttatacatttgattctaattcagtaaacttcacataaccaacttaccaaggtgataagtcttggtggctggtagaactgatgaagcattttcagccatagcaagaccagctcttagtatcggaacaacctgttaaacatgctaatgaaaagactaaatatatttgtagaaaaaacaaatgccattgacacatctaacactaaggattagatttaccatgacaggctctcttgggtcaataaattcaacacttgaaacagctacaggtgtttggatctctcctgtgattgttggctgcaaaagttttagaacaatttagcatggcatcattctctcaacaatgaaatgtctattgactggcaaataaaaatcatgactaatatttacacttttttttatagagcaatatgcatctgtcaaagttgaaatatgtgtatatgaaaaaaaaatgcaaaaaaggcgcaaaatggaagcattatgagttacaataacaacttaagatatttgtgcattcaccgttttacaaggtatcaattatccatgcaatttcaatacttaggcacatatatcccttatatagcctaatttcaacttccaaagcatcagaaatgtaagatggatcctagaaaattaacggataaacgatcagccaagcgagtttcccactcaccagccaatctctggaagcttcatatataagcaaccgaccaagctccgccatggcactctctaccacaaaaacagattgctcaatgttatcctatcaaaactttatcgcaacaattagccaattaaatcagctgtgtaaaacacatttttcgtatcgccatcacttcaccactatcaagtatcaacacgctaatccacggcttcgctttaacgaattgtttcagattccacgtttctcagtaatactatcaagtaccaactcatacgtcattcagaagcacactcactgaagatggcgcagggcgtctgctcgttgcgcaggacggagacccagtgctttatcagcgggtgcggcggcacgaacacctgcgagacaaaaacatcacgaggccacccactttgagcttagcgcgcacgtgcacaaacgaattgacaaggacaagcagaggcagcgtcatcgagagagagagagagagagagagagagagagagagccagatccgcaccagcatctggccgccggaggagggcgatcgcgcccccgtggcggcgtcggggctcgccgctcttgccgccgtcagaggcgctcttggccttcgttggacgagccgcaggatgggggcggtggcggcgaagcgcgtggacgtggcgagcgcgggggaggggagggaggaggaggaggaggaggaggcgtgcgcggattggcggcgtggtgcgcacgggccgcggcggagaggcgctcccgctcccgcggccgcggccgtggcgagcgacggcatggcgaattggcgaaggacgaggtgcggatgcgggggacgaaagcgagggcagtgaggtgagcgaggtgtgggatacggtggggtcgtcgctcttgtgttctgacgcaaatctcgaggtgctctcatcaccgttcagacttcagaggcttcagccacgtatgtgttgggagtttgcgataatttttggaaattggtgatacccgacgtataaagacaacactcgatatctaaataatactacctccgtcccaaaataaatgcagccgtagatatctgtgtccaacgtttgaccgtccgtcttatttgaaaaatttgtgaaaaaattgaaaatatttagtcacacataaaatactattcatgttttatcatctaatagcaataaaaatactaatcataaaaaaattttaaataagacgagtggtcaaacgttgaacgtgaataatacaaaactgcacttattttgggatggagggtgtacatcagtatattatattaaaaaataaaattatttgtttggtaccgagttcactataatactcaatataaactggtagaatatgtgttaatcaatgtacttcaatttacacttaaaatattgagacaattattatataggtcacgtttgagcgggataatgcctattaggtattaaaacttaagcttcgtgctggcccttaagatagtgatgatatcaaatcacatgcctccatagccatctcaaactccacatcgctatcttagtctcgtcgaatcccatgttatcgcaatcctctcttctcattgagcttagccagattaatgttgtcggtggtggctctgctactttcatcgtagtagggaggaggcggttgggtaggaggggcatcaataaccatactctatcaacaaatcaacgttgttggtggagagaggtcaagcttcggctccgttacatctgctgtgctcggttgaggaggcgacgacaaattctgaacttgattttggtggaggcggtggagcctacgtctcactcgccttctcgcctctccatacccactcaagaggatactgcatgaactggttccctagtattcctatgaaatgtttaatgttggtgtggacagtgataggagctctagaacacatacaaaatgaccattttatcttacatgtatttgtcaaagtagggtaaaaaagacaatggataaatattgatcacaacgtcaaactcgttgagagtttgagaggggaaaagaatgctatacgatgattcattatatcaacaaatatgcgatactctaccgaatataaaaaaaaaattccttagagatgatcttccacagagttcgcggcataatagcatataatattgttttgtataagctgaaattctggctcatctatatatacgtgagacaaaatttttagcgcaaaaatggaaaaatcaaaatccaacgcgtagatagataggctcggcccatccaaaggctttgattggctatccccaacggcgatagtgggccaacgtttttgtgcataggctaccaaatctaaccgcggcaccaacacaccaagcctcgtgacacctccttcctctcgaagcaaagccgaggacgtacgacgacgacttccccacggccagagttcccctctttccccttcccaatcctccgatctcatcccccggctccggcgacgcggcggggcgatgcgtagctgctgagcgcgcggcgccacgaccccccccacctcgagagcgcggccatggacgagggctacgccaacctccccaccagccacctcctcggctccgtccccgtaaccgatcccctccctcccccctcctcctatccgcttcgcgtgtctcgttttttgtgtgatgttatgtggtgtgatgattcgggtgtgatggtttctgtaggccgccttgacccccgaagagaggaagccctcacccgtcgccgaaggtagcaaccccccctcgattgcgtgttgggtttcaaggttagtgccattgcgattgtcacggattgctgattaggtttcggttggaaatgcagttggcacctcgcgtctgcagcagtttcctcctgctcttggtggtactggtggtgttggtggaggaggaggagggtaccagcctccagggacccctgcaagtaacaacaggtcgcagcgttaaaagcg

SEQ ID NO: 77567 - DNA, 978 bp, Oryza sativa
  unsure (1)..(978): unsure at all n locations
gggcactgcgggggtggtgtgatggtggttaaggggccctgctgcggcggtccagcgccaaaggggcgttgaggtggcacggccgcgaagggcgccgcaggggacgcagcagcctgcgcggggctgaagcggcgccgaacgacggggacggcggggcagcggcggcgccgggcatgaaggcggagacgggcctcccgggtaccccctgcggcggcctatcgttccccatcggcggctgcatcgtcgggcactccgctgctgtcacgcattgcttggcgcagcttcccccactccgccgcctccgcgtaacccgttgccgccgccgctccatggcccccgccttccgcccgtagataggctcagcaatacccctgtctgattcccgttccgcacttacgtttctccgccggaatccacagtagcacccgtcgccatgtccggctgcaaccgccgcccgtcgccccagccaaccctatcccggcccctcgtcactctaccttggccaccgacggccgtaggtctgcgcctctgccgcaccaaccctcaaccccacttcccttcggaaactgatctcctcctcctccctggccgccgcggtgccgtccacctccaaaatccctgatgccggagttacatttggtagggggaatagccaaataggagaagcacacaacctctttgggagccagtgggctgggaatgtnngttctcgaaattggaaatgtcgaanccgnaaaccccaaaggggggccccccgccaccgactccctgacagcctccaccccgcggcctgagagagagaaagagtgagagagaagagagagaggaagagtatgacatgtgggtctcacattttgagatnaacanaatgctgactggactggcacgcgtaccccacgtacaccaaaaccaccgtggattaggtcgaggagggaaattcatccgatttatatagttggggatgaagaatatccggtt

SEQ ID NO: 77568 - DNA, 10213 bp, Oryza sativa
tcctgcacccccaaacgaaacttggcaaaaaaaaaagaaaaactcatgggcataacttttctactcatgctttacttacttcagcagcttcaagagcctgaatgcaccagtagcacaagtgctgaagctccttttggattgatgattgtttgcaaatggtgggattcttcccactgaatcaagcatacgattttgagttcgggtagatcgattggccattgagttactctgaaagatacggatctgttcaagatcacgcccagaattagcatctgctcttgcatagactggatacaccttcacaggacacagggttcgtaaaactgatctccaatatgggaaaaaatttctccttgtatacgtgggatcccatcctccgcctacttcctttctcccagcctgtcacatatttcaatataagtacagcattaaaaaaaacagaaacatccatatttcagcgtggtcagccatgatctctcgcttgagattttgttagatagtccctttatcccataatataaggcatggtcaaacttgacacggtcttcaaaactaatctttgtcttataatttctcatgtattataagatttgtagtaacaaaattataaccatatgaaagtaaattcaaatgtcaatccaatgatatagtttttagcaagtaaaattcaattcatattgtactaaatgttgaccaaaatgttttgaaggtgaaatcttgaaatgcgtgggcgtcttatattatgggatggagggagtatgaatgatttcactacagtgtactagtacttaagtagtacgcttaagcaacatgataagctgttgaaccagcacaaggcatgccacgaacatagcaagcaaaacatggttttgttaatgcatcaaacaactactaatattacactgcacattcctttatcagaatcttcctcacagacaaaaaaaaaatcagatccaacaaatcattcaagaacactaataccgggcgctagtttaatttcaatatttgtattatttcctttactttttattgcattaccccttttctttggtaaagaacctgatgagaaacacactagtctcgatcacattagcatggcagagatgaatcatagttgaaatgcgtggcattgcaataggccatctgtatttggaggcaattcaaagcaatgggattcgtcaaatttttcaatttgttacctggttttgtaaaaaagttggtgtatctttttttaaaaaaaatcaaacaaggggagggcagaaattcctatagctaactttctgctgccaatttattactagtcattagtcattaccaaacaccattctagtcgaaacaagaccaaacgcagttatcacaagatcatgtatccacaaaaaaagaagaaaaatatatgttagcataatgtaactaaagcaaagacatttttatctctaacttacctattatattttcagatttgttcacaagatactacttctaggacaataccctgacatataagagttcgcattgctccatacaaaggatagtttaaacatgtaaaggtacagaaattgaagcatatgtgtagaccattattggcgaaacaccgccaagaccaagaacttccacaggggggtgtggactagagataggtcttcagatcataacaatggactagtaaccaaatctgacaacagactaatcatgcaagtgacttatccgactgctcccccctgcacactacagtaccacaaaatactatttgtgtggactatacctcacctagtacagctcacaacaaggcactttacagagcaaggtgaagatagagatgctctaatacagtagtatttgattatctttaccttttcctccgaagcgtgccgattagctgtttctgtaaatgccatgtttgcatctataagccatattctccataaaaaaaaagaggttagtgctaattttgttaaatgtaaaaagaatcacttgagcccaacacacctttgctacatgactctctctccatttcgcagtcataaggctgacttcaagaaaaaagtggaagacaaaattaaataatcagcaaagtaaacatgtattctcatagaaaactattgtgtgaagcaatacaaagagaagtacaggttcatagtgtcaatgacttctgcagtggggtaaaacccatactccttgaggatagttgaaacatgttccaaaacctccacatggggcgcctgaattgacataaaagctgttgtataagctagagcaaaaataaacagaaaaggcaatatgccgctagcatagatatatcatatatacaatttaggaatcatataaccaatgatagcagagagatgatggaaagaattgttcggaggagaaaattgcaattatacaatatgaattggaaggcaatagaatagtgtgcaaaaaacagtaagaaacatacaatcgcattcattttgctacatggttttatagactacataacatacatattcacattcatctagattgatttatcttatagttatcttaaagcaaagcctcttagattccaaaagttctgtaatcagagattataatctacacacttcaaaggtacgagttaagaactgcatcacacttctgtatgtttaaactttacagtcgttcagttattcaaattccaactgtaagcattcgaaatcacctcgattgttttatctttatttctcaaagagaaatgtgtcaatttcttcaggctttatgatataaaatgaagttcagacagacttaaagaggtcatgaattgcatactagtgtttgttgagctaaattgaactgtcctctggggtcacagacaagttacggtatgagctctaactccaggtttcttgaaggacctggactttataggctaaataaagtgccttaagcatatattttcagttaacaagaaggttaaattcaaaatctaaatacacccccagctcaagcaccaagaatacccagctcctaaaattcttggagctggagcatatattttggccatgaaaacatgaaagtgcttattttggccaatttatctgccaggcatccagaaaataaacaaagataaatgaaacaagtgcatgccttttgttcatatgcaccatgtgctattaatagcattaagggtgtgttcaggaggaggggttgggaacccctcctctccggcatgcaaaaagaagcacgcatgagcatataactaattaagtattagcttttttaaaaaaatgaattaatgtttttttaaacaactttcctataaaacttcgcacaaaaacacaccatttaatagtttgggaagcgttgcatggaaaacaagggaggtcaagttgggaagatagacttaagaacacagtctaagcctatcaaacactttatgttgattgctaaaaatggtactcctactaggaagtgacaaccagaaaatagacataagggaagcttcaaaaactacattggcatttcacactgtacatgtgaagtgatggacagtgaagtggatggaaagttttttaatctaaataacatcttgcgtatttgaaaaattaataagaacagaatttagtgataaaaacataagaaaacacgctaaattgatttatactacatattgaaaaaattccaaagttttaatatgaaactacaccattatgaccatccagcatagctacagaagttcgctatatatattcatttgtaaacacaaggtcagcaattttagtatcaaaccatagaatgcttgtatctacagaaccacaaattgaattaatctagtaatgagattaatacagattcattagctgttttacatatagcatttcatacaaactaaaaagtagattcgttatttatggcataatcatgtagtaatcagttatcagatgcataaaaaatgtagtaaacaaaagagatatggttttaaagcaaactccatccaacgcttttaatttgatagaagatgaaaagtaatcctttttatttcaagtcatatgatttcaacaagagacaactacatcttctcaaattaccactgccttctttagtgcaagcagcaattacggaactcaattcctttacattagttactatgggtggttgagacagactgattcaatgaggtagcaatagacaactttagtagggacatatagtctcctttttgttttcttaatatatgtgcacaaagcatcaagtaagaaaaaaaggatacatctcagtgaggaacgagcatactcaaaattttcagaaactacacttcttgaagaaaaatcacaaactacgcattctttcaatatattgtcagaaaactggacccttcttggcatgagctgcaacattaggcccaaaggtcaaccactctgaggtcagtagagccacatgtgcatgacatgtggttcatactccctccttccaaaagtctaagttctatttcattctttggtttttccaaaagtctaagtcctatttgtagtcactatgtgctatattatattttttatcggaactcaaaaagtcattttagtacttattggttgcatgttcatttggttttgtcacatgatgaatgagttaattacaccttggtcttggtgcaaaaagaaatagaacttagacttttggaaggagggagtaattgtcaacactcaacagctggtaaaatgtgcagctttatgataaataaatataaatctgggataatggttcggaaaaattgttcagtgataattttgagcttggaagtgtaattctctgaaatttatgtaaaaagatgggcagtagttcatagataattgctgtaagaaaagttcattggtttaagcaagacacctctcaaaacattgaagcaaagcataaaacaaaattggcataaaatcaaatgcaaggttcaatgaaaaataacacttccatactccaagttacaccaaagattaagaaaacctcatgtagtcatgtgtattacatatacaatagttcagtacaaaatataaatgtgttgcaatattattgttaatttaggcttggctttcagataaaatacaccaactctggaattcagatattaaatctcatatcagtaaacaacatcaactacctgtgaaggttgagtttcctccagaatctttcttctctgagaagctagttgggaagattcagggatggaaatatggaatagaacctatctcatgactaatgaaatcctatctccaatcaagagtcttaggtattcaatgcccctatctccgatcacctaacagaacaaacaaagctatgctactgaatgaaacaagagtctggttgatcggagataggatttcagtagttatgaaatcttgcgaaactgttagttttacaaaagttcacttctgtatagatttgttaaagtatgaactcttatcacaaagttatcaaatataacatttattattattattattattattattattttcagtcaacacaagaattattaacattcttcttgctaagaccacatgtattttttaaacaacagctcttacaatggtcaaaatacaaatattaaaaatattaagtaacatgcgtcagaggcaccacagctgcaatataccaaacatgcatacctctgaatgcgcctgaacgtatgcagaaagaggttcaccagcttgggaaattacatcaacaagcaggcctgtgcaatcaataagtgccctcttttcctcccgaagcttctgtgccattccatttgaaactttcccccatctcaaggcaaatgaaagcctcagtatacgcttgtacataatgtcatacccatttttctttctactgccatttatcttggaggaacatccccctcggatctgctcctgagcagccagtagtagaattgcggtctggataagttttccattctcaatataattccagagctcttcaaggagattatttgtttttcctgcaagtagtctagttgtatccaggaagatcttctgttaaaacaaaaggaacaaaaatctaagtgccatttagcatttttatgtgcaagcaagtagtgccgattaactttctatatatggtttcatttcttcctatcaaagtaattatggattagggacaatcttcctatcaaagtaattatggattgaggcaaagaaaataaaattacttactagcaacattttagtatattttattgaagactctccttgtctttaactatatgaagatgcactaacacaaagtaagacaaaagattaacaaagggaaactttactccctctgacaagtggagacaaaaggatgtttagtccttaatataactaattcataataacagctgtctgggatctatggcatgacaacagttaattactctttatgtcatgctgcaaattaaaagtactccagtactttgcatatatatggagggaagagaaacaaaccatttcaggtaaacacagcagatggaaaagcttgtagatataatccagatgatcctggccgggagaaagattgtcctcaagatacttatgcaggcaagtgttctcaatcgcgatatggagcaggagtaggccatcgatgacatcgtcgccaaccgtgcgtacgttggctgatgcaccatggcgtaagagcagcttgatcatctcaatagagaacctttcagcagcttcatggagcgggaagtatccatatttggttacgcagttgggattggcatgcaccccaaggagctcaggtgccctgccctccaatacaactttcgcgcatcgcagggaattgaaactgaccatgcaggttaaggtttgtgcggtgatggtgagattccatgacatggtatagcccttccagttcttgaataatcggaggaagcaacgtgcactatcctttataaagatgggctccaattggtcatatttgtccaagaaggtataacacatccactagatggatccatcacattcgaaaaaaaattgaggcatcagttatccaactaacaaagcacaacaaaataaactgttttgaggtttatggaggtgcatatatgacaacaacaataacaaaaccttgtgagcaagaaagttggggtgggctagagatgaaaccaaacatgaagcacggagaagggaagacagaatataagagcaggtacaatagcagactataaaccagttataaacaaatatcgaggaaataaaagaggagagagaatagcagcgggctacagatttatagccagttgcaacacggactccaaaatataatgtgtgtataacaggtgggaccatgtattaatagtatagtatatgtttataggtgactattgtatgaattggctattaagttgactataggtgatttggagttagtagttggctatactattaaacttgctctaaggggatctacagcctatcatggttcagacatgtgaatccagatgctcttatttaaggttcatattatgacagcattaaataatcaatggttcagtagacttaagtaccctataatattacaggattaaacaaaataattaatataatggaatgattcatcaattgaattctgtaaatgaaggtaacacaaacctcgggagcagggtctgggatgattatgtcatttgctatggtcttggcaatcgaaatattcctttcatccataaactgaaagagacaatgtcaacagtcagcactaggggaagaaaatatatcgtggctgggtagttatcataccttgtcaatctttttataatctaatccctcagcaagttcaaaacgagggggagggtgccgtggatacttatttcttactggaattgatccatctttatcattgccattatttttgtcgcatgcagctgcctcctttttccacgtagcataatcgggtgccttaaatctcaactccatcctttcgggtttactttcctggaacaaggaagtttgatctcgaatcacactccaaacaagataactggagtacaaggcatgcaatggtcaaagaatgatccagaagaccatgtgataaaaatgagtccttccatctaaaatggatcagacatcactgaaacatactaaaacatatttagcgaatagaaagcatatggagactcagacttcatacatctctatcctgagatgtaacaatgctatatgcgaaatgaagggacaaacagtgctagaaactcggatgcatataaagtgtatctagaaacgaaaagcgaaaagccaattttgagagtgcgaatataaacaatggaaaatatagaaaccaaaagctaaatttgggagtggaaatctagaaaccagaaggctatggaaatatagaaactaaaagctaaatttgagagcgctagaaactctgatacatagaaattatggaaatctagaaaccaaaaactgaaaaatattcactaacacccagattatttttttcttggttgggggaactgcagtaaaaccctagcttccagatctgggagagaagataagaagttaaggaaaattcaaaggaaagaggatgcgcatgcttcgggacgggtgctcaccggaggcggaagcagaaggacgacggcacccacctcgcgggagatggatgggaagcggcgcaggcggcgaggcgaggcgcggcgggcgaaactagagaagagacggtagtagaggccgagaagaccgggagattgacttgggccggcgcaaggagtatcttcattcctatatagaataagttcactttgagtccctctatttgtcgcccagtcccattttcgttccttggtcgcaaaacagggtacgacgggtcccccaacttacgaaatcagtgcaaatgaggtccctcggtggtatttagggttgaaaacggagcggatacggatggataatgctcataccatattcgttttcgtattttttaccggatacgaaaacgaatatggatagctcgaatacggaaacgaatacggattatctcgaatacgaataagaatcgaatatgatcgggcacgaatacggaaacaaatttttctcggaacacgaaaaccaactcaacttctaatagaaacaaataccaacatatataattagctcattttatataaaatgaagtataatttataaatattttttaaaatttaaataatattaatagtatggactagtgttaagagataaactactattaaatatatataaatgtatattgaaggttctagaattaaaagaaatggggtatgtctcatggctttggggatatccgaaatatttatccgtttcccacggaaacctttatcccaatttgtttttttttccggggaaaaaaatcccgtttttttttccgtcccaaaatttccaaaaatttcccctcccaaggggtgttctttttcctttttttccaaaaaggggagaaaaatttcccttccattttatccctagagggattgggccccggtttgcctaaaggggggcctacatggctcctttgactaatcctttggcttacgtgtcattgacgtggtgcttaggtggcaattaaataaaaaaataaaggcagcaaaaatgaaaataaaaaaattaaacaaaatatgtgggacccacatatcggtaaaaaaagaaaaagggcccacatgtcagtgggtcccacttcttcaacctcaccctctctacttatttctccttcaatgacgccggcgtgagagaagcggcgtgcggcgggcggcaggagaggagcggcaggcagccgaagtggaccggcgtgcggcgtgcggtgggcggaagacaacgggagaggaccagcgggcgacgggcggcagtcggcaggcggctggagtggagcagcgtgcggcgggcggaagatccgcctcctcatctccatcgtcgcctcctctgcgatggcgcatgccactgtcgctgccgtcccggaagatccggcgagggaagaccacaatcgcggaggtcgccgccgacatctccctccccgcccgcagccatcatcagccagagcggctccccattgaggccgccatcgacatctccccgttcgcggccaccgtcaactagagcggctcctcgtcgaggccgccaccaacatctccccgcccgcggccgacaaggaggaggagagtggctcctggccgctagcttgctccgccgcccttcttgccgctagcttgctctagtcgccggccgtcgtccgctccggcgccgcccgtcctgcttcactg

SEQ ID NO: 77569 - DNA, 8754 bp, Oryza sativa
aattcctgcagcccatggaaatgatgggttcaagagcacatcgcactccggaagaaataattttcgttgcttagcttagtgatggcgttatattctatttcatttcgaatgaactacgtcccatgattttcctcccgaatactattaatatggctgcaaagtattaccctggtactgctttgatgttttcttttaaggttcatgtgcaaaaaagtacttagggagttagggtagagcaaggctcacaaaacagcaatatgttgattggatagagtagctccatagaaataaatcttgcagtgtgatttttttatcttgtagatagccaagaacctcagagcatcatttgcttgaattatttgtttgaggtggctgttgtatggagtgctgcctagtgtgcactaaacaaaatgctcagatcctcagagaaaaatatgatagtggactagtggtattctaaccatttccaactgatgcaagaactacaccttctttttcgttatatattactttcaaatttgatccctgtcaattgttatgtttcagttagtgcaatgattgcactttactcaaagctggatcttagatggtatgatactgattatcttttcccatgtgttgctccttacttttgcagatggagatgtagaaactcaaacaaattggaaaggatacttcaatgttgcatcttatgctccatatttcaatgttgatactgatgttgtagttgacaggctcatcagctcggtttatccaatggatgggtttttcaggaagattgatgctaatcctgacatgtaagtatctcctattaggctattaccaatctgtggtcacccttcacgtttaaaaaattcgaccttaagtacctgctggtattgatgtcataatttctaatgaatggattcatgatgataggatacaattacagcgaaggatcatagaattgtttgtctacattatataatgtgttgttaatgtgcaagtgatgttttaagttgcatataacatgccataaatatgttttgaagcagtttcagcgtgacatagacatttggataggtgaagtactgtatattttacaaaactatgttgtaacagtgctaaggcatatgctgcaataatcgagattatttatctaggactagaagcatgattttaaggaggagaaggacatgcaggttttttcaagggacttttgacccattgttgtattggtgcatttctgtagtaactcatctatgcttttgcattgtaataattttgatacctggagccaacttattcatatgcgataaatcattctgctgtttgcaggtatgggcccttatggatcacaacaacactgatattcatgctagctgcatttggaaactttgccacttatctgatgcaaaggaaaacagacctgaacatatggagctttgatgttggctatttcaactgggcagcatcggtcatgtatggttatgctgccgcagtgcctgctatattctttttcctgtttcagtattttggatcacgcccaagccttgttcggttttggtgcatgtggggatactctctgtttatcttcatcccagcatctgtaagtattcacagtaatccatttctttgatggttcggagatgtagtctcagaaataactgtcagtgaaaataatccatgatgtaccagcatttaggcttgcacctcctgctcctgctcaagaaggctgctatgtctaatgcaggcactaattttctttgcttcaggtactgttacttattcctgtggaatttcttcgatgggtcatcataatccttgttggtggtgcttcatcttggttcatctccttaaacttaaaggaatgtactgagggagctgatatgatggttttgattgctagtgctgcagtgctccagtttactctggcactgttcatcaaagttttctttttcgcctgagattgtcttttggtgttgctcaggtctgcctctcttttttaccttctacgactagataccatagcatcataaccttcccaacagtacacagaccacgcctttatgaattttatttagtagtcttttattgtagcagttcattatcaaattgggttaaaatattctaatacattatattttgcttttgacaggtgagcttgatgttttgtctgctccaatcattctgttctggcgagcatccttttgaggaccaagcggagtagttttacttgacatacatattgacactagattgatagacctttgtgttttgtgttcatgagttttttttactcctttagttcacagaacttcactgtatgtttcaattcggaattgctgagtttgtcatctaaaattgcatagtgaaccttcgaccattttgatctacaataaccatttgactatattttgacaaatagcgtgttcctgctcttggttgagtgattgacaccttttttttagtttgaacaatcagcgtctctgtagcatcatttttcaattttcatgttatcgtaacctgctatagtcattgaggtatagtttatatcagtgtatgggtacataacatgcggttcccaacgactacctcgtttttgtgcatcacaatatcacatcactcttcatgtacaaaaactgaatgccatcagtgtggcataaacggagttcttctgaccattgtaaagtttgtctccagcctgcccgcgaaaatcacgagtctggactgaattatgctcaattctaaacattcctgtagatccttgagtgattaactcttttgctaggattggagaagaacgataaaagcttttacacatatcatggaagaaacctttgtagtgaatgaattgcataatcgtcgtagtagatcccatcaaacgtaacgtgtgtgagaacgtaaaactacagctcaaatagagctacgtttgttaggagactagcagcaacgcctccttggtcacagttgttagcagaaggctgcaaaactggtcactggtgctaatcaaaaccgcatggctagcctggatgggccgagacaagccaatgctgtcttagatgggcctagccgggcctaactcctcaaatacatactggtcttaatgtaagcccaagacagttcggtccactaaaaaatactatctcgctgagtagactgaggcacgcgtagaaaggtaatacgcaagctccttttcaaggcgtaatttcggcgagctctgcaagtcttgaagacgtaaagaatgtctcatcatcatcggtcccttgtccgttgtgctcgatgggctcctccgccgccgccggccgccgcatttgccgtaacctcgccgcgccgtcctggtgtacaaatttttcctgcacacgcagggccgcagtgtagagtccaatccaatccaatccaatctccgctgacatctccccactccaagcccacacgggccacggccacacatcgacgctctccgtccgtagcatgacaccaagaaccgcggcggcgctgtcaggtctactccgcggcaagaatgcagtgaacctcgcaccagagcaggtcccgaagctgcttgctacgcgcgcgtcacctgcccgggtggaggatggcgtctgtctccgtgaccctcccggtgcccgctacccgctcgacgaaattcctcgccgggatgccgcggtgggcgccaaccgcgtactcttcgactatgcgcggcgcgggatggtcctggaggtcctggatcagttctctgtcgcgcgccgcggcggcgtgctggttgacagcgccacgctgtcctgtgttctcaaggcttgcagatcagtgccagacagagttcttggggagcagctgcattgcctgtgcgtcaagtgtgggcatgatcgaggtgaggtcagtgccggtacgtcgcttgtcgatatgtacatgaagtgtggtagcgtctgtgaggggatagaggtgtttgaaggaatgcctaagaagaatgtcgtcacgtggacatcgttgctaactggttgtgctcacgcacagatgcattcggaggtcatggccttattcttcaggatgcgtgctgagggtatatggcccaatccattcacattcgcgagcgttctctctgcagtagcgagccagggtgcacttgatcttgggcagcgtgtgcatgctcaatcagttaagtttggatgccgctcgtccgtgtttgtctgcaattctctgatgaacatgtatgcaaagtgtggattggttgaagatgccaagtctgtgtttaattggatggagaccagagacatggtgtcatggaacacgttaatggcaggtcttcaattgaatgagtgcgaactggaagcgctacaactgttccatgaatcacgagccaccatgggaaagatgacacagtcaacatatgctacagtgattaagttatgtgcaaacctcaaacaactggccctggcacgtcaactccacagctgtgtgttgaaacatgggtttcatttgactggaaatgtaatgacagccctcgcggatgcttacagcaaatgtggtgaattggctgacgctttaaacatattttctatgactacgggatctcggaatgttgtttcatggacagctattatcagtggatgcattcagaatggtgacattcctcttgctgttgttctttttagcagaatgagagaagacagggtcatgccaaatgagttcacctactctgcaatgctgaaagcatcactatccatcttacctccccagatacatgcccaggtcatcaagaccaactaccagcatatcccatttgttggaactgcacttcttgcttcatactcaaaatttggcagcactgaagatgccctctctatattcaaaatgattgagcagaaggatgtcgttgcatggtccgcaatgttgtcttgccatgcccaagctggtgactgtgaaggtgccacatatttattcaacaagatggccatccaaggaatcaagccaaatgagttcacaatatcaagtgtaattgatgcctgtgcttgcccatcagctggtgttgaccagggtaggcagttccatgctatttcgatcaaatacagataccatgatgcaatttgtgtgagcagtgcacttgtgagcatgtactcaaggaaagggaacattgacagtgctcaaattgtctttgagaggcaaacagatagagatttggtttcatggaactcgatgatatcagggtatgcgcagcacggttacagcatgaaggccatcgaaacatttcgacagatggaagcttcgggtatccagatggatggcgtcacattccttgctgttatcatgggatgcactcataatggtcttgttgtagaaggccagcaatactttgactcgatggtcagggaccacaagatcaatcccaccatggagcattatgcatgtatggtggatctatatagccgtgcaggcaagctggatgagacaatgagccttataagagacatgccattccctgcaggtgcaatggtatggcgcacattgctaggtgcttgcagagttcacaaaaatgttgagcttgggaagttttccgcagataagctgctatcgcttgagccacatgattcatctacatatgtgcttctctcgaacatttacgcggctgcaggaaagtggaaagagagggatgaagtgaggaagctcatggactatagaaaggtgaagaaagaagctggatgcagctggattcagatcaagaataaagttcactcctttatagcctttgacaagtcacatcctatgtcagatcagatatataaaaagctcaaggtaatcataaccaggttgaagcaagatggttattcaccgaacacaagctttgtgcttcatgacatagcagaagaccagaaggaagccatgctggttgcacacagcgagcgactagctcttgcctttggcctgatagctacaccacctggaacaccccttcagattgtcaaaaacctaagggtgtgtggggactgccatatggttatgaagatggtttcgatgattgaggacagggagatcatcatgcgagactgcagcaggttccatcacttcaatggcggggcctgctcctgtggtgatttctggtgaatgaagggcagaacaaactgactggataaggtgtacgccctggcagtgccaatttgaacaatattactgtgagttgacattagagtattgggttgtctatagttgatatcagtacaagcccacaaatagtgttgtagttgcttgtagaagcagagatcagtgttaatactagagcattggtttgttagcattgccagagaaagccagttgccacaagtggtataattgctttatgcagaaacaggaataaacttgctctcattttttttggctttatgtttgatgaagtgaaaccgttcatcaaagcagcatgtttattaccttctcaagttttggcatgctgaattacaggaatctacagctacactggaccgcaaagatatagaagttcttttcaccagttcagttatgcattcataatccacaacaagcagttttacttgtgttttaatattggagtggctctacaatgcctgtgcaaagaacaaaattgtcctatgtttgaatgaatgtattggtaatctgatggcctcaataacactaactatattcaacaaggacagttttcagaaataatgccatacagtagtctaagcaacattttgtttaacaggagatgaacaaactcatgagaaagcacctccagaagctcaacttcactgcaccagtcagatccaggtaatccacattttttatttgactcaaccattgcaatggcagtttctcctgtaggaggctttacttgtgcttttctatagctgcttgttgcctccaaagtacagttgtgagttgtctagaatagtataatgcgtgtgaaacattggtagttaatgccctcttggatagaataggcgtatttagtccttcaaattaaggagttgtttgcagtagtatgctctattctatccccttcacttcagaggatctttttaataatttttatggatacaagcattcatgcatatatgcaagtgttgtaatgaaaatgggcacttccttcattcatattagtcatgtaatcgtgctttgcacgtctttagggtcccgtttaagaaccctgtattgtgccatttcaacctgtccatggctaattgttactgttatggctctgtgtaaatctaaccaaatattacactctgaactaaacaataaagtattcaagcttctagattctagagaagcctactgtattcattgtatcattcttcagtaagtaactcacaattagatccagcaggaagtatgaaatgcaggcagacaggtttggagtaataatgacaaacacatgcataaatcgcatattcagagttcagactatatgaatatcatgaaaatgtaggcacctcgttcgtatgaagcaaactgttaatggtggaggggaaaaaaagcatgattcagtttaggtgtgaccgtgtgagcgagattaaatctcgagcaaagaaggagaagaaagttcctgcctcaaaattgccttcatcctccctgcgtctcggcctctgcttctcttgctgctgctatggatgggccagcaatggcctggagatggccctgcttgttgtcaggatctggaagttcagagtagccaaatttctgaatttttgctgaagatcaggtctctaatctggctggggctgacatatcatcttggcttgacacaggataaaatgtgtcagctaggcatccttacactctgcctcctgctcgcccacctgctcatgttcctcctctgcaacttctcctacttccgttcatccttttcctgttcctcctcccctagcctacagaaaatacaaggaaaaacatgtttgagatgtgtatcctaggaaaacattttgttttactaagaagtgaaaagaccaggtaattgtgtaggaattgtgatgtatattctacatagggtatttttgttgggtgttggggcttgaaagagacatgatgataccagattgagataagattgtcactgatttttctttttgggtggtcatgcagccatggaaggattaaaaatcaaaggaatggaaatcattgttgtgctagtggctctgggtacgtagaagattcttcaactgcatgcagttcatctagctccaattgactatgcagttcatgaagtgcagtaagctagagctgatcaggtatgtttacgaagatggaatagtgaccttgcagagggaacatcatttttataagtcagccacaagaattagagatgttatatttatttgatgttgggaatacagaatgacatttgaaggttttgacgatacagatttgaataccagcatataatggtgagttgaatattggcctgaatatttttaattggctgtgccaggtccataacaatgatatcagtataaccaggagttgttgatgttcagaagaacaggacatcatgtatacttggaaagtacctggggaaaatgtttagaagagatgagcaggaactgaaatctcttggtgagatttaggcttgcacttcctgctcctgctcaagaaggctgctatgtctaatgtaggccctaattttctttgcttcaggtagtggtacttatccccgtggaatttcttcggtgggtcatcataatccttcttggtggtgcttcatcttgggtcatctccttaaacttgaaggaatgcactgaaggagcggatatgatggttttgattgct

SEQ ID NO: 77570 - DNA, 3275 bp, Oryza sativa
atgtgggcaatgctagaaagtcttataatatgaaacggaggaagtattaagttcgcttgatgttagcccaagcaatacaatcacgcaaaaattagttagaagctaatttatttcttcacaacctaaaacataccctccaactccagtggtattctgcatttctcagcccccatttattttctcttttatttcaatataaactctatatttttgcgactaattcaaacataaataaatatttctaacacttcgaattgaacaatatttaaattcacaatttggaggcgggaaggagtcgggcggcggggaaggacggtgaccgcggcggctggacggcggtgaggtggctggctgtcggcaacagcggttgccatgcctgcggtggaagaggcacggtggtggtgaccgtgactgcggtggaaggaggcatggcggtctcggacggctagccgagggcgtggcagacggacgcacctgaccggcgcggtagcgattggaggggtcggagaccggcttggcgaagagaggcgcaaccgatggtagtggaggccggcgaggcgcagccggcggagtggaggccggcttggcgcgagaggcgcgccgatggtgggaggccagactagcgcaagaggcgcatttggtggtggaggaggccagtgcagcgtgaggaggcgcgaccggcggtaaaggaggcaaccacggtgtgaggaggagctgccggtgggtgtgtcgcggtgttcggcgcacgaaggctggccggcgggggatgccggtgcagtggtcccacatgcctgcagaggttgagcggtggtggagcatcggtgcgtcagccattgactcgcaggtgatgagcagcgggtgaaaacctagttcggccttggccgggccgacaacgatggttcattccctctcatgagggcgttgtcgtgccgtctcatccctcaagggtggttgccttattgccaggcgaaagcccaatctaggctcttttgagtccttgacggacggcggcggcggttttccgtcgcttctctctttggagacatcgtttaggcatccccttgccgaaaccactcaatcgattggtgcaagcacgctctaggatagagttaggctttgtgttggttgtaagggagtttttgggcgatctcgtctgtgttcctttgttggcctagcggcggtcagtcacgcttagcggcggctggtccggtgctagccttctcccggacctgtgtgttggcgctggcggtatgtgggtggtggttttttcatgctctatcaatagaacttgtgcgagtcgtttaaaaaaacaaattcacaattttaaacaccgcgatttaaattcaaaatctaaatttcaaatgaaaacgtcatacgtacaagaattgaccaaagttttcgacacattaatcacaatcaggtttatactaattaataacatatcaaaactcttaacaaataacatatggaatcacttaacgaagttctcgacacgaaacgaagttcgataaagaaaaataaagagttaattagatccatgtcattgccaaatatgttgtattagaaaaatatcagtgctatttataaaatcagatgggtgccacttcaatcttctaaacttaaaacaatggcactctttgcccctgtcatgaagatgcatgccgctgttgctcctccgcttcccctttctgcaggccactccacatcacagcgatgctcaccgagctccctgtggaggaggacgacacgatgtctgattctcgacatcgtcggattgatttatcgtttatgttgatatcgattcttcctcactttattgcgattctctacaaaaggttagtagacctaatactagtgaaatattatcactagttctcctctattttggtaatattgacggtcgaaactgatcgataatgaccgtcaacaaaaccctacaaatttgaacctttgcttgtccttgggcgcgggccgacatatcggctgcagtgagatgaaaggaaggagtagaggggccatctctcctctctttcatcccgaaaattataaaataatacgtctagtgtcctacggccaattacacaacttttatagtgtccatatgtagtgttaattttttacggtgtccctcagccaattacacgtttttttcgtgtcccgtaacaaattttggcaaaaaaaaaaatcatggcggctactgttccaccactgccgcctaccggggggggggggggcgctacggcaaagtggtccaaaagcatgacgaaacgcggccgcactgactgacctggaagttggttgcgcgcttgcaagcgcggcgcggaggaggtggagaagacgccggctgcggcgacgccgaggacgaggaggaggaggtggtggaggcgtggcctcgggtgtgatgggagagaagccggcaaggcttgggagaaatgcggtgcacggcgcgtggaccccacgtgtcagtgggcctgcccctgcgcttctctcgcttcgcttgcccgagagaaacccaaaaaaagggagtcgctggaatagcatagcttcatggttttttgcatttgtaaattgtttttttcttttttcatggaccaattgagccaagggtaagtacgttcgagaaaaaaaaagaaattgtgaaaaaacaatttgcagatgaaaaaaaagaagaaaagtgacattacagttacagcgaatgcccgctgtttaagagtggcattcgatcgaatcttattttaatgatgatgttttagtgatcgcgtgggagataggtagggagaggtggagatggtccaccacgtggcctgcgaacccatccatctgaatcacaaggggtcctattcttttccccaattctctctattttttggtgggggtcaaggtatgtgtgtgaaaacggtatggaaactttccgaattccggatctatttttgaaaaaagaatctatcggttggattttttttttagaatttttcggaaatggaaatgaattcggaaatattttcttggaaacggaatcgaaaataataagggcagctttcgtcggaactcggaatcggtcggaatctttccggaaattttcttggaatttccaaaaattttgtgactgaaataccctggattcttttttttaagcactaaatagttaatcctatggtgtttggctgttattttttaaaaaatatttgttatgccactccgaagttacataagaatattttttcttgtattaggatttatcaacaacattactctattaaacatagggggtgcag

SEQ ID NO: 77571 - DNA, 1989 bp, Oryza sativa
agtcaacggtgtcaaacattttgaaacggagggagtagtatttagaatctcaccttgttgtagattattttgagtctgtgttttagtggcaagcagatgaagagagcagatgtactatttcatcccaatatatacttacattagttttagtagcatcaatctttgaaatttttaggattatatgatatctttcttaagcaataatatatatccatggcaagagtactgcatgccacattgctacactgaacatgcttaatcagcaaaagaaaacctgtagcaccgcacgatatccacaaaatccatcgaactaattaaacaaatatacacggacaggaacggctcaacaattcaacggatcactgatgaaaggattgatgctctagctgctacacatggccaaatggtctttctttacaacagcagctagcggaggagtgttgtttgtgtgtagtgtttgtgtggatggaaatggagctactagtcctacatggataaactccgcacgtcagtcgccctggtggtcgtcgctgcatgcgctttctgcactttttttctgaactttttgcttacaaaaccttgcgctttttgcccttttccccgacgagttgggcggttatggcgagggttgggtttctggacgcaagttggcagcggtgtagcacgcaggattgattgcacgttcgttgcagcattgagaatctgctggctttcgcataccagcggccggacgtgtacgacgccggttttgggctcgagaccaaaaacgggtggtggcgtccttgcctctattgggctctgacgaatgctatgtttatccggatgaggtagttagcctactagtagtagaagaatatttgtttccgttttaaggcttattgtttgattaatcgccgatcgagattgtcatagtggagtgctactctacgagttgatgatgggccgaccaacgagaattgcttactccctcaatactaaaaaagaataaaactatttttacacctttcgaccaagcataactttttttatttaatttattcaattattttttttcttcttaataaactaatcataactattttttatttaatttattaattttcttctaaagcaaccataacattttacatccactttcttgatccacatgaaaatattatgctgatatgttttttctttagaaacatagtataaatacaggcgctcacagagaatctattacgctcacttggttctgtgctggcatgttgaccttcattttctgtgaaactctggatgcagaaacatttattcagtttaaggttgcccattccattccagagcgagtgcgacctgtgcacgccgtgaccaccaatcaggatagacttccttccacggctgcacctctcgcccactggaccaaaccaaaccaaaaccattgccacccccacaaccttccacgtctcgtcacaagccgcttacaaatactcgcgttccaaaccaccatttcccaccacaaacacctccatcaccatcaccacggcaccaccacctccaaattccaatgtgtacgagcaaactagaggagatcaccggcgagtggccgccgccggcattgcaggccgcctccacgacgtcgtcgtcggagccgtgccgccgcctctcgccgcccagcagcaagcgccccgcggggcgcaccaagttccacgagacccgccacccggtgttccgcggcgtgcggcgccgcggccgcgcggggcggtgggtgtgcgaggtccgcgtgccgggccgccgcgggtgcaggctctggctcggcacgttcgacgccgccgacgccgccgcgcgcgcccacgacgccgccatgctcgcgctccgcggccgcgccgccgcgtgcctcaacttcgccgactccgcctggctgctcgccgtgccgcccccggccaccctccgctgcgccgccgacgtccagcgcgccgtggcgcgggcgctggaggacttcgagcagcggga

SEQ ID NO: 77572 - DNA, 14279 bp, Oryza sativa
cgaattgcatgatcgtcatagatcccatcaaatgtgacgtgttgtgagtgagtagcaggctagcagcaaccagcaatgcctcctggtcacagttattagcggaaggctgcaatactggtcattgctgctaatcaaaactggtcaagataaacttgttcttgaattttttttggttctctttgggcacatctaaacccggtgaaaacagaatttcaaggaaaagaaacatggccaaactacgaaaagtacaagatggcgctcccattcctcacttttattcaacttttaatcagacccttcacttttctcagccaagacaagtattcatggcactctttgtttatcatgtacgcatgtaagaagtcggtaatatcagtcgaaatgcacctactcttcaagtaggaatacactgccttctgaaattcctcaggaagattactgcaaaagagtttacatccatgatcagtaaaactacaaaatgcaccatagaattaaaaaaaggggggggggggggtgatgctcacctcaacttagcttcaagactggccgaatcaccagattcatcattcggttcaaacgacaagctctcaatgatgagttcgttagggtaagagctacagctgattttcaaatatgaagctgcttctttgcgaaccctcactatcaaagggatacagtactgggccgggacaccattgccaatgtgagttctatgtttgccatcttcacactgatcctctggctcgccattttcctcagcttcattgacagcgcttggcaagaacacttccacttcaatttgttctttatggtcactcctcttaagcgtcatcatgttggtaccatcctaatctgggatttcaaaaggaaagccttcacctaattcctttgactggcagaacataaacacacattacaattccatattaaaaaggatggcatctttcagcatctcagaaatctagggcttgttcagattgatgccatttcaaactataccattttttagcaaagttgctaaatatgtgcatccatttagtttcttaccaaactctagtaaataaataagaaatcctgccaaaacttggaaatattgccaaattgccaaaattttgacattaggtttattttgactacaatctaaacagcccctagtaagcttcttgtctgatatagtttgccatgtactataatggtacacttttcctttcaaagtctaaacagacgtgcccataaattgcaacaaacaaagtttatagcccctatcgttttgcttatgcttataagccaaaatttaaattttaaaacttaattttcaagttgattttacggttttttcattgcagtttattttacaacatttactttcgaatcattaaggacatatataaaagttttacccccaaatcaatttttggttgctaaaggtcgcatggataagcataagtataagcggaacgatgagcctcatagccaggaacacgattcaagcggcgtctaaactctaaagaggcgaacttaatcgcagatgttgttttctctctgagtcttttgtccacaaaaacggaaatcatcagtgagggatgagatgagtagtaaatacccagttgcgattcttgcaatctttctgggcgtaggagatctccatgtttatgacccggaggagctgtgcgtcggcggcgctcgtctgagaactggacaacgatgagaacaacgacgcggacgcggcgccatgccgcggatgacgaacgcggccgccggatccggcgccccaggtggcgaggaggccgcgcgcggcggccgcccaggaggggtgagatcgagctcgccgtagggtagaggagacggccatggacgccgcaaaggtttttgcgagggttttctcaggtctttccccattaccgtcgagctgaaggtgccgacgcttctggaccgttggattccacgttaggcccatccatgttgggccggaacggtataaggcgcggcccatagttgttgggctagaactggatcgcggctgacatgtgggccattcttttttgggccacacgcccacgcacgatccaatccgcgggcagaggataccggcgcggcggcgcggcgggccggcggcggcgggggaaggatctcggccggcaaaccgcgcggccgttctactcctccgggaatatggagccgaagcgcacaggtcagcttcgtcacctcctccccacccccgctgccgcggcggtggcccccgctcgcggatgccgcgttgcggcgtcatcacggcatcacgccggactccggcctctcctgccgtacgccgaccacctcccatctcccttggtgaggaaggtgtactaatactaccctcgctgcgcgctgcgccgccgcggccggcgccaaatttctcttgcacggcctgcttgatggctgcttctcacggttcttctttttcttgattttccaggaaaaagactcaggcagtcagactgaacaatgagcttatgagaatgctagaaatcgacgaactcaagacagtttttgggatccatcacaaagtgttcatccctatcctggatacatttgattcgaagcatctaaacacggtgaactgttatgcaacgccacgagcagctgaactggggaactgaatttggctgctggctttagatctccccgtcccagaaatcctccagcgacttgtaaaagctcgtcggatgggtcaagaattcgtacttgaaaagcctaacctgcatgttgcaaacagaacgtacagctcaggaaaaatctttagagtatcaggctttcagcaagtaatttgtcaaaatatggagccatgcctgttgaatctcgtagaactttgccatcagttcttcagggatgcaccagtcaaatatgtcaatgttctcccttgtccacacctcattgtcgctctttgggagcacgctctgtcccatctgaataccccagcgaagagcaacctgagcaggacttttctgcagcttcttggcaatggaaatcacagtaggatggctcagaacgtttggtccatcgttccctggtgatccgggtgaacctaatggtgcatatgcctgcaagaatagcatgaaaacaaatcagagtgaagtaaatgattaatatgctgagttgctgaccaaagttggaaagaaatggaaagtaaacagtgagaggatcataggaacgtcttaatacagttcgaacttacagaaagatgaacgcccttggattggcagagcttccggagcttgccttgctgccaaaccggatggcactccacctggttgaccgctggaggcacgcgagcaacattgagcaagtcctccagcttcttgcatgaaaaattgctcacgccaatggcacgagctttgcctgaatcatacaacttctccattgcttgccatgtagctgggatatcaggcttgaggtaattttccacactcaatttagtacctttcttggcacgaactggaccgtggacctgtgacgtgataaattgtaggagagattaaagattgtcacaatggattaggaattcctgttacaaagagtaagaagaacccatggcacaaatgcaaatactatttataactgaatagttttctttttacaagaagtataggcttaggatattttactaggtacaaatctaagtagtaaagctgcagatcctttaatgtggtattaatcgcctctggcacatcttctggagcatggtgtgtgcacctgaaaattttggaacattttcttacagtgaattgacttcattaatcgttttatataagaaaaaatatgcaatacgaaaggtagtatagttttacaacctaccacagtttagatgtgatgaataaatcttcacgcttaaccgcaccttcgtcaaataatttcttcagtgccaaaccaacctccaaaagcggacgcaacttttgcctacttttaactctagagggatgagtatttgacagtgaagaaatgtagttgaatcactcttaaaaccttaaactgcaaggctctgacaccaactgcgtgatattactttgtcattcttagtgcaacatttgtcaaactattattggaatcaaccgcaaacggtgtataagaaatataaagttactacgtatttcagatatccttgcatttcagtttaagcttatataaaatagaagcatgaaggtttcaggagcaacttacctctttctgattaccatactgtggagaacagtcaatatgacgatatccaacctgcaccagtacaagaagataacatttacatccaaacagaggtaaggaccagatgagaactgttcatattttcttcaaaagaagttgaaaaatgtcatcatttcaggtattaattaaccttttttgggttaactgagcaaatgaatgaacagaaaaatccagtcgatcgacatgattgttatacgcaggtgggtgcagcatgagtaacaacgaaatagaagataataagactatcgcctatattgattgttaatcatcaagaagaaatgaaaagacctggacagcagcgcggatggcatcttgaacagcacctggtgaaatttgccaggtgccaagaccgactgatgggatcgccgcgttggtgtttaggacaaaggattcagccatattcactccaaagatcaaactgtccttggtttccaagcttcctcttcttgtgtcgatggaatccaacagagagcgaacttgagcttacctggtgtctgagcaagaagatctgagcactaatggtaggtagccaaggtatgcagcggttgaaatgagcccggtgatcaccagtagtatactctaaaataagagcttccagaatccatttaataatacataattgaccactctagatgagacttagagaaacctgcaactgacgaagctaatgcaatttgaaatagagaaatcgcatcttggcaattgatctgccaaagagaaggcaataggcaagcatcacagctcaagtaatttattttaagggtgagtcaagtcaatttatatttcagaaagactttcgaaacaagtttaactagaaatattagctgctgaagtcatacaacaaaatcaagatgctgactaactacttactggcagcatttaaaaatcattgtacacttgagagaaaacatcttatgtcactgaaattttacttgtcccaaatatgctactcatatcgcaaactcatgcccatttatgccatcagagatgcagcggccaagttatctattatctagtaaacacttatgccatcaggtgacaattctaacactgccaatgcttcttccccaatgaactcgccttcacttgttcaatggcagtggcgggcaggttgtgctgctggtgcggggtccgtgagctgctggacactgcccggtgatgtcctgtccccggcaggtgaggggcctggctagctggtaccgcagaagatggtgagaggctgagacctcagatcagagtggcgaactggagtgctgacctgatgccatcgcctggcggggactcgttgaggtgaaacattttgtatatgttttaaaatactttattgaattggcatgctttagttagccacacaaaagttacatttacacctaggaaaaacgtatcgcaggttactaaggaactgagcgagtgagcagaagaaagcagacgtcaaactacatccaaaatctgtgataaagccttcttttaaacaaatgtccaaattactgataattttgccggtaaagattctggattccggttcttgtaaaaatacacgccagtaccagcaaaatggtagctgtagacttaaactccttttattcattcattgattaacatttccccactttatttgcagcaatggcagtttccagtttttcacccacacgaagaaagcaaacttcagtccagccaagtcgatcattagatttcgccatcccaaagctcttcgattgatttgtagacgccttccgggtgagtccagaattctccacggatcagcttcatctgcaaatcaaaatcgccattcatgagaaccatcaccaattcaccatcttgcccaaaaaaaaaagacccaacaagaacagagtttcagagcgtctgctgctgaagctgactccggccttgcctgctcgatttcagagagcttgatgaacaggtcctccgggatggaccagtcatagacgtcaatgttctccttgatcctctcctcgtgggtgctcttcgggagcacgctgtgccccatctgaatcccccaccgtagagccacctgcgccggcgtcttccccagcttctccgccgtggagacgaccaccgggtgcgcgagcacattgcccaccgctttcaccgacgctgtccccggcgagcccaacggcgagtacgcctgcagtgacgcatgacaaagaagaagatttgaagcacatcactaggataatgcactgaaggagaagttcagagttgggtgatatcctgttcagaatagcttcagctgttcagcatcaggcaggttaattactctctttctatgtgttctacaattgattctactggtagtagaatcaatttagaccgttcatcttatctaagctaatggatgatatctaatttatactaccaccttaactactggtacttctggtagtagaaatcataaaactacagctagaatcacttctaccgattgtaatactagtagtactactaccactgtaaatgggggaactattttgatcccttaaggggatgtcccttcatttgcttaaaaaccattcaaacggttataaaaattctggaaaaaattgataacactcatacaatatactctctttgttttttaatatatgacgctgttgttttttactatgtgacaccgtcgactttttaagatacgtttgaccattcgttttattaaaaaaaatatgtaattattatttattttattatgacttgatttatcgtcaaatgttctttaagcatgacttattttttatattcgcattaaaaaattcgaataagacaaatgatcaaatgcttataaaaaagttaactgtgtcattttattaaaaaatggatgtactcctatctatacaactccataaaatcttaggtccaaactcacatcgagatataaaaagataaattcagcatatgaatagtagtgtactgttcacatctgaatttgtcttttttatttctcgatgtgtaagtcgaatttaattttttttgacagatagatatcacaatactcaacatagttattttttttcatattttttacgactatttgtatcgaatttgaaaaaaaaatatacgaggggacatcccatcgaggaattagaatccactcccctataaatgtactcattcatgaataactgacacagtaaactgaggttatctcacattgaccacatattgctttcaaatgattatattgtgatgaaattgtatggttatatttataacttatatacttcaataatatagtgtattttcatatgtttataaaactttctgtaaaaaaaggttcaaagtttatgcttaaataatgccaatgttaattacttcctccatcgcaaaatataagagatttttgtttgataatacacgtatataggatatcctattcaaccaaaatcccggagggagtatctgagaataaagggagcggtagtttgcagtgctgagcaacatactgagaggtggattcctttggaggtgcaaaacttgcggagcttggtctgctgccacaccgggtggcactccacctggtcgacggccggcggcacgcgtgcgacggcgagcaggtcctccagcttcttgctcgagaagttgctgacgccgatggcgcgagccttgccggagtcgtggagcttctccatcgccgcccacgtcgccgggatatcggtcgggaggacgttttgcccgccaaagccggcgcccttcttcatcctcactggccagtggatctgacgaacagcgtgagcatcctcaactcggatacttttaagataatgaaagctttatttaaactcagttaattacatcatacaatagtcaccctcggtctttgtataaaatacacacggctaaaaaaaaagaagaaaggaacaaccagaaccagaacatctccagaaatggactgaaacttatcacgaaatggaacatgaatctcacacgcattgcatactcacaaggtaaagatccacatagtcggtctgcaaatcctgaagcgtgctgtccagtgcaaccgggacatcctccggagcatggttagtgcacctgcaagaagttgcgagttcttcagtcatgttccaagattactgtaattgctggtgctcgcctaagccaagaatgtttggaggttttggaatgaggatgaaattaagaaggtaattaaccagagtttggaggtgatgaatatatcttcgcgcttgactatgccctcgtcgaacactttcttgagagcgaccccaatctacagagccacagtggttactggttaggctgctctgaaaactcagagatcgttcacttaactaggcaaattggagacaaatttagtaatttacctccttttcgttgaagtaggcttgagcacaatcgatgtgccgataaccagcctgtagaagcatacaattcagacagcacaaaagaacatgaaaaattaacctgcgtgaaaattcagacagcacaaaagacacatgaaaaattaacttgtcacgaaattcagacaacgcaacatcaccttgacggcggcgtagacggcattgccgacgacgcccggctcggcctgccatgtgccgagcccgaccgacgggatcttggcgccggtgttgaggacgaagcagcgggccatggtattctgctgcaagcactgtacacaagccggaaaatgcatgcaaaatggctacctggacacttcacacttgcaagagcggctaataatggaaagcgcggcgagctcgtgccggtgggcgagatgtacacatcaccgtaccagtagtagtgacacttagggatggggatttcgtcgcggctatgaatccgacaccatgggccacgcatttagagatggctggaggtttttatagcagacgaccggcagctgtttcttgtactatctgattattatatctacatctatctatatctctctcctttataacactatatctatgtatacgtgtgtgtgtatatatatgtatatgtatatgtatatgtatatgtatatgtatctgtatctatatctttattattttgatctttgatagactcacgagtaaataaaaaaggttaattgaatatatgttgttataaatttgacagttttaaaatatgtcattaccccggaaaaaaatatgtcattaccatttatctaattggaacaatagcattgtaaatatatgttgaaatcagatacataccaccacatatccctttgctgcattttttatttttcttggatcatactgcccttgttcatcccctcctctcatgcatgctcatctcttcttcctcctacggtctagagcgagtgagcaagggagcaggagagggaacggtctgagcgcaatgacgctttcgacgacaacgtgtccggcggcggaggacgagtgcggcagcacggacggtagcggtgctcgagcccgcaagcatagtaggcggttgaactcgacatagtggcgttgctagcgcggtgctcgtggcggtagttgttgacgttcctcaagtaccaaatccgaccgtcaattttagcataaaagtaattgatatagttttaccttaacttaaattaagttaattaactcatagaaatcctctctatcccaatcctatcatttaattgttgctcttggaagaatcatgttcttaaattgtgcacatacgttctctgtggatacgctaccctaggatactcttggtaaaagctacaacggtatatgtgcgcttgcagattattctgtgctcataataaataccagcaacacttctagtggcagagctccagcgtagtggcgtcgccggtgcagtgctcgtggcagcacttctggtggcggagcttgagcgcagtggcatcgccggcgcagtgctcgcggtggcacttctggtggcagagctcgagcttgagcggcacgacgtgaccgtctaggcctccgggggagcttgagcgaggtgacgtggccggcggcaaagttttaaaattaatcaaataaatattaattgttttaaaattaaaaataaactaaaaaaatgctcatgcgttgcaataggtgaaggttatcttaatcttattattgttatacggtttagctaaagtgaaattcactgtaagaatttgcttggatattatttttacaagatcatgagctacaattagatcgtcttaagttagcatgcgagtttttttaaagagatttcgtatacgactccttctctatatattttcaaaagcaaacaaatttaaaaacctactcaaatctaaatttgtaattccaaaagcgaatgaactcaataactgactcaaatacggatgacgtatcaaagtaccgacaaaaacatcttcaacttttataattgtagagaagaggtatggatttatttgattcttttaaaaacttttatatataacactgtttaaccgttcaaaaaatatgcttacgaagaacgacaaagttattatagctaattgctatttacaaattagaactcacgctatagctactaccggcaatggatttaattacaaacgtaagggttagcaaccaatgctaaggacatgtttaataggttccaaacttctaaattcaactctaagagttaagtatggagacatggagtaaagttatagagtatccgaattctagctccacatttctagtttatttgtgaaaacacttcagccaactttcgtcatgttttgaatagagctgaaactgtacgactaaacctaaactgaaactttaccgaacagacctaataatggtgataagattgtgtcgggggcagacgcctagcagagcgctgcccgaacgaaacgctcgacgacgacgacgacgacgacagctacggccggtcggcgctccaccactctccgatggcgatccgccgccgcacaagacgtttgtcggtgctgccgtgctgtgtgctggagtggagcgctaatctgttggcatcttgcccacaggcccgcagcacgctacatgggcctagatatgccatgggcctcatcattttttccagcccatgtattacccgatgtcgccgctcgaattttttttatttataattttttttattaaaagttttacaaaaataattttccattttgaaaattgacggaaatagtcgcctaccgccctctgggaggacgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaaatttgcaggcggcccccttgccgccctccgcgagggcgattttgcactgtgcgggggcccgcctgcaaatgggcggcgagggggcatggaattttgcaggcggcccccttgccgccctgggggagggcgattttgtactgtgctctatattttttttatataaatatcaatagttatcaaatctttttatattgaaaactatacaagattaaaatcttcaagattggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtataggtatttaacagtattaataaaaagtaaagtaccgtgtgggcgagggatcgacgctccgtgagaggaagagctggcgaacgcgcctgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctgttcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtatggctcgatgatgtaattatcataaaaatttagaaatgaacaatccgaactcacgagtggtcggcaggggggacggtcggctgcacgttgccgggaaacacctgcctaagtccgaactgtctcatcacacgctgcggccagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaaggaaaaaaaaagaagaggactgataaacttataacgcagcgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacataggacagccagcgatgatcgctcccgcg

SEQ ID NO: 77573 - DNA, 19036 bp, Oryza sativa
gggagtcatcatcgtccgtgttcccactcgccatgaacgtcgtcgccgaggacgccatgtccgccacgtccgagccgtccgccgcgagcgacgacgacgccgtcaccagcagcagcagcacgaccgacgccgacgaggaggcatcaccgttcgagctggacgtggtgagcgacatgggctggagcctgtactacgcgagcttagcggagggcctcctcatggagccgccggcttccggcgcatcgtccgacgacgacgacgacgccatcgtcgactcaagcgacatcgctgacgtgtctctgtggagctactagcattgaagcagacgcgcgtcatgctcttgtacataaaagagtgacttcctaattaacagcagctgagcatgtatggccttgtatatagggtttttttttttttgatcgctgtacatttttcctacctctggaatctttgattcctatgtacggtttcctcatttcggcatgttttgagtgattgagagtgaaattataaaaaaatgtcatgcataatcaaagactagggaggaccaaaatattgcaaatgaacattgtttgtgtgtcgctacgtttcattaatagtgtagaaagccaaagttatgttttaccccgaaacggctaaaattcaccaccggtttttaactcaaatcccttaatttcaactcaaatcagggggccgttccagggttccatatttcaggctgaaaggcattgtttcggctagaataatatttttttcagttaagcaaaatttgatcatattcaactttgtttttctagtttttgttttttttttttgaaatttcaattctacccgatcccctcgaaatgttttttatttatatccctagatggttccaacgacataaaaggtaagaacataatttttattttttttatttgaaatttaaaactagaattattttgacgggatgccagcatgaacagtaaccggatgtatcgataagcagcatgaacggtcaagatcgtcttggatctgtctaggatttcccttatcattttcggcacggttaccgaaactccatagtaatatagttatcacgataaccacgagacatatcgtggttttaaaaactataaaacgattttgtaaaccctggatccatctgttgcagggtcctaagtgtgcgtgcacttcaccacacacgcacccaaaatactcttccgcttgggttgattagttcctaacaatatcaaaccaaaacgtcatttcgtgagaaatcgatggacttcgatcacagctaatacccgtgtacagtggcgaatctagaatataaattgagggggtgctagagcaaattagagatatgtcaactcgagaaatatttttgatgaaacccaaatatgcataagatcaacagaaaacacattgtttgctccattttaatttccagttacattaatatgcatctacaaaatgtatgaacaaattagtattttgtactgagagagtgtaagagtgcattatatatttgcaactttaatcaccaaactcttcagctaacatcctggcattctttacgtgcggccaattttactataaattactgattatactcactaatgactaactaaatacatgggacggagctggggcttgcgcaccaacaagcaccaacaatggattcgccgctgcccgtgtataagggtgtgtttcaggagaggagatagagaagatcggaaagatacgcaaaacgaggtgagccattagtatatgattaattgactattaagtattttaaactttaaaaatggattaatatgattttttaaagcaactttcctatagaacttttttttgcaaaaaacgtaccatttagtagttcgggaaacgtgcgcgtgaaaaacgaaacaaaactcactcacaatcacctagatcacctagtaaagaacacagcctagtcttcatcctgatcaataatgctaaacaatcagtagtacgagagatggtacacgaactgaattcgccggctactcacaatgatactactccctccgtcccacgatataaaggattttgagtttttgcttgcaacgtttgaccactcgtcttaatcaaaaaattttgaaattattatttattttatttatgacttactttattatctacagtattttaagcacaactttttgttttttatatttgcaaaaaaaatttaaataagacaagtggtcaaacgttgcaattaaaaactcaaaatcccttatattatgggacggagggagtatcatactacaacttgcctcgtacggaaataataataataataataataataataataataataataataatagtagtagtagtagtagtagtagtagtagtagtagtaatacagtacagtactagaatgagtagaatactctgctttgtccgtacacctgtggggcgcatcaatagatccagaagaggcaaaaacagcagcggcggcagcagcagaaacgcccgcccatgggtgtgtgctcaataccagaaatggcaactagcctcggatttttcccttttatgtcattgcaggctgacacgagaggtttgcatccatttgacttctttttggataataagctaaacaaaagccatgctttgctttgccttgccttgctctggaaaccgaggacaaccgaaccaacagattttggccgcgcgctggatacggctaagcaattcgattcccttgtcgacacatgcgtgtcagctccaggtttataactactcaatttgtctcaaaataaacgaatttctatagtttagaatttatcctaaaataaactaatttctatcgttttacctatcagtaaagcgagaaaattttattactttattcctttcaaaaaaaatattactttaacatcctttgcttatccatcaatcaatataatttttacatcaattaagagcattgtgatatattgtttctcaccttaaaattttcctgagatattagggtttgggtaatttgggtacagatagtactctgttgcaccaatctgatgttgtattattgttactttgtgtttccagtgagcacgacacgagatcgatcaaccgacctgcgacgagaaattgctacgacattttcttcccctcgaagatatccatgtgtatgtcaatgtcacgtgatatgtcttgtgttgctgctacaatcatcatcatcatcacgtccgtcatgatggcgcaatcaaactaacaccgctttacgctttcgccgcctggattaatttctcctcttctcttcctcccgtttataataattctctgtttaaaattaaaagccctccaaaatccaccatttttcccgcgtcgcagccaccttacaatacgcagccatacctatatatacaagctttccccgtcgccgccgccgccgccaacaccaaccaactgcggcttgagacgtcgcgcgcgacatggagaagaacaccaccgccatggggcaattgatgagctcctccgcgacgacggcggcgacggcgacggggccggcgtcgccgaagcggccggcggggcggaccaagttccaggagacgaggcacccggtgttccgcggggtgcggcggcgcgggcgcgcggggcggtgggtgtgcgaggtgcgcgtcccgggcagccgcggcgaccgcctgtgggtcggcacgttcgacaccgccgaggaggccgcgcgcgcgcacgacgccgccatgctcgccctgtgcggggcctccgccagcctcaacttcgccgactccgcctggctgctccacgtcccccgcgcccccgtcgcctccggccatgaccagctgcccgacgtgcagcgcgccgccagcgaggccgtcgccgagttccagcgccggggaagtactgccgccactgccaccgccacctccggcgacgccgcatccaccgctcctccgtcgtcgtcgcccgttctgtcacccaacgacgacaatgcctcgtcggcgtccactcctgcggtggcggcggcgttggaccacggcgacatgttcggtggcatgcgcaccgatctgtacttcgcgagcttggcgcagggtctgctcatcgagccgccgccgccgccgaccaccgctgagggtttctgcgacgacgaaggatgcggcggcgctgaaatggagctgtggagctagcatcaaattaaccaaacaatcttcactagcttgttggatgtagtagtagcagttctagctagcacaagtgcagaacacaaaaggatcgtttgtgttgtgcctgcgaaaaattccccaaggaaatatttgtatgcatttcatttaatttgcatggttacaaattcctacacattctatttgctcgaatacattataaaatctatgaattgtcaaaatatcaattctttcttccataaacacaggataacacaccagaacttcaccccttttcagcaggttttactgcagtcaactaatatgaccatcacaacaaagtagccacagaagtaacgatggcgacctgatcatccaaagtcaaacacttgcacggtacctgtggccacaattagaaatagagagagatatgatgttaggatgagatctagcgttagtaacagtaattgtactcacagagttataataatttattgaactcagcttgcgatctcccatcagacggggactgatgatggtactttgccatgggaggctggaggtcggcatgacaagacggctacgtggacgcctgcggattcattcgatcagagctgataaggtaaacgctgcagacggcagcgtcgacatcagcgtacgtggccgccgccggccgccgtggcgcgcagcagcacaaatttgctcctacaactcagcccaaattttatatatgtcgaggacgtgatgaacaattcaacgacgattagtgtcgtcactagtcactacacgcacgatttgaaaacaaaaacggctgcggttgcaattcatcctcgtgttcattcccctggccggccatcactataaatctttttgctcatttaatctgcaaagatcacctctgacggatttgttagtacgtagaagaggaggagtcgtagatggcatcgttgtcttaggccctaagtcacacggcaaagccgccaagagcgtttgctcctctgatcgatgggttgacttcatcatctccatctgatcgccatgaaaaaaggcgattgttgtcgtgtcccgccgccgaggaaacgtgcggccaaacgtggttgttccgcgggtcacacgcgtcgcgccgcggtatagttgggcgtcggcatggcaaccgcgcaccagcagcaagttgggcgtcggcttcggctaacgacgcgcgcggacgaggaaaacccggagatctcgcggaggccgcgaccgttttatgggcttgcagcactcgacctagctggcctcctactaacctggttctctttcggcccaactattactagctccgcagagcccaatatcccatcgctgcattggacgtgacaaccgggactatgggctggataaggaataagttcacctaccatccctcaactttacgtcgagtctatatgacatccctaatccccaataccagaaatcttcactcgtcaaatgtttaaaactgtacaatcaagtcccatgacagtatatatgggtgatctcgctaacgtagcatcctactcaacaatctagacctatatgtaagtgggtaaaaaatattttgggggccacatcccttctttccaccattttcttcttctttttattttttcttctcctctttttgttcttctctttgccacaaagagaggagcggctacggcgtggcggcggtgatggcaggcgagcacacggccgacggagtggagtggtggccgggccatctgccgccggttgcgcgtcgagaagattggagaggaaaggagaagagaagagaagaaagaaaagaaaagagaaaaaaagagaagaaatatgatatgtgggcccccattttttcatctcacttacatgtggatcacatatttttttattttattgtttactaggatgcctcatcagcgaaactacccatatatactgccatgggatcttgattgcacggtttttgaacatttgaagggtgaagatttctgatattgggaatgtcatacagattcgacgtaaagttgaggggcggtaggtgaagttgttaacgttaatgagttcaaaggctagctcggtttggctcatgagttggctcattaatgaggtatatctcatttgtatcatattaattatttcaaatttaccattttatcatgtattaatataataataaacactaattaataaagtactcaataaatacgaatagttttaatgtaactaaaagacaaagtacctgttaaaaagcaccaagtttacgaaggtttggttatatcttgtactaacgagttaaacgagcagctcatgagttaaaaggctagctcagctcgactcattaagattacgagtccaagctgatccaagccgaacttgctacaagccgatccgagctgcgagtttcgatttcccccctcccacccctagtgttcaacaaccatcgaatgaattgaaacagacaatgcacacgcttagtccatgaggacagaacgttgccgccttttattcatgtagagacagacagacacggcaaccagcaaagcaagcacacatttttttgtccgatcgacatacgttccaaacccgtcacatattttgctgtcgatcgatcgatggatggatcgatctagaggttgaacatgaccttgatggcgtcgcggccacgggcgctgacctcgaacgcctcctccacgtcctcctgcgagaacccgaatcggtgggtgatgagcggcttcacgtcgatcttgccgctgcggaggaactcgatgcagagcggccacgtgtccttgtaccggaatatccccaccacgtccacctccctgatcgccgccgacgtcagcggcaccgtcatctcgttgtgccccatcccgacgaggcacaccttcccgccgccgcgcgtcgcctccagcgccgtcgccaccgtcttgctgaacccggcgcagtccaggctcacgtcgatgtccccgcccatcgccgccctgatccgttccacctcctcgccgacgtcctccgcgcgcgccgacaccctcacggcggcgtcggcgccgagggatcgggccacggagaggcggtgttcgtccacgtccacgatcacgacgcgcgtcgcgccgaacgcgcgcgccgccagcagggtgaccaggccgatcggccccgcgcccatgatcagcacccccgtctccggcccgacgtcggcgcggcggcacgcgtgcacgcccacgctcagcggctcgcacatggcgccttcctccaggctcacgttctccggcagcttgaagcacagatcaccagggtgcacgatctgagtaccacgacattgatcagaattgcatcttcttcttggagagaaatcgaaatcgagctgaattgcttgcttgcctggttggcgagggatccgtggacgggaggggtggcgaagaacttcatgtcctcgcagaggttgtagcggccgcccttgcagtgcctgcagcgccagcagctgatgccgggctcgagcgccacgcggtcgccgacggcgaggtgcgtcacgccgctgccgacctcctctatcacgccggcgcactcgtgcccgatcaccatcggctccttcaccacgaaatgcgcaatgcgcatctcctgcacgcactcaaacaacaaacatatataagccacattatctttcattctttctgtgagcgaacaacagatcaccctgaggtagtgcacgtcgctgccgcagatgcccactgccttcatccggacacggacatcataaggccctgaaaatggtcatctatctcagtgttgtttcatccaacatttttactgaatttcacactcacatttgtagccatatacagcagacgaatgcaaatgcttgacgcttataaagaaacaaatatcataaaaaacatatcaaaattcaggagctgagcttttgagactcaggcatagcatgagctgattgcatagtgaagtagtaggcgtccacatgaaacagactagcatttcataaacaggaaagggatatttcttctttctaagtgccaaaaccttagttttgtactagcaatcatcttttttcgcgaacacgcaaaagaattacacgtcaatatattagaagaatagagtttttgttacacgatgcactcagcaagtactagcaatcatctttcaggaaactggaaacgtgctactattactcaacatgctttatatattatccaagacaggataatataaaaaaaaaagggaatagtcagaactacctgggttattggacaggaaaataaactaccacaacaactgatgaaattatcagaaaaagattggaaaagaaagtatactactacacccaggggatttctgaactgagttactgctacaccaaaaattctgaactattcccaaggaatcaaattagcacaacaaccggccaattttttatctctccacgaaagaaaacatatcaacaagaagagagtagcactcccatcacagagcaaagtgaatttgtttatcaaagaacaaccaaggtcagggacaggagaggatttcacacgaaccaactggcgggagcttgaagggcatgatcttgagggtgttcttcgccaccagccacgccgccatgttctcctcctcaccggctccggccaccgccgccgccgccgcctcggctcctttccctcccttccccatcttcctcctcttcactcactcactcactcacccaaagtcacagtgtttgcagagagcaggtgatgactgatgagctagtgatgtgacgattaaatagggatgaaatggcacggatgcgtctatttttagcggaagagaacaaagagtacacggcctacgctgcgatgcttatcgccatacgtgacagacacgatgccttagcaagttgaggacgcaagaaaacgacagtggcagcgtcagatttttcttggcttcatggtcctgctcacgtaattatctttgcaatcattccaaggagagaagaaaaaaaatcagtgggaggttttagaaggagccaagcaaattgtgtgatcagaagagcgaagcactgcgctttacgattggattagacaaacagcatttggttctttcagggaaaaagatgtaacaaacatttggtatctgcttcgtgatcccaggacgcgtcacgaaatggggagagattgttaaaaatctgggtatcaaaatccacgtatatgccctgtttggaccacggtttttattgcgttccgtccacaatcagacggcaaccggtgacgacgaaagcagcttcaggcttcaccttggctgtgacgatcgatgaatcaagggcaccatgtgatcagtgtgtactacctataacctactccatccgtctaaaaaaaaaacctaggagccggaccggtggtaccagatcctccgccggtctggtccagctaaaagattgcctgtgcatgtgaacacgtaaaaaccagctggaccactcggttttctgggaaaacagcttaaaaccggtcagaaaatcggcactaaaccgctaggcaggtgctgtagtaacttagagggcaggcgcatgcgggggaaagaggagaccggcggtcagaccggaaaaaaaccaaccagagcggactatccggttttcaaatcggcactgcactaaaccgctaggcaggtgctatagtagctcagagggcaggcgcatgcgggggaaagaggagaccggcggttagaccggaaaaaaaccaatgctatagtagctcagagggcaggtgcacgcgggggaaagaggagaccggcggttagaccggaaaaaaaccaatgctatagtagctcagagggcaggcgcacgcgggggaaagaggagaccggcggttagaccggaaaaaaaccaactagagcggaccgcccggttttcaaatccagaaccagagcggaccatccggtttttatataggtaaaacggttgcacatgcatgctggggaaagaggataaaatataggtaaaatgtgtgttgggtaggatttgaacccacgatgggttgattggaagcacgagcgccaaccaccaagctatgcttgtgtttgaaatgaataaattatcaaccggtcaaaccaatgacccatcaaaccgagggcctcgccggttcaatgaccggtccggtctcaattacaatatgatccctcataatacaataaatttggactactcttcgtccagattcgttgttctatgagggatcaggttgagtttttttttgatggagggagtactcttcgtccaaattcgtcctaaatttgtactactactctaaaaaaagaaaaaaaaatcctaaatcacagacgaactgatcaaaaggcccaatcaaattgggctcttcggccagattcatcctaaatttgtactactactctaaaaaaagaaaaaaaaatcctaaatcacagacgaactgaacaaaaggcccaatcaaattgggccgtttcgatgagtttgggccagggtgcagaagtctgaagtttgctactaacggcgacatagacgtcccaatgaatagacagtgatagaagattataaataactccaataggcgataaatgaacagtgcgcaccggaaaaacattaggtagtactccctccgtttcataatgtaagaatttctagaattgttcacattatgtctagatttattaaggccccgtttagcacagctctagctcccaactccaatttacctggagcgggagttgtgccaaacggtccagattcttttttttttcggagtggagttggcagagctactcctagaaaatgaactacgggggtggagctgggtttttgctgctccacagctccactccacccaaaagacccactaccctctaatattatagtgtatttacatgaaaataccactcaactaccccttcacccttctttcctcccgttctctctcctccccccaatcttcctcccaatcccgagctagtgcggcggcgtcggcgggctgcggtggcagcaacagcgtcaacggcgacgggcagcggcagtggcgggcggcggcggctgcgggacgacgacgacgggcggtgcgcgcggccggaggctggcggcggcgggctgcggcagcggcggagagcggctgttgcgggacgaggacgggcggcgcggcggcggggccagcaggtggcggcaccccatcttcttccccatcctccgatgacggccacaaccggttgtggcggcgtctgcgtcggcagcatacggggacagtgagcatgggccgcgacgcgtcggcggtggcaggcagtggcggcggttgcgggcggtgttgtggtggccgcgactggcggcatgcggtggcgtcggcatcagctcgcgagcggcggcgtcgacaggcgactcgcgtgcgggggcatcggcagaaggcagcctgggcgacggcgcttgcgcggcggcttgggaggcggcggagatgcgtgggcctcccggctgcggcggcaacgtcaaggcggcgcctacaaagtgttcgatgaaatggtgacaaaggatgtataaatgtggagctgagtaatctagccaaacacttttttacctacctcagctcctagaggagccagctctcactggagttagagtttggagttgggaattagagttatgagctctaccaaacggggcctaacatttatataaatgtaggtaatactgaaagttttacattataaaatggagaaagtacggagtgtatgattgagttattattgtggcattaaaaaagagaggttgattagacaagaaaggaacgtttaaggtagtataaccgatcatgcacggcattactactatattatatagagctgaaattctggatgctggagtatatatgaagttggtatttggtaagttgtcggttgcctcctttcatcagatatcagcgacaggtattcttcttcttcttcttcttcttctttagcttgacctggtatggacgtcattagcccatcatggtcctaatcatggtgtacgggccaacgttaatcgcctcgtctgttcaagtgtaagattatgcagtactactactgttgtttaagcataattaataataagtgattagttaaggcaagatgtacgtatgtacgtgtaggaaaggatagtgcaggggagagcccacatggtcgatgatgacttgaaacaggattatactacatttatactatgggcagctgaaaattagtcgatgcatcgccgtcagggaagatggggatttgatcagttgatttgcagcaataattaaatatttcagtggacacggtaaaaaaaaggaagaaattaactcaacgccgacatctatatgagtatgaccaccgaattgtctacttttcacctgtgtcggtacaaaatccagccgcaatatattaccggtcgccttttcacatacagtagtcctcccttcgtactcgtataggaaatcgtttagaacaatttaagtcaagactttaggaatataaatcataaataactcttaagttgttgagtttgaaaacgtaaaaattatattaatatatttatcttgaaaaatactttcatagaaacatacctatatcacttttcaataaatatttttgtaaaaaacaagtagttaaagttgtgttttaaagatcatgtcgctgttctaaacgattttcttacgagtacggagggagtacttgtatacttgatcgccgcagtaaacatcgatcgagacgactccagtttagccatagcaattggagattgagaagcacggagcccacacggttgagagttgatgtggggggaaaccgcgtcgattcgagctagctggagaggaggattggaggatattctcgatcgtcggcgagcggcggcggcagagcgagcatggatgaattcctccgtacgtcgacgtcgttgaacaggtcgcgggcggcatggatcggtgcttttctccttttcttctcggctattgtccgccacgacgaccggctaaactccatcactgtcccacatggcaaatgcccattggagctcctctcctcagatgacacatattctagtttctgacgagatgtgagcctgtggcgatccttggagtcacgtctgttttaatcttaacctcaattttttaggcaaaacaaaaaacaaaaattatataaaaaaattaagtctaaaagtctgttagaatttatcttttttaatttacctatatatatatatacatatatatatatatgatgaattacacgtagatgtaatattattgagagtacatatatattttttctagaattttcgatgaaatttgttagttggtgtgtatgatgtgtacacgtgaaaacttttatgcataggatatgattccattaaagttaatattaaaaaattatgacaaagaaaaacctttaaattaaattttggttgcgctgataagctgaccaacaacaacagaacggtatgcattcatacaaatatcaaatgtcggccaacccttatcttaggacccactgtcatggcttcaccgatgctatggtgcagccccggtcatcggatgaaaaaaaaaacagggggcttaaaataagggattatctatatcatatttaaaaattaagaccaccaagtctacttttcaaatggctcatatcggtttgatatatatgcagcctcatgcctccaccttatcccctccctctcctcgctcaaatcggcatgctcgttgccaaaccccttgttcatcgcgctacactagtgagccctcccattcctcctccccatctccagtggcttatgtaaccgccgctctcgtctcctaacctctcccgttccctcgcctccgtccacctctcgtatccatcacccataccaatttggtcactgctatgggtcatgacccaattacccaatcccaatctcaaacgccaattaattcattcataggttctcaacgtcaacgaggatcactctatagttaaaaggagaagggtccgagtgagttttgatgcggatacaatgatccagttttcattttttttaaaaaaatatacatcaaaatttcttagcattttcattttttttaaaaaaagggtcaatgagcagccgagctgaagcaagaaaggcaggtcaaacacaaacaccagtacatcactctgaccgcccggcacacggcgctttcaatcacccccactccacactcgtttccaaccatctttccacagatgaggaggccttttgccaccatcaccccctcatctcacatggcactagcactgtgctaatgcgatgagtgcatccatcaaacacacagcagcaagcagtggccgtcttgtcttgtggcatctgttgtttggccttcgattccgtaatggcatcgtcaccttgcaattgcaagcttgcaaacatttccccgggggttgaaatggtcagagcaattgcaacctacagcctcccaaagttggggtcccccccccccctcctactacctccctgcctggctgcctcccaagttgctgtcaacaatttactctgaataattgtgtccttttttcggtgtctgattctatttgttcttgggtaagtagtgaatcggttgcgatcgcagaaagacctagcggtgatatggaaatttaccgacatcagtaagaccgcgtcgatgtctaaaacgataacgttgttaggctgcgttcgagaaggtaactttcctatcctttttcgccacacacaagatgagaatagttattagcatatgattaattggtattaactattataaatttaaaaatatatatttttgatttttttaaaaaaaactccttgataaagcttttttacataaaacggtatggtttagtagttcagaaagcgagaacggtgagttggtaaaaataaatcgggagactgagccgaaattcagtatggaattcacatacataaacactcaataggagtagaaattgggccggtcagcgccggcagcgcaaataggggagccatatggagtacaagacaaggcgtgaatgctggggaagacgagcaacttgatttggtttctgaccaaattaagagaatatctggaggttgggggctttcacacctaatattaaaaaaaacatgttcttttcttcacctttttaaacaaaaaaatcccctttccctatataaataagtaaaaccctatcctgttcctatatgatcatcttgtcagtcagcaggatgccattgactggattgtagtataacaagatggatgatgcatatcagcatttgcatcaccttcatcaatcctctgcttggtatgttgctgtcactccctgtgagcctgtggccaactgaatgaaaaaaaaaaggaaaaaaaaacaagcctttttcccagcagcaggacagccactggcgcgcacatcgatccatcgatcaccacttcaccaccaagagccgagcaaaaaagctagccggagaagaaaaccaggaggcggcggcggcggcggccggcgacgagggagaagcagtcgcatgcggccactcggcggccatccggtcgctctcgccgtgacagcagcagcagcaattgcaactcgccgagctcatccaagacaaccctatccatgaggcaaccatgctcttgctcatcaacaagtacctgtccaggagcaagaacccggcagccggcgacgacaaggagatgccaccgccgccgccgccaccgccggcgaacggagcggagcgtgagttcatgtgcatccccggctgcgtgccggtgcgcgtcaagaggggaaccacgacgacgacgacgacgacgaccacggcgaggacgtcgcggcacaatttcgtcaagtcggcggcgtcagggctgttccccggcgcgcagttcaccaaccacgagtcgctcccggcgatggaggaggcgtacgccgagttcgtcgccgcgttcccgcagtacgccgggctcgcccaggccgacgccatcagggacggcgagtaccagcacctcgaccgccacgtgtgcctcgactacaccggcatcaacctcttctcccacgcgcagatgaactcgtcggtgccgtcgacgtcggccacgccgccggcgtcgtcgtcgggcgcggcgtggcagccgccgttctttgacatcgcgtacaagtccacgagcctgcggtcgcaggtgcaatgcggggacgacgtcgcggcggcgtccgcggcgggcgggatcggcggcgccgtgacgaggcgcgtcatggcgtcgctcaacatccccgacgacgagtacgccatggtgtgcacggcgaaccggaccaccgcgttccggctgctggcggagtcctactccttccagcagcacggcaagcggctgctcaccgtgtacgactacgagagcgaggcggcgggcgcgatggcggagagcgcgcgccgccgcggtgcggaggtgatgtcggcgacgttcgcgtggccgggcatgcgcgtccacgccgccgacctccgcaagaagctgctccgcgggaggcggcgcggcggcggcggcgggcaccggagggggctcttcgtgttcccgctggtgtcgcggatgacgggggccaggtacccatacctgtggatgagcgcggcgcacgaacaagggtggcacgtcgcgctcgacgcgtgcgcgctgggcaccaaggacctcgacacgctgggcctctccctcctccgcccggacttcatcgtctgcaacttcttcaaggtgttcggcgagaacccctccggcttcgcgggcctcttcgtcaagaagtccagcctcgccgcgctggagcgctccgtcatcgcccgcagcatcggcatcgtcagcatcgtccccgcacgccgctggtcgctccacgacggctactccaccgagctcgacccggtcgccgcggcggcggacgacctcgacaccaccagctccttctccggcccactcagtggcaccctcatcgcgctcacactcaagaacgtaccggagatggacgccgcaggcgaggagaacggccactcgccggagatccgcgaggccgatccgccgccaccaccaccgccaataatggaggtggagtgcagggggctggaccacgcggacgcgctggggctgatcgccataggcaaccggctgaggtgcatcagcaactggctggtggtggcgatgcagaagctgcggcacccgcagtcggagcaggggaaggcgctggtgcgggtgtacgggccgcgggtgaagttcgagcgggggccatcgctggcgttcaacgtgttcgactggaagggggagaaggtggcgccgccgctggtgcagaagctcgccgaccgccacaacatctccctcacctgcggcttcctccgccacatctgcttctccgacaagtacgacgccgacagggccgccgtcctcgagcacatcgacggcggcggcaagaggaaggacgccgccggcgagatggggatctacgtggtgaacgcgtcgctggggttcttgaccaacttcgacgacgcctacaggttgtgggcgttcgtggccaagttcttggacgccgatttcgtggagaaggagcggtggaggtacaccgcgctcaaccagaagacggtggaggtgtagccgacatgtccatccaccttcagcttccaccattggtacacttcactgtcactgtcactgttcgccattcttttgggatcagctcgatcggctgtgcagagctgctccgtccattctttgtgtgagagaggctcgctccagtgtgttcatgattatactgtaaaatgtagtctttgcttccttagaaaaaaatatgtgcctattacttgttcgctatactgaaatcatttggttgccatctccaggatatgaattctgcatcattgtttcaaagcagaaaaagttacagctattttcttttatctgctcaagacttaactgaattttttagataagataaaaattacatcttcaacgtctgcatcataagatgcacacagccaacagttttgcaggatattactgagaacaataaagcatggggagggaattagctagtaacaatgaagcaatagagctagaggaaacaaggatactaggacctagtactactacagtactacacaaaggtttattgttcagcttaaagtaaaaacaagctgaggggcacgaggggaacaatgaattattggaagatatctagactgagcactctaagaataaatacatcaaactgagcaacaagatggctaataatgcgcgtgagctcacagcattcttggcacccaatcagtgaccgtttgcaatgccgttgcagcccttgatttttccctcggcggctttcttgtcatagaacctcctgtacatcgaatcaacttttgtaagatagaatgttcctggtggcaacaagctggtatctttgcttgtttcaaaatcttttgctccatagcggtgctccatcagcttcaatgtctcaataaacttctcaggtgaggtctattataacatgtaaaggaacaagttagcttgctgtagagaaatcacactaacgaatggactattcagagatgactacagcggagcatttcacaatcagcaaacatataatatcatggaaactacagttgcatcactttttatacgaacaaatcaactagtggtatgtagccatccttaacaaaggcaatttttaaaatgcttgaaacaattaataacacccccccccccccccaagaaaaaaaatgttgaggtaaacctatccaatagtgaccgcccttgccctttctttccctggtgacaggtttggtggtacagtatatttgcataattgcatttgaccaattctttcatcaaatagcgacgtggccataatggaaataaattccaaaaccatgtccgatcataccgcatgtatgcaacaaatgtacatcataatatgctttatcgcatggg

SEQ ID NO: 77574 - DNA, 699 bp, Oryza sativa
  unsure (1)..(699): unsure at all n locations
acccaatgtattctttaacagtaaaaccttaaatcaatttatctgttggctcaagcccggcccgtgagcccccgaacccattcatcatcccactagcgttagcgtaggcggaatagcatcctagggcgcacgcgtcacgccccgtccctcctcccccatctctcctcttttgaggaactcaatcacgcacaaaaattaccagattacccccaaccccatcatcttcgatctctctctccaccgcggcggctctctctctcttttctcccccacccccaaccaccactttcttcatcaccaaagcgccggtccctcgccgtgggcgncaccttcggcgnccgcggcggtgccggtcgtcgaggcgggaggacttcttcccgcgcgccgcgcttgatccgtnccgttcccagtacgcccgaggtgaggcccgtccccttcgattgggtcctttcttcgctctcactttttccttccccccagtctggaattccggcgactgaccccccctgtttcgatcttcgtgcgcggnggagcggtcgatcccgtcggtgaatgcgggcggggttagctttgggtcgccccgctgctggtggcttgtcagaggggataggccctaagggtcatgtgtgactttttgggcgcgccatccgtagtaggatgaacacactgataagttcttttttttttttttgcgaagtt

SEQ ID NO: 77575 - DNA, 617 bp, Oryza sativa
aatcgactagctatgttacttatgtccctacctgaactttatgtttaccatgtttaattcccctagctcagttattggaatattacagtattagccctttttagttcaagattaagttgcgtcttcaagcctcggcccctggtttcatggtggtaattatccaattaaaatgcgactgaatggtggtttgtgggtgcatggtttaatggtcgcgccatgccagttaagcccggtttcgcggaacaccctggaagttttcctcgtcttttccacaagccagggtgggcaccggctgggcttgtagtgtagctttcctctagctgacgcatccaggcaagggtgggcgttatgtaccggggcggcccttgcgcgggcctctgtcgcttccgaattcacttaggcacgagagggtactgcccgttgcccgttggggacaggggtacaccttgaggtgtggtgtgcttggctagagggggttatgcgaagggtcttgtcacggcctctttccggtatgtcgtggtggcatgtcggcgcacggtaacgtgtcgtgaggctgtgtcttgtgggtacagttgtacacctctgatcagagtaaaactatttgatatagccgttac

SEQ ID NO: 77576 - DNA, 6271 bp, Oryza sativa
aagaggagggaatttagacatctaagcgggcctttaagaggcccgcttgcgaaaatatattttcacgtacggccgcttaagaggttcgtttgtgaaaataactagatgaatctcttaaggggttacatgcgaaaatgcattatctcgcatgcggcccctgaactatttcttggtggagcgattcttcatgcgcaaatagtagtgatatataagcgtccagatggtccgcatggaacctaaaagggttctcgtacagaaaaaacgtttgctatgaatctggataaccgtgtgtccagattcatagctaaaagttgttatattttgggacggatgtagtaatcaatatggacggaaggagtacttcatccgtcccaggatatagcaacctatgattggatgaaacgtatcctaatatgatgaatctggatatagacctatctagatttgtagtaatataatacgtcttattctattatagtttgttatattatggggcgtactcactccaccaaaaaacgaatctagaacggaatgtgacacattttactataatgaatctggacgatcaattgtactggaatttgtaacatctagttttatgttcgtcttttataagatctagttttatattcgtcttttacaagacggagagaatgaggggagtaaaaaaaaaaagcattaacgggtcgggtcttgttccattagaaacaacaattcagcccagtaatcggatggaccggaactcatcccgtgccccgggattttgtcccgtgcgggtacagtcagaaaaagtataaaaacaaccttaaaaaatgtcacttccaaataaaatatttctctcagatgccagacacgccgggctacgagctaggtcctgtccagaaattagtttctttcaacgtccattcgatctaaattattttacccttccctatttttcccccatcatgttcttttctgggagtacatgtcctccatcttatggacattattgtgtttgctgaaactaccgctatcagtagtaccaccatttgatttgattaaggcccacatgtcatattcaatatatacttatcggcccatcgattcgtttattcggggaataagcgaaacgctatatttgcaaatgaaaaatagtttatgattaaaacttttatatacgtgttattagcgatctgaaaacaaaaactgaaaaataaacttcgatgaaaaaccctaaaatcaactctaaatttaaagttgaaaatttaaattttagctaataagtataagcataaacgaaaagatgataccatatgtttgacacgaagtttggtaataaaattgcaaaaaaaggcaaactctgggttttcgtgtccaactttgactgtccgtcttatatgaaatttttttataattcgtattttcattgttgttagatgataaaacatgattaatattttatgcgtgacttgtctttttaaatttttttcataatttttgcaaataagacgaacggtcaaacgttggacacagaaatcagggtttgtctttttttggacggagggagtagtttgtaacaaaataattcattatgtggttcttaccatgttaaatattgttccactagtcaataacactcttgatattcatccaagtttttcacattttgcagttttatgttttggtgactaaatattcgtaaattaagttgaattattagtttagtcaattaatcagataagtattttgcagatcattttttttcataaattagcaccaacttcacacacaaagcatcacacaagaggcaacatgatgcaagtacaaattgctgcatttttttcttttctttaacccaattccccaaacccacccacctccaccctcttggaaagctcacccagtttttttttacccccatagtctcctgtgcacaattatcactcctcttctcctttcacccctcttcacacacaccacggtaaaaaaaaaagaaaagagaaagaacagagtaaaaaaaaggaaagcacagtaaataaaaacaaaggcatccaccacagccccatgtgtgactttagaccaaattaaaccagtggtgctgtgcctgataacccatgagagagggaggggtgtattaggaaaattttaatcaccgtttaagaatcccaaaacttagaaatgggcgctttgcttgcctcccatctctctctcattaacctcttttactttaaacacactcccccatgagatgagcaggcagcagccagcagccagcagcctgcttgcttgcctagctcccaatatcatcaaatttttgcccttcccaaggaatcttacccaagatgctctggattggctacaatgccccagggcttgggtggagaggttgtgaacatgacctagggtttggagggtaaatatggtaactagtgggtatttagggatttgcaaggttgggattagcaataagcggttttaggttattggttgggggggtatgggctgtttgctgtcaatcccaacgggtatccatgggcttttgcttggtccttgggtccattaacccaaaagcccaatgccacttcgttttttctctttcatcctttaaaaagaaactggcgggtttttccacgttcagaattagattttatatacaatcgacatatttttctttttcataaatatgattgtattttctatccaatagattttaaaagtatgattagatttgatatatttctcttagcttatgttccatacctacaactgtgttttatatataatagaattttgaagtggtgttagatttgatacctctgttttaaattgcacgtcgttttaggtttatcctaaatcaaatattttagtctttgaccatcgatttgtataaactcatatagtttaacataatacaatttatattttagatttattataataataattttataatatataattgttgttaaactatacggaggtttaaaaattaattatcaaagatagatgtgtttgacataggaactaataaaacgataagtaatttcaaatggtcagagtacaattcttgccttctgttttaaatatacaattatattatatacaactacatcgattaatctatatcattaaaacatgtagttaccatgtgtaacgatcaaaatatttctctttttcttataatccaagaatttatatcccatacatatatgtgaagttggtccctccttttcgagctatcgttataatatataatagatagattataaagaaattcaattggtgtttaagtatattgttcaatcatgtgcattgcgtgagaatgatcattgtttcttgctgacaataacggcatcttttaagatcatttctccatgttatattaaataataacataattgtcttttaaactcgagagctgtaatccttacttcctacatttaattctatggggggtattttaatgcaatgtggtcttcaaaattactcccactatctaaaataagttattttctagatacaaatctaaacaagtgcgtcaagattggaaataagaaattaacttattttaggacgcgatacgtagaacatactccatccgttacaaaattagttcgttttccagttttccctattccacacatatcaataaagaaaactaacatacccctaatttatcaaatcacaatacaattattcctcactttatatacttctttcatactttcataaacttcgatgtaataattacttaaaaataaatttgttttggaataaattaagtgagcgaaaaataaacttattacaagaagtttaatagtatagccaactaccagctccaaatcatatatagtcaatccaatatctaattcatataatagttatttataaatatatattacaccattaatatttggtatacctctaagatatacaaaacatcttagaatcagtgttgtaactgactacaaatatatagcgtgcttctcttctctctcctttcttatcttctccatatgtttttatagtcggcttgtagtccactattatacttgctcttattaaatggagtagctaatttctcttgcaaatcttcgtcgaatatgcctggacaactaacaaagagtaaaccatccttccaaatatacttatactctctccgtcccaaaaaagcttaccctaagagtggatgtgaccaatgtgtccccttctagtacaatgaatctaaacacattctcttctaaggccgagtttagttccaaactttttcttcaaacttccaacttttccatcacatcaaaactttcctacacacacaaactttcaacttttccatcacatcgttcaaatttcaaccaaactttcaattttgtcgtgaactaaacacaccctaagttgagttttttttggacggagggaatatattgtctagctagtgtgcctaggttcgtactagtggtatgtcgtttatagccattggaggacacatttattactttggaggatatatcaaccgtcctaatttacaatttcgtaggataccactatgcaactccgtactctctctgttccattaagaatctaattttaaagaaaaatttggactactccctccgtcccatcaaaaaccaaccttgtactggatgtgacatatcctattactacggatttagacatattggtgtccagattcattgtaatatgatatgtcacatccagttctagatttgatttttttgggacggagggagtattctttaggattaggttttttttttggacggagagaatactccatactactgccttgggtgcatttacaattttgctagttgatcgaattttgcaaactttgatctttttatatatgatcacaccttacaaaatttggctaaccgaatatctttttagcctacaaacaaatgcagtttgtaatgataattattaaaagcaatctagagaaagcgtgctgcttaattagcagatgcaacccctattttccggggctttctcggctacaatactacccgtaaaaggtgaacgtttttttaagatgaatagagtttagaagacagtattagtaggaccccatgttttctacttttctttcatcaaacaatcgccaataatcactcattcactcgtgatatctaagcaacgtaccccagtttgacctatgctcgctagtgattggccggccatgaatagaatggggaggagtctagtatgaccaaacaagaagcttttctcttctttttattatgcgaaactgaaactttcctcaatgcctaaacagaacaggaaagacattttttttttcgattagggagattatcgtagagacgctgacttgtgggccctactgttggagaatggacaagggagtgcggctaacccccagtcacatggcacggctgacggctctcctaggtttgctcgagtaagattttatcccggatacaatcccccaatgccttttgtcagtggtgcggttttcacatgcttgtcgagttgtcgtgatgatctcactattctttcgtgtaaactacaattacaaggtctatatcatatttacgggataattctctccgatatatgtaattcattattgctagttttaggaaaggtttagtaagaagaaaggaaaaaaaatgagaatgaactagaggtatctttgatacctcttcaagcctaagtgtttatattgaaacaagatgaacatttcaaacatgcgggaaacgatacgtaggtctatcggcttgtctaggttaatagggccatccatgagacctattgagtttctgtaagacaagaagttccgtcataagcacctatcgaccttgccatatgttaacaaggctctcaataggcaccgcggatgcaagcgggccaacccgcggggtaacccgtagattgactcacgggttacctactaattcaacctgtaaatgagtttatgggtcgacccgcttgcatctctaggtgcggtaaatagggccacgacgcgaaaacccatgggttaccacttatttgacatataagaagctagatttgtaagtcagtccgtttgcatccccgcagtgatcatcctgtcgtagattggcacggctcgtcacatcattactagctagatgctctgaaatcatgcttcgttatgatggtttatcgttattgttacgatgcattgttatgaagaaaaatataagataattttgggagaatttttaaacagaagtctccattatccatctcataaatcttctcgatggtatttctcctacatacacca

SEQ ID NO: 77577 - DNA, 502 bp, Oryza sativa
caaacaactcgcaacttattctatatcagcttattataatccagcttagagtaatctgatttaataatctggattacaataatcttaagctgaaacaaacaagaccttaataacgttcatgaactgcacactgtacactagtgtctacctggcttgtatttataagctgatacgtaatgctatctggtattggtgctcactgatcagatatggaggagttcgacggcgccatagctcgccggcgagccatggcgcgccgcggcagcggcggcggcaacggtgacggcgacggcatcacggtgcacgtggagcagatggcgcgcgggctgatgcagaggcaggaggcggcggcgtcggacgagcagcaccggatcatggcgagcagccaccgggtgtcccgcgtcccggcgcacctccgcgacgccaacgccgacgcctacacgccgcggttcgtcgccgtcggcccgctccaccgcggcgacgcgcggcggctcggcgccgg

SEQ ID NO: 77578 - DNA, 1195 bp, Oryza sativa
tgcttatatacataggctacccattgtgtatcaagctacagtctttttatccgtagtcaataacttgcacctttatggacttttgtctttacaaaacatattcgatgacctaaaaaacttttgtcttcacaaaacctaaggatactttaagcattacgaaaacctgaaattttgtgtaatcctcattccaagatgtatcttgtgctatattttctcataacatgaataccgcattctcccaaaaataccaaccgtggtcatattgctcgagggaaactccgtgatcaccacattttattctagcgagcatgtgacttctaaatgataaaatccactcttcgttatgaacatgaaaaaaaccctctcaactgcatgcatatcctttttcctgaatttttattacctttaaactctttttattcaaattttaaaaaaaatcgcaactgctaaggaaaaacactggcagtaaaaaaaaaaccacaaccttcatctgaagtttttcatcctcattttgctgacgcctttataaatccatccaaaccacactcacgagggtggcttggcttacttgttctcgcaagaaaagaaaagaaaactcacacagtggcagtaaaagtccaagcagcaagtgaccaagaccccaactattaaacaacaagtgaacactaaacacactcatcccatcagcagcagtagcaaattagcaatagccccccgacctagcttgagacgacctctcatatcataagttcataggctccattaaatatactcctcctccaacccccgagacgcgcagataagaccaaatcgaccgaggttttaaccctaatcaaccggggttttagccaaaaacacattaataccactactaccggagagtgagcgagtgtgtagcagcggcgacagtagcagcagcaacgcctccgctcgctcgatcgatcgatcgatccatctcctcgtctagctccatatgcgagctggggtgcggcttaagcaactccagctcaaagtaatcttctcactagcaagcaagctctctctcatgtcgtgaggtgtagattaggggggagatttgttcttcttttttggtctggttttttttgtggtttcttgatcgttttggggggtaatggcgcaccggggcgaccggttcttggtggtggtggtggtggtggtggtgttgggggtggtg

SEQ ID NO: 77579 - DNA, 3596 bp, Oryza sativa
actatacttactactatcatacatggcctccatgccacaatacaaactgacactacttgtataccttgggtactgtagcatttccggcaaactagctagctgcaattttaagttcacaaagacgcggccacgaaagacgtcgagtatacggtatgttattattgagttgcatgcaccaaccagttaaactcaaaagcttaagctaaagagctaaggcgggcaattcaggacatatagattgttggtatgatcaaggagtgtcagttgacgaccctgcaagatgtcctgacctcgccggcgtcgccctccttgaggtcgagctgccccatcttgagcatcccctgctggaacgcgtagaagaagtatgcctggttcatggcgaacatgttcaccagccgcttcgtctccggcgactcgaacagcgtctggtcggaggtcagcaggccccgccgctgctgcagctcgcggaagtagaccccgtcgaacacgttgctcgtccggtcgaacgtcgccgtcgcggcgtccccgccggcggcgcacgtgctgcccagcgacgacgccagcgccgcgtccagcgtcgccgcctccgtcgccacccggttcttgaagttggcgcagtgcgcccgccccagcgtgtgcccccccgacagcgccaccatgtcctgcgcggtgaacccgtgcgtcccgaacagctggatcagcgccgtcgcgttcaagaacggcggcggcagcgccaccgtgtcggccgcgctagaccgcgtcccgtccctcctccccgtcgccacgccgtagtacgggccccccgccatgatgacggcgtcgcgcgcggcgagggcgaggacgtcggcgcaggagacgacgccggggcaccgcgactcgagggcgtccttgatgcggtcgatgacctcgaagccgcggaggctcttgttggcgagcgcgtccttctcggcggtgttgtccggggtggagtcgaggaggacggaggcgtcgcagccctggacgaagcagtcatggaagtggaggcggaggaggctggcggcgagcgacgggtcgcccatcagcgcctggctcaccacgctcctcaccaccatctccgcgaacgggcagctcatcccgtagtagtccatgctcagcgccgccgctcgccgcggcgccgccgccatggccaccacctccaccatgatcagcaacctcaccagcttcttcatcatcttcgattcactcttactagcttgcgatgaagaagatgagagtgtgtgtgagagtgagtgagtgatcacatgtatgatgcggtatttatagctgaagctgaagcacatgaacgatgtcgattgatttgaattatgcacaattgattaatgtacgtagtgcacgacatggatgaatccaaaaaccagagcactaaacggtggagagatcatgttgtagcaagagtcaaaaaagctctctgtgcctctctgaagatagcggcgtatgtagtgtcactcatgcatgcaaacgcaactaactgaatgtccgaatcgtatcatattaaccatataaaattgccatcagggcaatcaatcagtcgacgaacaatcttctgaaaccattttttaatcaatatttctgtggcattggtataatttcagacgtagtacgtgggcgtcgcatctgcagctggcatccatggccagatgccatgcatcaccttggctatcgccgtacgttgccatcgcagcggcgaagtgggtcactctcgatcgattcatccactttaaaaatccctttctgaatgaacaattgcacgcgcgtgcgtgcctggaaattcagtaatctctgcattacagttctacgtatgcagcgcattgcaaatgtagtgcagaaaggtatagccagccgccatggatttcaattcactcaaactgcgcctgcgtcaccgagcattatttcagttagtagtatatgggtagatcgcatagacttttcccatactgtgcaagcgatgcaagatgtgataggcccaaggcattaagtccacaatctctagctctgaatttgtctgcatattgtactagtggttggatcactagtaggccattaccactaagctaggtagtgatatatcatactgaaaaatctgaatgctgagagagtcatcccatcaagttgtttcactcattcattgattggagtgtatatggatagtatgttttcaccatcgtgcgaaatggtgagataactctgaataataatcttacatgtggttgatgtttagttgaccttgtaaggactaaggacggaaatattagtatttgcaatgtggacgtaataatgcatggagatgagtttatcacactaggaatatatgttgatgaacttatgaattataaaattaactgttaatgttctgtatatgtagttgtttaatcactacaattaagctagtgatactgaaaaatctgaatgctgccgagttacccctttctcttgtttcactgactagctcctgatgcatcatatgtacttaattatgcgagctcccccggtgacatttcaggaaaaaaaaaagagtaaaatgtattggcagttcttaaatttgtagggttgtgttatatatatctctaaactctcaaaatacatatccatgtcctaaaacttgccaaagtgtatcatctaggtcccaaatcgacacatcccctctggtattctacgtggcgctgatgtggcatactacatggacgtgacgtgtccttttctttttttttcttcttttcatttatttttctttttcgttttcttctcattcttctttttttcctttcttctgctcgggtcacagagaaaggagaagaaaggggaaaaggagaaaaaaagaaaaagaataattttaaatgggtcccattaatttgtcagtcaaaatgatgccacgtcatgtccgtgtggcatgccacattaatgctacgtaggatcctgaaagagttgtggcaatttggaaactagatgataaactatgacaagttctataacttagatatgcattttgagagtttagggatctaggtgacacacctctacaagtttaagaaccgtccgtacactttactcaaaaaaaaaaagtatgcaatctgaaacatatatgatgtttgagcatcgtgcgaaatctgaatgacaggttgtttcatagctttgtactatgaattgaaacctgaagaaacctatatgtttcactgaactagctcctgcatattagtagcatatgtatgcactaacgcagaggataaaattaggcaacactactttataagaaaaagggattgcttgtcaaaatagtggctgtcactccagaccaattagccatgagcccatgacattactgacatttcggagatggatttgttttgcgcatgttgtctagtaagtcatcaaaactttgaaaaaaaaattaacttatacaaatatgtaagttaaatttgaacctacatatttgtgcagtgatatactacctccgttttttaatagatgacgccgttgactttttctcacatgtctgaccatttgtcttattcaaaaattttatgcaaatgtataagatataaatcacacttaaagtacta

SEQ ID NO: 77580 - DNA, 538 bp, Oryza sativa
ctaatgtcaaaagccggaatgttaaccaagcatgtcctctgtaggtctggttgccagcggtcatgaagctcataaatgtagcttcaagcctttgtaatagatccttccctcacacagtaacgaacattgcaaccctttgttggtataggaatgctaagcgactgatcaacgttttgcagcttccatgcacagcaactgtgtatcatgtacaagtggattgcttgctcgaactggtggagatcccgtaaagtatggaggagaagcctgtagattgcatttctagcttaatttggaagcacatttgagcaacagccaaaaaatatggggtaaagagaaaagagataagctaaccttgctcataatgaaatcagaaagatcctgtgttaaatcatactccttatatgacctgaacagcaaaataaatcaccgatgctatgcagttaaaatcaaaatacccgaacttatctgaatatgaaaaattccagatgagaagtgagtgtgtcaatagagtcaaattgaacatgcagaacacaaacgg

SEQ ID NO: 77581 - DNA, 6331 bp, Oryza sativa
atttttagcaggaatcacgcttcagatgttgttttgatgctacttttcttgtctttatgtttttacagctagatgtaatgcctgaattgtaagctactaatggaggcctttggcctggagaagaagaacagaagcaaactacaatttactttgtcttaggattagctaaagtagcttagaaccctaaaatcgctgcactgttttcccctgtttcttccatttcgcactcagggtcttgacacccccgcggcgagctggttcatgccgtcgttgcaggcgcccgtcgtgctcgccgcacgcacccgcacaaagatcggtcacgatacggctgcgtggcaacaagggggtccggtgtttaaaactccgaccccatttggctcgaaaagaaaagaaaattcctatctttcttttcagaagtgccaacgcgccatcatgccatattgccatgtgcccctttgaatcaaaggatttatgtaggaatttcataggatttaaatcctatagaaaattttcctatttggccatttgattcaaaggattgaagctttccaaatcctatgaaattcctatggaatggcatattgcatgtagattttggaggaaatttagcaagagctccaacctcttggaaaatttcctttgagtctatctctcttatccgattcctgcgttttcctacgctccaatcaaactatcattcctgtgtttttcctgtgttttgcaatcctctgttttacacttcaattcctgtcagaatcctgtgttttttctattcctccgttttttctaccctacgattcaaaggggcccctaaaccggcaatattcaggttcaagctctgttgccacggaatgacttggcgtgcagatgaattattcctcccaaattttcacagcaataccaacttttccaatcttccgtgcactgagaagagaagatacatcagaaatgttgtgcgttgtgctgtgcctatatatgtattgacttgctgccagcaggctaataaattcatatgtgatttgctccaggttcccatggactcgatatatgagagttaacaccaaacaagaacggacgcaacagaaagcttgtgcatctgtgtgtatgtgattatacccaaagctactcgacaaagttttcaagatttgtcctctcagtgttgcactccaatactccatttcacattttcatttccatggttaggacaattaaagcacagtagaaaaaattacacctttgctactcgccgggcaattaaaagaacccaaacaattactgtcgaatttactcaccgtcgatcgtcgtcctccttggcaatggcggcatgccaatttagggttcgggggtgagtggtgtgtcagtggtcgtgtggcgttgccttggtcacacgagagcgattggctagtattggcgacggggaaatcttggcagtgtggttaggaggcgatgattgaagagatgcaaagtgtgcgtaaagtagagaaaacgataaatatgtcactccattagtagggtttcgataaaatggcacctactagtatgcaaaggataaaatgtcactcaataggttaccttcataatattttaccttgggaagtttaaagaccacaatatccctacccgttggagagaggaagggagaggggcccagggaaaaggccaagccagtgcttgcctgccgtaggcggtgagagtgtatggacgggtggcgtcttggaaaggagaatggggcgacaaggtagcggtagggacaatagagcggagggaggatgaagcaacaatgcagtccaatgccgcccacctggacgcttgcaactcgtcgctttggcgcagacaagggaagaggacggtagcattcgcagctccccgccccactccatccattttctttgatgccgattggggagaaagatggagtggccagcgccccatctacctcgccgccccatcctcgcccgcctcccgctcattctggcgggtagcatttcattgaaagcccacgaatggagtggcgtattatccgctttctcgcgtaaagtatatgcaaaatgcaacattagttgctctgaaaaagttgtggctttcctttcctcgtatatgttaatgatgctaaaactacaagcctgttcaatatgatatcttttccaattaacccaaaagaattgccttacttatttcttttgtggacagcacgcagcgagccaacgatgcagccaccatggccttaacatgttgaaaaagatccagatcagttacagtaggattcgcggcacagatttacatagcacctctgagattattttcagggcagccgattgatttgagtgtatatatcagaaaaaaaaatttcaagcgtgcacgggctcaccaaattatcaagggacgtacgcaatcacaattaattgaaacagaaatgttattatcaagcagaggtgacctgccacctatacctgcctgcttggtcacagctggctattacccacaccaattaccaatgtaattgcaagaatgcaatataccgtcattcttgaactacggagtagcaaaggaaaatgctaagacaataacagaatgctgcatcaccaagtccgtacataaggcagcagcgcacgcaacgttaggtatctctcaaaaaaggtctttctttactatgaacaactaaccaaaacataagggaaagaagatgtgttgtgaagcagaagttgcaacatgaaagagctgaacatttcgatcaaatcttccattcagtagtttctagaaaatgttcactctaaaggacttatgaacttccccagcatttccacttttcggtcgtgtggttcactacatattcttgaaaatgatcctatacaaaatcaaagctaacaagataaaacagaaaaaaggcagcactataaacagaacttacacaggattatatgcaagactagaatgcagcaaggagacagaacatgataatggctgatgtagcactaagtgcccaagacaaaaatgcaagcgctacagcaagttcgaatctcccacaaggcagttgtggataccttctgcagaaaagcacgtcccttttaaacagaaccataacacctccagctgagcaagatgcagcaaaggacagaagtgcagttacctgcatcaaatagatggagtcaatttatgctgctgaagtctgtgaattataaacgtggttgcatgaatgacaccccaattgctcaaaaaatgtcgcaatttgattgaaaactcaatccaaaccaggttgcataccatgcaaacaacatagatttccatgtcaaacaatagtatttttatatagaaaataaagagaactacaacaaaccaagctccctcttgccatataatagtagaatgcactatattgcagcaatcagttatcttcagaaaataaaaggcacagcaatcaacagaagttgcctaacctattctattgtaccctctaaatggcacttctgtggtgtttgctccagtaggaagtgtaacaccatataggatgtgcctaactatcacaaacaatctagtggagctgatctaaaaaattttggatcaaacaaaaaaaaaatccaaggcaacaagttaagtgataagtgatagagttacagagtttaatcattacccagtctccaatgacaaacaaactcacgagaagagcattgttgagatcccttttgactgtcaaggcatacacgtcaaggcatgcaagtcccaagctccacaatgattgtaatcccattgatgcaatcaagtagctgaaatttgaaagccacaacaaactcattacatgattcaaaggaagattgcgccaaagagggtgcgaatacaggaaggaccgttgtaccggtgcctactaaaaccgactaaatacaaagttaccaagaaaaaggtcatcactgcactagaattgtaatacgaatgattaaggtacaccaaatccacatgcatcatatgaaaaataggaaacagagcataaaccaaaggggattatcaattatctttgccgaatgccgatataaccagcattaacaacaaaagccaatgttataagttatgacatgtacacatacctcgtgaacataaacaactggatagtatagtgatagcttcataattttttttcagatcttattagaggttgtaacttgtaaaccacattcccagctaacgcacagctgccatttgatagtgaaaggccctcatttctacgattctactcgcaattagctaagctccttgtgaatcatccactcctcactacccaattttggaaggccgcaagccaattactcactaattgttccaaaaccatcgagcgcaaaattcatgctcttcactgcgccccaaccgaaattacccaccaaatctgccatcatcaactcgcattgctccaggcgaagagaggggacgagacgacacactacacggatcaacaccaccaaaatacgaaactccgccccccaaaatcaaacgggaacgcgtgagggcaccgtaccagaaggccgtgtagttggcgaagccggccccggacgccatgacgccgatggaggctccggcgaaggcgacctgccccacccgcatcgccagcccgccccacgtcccgggcctccaccacgccacctcccacatcccacgaccccccaaacccctcctcctccgccgccgccgccctccccctcacctacctccaccaccggccatggaccaaccggatcaccgccggcgcactccaatcgaggtggttggaaaccaaatcgcgcccaaaaccgccgcagtttctaggctcacactcgcggaggaggaggaggagaaaaagggggaggaattctggctggcgccacggcggtggtggtgttagtagagttgttggtgcgacgctgacgctgacgagcgcgcgcgagagagagagcggcgcgggacccagctgcagcgtgagcgcgtggatgacggaggcgaggaggaagacgacgacgacggcgacgagtcgacgaagcggtttgtttgggctctccgatctggagatccgacggctgtggggttagccgagggggtggaggatgagcggtcgcgatcgtttgttaacgtcagggtccgtacgctgacaagatggcgagcgagtgagggtgtgtttagttcacgccaaaaaaaattaaaaatttgatttaaattggaacgacgtgacggaaaagttgaaagtttgtgtgtgtaggaaagttttgatgtgatagaaaaattaaaagtttaaagaaaaagttgaaccagatgtgaaacattgaaactgcaccgctgttgcacggatgggtagatagattttggcattttggtacggaaaggtggcgttgttgcttggattatgcatttatgctgcatagaccgcatggttagagtaaaaagtaagcatgagtagtaataattagtaaagcgacccattgacaaaatatttttcttcgacgtgagatttgtaactttttattttggtgggttttaagttttgtgcattgtacatgaaagaaaagatgaagggagtgtagcttaactggttaagtttattgtgcttaaaccaatccatccggatttaagccttagatttgctaaaagtgttatcattttcgactaattattttcagtgatgtacgacatactttcttcgtccaaaaaaaactcaacctagtattggattgaacgctttctagtatgtccagattcgttgtactaaaaacatcacattcaatactatattaggttttttttgggacggagagagtgccaattaacaatgagacaaatgcttcgatattttggagatatttgtagggataaggggcttgtttgatagagcttcgacacctaaatttagtttcaggagttgagtctatagtgaagttttagagctgcataaacccatctccatctctctagttcattttgtgagaaaactccacccagttctgctcctattttttatgaaactgaaattatttggctgaactctagcttgagctggagatgtgacaaacagatccaaggtgtgagtgtgtgggggtgaatgtgtgttatgagtaagtcttggccctactcagcaattgaaaaataatgctggcgaaaaagaggtttatatagtttagtaatcgaaagggtaaagctatggtcgaagtggaggtgaaagtaatactactgctacgtcagcgtggcggcgaaaagtggtatgcgaatattcggtgcgatttcttttcttttacggtaacagaaaacgcgacacaaacaaacgggaccacctatacgtttatcgataaattttcttctaaaaatttgacagatgtaatta

SEQ ID NO: 77582 - DNA, 14314 bp, Oryza sativa
ttaaaaaagggagggagtatcacatattaaactattttgttaatttattttaaaaaataaataactttttaggtgacatataaaaacaagtagcgcagataaactccttagactccacatgctatatcataaaagcagaggtcaataggctcagacgcatagttagcaacgcaaattggaaggaaaatgctttgtacatgccattttttatagtaatccctccgtcccaaaataagtgtagttttagcactgttcatatctaacatttgaccgtttgtcttatttgaaaaaaattatgattaatatttttattgctattatatgataaaacatgagtagtactttatgtgggactaatttttttaatttttttataaattttttcaaataagatggacggtcaaaacgctaaacacggatatctatggctgcacttattttaggacagatgcagtaattcacactgcaagttttctgatgccttattacaaccaggaatcacgcatgacagagttgagtagatattttatacacctaggtagtttaaacaattatataaaagattcataaaaattaataagagagattatgataatataagacactatataaacatgcaagtctaaattcaatttaatatgaagaaataaaaaacaacaattttctttataggtactattcactatatgattttattatttttatttctctaattgtagataaatatagtcttgcatgtttgtatgtagacttatatcatgatgttaatttttttttaaaaaaattatctataactatttgagtcgcgtcaaatgatggatgctatggtatctagtgcagaaaatccatatccagagtcgagtaaacaaaaagagagaaatacttagtagcaagtagcaacaaccatttcaatagttttgctcatgcataagcatgatccagttagcttattgctaactaggagtacttgtgatctacagtatcaactaatttcctgccatttagcatgacagggttgaaggaacaaaaataaatagctgatcaaatatacttgtagcatcagctcagtggcttaattagctgaaggtgagcacactctcatgcatgctgtcatcgatcatgcatgatcatcgatatctaattcgtttattgctattgatggtttgatggatcgattcagagggcggcgaggcggcggacgttgatgggggagacgacgtcggcgccgccgtagaaagcctccctggcgatgagcacgttgaccgccgccgtcgggtggaaggcgtcccagaacacgtagcggtcgcggccgtcgcacggcggcatgaacgggaggcacgtcacctggccggcgttcctcccgatgccgcagcatccgcggtccaccacggcgaacccgtgcgccgccgggtcgccgaggatggccttgaacacgccgtagttgtccaggaacaccaggctcgcgccggggaggccgccgccgtcgaggcggcccagcatcgccctcacgttggcgttgaacggcaccaccagcgcgtccacctccggcgagcaccggctctccacgctctgcgccagcacgttcgggatgcaccccatcgaccccactccggccaccacaaacttcctcgccccggccttgtacagcctctgcatccattattgaggacattgataagctcgaagatgatcgatcaatggcggcggcggctaattacgtacggtgagctgggcggcgtagcggtcggcgaggaggtcggcgaactggcgcggggtgtagcggcggcgggtgttgtagttgggcatgaggtagttgttgaggtagtcgttgctgcccagcccgacgaagaggatggaccgcgccaccatggacgccgccgcctccttgccgccgacggcgccggcgatctgctccaccgtggcctcgaagttgtcgatctgctggttgaacggaatccgtcccacctgcatttgcaatcaaacaacatcagttcttgatcgatcatttccttgcatgaatgatcaatccatggatcgagaggaggattgattgattggttgtgatttacgaagttcccgccgctttcgtcgaggatgccggcggcggcggaggcgaagttgacgccctgaagaagctgctgcacatgcccggacgcttgggagtatggtggcaccagtggcagcccaagcagctcagctgcaattagctcagtcagttaccattttgttctatattatgatgttttgagtttatcttaagtcaaactatttaccacttgacaaaatctatctatctatctatctattatatactaaaaatccattaaatttcctacaaacactcctaaaccgccatgtggcttatacaaacgctcttataccgctatgtggcgctctaacaaattatagaaattctaaggaaaaaataaaaatccgaccatcgattttcacttaatacggtggacccaccatttcacaccattagatatctatcttgtaacaaggaaaaaaaattcacaaaacccatccgtatcccctccatcacgtacataccgtacgtacgttccccaccttctctctctttctttccatttatttataggtagcaaattttatattaaaatattaatattaaataattagaatttcttataatatatttgattttaattattccatgtgttggagtgtgtgtgtatatgtgtgtatatatatatatatatatatatatatatatatatatatatatatatatatatatatatatatatatatatatatatatatataagaaatatatcatttgcatataaactcatatcctttatataataactaaatattaatacatatcatgcaatcgtaaatgatctaccctctctccttactcactttattatccttatttctggctagcagcttagtatataaataattaatatataattcttattatataataaagatttggtaagcagatccccataaaatatcatgcagatctatccattatacatcctttatagtgtttctagctcatcacatggcacatctaatatattataaaaagtactataaatgctgcaaaagaaacatttaatcaatgattttcatttaaatagataaacctattattttcaaccataaaatctatctatataaaacttttaaataaaaaacgtctcctccccttcctcctccttcctctcatcttacattattctggaaacatgcatatgtaaattaaaactacaatgtcaaacaaaaattagaaattcaactattaaatagtgttttgtcgagagacagcatccctgctttttttttccatgtcatccgaattgacataataaaatatgaaataattgaaaaaaaatcacatgcactcataatttatatgaaatatgccttttaccatggaatcattattttttttaccattagatttatcttaatagatagacaaaaagagaaaaggcccaatcccaaccctcctgtcctattacattatgtccgtacatatgcatgtctgcgccctcccccctcatgcacgagcacaacctcgcctcctattttccttctctcccattgtcctatttttatgcttattaattagatagaaaacatattttgtgatagcaatttctaaacaactataccacctaaactattttttttatctgtgcacctcattagattatttgcagtaaactttcatgagtcgaatccaaattaactactacttctgtcccaaaatgtaactatttttagctaaaaatgcttacattttaggacggatgtagtatatttaacaagtaaaagaaataaattactttagaccatattttggaggctagctattggtcagtcataaatatttaggaaaagccacaaagatttttaaaccatatgattaacaacatgttgcttacattataacaatgtgaaacacttttaagtagttagataacacatttgtggaaaataacaaataccgacgaagaatatttgtggagaaaacatactttgaagtatgacagtgctatccggttaatattatgttcttataagtttttgaaacacgcagaccacaatagatgcccgcgcgaatgcgtattaggaaatagttataacccctcaagccgccacgtggcatcctaaaaatactcccgagtcgccatgtgacattctaataaaatagagaaatctgaccatcgattttcacttaaacaggtgggcccattattttagatcgttagattatctttaaagaaaaaaaaaccctaccgtccctacctccgtgcaggatgcgtattgtacgctccctatcaccccttcttttttttttctctttgtttctttcttctttttttatctttatgaaaaaaaatccctacaaatagacatcatacgagtaagtccattaaacttcttagaaacgcttttaagccaccatgtggctcctacaaacgctcttgagccgccacgtggcgttctgataaattagagaaatataagaaattccaagaaaaaaaaagaaaaacatcgtaccatttattttctctttacacaccattagatctatatatgtaaaaaacaaatgtcacgtacgtccacacctctccctaggtccctcatctcctaacatgtacgtacatccaaagtacgtatgtctccccacccctctcttcatccttccatttatggtagcaaaattttgtatataaaaaccacaacaactaaatatttagaatatcttataatatattcgattttaatttgaactatgtttaccatattttggtatgtacatatataagaaacatatcatttgacataaacccctttatcgcaactaaatagtaataaaacattacaaaaagtaacatatatcatgccatcgtaaatgatctcctattatctctcatgctcactttcttatccatattttctagcgagcagttcagtacataaagaaccaacaaatgctatattaactatctattatatacttaaaaattcattaaactccctacagatcctcttaaactgtcatatggttttctataaacactcatgagatgccatgtagtgctcaaataaattaaaagttcctagaaattatgataaaaaaatcaaaccattgattttcctttaaatatgtagatccaataattataactgctacatctcacaaaaataaatcctatacccccacctccatccctaccgtatgtgagcatgcatgtacgtacgtacctccaccgtcctactcatctccgggatccaattctcatatcctatttttaagataacttttcctattttctacctagcacataatatatagaaaaataataatagctaaatgatcatgactctcaagttacatgtacttttctcagtttatttgactttttgtgttatttataattaaattcaagacccatattgcacatatttactatatataagttagataatactgctattctgactacaaatatttgagcaaaatagcacttcgaaaatgatgaatgaattcaaatgtgtgggtctaaagtccaagttcaatcaccaccaaagaagcttggaaccagaatgcacactctgggcctgaacccgatgaaggcggagctacaagacattattagcgaggtggacactgacggcagcggcatcatcgacttctacaagttcctggacctaatagcgcactaaatgattagatgaaggacaaggactaagaggaggggagcagagggagacgttccatgtcttcgacaaggactagaaaacagcttcatatttgccactgagccccgccacgtcatgtccaatgtatcaagagaggataactgatgaggaggtcaaaaatgatccgcgatgctgatggtgacaggcggatcaccacaaggagtttgtaattaaattcagaacaaaaatataaaacaagcaatttgattaaaatacacaaacaaaaaataaaaaacactaaaactataaaaaaaaacaagattccatgtagaatataaaatatcaagagtccctataaaagtataagttataaatatctaaaatttggaataataaaataagtattaaaagaagagatcaaatacaacacgagatgagattaagcgcaatttaaaatccctaaaaatacaatttagaataaagtaatttgatttgaatacaaagtcgaattaagaatcactcaatcactaaattcagaatacaataaatattttttaaagaatttttctatctttattgattcacatgcataacaaaatgcatatatatgaagcaattaaagagagggctagcagaatggtaaaaatatatatttattaccaatgaaagtttgtcgagatttcttcacgaaaaaaagatataataaatactcaattaacagtagagaatacattactttaattttttattttttagaactattttcggtacaaactaatacgcatgcccgcgcgaatgcgcgggctatcttcctagtttatagaaaaatatatcgatatttcaaacaaatatactatagataatttaagtattttctacacctggatgctatggcacctaggtgtatgcacgtagtttaaacaattatataaaaattttataaaatttgataagatagactatgataatataatatactatacaaacatgcaaggttaaatttgatctacatatgaaaaacaaaaacaacaaattttatccgcattgtacgggattcaatggtggatgttgctaagttatttacaaaattggccaaatttaaatgtaagaatgtttgacttagaaaggtaattagtaacacgtgagctagtaaatcaacaaaactaaactgataactcagcctttgtactactagtatttagtacaaatgaaattgtcagccaaatgaatcctatatatacatatatgcatcattgttttgttcagttcattcactgaaccattgctgacttgtgcgcatgtgcgcaggtcgctagctagccagttcattcagtgtcttgcagtcgagtatgaggtactggagatgaatcacgaaattttgcaagctccaaacaggaaatgccaactgttgcaattgcaatgttactgctacttctgcagatctggtctgcgaggaggaggagataactacatcgtggtacgtttcataaatgcgagtatgtaatgtgctccatttctgtggctctgttggtagtaaattgtgctctgcctaggatgttggatctgtgttcaacgctcggtgagaagatataggctggtcaacatgtacagcaacatcaccaatgttcatcacaatcaaacatgtgggctaattaatcacaagtcagtaagcagcctaatcaacaagcagaaaaaaaacacgcctaaaacctgaactctgttcgctcaaaaagatcaaaaaaaaaaagagaagcaacctgaactctgaaactcttgctagaaatctagaatggcgttcaaaaatcttcagattgcattgcaacatggttcaaacacaaatccattttcagcttagcttaaaaaaagaagagtaaattgcactttggtccaccttttattacccaagtttctatttggaccacccttaaacctatatttttaatttggaccaggtaaatttaccattattgcggtttggactactatgaacaacttttctcgtcatgtctaacttccctttcggcaaacatatgaaccacacatagaggagttcggccgtatattagagctaatgtgtttaaggtcgttgattgtacttaaaaaaaatcattcgtggtggttcaaatcacaacaatggtaaaatttatccggtccaaagtgaaaagatttgtttaagggtggtttaaagtgaaacttaagtaataaaatgtggtacaaagctttattcactccaaaaagaaatcgatatgcaatacactgtctgacagtggtgaacggtgactagcagatgcagtttgtgacaggggcggatctaaagtatagtcatcggtgtcaggtgacaccaacgactttcggcaaaacctatagcaaaactaattatctatatattataacatcatattctaaaatataattagtatactatgacatcgataaacacgttatgacaccaataaattaattttctatatccgccaatggtttgtgaggtaatgaacataccgagctcgtcgacgatggtgtagccgttgcagaagcggccggttgggccggcggcgaagtcgatgccgtaggggtagtagttcgccttggcgaacgacgccaggttgttgttgttcccgttgtcgatcagcgagtcgccgaacacgaacagcgccggcaccatcgctgctttccctgtcgacgccgccgcctcctcgctgccgccgccctccgccaccacgacgaataccgcgccgacgacgaccaccgcgcagagaacgaccatcgacgccggcgccggacgcagcgtagccatcagcatttggaagcgaaacgcaacactgtgcaggtgggtgcagtaggctgagttaatataaagcagggtgggttcgctgcatttactccattttaacaaacttaggcttagtttcaaatactacattactaagcaaattctggttacggattatctatttaattataaatataaattaaatattttggtaaataaacctaatagatagatttaataagcaacacaataataataagcaacacaataattcttcatgtgagaaaatatagagtaaattgcgtccacggtacataaacttagtaggtgggtgcgatctagtgtaacaacttgaaaaatgattattctggttagtacgtgcattctggtttaaaaaaacaatattagacaccacaccttttaagccacgtagtaaaaaaaaatcgtcgttgccaataatctaataaggataatgattgtcaaataataatggtctagatgtattgtatttgcttgcttacaataataaataacatgtcgattcgaaaccgaaaatatcgttaaaactaagtgcataaaaattgttgtaacatagtttccgaacgattctactactcaaatatattcaattgtactcatcaccaataattataatagaacaaacaaaataggttgaatcatatgtatgtaacaacgttttttaccaaaatgcacttaattgctaagtttatgtaccggtctatatattttttaagttgttgcactaaatcgcaacccatggtagttcttatactactgattcaatttactcgtgaaaatgtatttcttgaagcgtgaagtaaataatatctgtttaacaatccgatgaataatttgaaaataacctagcctgacttgccccaaatctgaatttacttcgaggagtaaatgcgctgccgtgccatagacatactgtcatattgccactgtgattggcgtgtcatcgaccgtggattgtgaaagtgcttcttcaatcgtgtaaacggaggcacatcttttctacgttaagacttagattttatttttggttaacacgtttttcaaattactgaacaatgttttttacgaaaaccttttatataaaagttgctttaaaatattaaatatattgacttgttaaatttataataattaaaacttaattagtcatgtgctagttaataagtttctcgttttacgtacgccaacataatcttcatattcaccagatgagcccagacatgtaaaagtggactccctctcttgcatgtcttttaggctgttttcttaagtccacttttccaacttcaactcacctgtttttcgcgcgcacgttccccaaacttctagacaatactccatccgtccaacaatatagcaatatagtaccagataggacacttcatagtacaataaatttggatatagtttctatccagattcattgtatcatgaagtatcatatcaggtactaggttactatattatgggacagaggggtatgtttttttttaaaaaaacatttatataggaaaattgctttcaaaattcatataaattcattttaaaagtttttaatctaatacttaattaatcatgcgataatatgtcgctacattttgcgttcccgaggaagaagctcccaaccataagacaagaacacagcctatgtatggatgagatttggcttgccctatcaaaacacgcctgatctaaggtgctttggtttactaccttcattttttaatatatgacactattgatttttttaatcatgtttgatcatttgtcttattcaaaaaatttaagtaaatatcttttcttttattgtggcttgatttatcactaaaggaactttaagcgttacttatattttaagatttgcacaaaatttttgataagatgaatgatcaaatataatgtaaaatgttaatgatgtcatatattaaaaatagaagggagtatctttttttgggaaaaaccgtccggtctttcaaaggaactgagccagacaccggttcctgttgaatcatcggtccggtctggttttctagctgtggtgggccctgaccaaccatgccggcccatattgagttccactgcaatttgggccaattgaggcccaaagtgagaaggcccattagtgactgctcctagtcgtcccctccccttcctcctcgtctccaggtagaagccaaacgcgaggcgaaaccaccacacctcaccgtcgaatcgaatccaaggcggcggcggcggcggcggcggcggcggcgatggggatccacgagcacgtcgaggggatcaaggcgcactgggcgaagaacttctccttcctcgactacttcaagaaggtctacggccgggacaagcccctccccaagtggaccgatgccgacgtcgacgagttcatcgcctccgatcccgtctacggcccgcaggtcaccctcctcctcctccttcccgcacaatccgtctcctgctcgtccggccgcccgtctaaccacgcgaattttcccgatcccccctgtgtttttgcagctcaaggcgatgagggaatccaggaagttcgcgctcggcggggctctcgtcggcggcgcgcacctcggcggcatcgccctcaagtactccaaggccccgcacggtatcaccaccaatcgcgacctatctagtaatttcaacttgcgctgtgattgcgcgtgcatccggtgcctgatttggttgggctgcaggtgtcgtcctggccaccggcttcggggcgatctgcggcgccgtcgtcggatcggaggtggcggagcactggtaccagctctacaagacggacaagcagggggccaacctaaggttcatctactggtgggaggacaaggtcgcaggtatcataccaccttcttcgtctcttgttcttctcattctcatgtgctttacttgctctaattcgatcaggccatttcctttgcaagtgaacactacatcacaatgatgattccggtagttgatttccgatgtaaaatttgtagtaattatgaggtatcaatattgtgcccctttagtgaattgggaatattagtttgcaatcatgagatggtctataatacagttggaatgggctaggaatatcgagtcgtgaatgcgaggtgtcgactctatgctgtttgagtaacttagaaacgtttgaagaatacaacgaagttgtgtgtcagtttttggtcgtggacagttgttaacacaactgatcaggataaagggactgcatgatgttgttccattgagctagcaagtaaatgcatcgcatttgaaggcctccttctaaccgtgttcgattttctttttgggtgcttttgtgaacaggaaaccagaaaagttgagtggtgtctatctggtccagcagcttggcaagagtgatgtccccccgctgggatttttagttgctcattcctagtatttccaaataaggtgtgtattggttgtgacgattacgcagatggagtatgtttccttttgctagtaccgtgagctctgtctgttcacagcctgaacaacaacttttgtgctctgaatggttcacaaactaaatgctgatctttaccggtatctgttgatctttgtccattaaagattactttgcatattgtaagtactgctttaccttgaagataataaggctacataacgtaaccaattcccccctgttagtctttctcaatggatcataattcctaagtgatcattggtgtctcctatgggatctcattcctagtagttttcaaatgaagtgtgcgtggttgtattttgcaattatgcagacgtagtgtgcttccatttgctactactgtgagctctatctgttcacagcctaaaacaactttgcacgaatgattaaattgcatctcggaagtactactctattttaaagataataaaggcttcataatgtgatcaaacttgtttttttctcctgttagtctatctcaacgcatcctaagtgatcatcggttatgagggcctaaacttttgacgttgtagttacttccaatgcatcaatgatcttgattccaatgaaggtcgaccattaatgtatgatgatatagcgctggaattgccatttcttgcatggtatttaaaatgcatatatttttcttccattcttttactaccatgtatggtgctatcatggcattgtgctgcatcctgagcaatgttgtgtaaacatcaacatttcatatgtacatgttgccaaaggactcgagtagttcattttctgatcttggttgtaggtcttcttttattttctgtaccatacttactgttagagttaatttttgtgtaatatgggtggagagcgctggaaaggtgatataagcattgagtttcagcgcaatttgacagtgttaatagttttcctagcatgacctcatcactttgatatttacagttattatttgcacatagattttgtgagcttaaacctggcaaactgaaaccatatatttagatagattttgcgagcttaaacttggcaaactgaaaccagatatttaggtagattttgcaagcttaaacttgtaaactgaaatccgataaaaaaatgcttaattctacaaatgtaataaacgttccaggaaacaatagtctcaattacttgaaatggttcaacaacagagctcctcaagagttctttagggaaaaacaaagcaccacagcccaagacaaatacaatactaaaagacacttcctgcgggaacttgtctaaataaggtacatcagaatagcaaagcaaacagcaacacaagcattattaaccatattacacactagtaatgaacacaagtatcccccaggccattattagtgttagaaggaatagcccatctccgagcccctacaagtagaatagccactcagtatagtcagtgggttagtgatctcttctaacagtgggactgtactaaaatgcccattctgttgatctgctaccatcatgcctacgtcgatcagaccattctgttctactatctgcaagcaaaagcacatatctgacatcagtttacggcacgctgcaacattttatcttcatttttaaaactggcaagtgcacagttctatgtcaatggactgccagtaccttttcttggagaatttcgttagcagctttcaacatgccttcctgcacgattagagataaactatgcttttagttagttattaatcattttattggatatttatagagttaaacaagatagtttggcttgccttgctctttagtgcttggatctcttggatcattatctgcatctgttagattaaagattttagatctcttgaacaatttgttctttatgaaatctgaagactttcaatgagttacctttgcggagcgaatgttgtacatccatatctctaagtacctctctagggcattcagctcttcaacagtcatgtgttcatttgccctgttcccatagatgtacctgccatgggttttaattttgtcaagagttaagtgtctgaactcattataatgtaaataatatatgatgtattcttattacatcaatttctcgagtaaacagttcggtttggtgaatgaagctcttttacttagtgtgagttcaacaatttttttgtaacacttccatgtatggttatgttacttgcagtgatctagtgaatgatactgagtgtggaccaagtctggatagcattgcatacttgttgcgatgtgaacttactaattggacatagaaagctatgtttgtttatgaaatcaaacttggatatttttgctggaagattgtatgattttatctattttttcttctagaa

SEQ ID NO: 77583 - DNA, 657 bp, Oryza sativa
ctgctataaatgcggttaggtaagcccgctgtgctcacctaacccacacacgtggcgccaaaaccacagggggtcggggcgccccagccctcggggccgaaacgggagcggcccgacccctcggggagacagagggaggggtggccacgtcaccctcgggcccgacccccccccccaagggggtcaggccacgtgggtgaccgcggctacccaagcctctagttacgatacccccggccccatgtcaccgacagtagcccccggcgttatgccagggcgatcgcccccctcgagggaagcgctcgggcgtgacgccactccttaggcccggtgacaggtggggccggtccctacaggcgggcagaaacccagcggtcgcaaatcgcgcgcatcggcaagggaaaaccgaccgacaataatgagcggcctctttaagaccgctacattactcgagcagcgcgcgaatcgggacgagccggttcgtttcgcctggagacatgatgatggcgcatttcacggttggcgggcgtagttaatgcgcgcacgatctgccccatctcaaccgccatggccgcacatctgccgcatgcgccgcaaacaggcgagtggggttagtggaggcgtgggcgcgagaaacgagggggcgaggtagtgggc

SEQ ID NO: 77584 - DNA, 1092 bp, Oryza sativa
aatggcggacgaacggcgggtaacggccgccgctcgccgcgccctccgcctcgacgacatggagccggcggcggctgcgccagaggcctcggtggcggaggaccgcccgccggcgcctaggcgctgctgcgccgtcatgaccaagtcggccacgtcatccagccaacgtcgggctggagtctctggatcggggacgacgggcgggtgacgcaggagcgcgcccgcagcctggagcgtgccctggggcgtgccgccatcgccgtagacgaggcggcgacgcgccccatctcgccgtcctcccccgtcgcccgcggacggcgaagtcgcggatctttcgacctccccgagcgcctccccccgcccaagatttcggcgagaggggaacggtggggtgcgagcccgacggcgcgggttctgctccccgtcgtcaccgctagcgttcggagagaggctgtgcgccactgcccgttcggccattgggctgagcgggagaagcttggcgcacacgaaagaggacgagggcttagaaaaacacgcgcgccccctacctggcgcgccagattacggagcgtggggctcctcaccgggagaccgcgcaggcccccctttgccggttcggccgggggcgctaagtgaggttcttcgccctcgatctgaggaacgtcagcgagagaggaaatgcgcaagacacgggcgacgtagacaggttcgggccgctaagaagcgtaataccctactcctgtgttctggtggatctgtgcgtgaaggaatacagagaggccgagagcgaaagagagttcaggctgtagaaacccttcgccagagtccccactccccttctttcctctctctcctttttttctaggcctgggcctcctttttatctggtcaggggtcaccacatgggcctctagctgcctaagaagggaaacatgctttttacaatcagggctagttacagccggaagtgacctctgacaagcagagcacacgcctcctgccctgctcacctgctttcccggtggacgcccatttcaaccttcatttaatggccagcgacttccttgccatacttgcgctgaagcctagaat

SEQ ID NO: 77585 - DNA, 680 bp, Oryza sativa
gtatcccttctcttcttcctcttctccgagcgctcgcatcgcaccgcaattcaatgcccgcgcttcggtgtgagatcgacctagccggcctccctgacgacgattgaagatcgaacctaccgtgtaagctcgttgattctgttgacgccttgtttttcttttttttttagggttgttgacgccttgttgattgattcatggtaaatgttgctgttagtttgattggtgtactcccttgcagcattgccttgatcgatgagttttaactgcattattaatagttaattcttttcctaatttgttctcggagatgaattgacaaattcaatcacaagctaatgcgggttgttcccatgcaagttcaacataacatatcctgaatatatttttgttgaaaaaatatcatacggagtattccgaatcatatacatgtacttgtatgtttttttccgtataacacattatccaaacaattttactacagaatatttttcttaatatatctctcgttaactaactcttgtcttaatcttacatatacagtgcaagatcttgtatagtttgcaaaatccagctgtctaacgaagaacatgtaaaagatcttgtatctgcatggatttcgatgcgactacctaaagtgccaggtaaataactgaaataagctatccagggctgcagga

SEQ ID NO: 77586 - DNA, 1118 bp, Oryza sativa
gagtgaaggacgaaaggaaacaatgacttggttgttgatcaggagttgctactatgctgcatatctcaaagatacaggtgcaaggtatatgtactctctcttagattaaataatttttggcacggtgggcttacccttacccctgattcccacgagacactgcttctccttgccttgagcggttgaaagacagaacagcaattaaagcaccaatcacccgatctttattcaactcttgttccggaagttttcaaatgattttgaaaaacaaaaccaagttcctcaagtgattcactcagtctctctaagtgtatcaaaatgaattcctcaccaaatgttgccttgttgattcctactctaaggttttgatatgtggcgctcggtagggatcaatcatggtatacttgcattcacatttattactaagtcaaaaacttagactaaagcagataactaaacatactcaagatcaagatcgtgcataaagtgtgtgatatatggtgtaaatggtgcatgaagaaaataaagaaaatgcttctcctttttgatttactttcttaatgcttctcctttttgatttactttctttctcccaaaaatccttcttttattggaagtgggcatggctacaaaaatttcttttaacatcatgctcatgcttgatggagtataactttatttatttttttttcatttcataaccatgcctttccctcccctttctttttttttcaaaaggagctttttttctgagaagaaagcacatggaagcatggaaaatttatttttgtggtgttaacgaccgaatttggtaatatcaccatcagaaaagaggattagatcgaagcggagtcaaaggcaaagatcaattcgggaacagagtaagaatcggctgaagtccgagtcggctacggctaagatcggcagagttcgagtcggacgaggttagccgattgagttgaatccgtcaatacaactcggtgtacgtcatcgggttgagttgatatgcttcaagatgattgccacacgtgggtagagtcttgagaaggcaattgtatctattaattaggatattttatgtaatttccttagagatatgtttgggcaaatgtctgccg

SEQ ID NO: 77587 - DNA, 1179 bp, Oryza sativa
agcttaattatgtgctagcatctgatgggtaactggtcagtaatgtagttcaattcctgaataaatgttcaggctcaggagttgcatgcaaattaggtcttcttaatgcgagaaatcagctaaatctattacctaaatgcggagataaaataaatcttgcacctaatgttctggtgaagcttagattaagataagaaataaagaacttgaaacaaaagaaaattgagataagagccaggggcgccttggtattgtgattttgttggctttatggccgcacaaataaaactgaaattgggtgcctaatggctacaaaattcctcctccattttgctttacgaccatttgtcttgttaaaaagatggctagctttgctagcttaattaaaacatgatgcccatttggtgtcatgtcaataacccctctttttctcctcccctctctcttttgctgcacaaagcatctttacccaacaatttgcaatcccaaatgattctctgccattttaaatccctcacttgttagtgctctcacaaggttttcatctctatcacccttggcaaatttcccttttggcccacaggaaatggcataagtactcactgaaaaaactacagcttgaacttgagaggaatacattgacaaggcattctgtggaagagagtaccttgtccatgaaaatgatgtttcctcgtcgaaaatacatcctgacatgaacataaagtaggtttttatatcttacaatatgtatcaatataaagtggtagcagttctagaaaggtgcccttgttagttagctgagggttggagatggggatgaatctggagtgagtgagtttgtttgttcttgttttttcttttttaaaaaatgatgagcttaaaaagaagcacattgtttctatgatgagtcacaactcacaagtacagtttgctcgacatagtagattaaaaggtctttgatatgtgtcaacatataattctgttgtttggggatagcaacaaattctctcctgaaaaagaaattctgaattcagaactttgtgggggctcatacatctatataactgaaagtgcaaaccttcagatatacaggagtagtatacttttctgtcaatattttttttccttcaaaacaatttacaattgacaagatgaaagttactgcttactatagaaatc

SEQ ID NO: 77588 - DNA, 4978 bp, Oryza sativa
tattgctgagatgtacatgttttatagatagcaccttactttaccattgcgggtgctcttataatattgaaattataattagtatgtacttgattaacatatttatcatttggacatttggtcttggtctatttaatgtgttgacgatacattcctgggtgtgtacatgtatgtgttccactgtaatcaaaataagacaaaacgaaaaggtgacactgaaaatttacacatacgcactcgcgggtgtatgctggtgtttggttttaaacggctgaggcaacccggattaaacaaccctaataatatggaggctactgtcaaactggataattttcgccaggccatcgtcaaactagattgtgtttttaggccaacggcctgacgtcctgattttatagaatgcaactaaattcaaacattagactcaaaacaatactatccaagaagaaaagcattagactcaaactgcattgttgacatgaggatttcaaactttgttgcaatatttgactcttttggtccctttgcaatggagcatagtgccggtcaaatagtaactctatgtatatggagacgcacttgatagtgcagtggtaaggggacgtgtggtttcaacaccgagattccgtgtcaatctccaacatattcataaatttcttctttaaaaagtattcgaagggacgtcttttccttcaaatctcgattttaataattatatgtatatgacaaaataattttaactaaagaaagagggttcctcccatcctttagaggcatatacctccctatatattatttaagagcaaaaaaaaaccggttgaactgataaacaattttatgataggagaaaatctcgttctgtgcatggttctctcaccccgtcacccgaggtgtatacctcccaatatttgagagaaaaaatattaaaccgattaaactgattattaaaaaaataagtttataattggcaatgagctatagacttttctgggatccacaaggtatatatagggatatataccttctggctaatacaaatatctatacctcttaaaaaattatatacaaaaagggctctcaatactattctaatttaagtttagttttgatatctactttttatagctatgtatatcttgattatgacgaagtgtatacctctcccagataagagagaacgacttgtagttgtttggcacaaatccaccttagcaacttccccatttgctaattaaaaagagtatgacctacatatgacgacaattaatcgacgtaagtttaggggaatcataaaaagtaaaaaagtaaagtacaaattcatacagtaaactaggttttttcaatgacgtaaaacatatttttctccctatatgttccatatagtctatcatggttagcatagtcaacacacgcacttgattaacttacagtaaaggtaagccggccgccaaatgaatctagctaggcctcaatagccaaatttcccaacacaatatatatcttgtgtggagctagattttaaaaaacaaaattaaatttcacatacaactatataattctctttctaaaatacaattttattttctatataattgtgctgaattcggaaccaccatgattaaataatgctcatgtttatccggttctctgacaaacgtggccttctaagccttccggacaaaatgtggttgctcattatataaaaggcatatcttgagagggcaccaaggattaagaagagtatataaaccaaggcaaaattgagttaaaattaacatactgtccctatttgaatacattggaaatagagaagagtagttagtgagatgtgttttaggaggagactatacaataaatagggacacaaggaaaatgtcacgccccgaactagtaccgaccggaactagcccgtgacgctccaaattaacctgttagtcgataccagtcccaggaaacagtgctggtatcacaggaagacggattatcacagcaacagaggtctctttattatagagtagaggtacagtcatgttgggctgcggacagatcccgagctcacaactgcattacaaaagggaaacggaagccaggactaggaccaaacaacacaggcgcgacttgggaactaggccgaaaccctaaaactcatcgtagccggcttgctcctggaagaactcctcatcagcaggatccgcttcatcttcttcagcaactgggggaggattatttatatagagcaagggtgagtacgggagtactcagcaagccaagggaaaataagtgtttaatgcaggcttcaaggaaaggctgttgtttttgcaattgattttatttgaactcctttctgaaaacaactaagtgagtgcttctcaaacgacacggatgagacagtgcgtctcgtccgatcggagtatgtgcaatgtatcagtctttagaattgaatcaaggttggcacccggccaacagcttttcaaacggccacccgggccaacagcttttcaaacggccacccgggccaacaactttcaaacagccacccgtgcctagctgatcccgtcagctgcagattttcaaacatcgaacccctttccacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacatcgggagacctccaagctttcatgacaaggcatttccaaagccgacacaggtttaccatataccgacgagaggggtcccagatcaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtatttgtcttatgtttggatgaaattccaaggaaacggtccttaagtgcaagagcgggaaaccgtacacccggtacgttccccggtccgcggttttggaaattcatttagttcgcaagcaccgacccaggtgtcgggttttccaagtcttttgcaaaacccaagttttacccaagtttttttttcagattttaagtttgaaggcgtccgtcgatactcgcacagggtgcacgaatatcgagacgcaactagatggttacaaggggacatgatataacaattaacaaagaaaggatcaaatgcaacaaattaggtaggtccgccaatctgccttgcagacgggacaaacagattaagtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggataactcaacaaacggcaaaaataaagccctattaacgacctctaagcgtgccattagatagatctcgatatttgaggaattttggaagttgaacggagtcaaacggatttacggttgggaagatattgaatttctaagattattggatttttggtctaaatgaaaaaggatttatttaaatcctttttgaaaaagaaaaagaaaagaaaagaaggagagagggaaatcagacttccatcgggcggctagggcgcggcccgagagaaaggggcggctcggccgagctaaatgggccggccggcccaagaaggcggcccaaagcgcgcgcgcgggcggagaggagagagggagccggtggaccgagtccatctcgcgtggtcccgggtgggacccgcttgtcagcagctcggctcaccgtgcggagggagcacgcggcgtggcgctagggtgtggagcggggcgcgatgcatgcgtggttcgcggtggacgcggatgcggcgggcccacgcgcagcctcacggctcgcggtggaacacgcgcacggggaggggctgaccggggtcggctcgacccggtcttggccgagctggcgccgacgtggcgcctacgtggctgccacgcgggccggcgggaggtagacgacgatgtcggccggaacggacggcggacggcggctgcgaaaggcggggcgaaccacggcgattcaggcgaaagcgagcacactgggtggttgcacaggacaaggggagacgagccaacggctcggattcgccggagggagcttgacggcggcgaatcgcggcggcggcaaccggcggcgggagaagggggaaatggcgacgaggtcacgaggggccgattcccggcggcgagagcatctacgcggctacgggaatccgatgctagcgttggattaggaggaaacgcatcgagggaggccggcgacgagaggcgcttccgagctcgggcggcgacggcggcgagcacatggcgagcggcggcaacggtcggggcggcgccggctagctacgaggaggctactcgtgctactacccgagtctaaggggaggagatggaacgaggaggaagaacgggggaaggcactcccgtgcgggcgggcgcagtgacgagaggccgacggcgcgggagtgatctctccggcctcgggccgaggaagaggaaggagagggcgcgcccgaagtccccttccgtgtccttgctcgtgccggctcctccgacatgcgcaacgacgaacggcgacggcgaacagagcacgggaggcggcggcaatggcgtggaggcgaatgggagaggaaaggaaagggggaggcttgggtttataggggcggcaatgtcggtttgggacccgacttagggtggtcaaaggagagggctagcgctcggcggtcgcggccaaagcggcgacagggaggagggaggaggatgacgccggcggg

SEQ ID NO: 77589 - DNA, 7637 bp, Oryza sativa
  unsure (1)..(7637): unsure at all n locations
catgttttctcgcacgtttttttgcttgtttttttcgaatgttcttttttgccttttttcgatacaggagaatatatgacgaaataaaaccatgtagtagatggcaaaaaaatcgatggatcctatccaactcaagcgtccattaatttagcttttttctgacagttttttcagagcgatttgtttttcaatagatggtgttttttttcttgcgcgattttgccatttatatgaatcagattttttttccgttcggatctacagtttttttcgccacttaggggaaaaagacttttgttgttgctgtttttctttattttcttttttgtacggcttttctttttctttttatgcccctttctaattttgttctctctcttttattatttttttaacaaaaacgacctcaagtatcttattgcaagattatagggactcaaatgtaaatataaaaattacagggacttaaatgcaaaagtacagacccaaaaattaaaatcaaataaaaatggaatgctctcgacttgtatgttccgtttttgcaaacagatctccaatccgacacatcaattttttttcaccaattagagtcggacttttttttcccttctaagagggaatcggatataggagttggactttttaattttttcgctatttttttacggacgaaggaagcatctcttattttttaagtagtagagatatcaacatttttttcctgtcctatatattatataggaatgttttccgaaactatgtttatcatttaaagaaaatgctatacatacttttaaatatttattaaaatgtctatgtacaacaaacttacgaatattataatcacacaacaaatttctatacttccaacaatatagtttacgaatttctacatatccctcatgtattgaagggtaaaactgacttttctatacctattaaacggtcaactaacagacaattgatggcaagggtatggaagggatccaaatcaaaattcagaggntatacaagggagtgaagaaaattcaggggcatagaagagatcagctaaaatttcaagggtatggaaggaattttctcgctgatataactatatggagtatatggagtagtttgtagccactagcaattattaaaatctaaaactcaacacgtaaacatatcaactcaccattcactagcaatttctaggacattataaatctcatacaagtatgacacatatcttccccacatcatttcacaacatttcaatattcattatttatataataattcacatatatttatctctgaatttcacgggaaagcctggagtatcatgtggtatatatgtacttacttactacctccgtcccaaaatatagcaactttaatttatagataagaatacttatattttaggacggatggagtatttgtttgcagcgacccaaggccagagacttggtggtacgtatgcctgttgactagacttaagggagtgtttgaggagaaggggattgaggagattaggaagatacgtaaaacgaggtgagccattagctcatgattaattgagtattaactattttaaattttaaaaatggattaatatgattttttaaagcaactttcatatagaaattttttgcaaaaaaacgcaccgtttagtagtttgaaaagcgtgcgcgtggaaaacgagagccaatctcccctatcacccctaaatgaacgatgccttagcatcttggcccgaatgcccaatcagtcccagaataatgctatcaaagcactgagatgcttcaagctcttttttctaaaaaagataacgagatgctccaaactcttggagactttcttagaggatggtacctagctagttgggaatgagatggaaagaacgtttcggttaaaaccggagcttccaatcacatactggaaattccgatttgaaccgaacattttcatcattctaatataatatgaagttgtgataatttttaggagcgcctattcaccccctcttgacgacatcgagatccttttagtctcataagctgcaacctctcttttattataatgtgtaatttttggggggcaagtaatataaatataagacatagcatataaataaattatctaattctagacaatagataaaatctgatatttctttcaacagaaactacaatcacttattacaaaattattggcgcaaagccaataggatggaaaagaagagaaatattaactgcaccaacaaaaagaagatatacaaattattcagatagtaatcctatcagtaatttttcatccaaagctggtcatatatattactaacctaatcgatctgaagcttgacatttggcccggtaattttaaaaatgaagaggggcagtataagaagcgccggtttgaaccacggttgcctggctacgccatgcaggaaggcccgtagtgatggcgagaggtagttgagcgctagcattgcacgttcaacaacgggttggagtaagttgagtagaaactcgcggatgtgctgctcgtatgtttccattaaccatttcagcacgaaacaggccatggcgccataaactcctccgttgagctcgatcgctaactgccagccgtccggactgtgaagatgtatcgcggtcctccggcgccatctgctacaaaggataccccataacgcagcatgtttctcctcgctccctcttgccagtcaccggtgctatcgctctcagaggtgtggcttcccatgtcgctctgctctctgttggtttcgacttgtccgctgacggcctccatgaactcctcgtcggcgatgagcttcgccagcacggccggagccaggcaaacctccagcgacatgctcccggcgccgtccggcccctcgtacaccgtcaccttcccgtcgaacttgttcgcgccgccgctccgcacgctcaccggcctcccccacccgaagtcgttgcccaacacgtcgaaccgcggcgagctccccgtgatcagcgccacgccgccgccgccgccggactgcagcttcgacatgtacgtgaactccggctcccgcacccaccgctccagcgactccctcgtgcccgcctcgtcgaacgacgccacggcgcggttcagctgccatgccgtccacccgagccccttctcctcgatctcgccggccgtcgcctccgccttgctcagcgacagcgcgttcccgacgtaccccaccgggatgccgttcacgcgcccccggcattcgaccatcaccgtgtagaacgtcacctgctccggcgggagtcgccgggcgcggcacacagctcgccacaggtgcgcgagcacggcctggagcgacgagatggtggccgtgcccgtggccgtgccggccatctcctcgttcgccctcgccttgagtttccgggcttttgttgccgagaaggtgaagaagcattcctgcacttccggccgctcgagccgccggacgatgtgctgcagtttgccgaccggcatggggatcggcaccgggctggtctcgacgaaccaccgccggaacaccggcgccggcgtggagatctccctgatcaggccgtcgctcacggcgccgccagcgcggcggttgatctccgaccatgcgttcatgaactcccagaaggtggtgccgtcgccgacggagtggttcaacgacatgccgacgaacaagccgtcggcgagctcggtgacctgcaccgacagcactggccgcgactcgacggcggcgtcggcgccgagcaccaggttgtacgagtagaacgaccatacctcgggcggcgtgtagagcgacgagacgacgtcggacacggccacgccgggcgccgccgcgtggacgaactcggcgccctcgccggtgcaccgcagcgtgacggtgacggtcaagtcgtcggtgcgctcctcggcgacgagacggccggtgaacgggtggaacaaagcgagggcgcgcgcgaaggaggacgcgagggcgtcggcgaggcggtcgccggagagcggcggcttgggcaggaggacgcccttctggatgtagtcgatgctgaggaggcggaggtcccacggcgtgaggtggatgtcgcacggcggcgcgtgaccggacgacgacaacgacgacgacggccggacgaggcgtcgggacaggacccggacacggtcaacggcgagtgctacgtttcggtggtcattgcttcccatgtcacgctgctctcttggagtccgtacgccttcttttttttttttttgaatccgtgctactggggacaccagtcacaccacgtcttgtgcgtgtgcataatagtgtattttatgggcaataatatatagaggtccaactaaagtattactccaccagtagaccctaccatattttagaaaggtgacatgggatttctttctcttcatttttttttatctcttctcgttaactctagatgttgacattttaatttagaaactattaaagtaatttctatactcatatatatatatatatataaattatatacctagtgggttgtttttttggaaacaaattattatccaatagcctctcgtctctctcttttcatccaactattcaattgtttccattgttggtacctaaaaagagttgggttttttttatgagaaatgatttttttcagctttgttttgctctctttattaactcttttatcgcatcagttttttttcttacacgacaacatatttaatgctatagaaactagctaaggtgaatgattggtactgctttaaaagctagatctaaaatgttatcaaccaccctaatttgaccatatctttaggatactccaatatcatatataattaacaattcaattttagtgttggatctcaatccagaggatctcttccatcccttgaaactgcattgttgacatgaggttttcaagaagaaaagcattagactcaaactgcattgttgacatgaggatttcaaactttgttgcaatatttgtctctttcggtccctgtgcagtggagcatagtgtcggtcaaataataactctatgtactacctccatcccaaaatgtttgacgccgttgacttttttaaaaatgtttgaccgttcgtcttattcaaaaaatttaagtaattgttaattctttttctatcatttgatttattgttaaatatacttttatgtatacatatagttttacacatatcacaaaagtttttgaataaaacgaacggtcaaacatgtttaaaaaagttaacggtgtcaaacatttagggaatgatggagtatattttctatataattgtgccaaatttggaaccaccatgattaaataatgcacatgcttatctggttctctgacaaacgtggtcttctaagccttccggactaaatgtggttgctcattatataaagggcatatcttgagtgggcacaaaggattaagaagagtatataaaccaaggcaaagttgagttaaaattaacatatcctatttggatacattggaaatagagaagagtagttaggtcatttacaacctaatgactaagatggtgtccatagtattaaataagttgtcacttgggatgaaaaatgatatggcaagtgaataaatgaggaaagagaaggaaaccatgtcttgcatgagacatggtttctacacaacatccaagacatcatgtgagataagtagcattaaattgaagtatggaatagtggtgtttgcattggaaaagtagtgtctagtactagtttcttgatgatatggagtttatgaaaactatgtctagtgtcataggttgggaatggctttagtgagatgtgttttaggaggaaactatataataagtagggacacaaggaaaacaagcaagaaattgttatgcatgccttacattttaaaacaagataagaaaaaccatatgctttattaaaacacggattaaaatataatggatatattaaagaataaaaccataatgatatggctgcacttggaacattgcaaaccaaacttggctgtcaagatgctccatgtctttggagatgtgtataactagtataaaatatatagcccagaacacgagactgccatctctcagtcttttactagtattttaaatcattgcatttacgacttaattatacacgtgagccaccattgggagactagcaactttctatctgacctgtcttggttttctcttcggttttgtcttgatcatctctttagtttagccgatgtggttgccaatggcgtgataaaagaaaacctacaattaataagcctaaaaaattacaattaatgcccctaatgaaacccaaaaattgacacgaacggcgtgtgagttagcaagacttaagacttgcactcagtagtcaatatatcaataaataaaattaagggtgagtttgaggagagagggattaagaagattgaaaagatacgtaaaacgaggtgagccattagtatatgattaattgagtattaactattttaaatttcaaaaatggattaatatgattttttaaaacaactttcctatagaaattttttgcaaaaaatacaccgtttagtagtttgggaagcgtgcgcgcagaatacgatgtccttttgtcacccaatcccccagaactcatcacaacgaacgcagcctaagagcaggtacaatagcagggtataaactaactgcaaacatattttaagaagataaatgaggagagagaagagcagcgggctacagatttgtagccagctgtagcacggacttaaagacgcagtgtgtgtatgacaggtgggaccatgtattaatagtgtagtatgtaactattatatgattgagctattagattggctatagatgaattggagctagtagttaggcatactattaaacttgctataagaagattggtacagtggagcaaaagacaaacatagtctggcacgatatgtcaacactttggtgacggtatctggtgatctactatgtgtgttcgtgactccctttttctaacccctctcccttatttttcacgcgcaagtttttcaaactgctaaacgatatattttttacaaaaatttctatacaaaagttattttaaaaaaatcaaattaatcttttttttaaaattaactaatatttaattaatcatgcgctaatagatcactccgttttccgtaaatactattcggttggaaaagtctactggcgaacacagcataggaccgcagcgcgtgaccggacgacgacggccggacgaggcgtcgggacaggacccggacacggtcaacggcgagcgctacgttccggtggtcattgcttaccatgtcacgctgctctcttggattccgtacgcctctactagacacacaacaccttcagcatatgcttcggcacataaaaccatgtaatccctcgatcaaaaaaaaaaccttaaccggatatgaccttcttagtattacgaaccatctccagattcgttatactagaaagggtcccatcttctagtagattaagttttttttaacagataaagtatacactaacacatactcctaattatttaatttttttaaaacacaccaattagtttgataagcatgacgtacggaaaacaagataaatgagttgagaaact

SEQ ID NO: 77590 - DNA, 7930 bp, Oryza sativa
tgcgagccaggcttgctccaacagcactggttttgctcaccttgtggtagtaggaagcagcaaggctgtctcccttgttgttcctgaaatttgcaaatcactctgttactaccaaaatcaaagcatgttagaataacctattgcagtaacttgttgcaccaatactagtccaaaatactccatctgtttcacaatgtaagtcattctaacattttccacattcatattgatgtaaacgaatctagacatgtatatctatctagattcattaacatcaatatgaatgtgggaaatgctaaaatgtcttacattgtgaaacggagggagtagcatatggatgacacagaagatgataagcaaacggcccaagaaatccccagaaactactgccaaatcactttgtgctactggaaatggtagctctggacaaaggttcaaccatacaatcccctcgggtccggctatggtaggttaatcacacgctaatggaccactccgttttgtgtgtttgggggagagttcccaactcccactaaagaacggagcctaagtccacgcccctcgctctgccaacttgaggatagtaagctagggtttcctcatatagcatagtaaccacaggcataatctttgggctcacataatttagctccttattccttgatgaagcacttgaagggctagcaatgttgtcacatggagccatagatagtttcaatgaagagaacttgctaggaacatcccacatctggtaatgcacttctgacgaactccagggcaccgtcgctgcactttagagtcataagtgatgcctgatcaagtgcatacaagttttcaatcgcttgattaaatggattatataaaccaagcttcctcccagtattcagtagaacccttccatctattggatcaactgcgagaggcactacaacatttgtcgcaagcgaaaaatctggccagagttttaaattgattgtgtatgctatagtccacagaccatgatcccacttccatatatctaactcatctgcaactggatctgagaggcatacacacaacatcctctgaagctcgaccacaaatgcggacagcgactttcattgtcccacattgcaatgcatgaagggcaagggataacatcaaagatcttagcagtaacatcaaaagagacaatggcccgctcataactccaacccaccttggctcgctagtcgctcatccagtacaggaacccatccagagaagcaggtggcatgtcattcacaggcagaggcggcccaggaagatgcatgctgtatccaaagccacaaccaaacatcacgcatcttaagtaatatccacgagttttgtagtctctccagtcatagaaaatcgcgacaacaacatgatcctgaatcacctggctgaatgccaagccaacattcttattgtcaatagcaaaaggattgccttcttgttcacagcaactgataggcgctttccacattgggtgcagctgcagctgcagcagctctttgtgcctgttccaatagatcatgcggtaaccagtacacgggttgaacagacagtccttctcctcatgctcaccagattcaacccatggcaaggcttggagcaaaccatctttgtgtctagaaacagtgtcttgattagatgcctcttggagccatttacttaagggaacaaagctgaaaagagattttctagagcccttacccacaagcatgatttttggctcgtcgacctcattagacatttagactggacagatactcgattactgagttgcacgcatgacccactaaatgtttctaccaaattactcttcttttgaatgagtttaccatgaccgtaattaatttatatggacaactatatcaaaggtaaaattagggtcctaatttgcatgttgtcccggggcaccaaaattgtgtagacgccctgcctataaatggagtatatgtcttcgtatgtaagagatgattttataaaaaggacttcgtctgtcccaaaacattataattcaggatggatttgaaccatactagaacaacatgttaccacttaaatttagcactatagcaagaataggaaaacatgaacaaatttgaaaaggacccagacttaccatgcgagtccagtctaacactgtcgtagggctagtcagatcaacagcatatagacgatcaaaccgtcatagcccaactccggccctgtttagttccaaagtttttttttccaaacttccaactttccatcacatcaaacatttcatacacacacaacttttctgtcacatcgtaccaatttcaaccaaactttcaaacttcagtgtgaactaaacacagcctccgagtaggaatccgttggtgaacacaccaaacttaataaataagtatttggtatcccaagatgtattacagcttatgtattaatattatttttaaatttttcttatattgtttatataggttgtaagcacctaaaactagtttgaaattgagatatcaaagatcaagcaaacgattgtgaaacattgaaatatttttgaacttgataatgttgtcatccatggctttataaacttgcatcttaaaaatacaacttatagagaaaaaaatattattagttaataaagtgaactatttaaaataatttatagctataatgaggaaaaaatagtttagcaggtcaagtgacaacaaaatagactcttcttttttcaatgtcaaatgatgtttcaaaataggtacagtaattagcattttccataacatactgttgttagaatacaataatgtccaaggtcctacccgcgaaaatcccaacactggactggaagcgccttggtggtgctttgccttagcgatcgcgatttcgcgaggtcttcgcttcgtctccgccccacacccccaaacccacagccacgacgcggccgcaatggcggagcccgagtcctccacggccgcggccggcggcagccgcctccgcaacgcctgcgggggcgtgctgtgcgccttcaccctcctcctcatcggcgtcctcgcgttctcgatccgcctcttctccgtaagatctgatccgccccctccccccactccacctcgcgcggcggccagatccggctcgccgttcgtctcgcgtttcggaattgtgcattcttaatcggccccttcgttttttttttgtgcctcaggtgattaagtacgagagcgtgatccacgagttcgacccctacttcaacttccgcgtcactcaggttggattgcggggagcttccatcttgtgtgttattatttttgtggagtatgcggatttaaggaatttagctcgaatcataggggactgcaatgttgtgttgatttcagagtgttggtgtcagtgggttttgggttttgcaaagtgattttggagtatattttcgtttactactggatgattagtggaagtatggagcaacagatggttacatgcttgctggaatcagttgtggattacatcagatctaaaatttccatcttacctattacagtttttgtcgaagaatgggatctacgagttctggaactggtttgatgacaggacatggtaagagccttacgtcagatgaataatttaatattccctccatctacttttgatagtcatatttcatcttggcacaatgaccaaggataagtaattctacttatcatccatttaaacatgctactagttattccttgtaaacaagcgattcattaatatttacatttctcgatgcccatgtagccaatcttgtgtggaagaatgtagagtcacgcattaaatcctagaaagtcattaagatgataggtgattgaattgaaatatgcctatcaaaagtaaatttttcagatttgggaatatgcctatcaaaagtagatggagggagtattgtgtaatcatgatgtaaaatagaatgtgtaatacgcctacttggctgattcccttgctgttgcttctgttttaggtatccccttggccgtgtgattggcggcactgtgtatcctggtttgacattgacagctggaaccatttggtggtatgttatcaaaggaaagcacttgtctgttcctcattaatgctgtggatgtgcctaaaatatttgattggttttgcaggttgctaaattctctaaacattccgttgtcagtggagactgtttgtgtgttcactgctccaatattctcagcaaacgcttcctgggctacttaccttttaacaaaggtgttattttttcctctcccggaagcactagttctcacactattggtactcatacaaataattgtgcttatttcttttaaccttccataggaagccaaaggcactggggctggattgatggcagcagctattttggcaatggtaatctgcactatggatttttctactaggctttttttttatcatgaaagattactatagtattttgactcgattatgatccatatattttcttttccacattacacttgtcatagtaataggaagctatgataatgaagccgtagcaatactgaatccacattccacattacacttcttttccacactcaaatcacacatcatttattacaggttccctcatacatctcaagatccgttgcaggaagctatgataatgaagccgtagcaatatttgctttgatattcacattttatctatatgtaaaggtaatggtgcatgggttgtttttgttgcctctttaacatagcgttatgaactgacctgttctcaaatgatttgcagacactgaacacaggatcactcttttatgcaacgctcaatgctctctcatatttctacatggtaatatctgataatttgaacccatgttttccaatgtcctttataatcaagcaacaaccttgtgcaggtctgttcttggggaggttacacattcatcatcaaccttattccaattcatgtactgttgtgcattgtcactggtcgttattcttcacggctttacattgcttatgctccccttgtaagtgcataacatcatccttttctttcttcattttgaacaaacaaaataaaaggagttaaacgtttcagtgatactgtttgtctggaaactgacctaataagataattatcattttgcaggttatactgggaacacttctggcagccttagtacccgtggttggttttaatgcagtgatgacgtctgagcactttgcatcatttctggtatatacattcattggcttatgcacaccttttcttccttgtggaattttcttcattcagatcatttacccactttgccctattagaataaataaccagtgaactttatctcctaacttcatcggagaaaattgctataagccaccaataatttcattgataatagtatactttaattgcaggtgttcataatccttcatgtggttgctcttgtgtattacataaaaggacttctaactcccaggctgttcaaagtagctatgactcttgtcataacagttggcttgtaagtctcttgctttttttattgtcaggtgcatgagaaactagacattgagcttgtttattccttggaccaataatcaccatctatccatcagaatttaaacatttaatttctttatttgagatggtatcttaacccacatatgctaatggcaacatccttcctccagggctgtttgttttgcagtaatagctatactcatcgctttggtggcatctagccccacaaaaggatggagtgggcgcagtttgagtctacttgatccgtaagtttttttaccatggaaaataaatattatgttattttgctgtaccgggctgggaatcattacatgaaataatacttaattttgaccagctgaaataatacaaactatgcccctttttttatgcttactgttttagacaaggaaagcagtctttctgatgcatgattttctgaatggagtatatctcaatgtcctattggtgtttattttccgtacgggctgggaaccattacatgaaataatacttaattttgaccggctgaaataataaaaacaatgcccattttttatgcttactgttttagacaaatgaaagcaagtctttctgatgcatgattttctgaatggagtatatcacaatgtcatattggagtttattttcttctggttctctttctgcatcataacttcacgttttttcctgctttttttttacagaacctatgcaagcaagtacatccctattattgctagtgtcagcgaacatcaaccccctacctggccctcctatttcatggatatcaacgtgttggccttcttgattcctgctgggatcattgtaagcagtctacattttcaatccgaattgaattagcataagtatttgttcttactagttaatattgacattgtcaacagtcatgcttcttgcctttatctgatgcaagctccttcgtggtcttgtacttggtcaccgcagtatatttttctggagtaatggtaagaatatgtgtaatgtaaaagcatctataaagcaatgtttatctagtatttatttattaacttttctttacatatattctcttttaggtgcggcttatgcttgtccttgctcctgctgcgtgcattttatctggaatcgctctttctgaggctttcgacgtcctcacaagatccgttaaatatcagctatcaaaattatttgatgacagccctgctgctgtacggttgctttcttcattgtttttctttactctgttaataattacctggcttcatccttaacaaacttattgacaacttatttcttctgaaacttaagtcaggggatagtagtgcagagagttctagcgctagtactgtctccacaaattcagcaaaaaatgagactagacctgaaaaaactgaaacagccccaaaggaaaaaccatcaaagaaaaaccggaagaaggaaaaggaagtggctgaaagtgttcctgtaaagcctaaaaaggaaaagaagcttttggtacttcctatggaggcatctgttttgggcattttgttgctgatcgtgttaggtggtttctatgtggtaagttaaatattcttagtcttacagaaagaacagtcataccataagtgatgtctggatgtatcttaggagatgcatttttgtaggtccattgtgtgtgggcagcagctgaggcgtactcagctccttcaattgtgttgacttctcgttcgcgtgatggattgcatgtttttgatgatttccgtgaagcctatgcatggctcagccataacacagatgttgatgacaaggtacgctcatcccttgccctctatttctaagtgctctgtgtttttctgacagtaagacggtccactgcaggttgcgtcctggtgggattatggttatcaaacaactgcaatggccaacaggactgtaattgtagacaataatacttggaataatacccacatagcaacagttggaacagcgatgtcatctccagaaaaagcagcttgggagatcttcaattctttagatgtcaaatatgtccttgttgtatttggaggttgatgctttgtggacttctttagaacaaatcaataactagtggccccagatccctgacgttgggtgtttactttacaggtcttgttggctaccctagcgatgatattaacaagttcctttggatggttcgcataggaggtggtgtattccctcacatcaaggaacctgattatcttgtgagttgtgaatctttttagggatggtgccttacacatcattttggtgggcataaggaagaatagaaatagtgaaacaaatatatgagcttgattcactattctgatttctcatgttattttgttgccagagggatggtaactatcgtgttgatgctcaaggcaccccaactatgctgaattgcctcatgta

SEQ ID NO: 77591 - DNA, 2226 bp, Oryza sativa
ttactctcttaccatatcaatttttttcttacatgacaacatatttaatttaatgctatgaaaactagttgaggtggatggttggtactgctctaaaagctagttctgatatgctatcaaacaccctaattcaaacccagggtttgatttttttttgatagagtagtatatctttagaatactccattattagatataattaatattggatctcaatccagaggatctcttccatccttttgactatattccttctccaaaaccctgtgtattatattttggtgctaccaccttgccaccacactatatttgtttccacaacgctacctacttgcaagacatcatcaccgtcttctctcccatgcgatcggagatgagggtaagaaacctccaactttgcatagggttgacaatgagggagaaaaacaagttattataatataatataatatatagtggcaattctaacttaatgcaggattgacaatgagaaaaagaatgagtttgttagaaggtaacatggggtacggtggtagcaggctcatatatatctaggaggcgaaacataaacaatgggcaagaactgaagaagcaatggttggccgccgatatgaaaggttgaagaaatcagccatattaactgacataatcgttggacatgataatactaatgactagagattacctattggctggcgcacaaatcggatctcagctaatgatgcgtattctcaactcgagatgttgacattttgctcatttgtgatctgcggctgttgatttcctgatgagcccttatcatattgaaatttataattaggtatgtacttgattaacatattcatcatttggacatttggtcttggtctatttaaaagtgtgttagaggatatattaattcatgggtatgtgtacttgtagatcgagtaatgtgtgtatgtgtttcactgtaatcaaaataagacaaaacgaaaaggtgtcatcgaaaatttacacgcattcccatatctataaagttataacccactaattttaaaactcaacatatatacaaacatgctacctcatcatccactagcaataattacatacaaaaattatgcaagcatgcaacatcatctataattcattgaattctacaaatcaacatccaatcatcttcctttacattatttttcattatatatatatatatatccatcatttttatagtaattaacatatattcatccatataaccaaagtgagggatatcatatttcatctataatctcatacagagtttactaaatttatttctctcttaacatagtttgataaaccagatttatttgttgttaataactaatataatttatacttttagcttgattattaaaaaatattaaaagttactcagtaatttccacagcaaagcgtggggaatcacatagtattataagcatactggtgtttggttttaaacggttgaggaaacccggattaaacaaccttaattatatggaagctattgtcaaactggataattttcgcggggccatcgtcaaactagattgtgtttttaggccaacggcctagcgtcgtgattttatatatagaatgcaaataaatttaaacattagactcaaaacattttttttgactgaaagtatcctagcagtgtgattttcatttattgaaggaatatttacatggaataattacagggaaaaacaagagaaaatgaaaaagctctataaagattgtaaccaattaataacagcttgcttgaggggatccttcattctgcagagatgcagaagaatttcatttataaagagagactttcaagattggaaggttggctacaaattcctgaagatgaggccatttctttatttccagatgtgccaagcaaccacgaagaagatttctagaaaaccgggctgattgaactgccatcttgtgagagctatcctttggtaaaattcaagattggcattctatttaattcccagaaactgccaacaagcattagactcaaaacattactatctaagaagaaaagcttagctttagactcaaattgcattgttgacatggggatttcaaacttcgttgcaatatttgactctttcggtccctgtgcagtggagcataatgccggtcaaataataattccacgtatacgacggaaatttttttaaaaaaatatcaaatactccctctgttttgaaatgtttgaca

SEQ ID NO: 77592 - DNA, 2247 bp, Oryza sativa
  unsure (1)..(2247): unsure at all n locations
gtgtttgaccgttcatcttattcaaaaaatttaagtaattatttattcttttcatatcatttgatttatcgttaaataaactttcatgtacacatatagttttacatatttcataaattattttgaataagacgaacggtcaaacatgtgctaaaaagtcaacggtgtcaaatattttgaaacggagggagtatgagcaagaaaagttacggaaagagggttcctcccatatatatcctttagatcctttagagacatatacctccctattatttaagagaaaacaaataaaccggttgaactgatatacaattttgtgataggaggaaacctcattccgaggttctctcatccgaggtatacacctcccattatttgagacaaaaatattaaaccgattaaactgattattagaaaataagtttgttatttgcaaggagctagctagacttttctggtccacaagctgtataaataaggatatataccttctggctaatacaaatatctatacctcgtaaaaaaaattatatacaaagacgggctttcaaaactattctaattttatttagataatggaatataagattagttcaatactattctaatttataagattggttttgatatctactttttataggtatgtatacgaagtgtcccagataagagagaacgacttgcagttgtttggcacaaatccaccttacactactagaaaaatggtctttagcgacgttggccatttattttttcaggcgggtagacacctaaaacacgcaacaccgcctaggaagccagctaccggggccatggttgctttccgcctgcgaagatagttctttgcagacggaccacctaagctagccgcctgcgaagactaagcttcgcaggcggaccacataaggggccgcctgcgattattccaggcggtcttgttatgtggttcgcctgggaagctcaatcttcgtaggcgcccattttatgccgcctgggaaatttatcgcaggcgacatattttaccgcctgtaaaaatctggccgactatatagtcttattcctccccgagctcctgttcatacccgacgattttctctctcttaaaggcaccaaaatataggggggaggttttaaactttaaattttcaagggatttttctacggtggttagatatatgcctttgtactctatatacataatttttttgtaatttaaactccctttttaccatggatctatgcatcaggtcgtcgctcatggcgccgccagcgcggcggttgatctccgaccatgcgttcatgaacttccagaaggtggtgccatcgccgacggagtggttcaacgacatgccgacgaacacgccgtcggcgagctcggtgacctgcaccgacagcacgggccgcgactcggtggcggcgtcggcgccgagcaccaggttgtacgagtagaacgaccatacctccggcggcgtgtagagcgacgagacgacgtcggacacggccacgccgggcgccgccgcgtggacgaactcggcgccctcgccggtgcaccgcagcgcgacggtgacggtcccgtcgtcggcgcgctcctcggcgacgagacggccggcgaacgggtagaacagcgcgagggcgcgcgcgaaggaggacgcgagggcgtcagcgaggcggtcgccggagagcggtggcttgggcaggaggacgcccttctggatgtagtcgatgctgaggaagcggaggtcccacggcgtgaggtggatgtcgcgcggcggcgcgtgaccggacgacgacgacgacgacgacggccggacgaggcgtcgggacaggacccggacacggtcaacggcgagtgctacgttccggtggtcattgcttcccatgtcacgctgctctcttggaatccgtacgcctcgatctactggacaaaccacaccttgaagatgtatatagtgtattttatggttgggctcttactctgagattctagtattcgaggagctaacgatccaataaacagaacctactatatggagtattttagaagtgcagaattaaaattgtatgaaattgaatattgttagagtgaagtgcatgggtggtccttaaacttgtacggatgtatcatttagatccctaaactctcaaaatgtatttttgagtccccgaacttgtcatgagtgtcatgtaggtctaaacggactctaacccgcttcgtgagatgatgtggcatgccacngtgacgcttac

SEQ ID NO: 77593 - DNA, 4964 bp, Oryza sativa
acatgtcactggcttacaaaatacaatttacatatagaggggagagagagagagagaggagaaaataagttttttaattttgaaaaaaaataaatgaaaacaagagaggataaaaaatgttttttatttttgtatatatgactgacatatgggttccaatgacacataggcgccaccatggcatgccacatcagcacacgaagtgagttggagcccatttgaacctatatgacactcgagacaaattgagaggcctaaaaatacattttgagagttcagggatataggtggcacacccgcacaagtttagagaccgctcatatactttactcatattgttatataaggacaattctaattcagaaactactaaagtaatttccatactcaccatgtcatacatacatacatatatatatatatatatatatatatatatatatatatatatatttatatatatttatatatttatattatatagtggtttgttttttcgaaaaaaaattcttgtctaataacatctcatctctctcctttcatccaactattccattgttcccattgttggttcctaaaaagagttggttttttcaagataaatgatttttttcagctttattttgctctctttattaactctcttatcgcatcagtatttttttcctatatgacaacatatttaatgctatagaaactagctgaggtggatggttggtactgctttaaaagccagatatgaaatgctatcaaccaccctaatttaactatatcttgtcacgaccggaattaacccaacgggcgttcctttcgtgcgtgtattattccttgtcccaggaggcaaggtacaccaagagttgatacaattcagagtttaacaagcggaagcgtaaatagataatttattacatgggcgacgaaggcccagcacacacaaagacaaacgagaaacagcggaagacaagggcgacgaccacaggcgcttgacggcaggcacgagctagacaccaaagccttcatcaaccaggggctcctcttctgggttggaaaaaattaagcaagactgagtacaaccaccgtactcaacaagacacacccacaagtgcataataaatgcaagggagtacaagggagttataatataaagggttagggttgcagtaaacagcatttaaagatgcttagttgctcaaagctattttgtaaacacgattctagaactatgcaatattatttatcaaggccgtgaacccacacgaacctgccttaacccaaggcctacgatgattcaaaccgaaccggcaacccgaccctgggtcctagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccacgacatctcgactaccgggccgcagctcgtgtagccttcatttgccctggagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcgatgtgaattcaattccacaatactccaacaattccaaagtgtccaggtgatatgaatatcccaaagtctagagttgtaaaaccgcctaatgttacctaattaaatagcgaagcatctacctaacatcatactagtggtaccatgagtagagtgtccactagttggggttttgtttaatctagggtgaacaaggaaataataacaataacaataataaggtcataacaaaggtaaataggcatgctaaataaaacagtgataacgcgggaatttaaataaagcgataatgcaataatttaaatcaacataattttataaactgggattcaatatgttcaaagatgatgtgacttgccttgctcgctttcccaaacgtcggcttcaacctccacgaagagcggatcttccgaagttgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaaggttatatgctctttaaatgaatatttgcgaatttcttcatttaaattttaatttaaaatggatttattgcgtcagccgaggggaggggcgcgcagaccgggtccacgggagtggggcccacgcggcagcctcacggtccacggtggaccgggtgcacctggctcacaccggccggcgccgtgggtcccacgcgtcagccgcacccgagggcgcgggcggctgacggccgggccccacatggcagccgcggggcgcgcccgaaggcggccacgccggcacagccgacgggaggcggcgcacccgcgccccgatggtcgccgccggcgaccaccggcgcggtggagcggcgcccgagagaggggagggaagggggaaacaaatcggcggtccacagctcaccccgggtcgacggcgacgacgggaacggcgaccggagcggaggaaggcggcggcgcggctcgggtagacggggacggcggcgttccggcggtcggcgggcgaaacggaggggtggacgaggtcggcgaggttgcggcgaaaccgaaggaggcggcgccgaagcgggagaaggtccggggcgacgacggcggcagaccggagctcggcggtgacggcggagagagagagcgacggcgcgagctcgattccggcggagagagggagcggcgagtggcggaaacggtggagggaggcacggggagtgtttatatagggttgggagtgagagagggtggccggatgagggggaaacgggcgcggaagatccggccgccattgatgcgccggcgaggtttagggggaaagtttccgaacgaatccgagggagagagggagggaaaaatggggggaaagcgggagggaatcacggggaatatttcccccctcttgattgcacgctgggcggacgggagcggcgggatttgcagcggcggcggcgctagggcacgggcgatgcggcgggagcggcgggaggaaggggatgacgggtgggccccacccgtcagcgaaggtggcgggcgggcccgcccgtcagcggcgcgcgcgcgggggggagaccgaatgggccgcggggaggaggagagagagggaagaagatgggccgagccggcccaagagggggaggggggaaaagactttttaggatttttctttttataaaatcattttaactttgtttatttcttaataattattatttgtgctctgaaaattccactaaaatttatttacgcattttaggcttttaggaaatatacaaaaatcctccaagccttatttgacttttaactttgcacattttaattgtgggaggctttcacaaggattttaattattctaggcataatttcgaggatgtattttagagtcgttttgggacgcgacatatctttaggatactccaatatcagatataattaataattgaattttagtgttggatctcaatctagaggatctcttccatcttttgactatcttccttctcccaaaccttgtgtattatattggtgctaccaccttaccaccaagctatatttgttcctacaagtctacctacttgcaagacatcatcaccgtcttctctcccatgcaattggagatagatgagggtaagaaacctaccgtttcgcagaggagcggcggcgcagctgtacggcgacgatggcagcgcgcgccgtgaggatggaggggcgccgtcagcggccggcgccactagccggagccgtcgccgcggccgctccgccctcgccctcccgttgcctccgccggccagacctcgcctgcccaccatcgtcgctaacatgtgggatagagagagaagagattagagagagaagtgaagaaagggatggagagagaagtggaggggatagagagagaagagattagagagagaagtgaagaaagggatggagagagaagtgaagggggggatacagagagaagagagataggagagctgacatgtgggcccaagggcatttttgacatttcacatgatttctctctactcttcaaccaaaaattattactttaatgcgtgcggtgtccactagcaaaaatccaacttttgggagtgttttcctccaaaagtcacttcgtgcgatgtcctacagctaaaactgcgaagtcacggtgtcctgtagcaaaatttgcctatctaataacctctcgtctctctcctttcatccaactatttcattgtttccattgttggttcctaaaaagagttggtttttgtcaggttatggatactgcataactaatggtaatcgactaagttcagcggggcccaccatataccaagtcttatatggaatcataccacgtatatagaagtagttccggataaagaaggacgaatagagttctatatggaaacaacaatgactacttggattgtatctatattggtctccctagttctacttgg

SEQ ID NO: 77594 - DNA, 671 bp, Oryza sativa
cagttgatgaaaatttgcaagccaagattaaacttgaatatatagagctccatccattttaaaatatatgtgtttattttgtttccctttttaatgtaagcattcttgccaaaattgcaggctgtactcaaaatagtgagatctggtgatcagataaaactttctaaatcaccactcaaagtctgaacctatattggtaacagttcatatgcaggatggaaatacataaacacatgaggagctttctcttttgttttcccgtttcattatatatatatatatatatatatatatatatatatatatatatatatatatatattatatatatatatatatatatatatatataccaaaatacccatgcatgtgggacccacacgtcagttccattttaatttcttcctccaccctcccctcttcttgctttccatctctgtccacctctccctcggtaataagagaggcagtggcgggcaatccatgggtgtgcggcggcacaagcaacgagagagcgaggcagcggtgaccttgtatgtgagggaggtggacgctgcataaacaccatctttaaggcaggagccctcgagtgaatgattgatgtgagaatttgtagctgctaaataatatggaaaattttaacctttataccttttaaaatcaatgtgggg

SEQ ID NO: 77595 - DNA, 669 bp, Oryza sativa
  unsure (1)..(669): unsure at all n locations
atgtcagaccaagatttccaacaaataccttctttactgtcttcatcattggtacctgtccaccagaatttcctgataatggcagttaatttatatagaagttttttggagtgtaaaatggtagacatatagaaaatagggatggaagcaaacacagattttattaaagaaagtctaccagcatgggataaagtttttgctttaataattgacagcctggttttgaatttttcaatgataaagttgtaggcagagtttctggctttagtatttagaatgagaggatgaccaagatgtttggaattgttgttcattaaggagacagggaaaatggataaaatatcttgagtgacactgataggataggagtatgagagctgaacagaatagaagatttattccaacctggagtttgacctgattgatggcaaaaaaattgaataatttggaagatgcttctagcttcttcaggagtggcttgacctacaatcataagatcgtcagcatacattgaagagtgagggtgggttgttttttaaaagnaaaatttccccccccaaaggggggggggaaaaaccccctttttaactttagtcccttctttagacactaatttagagtattaaatatagactacttacaaaactaattacataaataaaagctaat

SEQ ID NO: 77596 - DNA, 7871 bp, Oryza sativa
actttcccatctctcagtcttttactagtattttagatcgttgcatttacgacttaattatactatcttcatctcaaaataaacataatcatgagttttcatatctaactttgatcgttcgtcttatttaaaaaaattataattgatatttttattgttattatattataaaacatgaataatattttatacatgacttatgttttttattttttttaaataaaacgaataataaaagttggacacagaaacttatagctgtgtttatttagggatggagggagtacatgtgagccaccattgggagactagcaacttcgcatctgacctgtcttggttatctctttggttttgtcttgatcatctctttattttagccgatgtggttgccaaaggcgtgataaaggaaaacctacaattaatgagcctaaaaaattaaaattaatgcccctaatggaaccccaaaattgacacgaacggcgtgtgagttagcaagacttaagacttgcactcagcagtcaataaataaaattaagaagattggtatagtggagcaaaagacaaacatatatagtcgttgctgacacgatctgtcaacactttggtgacggtatctgctgatctaactacatagtttgtagccactagcaagtattaaaagttaaaatttaacgtgtaaacatatcatctcatcatccactagcaatttctaggacattataaatcttatacaagtatgacacatatcttctccacatcatttcacaacatttcaatatgcattatacaataattcacatatattaatctttaaattccatagcgaagcgtggattatcacatggtacatagtagtatgttcttatttgtttgcagcgacccaaggcccgagacttggtgatacggatgcctcttgactagacttttaaatagcttcttggcccgaatgcccaatcagtctcagaatgacgctatcaaagcactgagatgcttcaaactcttttttctaaaaaagataatctcggggaataaatctgaatatgcacttatttagattcgccgtcagaagtttgttttttcaaagagataatttgatgagagaggcttgcgggttggtgttagggatggcaggttaatttgatgaggtatgtatggaacaggcagactgtcgttccaacttagaagagcgaggtgtgcccatctacgtacaaaattaggccaacaatacttgattgtttcatcggtttttatatgtgtcaatcacatatttttatctatttgtgatagacctaaacttaaagctcagtctaaatttgtaagaccgtaatctacagttttaatgtaataagtatgtatttttttaattcacctagatatgctattccctttatatttttgtttacactagcaaaatgactgtagttgcagtgggtgaagaagaagaaagatggagatgattcgatgcctttagtgtgagttgtcaatcacactatctagataaaaatatgtgattgacaatattttgttaattattttgacaatatttgtgatagacctgaacagtgccaaaaacagtgccgcccagtgataaatcgatggctactttggtgctgcattttggagccgtgggaccgtcgctgtgctgctcgaccgtcccgcggacccttagtctcgcgttttggagctgcgggatctgagtatatttatgcaaatccttcctatacaagcatataaacgtaaattattaaaaaaaaagtatattcgtaaatttttcctgattaaaatgtacccatagtggttcggaattttcttctccgaacccacaaaagatatttttaatggtactcgtaaatactactccatcccaaaaaagaccaatccagttaggaaatgaggaattttcatgggatgggtggtagacatcaaaatgagggatttttacttgttgcaaccttcagttgcatatttaacatgctttaaaatggtaaataataattttaaaattgattggtactctcacaatactaagtttgatgaactctaataattcagctgatgaagtagaccaaccctaatacttcagggatggagtagacttattcctagtaaataaaatacatagttctctcttcctctcataaaaacaaatctaatataaaatgcgacattacaaaactacgaatctagataggacagtggacatcccgtactagatttgttttgcctttgtctagattcgtactagaattaaccatgtgtcgccgttcagccactgacgtcagtgatgtgtcggcggcggcgcagtcaccgcgctcatgaactcctcgtcggcgactagcctcgcgagcgcctccggtgccaggcaaatctccaccgccatgctcccgccgccgcgcccctcgtacaccgtcatcttcccgtccaccttgttcccggcgccgctccggacgcccaccggcctcccccacccgaagtcgttgcccaacacgtcgaaccgcggcgagcctgagatcaccatcacgccggcgttctgcaggtccgccaccatcatgaagctcggcttctccggccacgccgccaccatgcgcctcacgctcgcctcgtcgcccgacgccgccacggcgcggttcagcagccacgccgcccagcccagccctttgtcgaggagctcgccggcggtggccttcgcgacggcgcccaccaccgtgttgcccatgtactcttgtggcacctccttgacccgtgctcgcaatcccacggaaaggccatagctcgtctccatctccggcgcgaggcggcgggctcggcacacagctcgccaggtgtgcgcgagcaccgactggagcgaggatatggtggccgtggcggcggcggcggccatctcggcgttcgccttctccttcagcgtcctcacgctctccgccgagaaatggaggaagcactcctccaccggcgtgtacacaggccgccggaccatgtcctccagcttggcgaagggtagagggatcggcattgggatgccgtccacgaaccatctgtcgaacaccggcggcggcgtggagagctcgaggtcggcgctgtcatcgctgcggcggctgatctccgaccaggtgcggaacaagtgccagaaggtgaacccgtcggcgacgccgtggttgagcgacatggcgacgaacatgccgtcggcgagctcggtgacctgcgccgccaggacagggcgggactccacggcggcgtccgtgccaagcatgccgttgagcgggaagaaggaccacaccacccttgggacgtagagcgagtcggcgatgtcggcgacggtgacgccgggcgccacggcgtggacgaactccgccccctcgccgttgcagcggagcgagatggagatggtcggaacaccaccaggcgacgccgtctcggcgatggcgaggcggccggccagcgggtagaagcgggccagtgcgcgagcgaacgacgagacaaggtgttcgacgacgtgctcaactccgccgggaggcttgggcaggacgacgcccttctggacgtagtcgacggtgatcatctggagatccaatggcgtgaggtggtgcaccgtctcgtggtccggcagctcgccagcgtgctccgccgccggtcggaccatgcgccgcgacatgatgtggacgccgccttccatttcgactagctctcgagctcagtggtacgtacgtgttggactaatggtacgtagtagcttaggagtttatatcaaggtatgaatctgtgattgctttggctggtgacatgatataaatgcatgtcgagctctcagatgttagagcatctctaacaacctctctatcagcctctccaagccaaattttggttattcaaccaaaaaaggaggtccaacagattggctaaccggatggccaagccatccagcagaccaaaatcgttggctggctagctagatttggccagtcaaaacgtctcgccaacggtggcccgcagcaactgtactcctcgcgaggtcgtcgggggcgttgtcgtcgttgtcgaggtcatcgtcggggtcgtcgtcgaggtcgtcgtcgcaagccgctgccaccatcgccatccccgccctgagctccaccgccgcgccccccaaaccgttgtcgccgtcaccgcctcccgcctccccgcgccaccgcaccaccgcgccatgcgtcggccgcctcgacgggaaggaagggggaaaagaaggaaagagaaagaaggggggagagaggaagaagaggagagagagactcacatgtgggtccgattttattttggagaggattaataaagattctgttggagtaagtatatagtttgactagctaaatcagatagagagttggctatatgggtgtttggagagttcgatttggagaggctgttggagatgctcttaggccttgtttagttcccaaaacaaaaccttttcacctatcgtatcgaatgtttggacacatgcatggagtattaaatgtggaaaaaaaccaattacacagtttacgtgtaaattgcgagacgaatcttttaagcctacttgcgccatgatttgacaatgtggtgctacaataaactctaatgacggattaattaggcttaataaatttatctcacagtttctaagcggaatctgtaatttgtttttttattagagtacatttaatacttcaaatgtgtgcttgtatatccgatgtgacaaccaaacctaatttgtttcccaactaaacaaggccttaatattgcttgctagatggaatgtatttttttcatggcactgaatctctactacttaaaaaatctggattagtgatggtgaagccaaagtagacatgcgatccaacgtagtaacgtagactagtttggagcgacgaaaatttaaaagaggtacacgcgatgcggaacaaaaaagcgtaaaaagccatgtcgccccgcaacccgcgccccctcctccgcgcgcctccatcgccgccccgcaccctcccctcgcctctcctccgcgccgcccctccaccagcagccgtctccacactgcgccagcgcccctctcctctccacccgcgtcgccgccgtccccactgcgcgccgccgcccatcgccttcccaccacgcctccacccctagccggagaggcgccggccgcgccgcccctccacctccaccagaagccgtccccacaccgcgacggcgaccctcgcctctccacccgtgccgccgccgtccccactgcgcgccgccgcccctcgcctccccaccgccctcgacctgcgccgcctcctcgcccctcgacgccctcgaccgctcaaggtggtcacagacgccgtcatctgaaggtatgtatcccctcctatcccctcctgccccaccatgtcgcccgacaatatggccgccgcatgttcgatgaaatgtccagtaagaagctccatccatggactcaatctgctttggggaaatgagcaccaaatgaacatgcacttgaatattgtacagatcagttgcaacatgtatggtttcttttataattcttcatgtacataggttgaatatgaaataatacctcggttaccatgtgcctgcctcacttccaaacctttcaatcagctgacacatgagctatagaacaaacaacgattcatgctttttacgcgggttgttctatatttatcatgatgactctcagttcaggttaattatattgaaaaactatggtgtcaagagtagcatgcttgagtgcttaggaatacaacaatatttttagatgaaagatgaaggttgaaaaatcattagtttacaaatgcagacttcctttttttctccaacccacctcactgttttgctaatgacatgatgattggaggagggcagcgttgcaatcattcttgtgtatatattattggtatatacttttgacggatgatttcggtaggcgtataaatgaatgtactgacatataatatatatatatgcgatccttcattaccatatcagttcgaacagttgcttcccacccacataacctccttccctgcattgaaggtatatccaattaattcgcttaatttcctttactgtgtgttgccaattttcaacgtttttataatactaccatcagcaccactgggattctgcctgatggtttgtactggattgaactctaataaattttgacttgtgcatttcagggttccaatggatagcaactttggggcctctcgaccgacatcgttgacaggatcaggtgagtttttcaaaaaatataataataggtcaatagctcaacctttgccctatgttcttatttgttccattcatatattttttccattcttggttcagccggtgatcctccccttggagttctttcagacattactaatctcagtgctgctgaattaagaaggaaacgtgctagagagaggtacgctttgttgagtgtggacgagaaggaggcgaggaataaaaaggcccgtgagaagaggcgccaaaagaaggaggaatgccaaggaggaaatcaatctggtgctgctgtgaaaggtaactacaagccaactcaactcatcttgggccatctattctattgattaacccacatagcgagtgaccaaagatatccacaaaaaagccatctattctattgatttgcatctcttcaccgaatatgaatgaagaacccaacagctattgcatcttatttttgaaggggtgcatgcttatttcctttagctttcacacacttccaatgccagacaatgcaatgcataaccataaatttaatcaagcaaccatttaaggcagaaaaaaatacttactgcaagtgtgtgggataagtgtgttaaatgcctcatcaaatgataacaatcacgcatgctggacagagctagcccacatggcattccaccttagaaaaaaagaaaaactattagccttcttgctcaactccatgtatcctcggtctctactctatgatgctctcctcacccattgctccctcactgcctttcttcttgttagaaagtataccacagaaaaaaaatagaatttataaaaactgacaaacaaatgatattttgcatgctccatggtaccagccaccaaaaaacacaaaaaggaaaacaatatgatgcaattttagtgttatggatgttcgcatcagattattgtttgcatttcatgttactaaaaaatatatggccccatgttaagaggtaaacaactgccttcagtatattttgtggcttcgtgcacatttggtagcatatattagcatgcatagatataactataggatgactgcagaaacaaagtgagaatagggaaacaaggcatgaaagcagaaggtgatacaattataatctccatcttcatgtactctaatacccagaggatcctccgtcgcctcatatatttctctattctttgctgtaatatgtatcggtactaatgaaaagatattctgccaattatgccaaacaatcttctaatttcgcggcgtcggaacagccccacttggcgatattacaaatataagcgctgctgatataacgacgtgccaaatggaagtgaatgattctcccacactgcatcaaggtaagaataacatattattacattccgcatgctataagagggcggaatgcaatgccattattgttgtgtacagtctgataacgtgatggttctatgttttaatagaaagtgaagcttcccatctcaacatcacacctagacgtctcccatttacaatcatcaacaatgtagctcactatggtcccaatgaagtacctttgagctgcgtaattcaaacaacccaaatatatatatatatatatatatatatatatatatatatatatata

SEQ ID NO: 77597 - DNA, 1423 bp, Oryza sativa
ggcggtgagatggtccttttcttttttttcttttttattttctctcgaatcaagtgggatacatatcccaaatcaaaccccaaatacccaaatcaaacccaaaccaaagtaacatcacaaatcttatacatcacagatccatacaaatgtacaatgaatcacaatattgtccatacaaaagtacatcacagtgaatcacaaataaaaaaacaatgttgactgccgctgtcgccggccgccggccgcggccccatcggccgccgtcgcatggccgcctgccgcgcggccgccgcacggccgcggccccacctaccgccgcccacggccgcctcgctccgctgccgccgcacggccgcctgccgcgcggccgcctcgctccgccgccgccgcgcggccgcctcgctccaccgtcgccgcacagccgcggccccaccagccgccgccgcgcagtcgccttgctccgtcgccgccacctcgttccgtcgccgccgcccggccgcagtagagaggggaaggaggaggaggaggcggggatagaaaaggggagcagagaggggaaggaggaaggggaagggccaggggaggaaggggatatcgaggaggcgctggaggcggataccgagagacttaaagaggagagaaaaaaaggggacttaaaggcggggatagcatgggaatctttactcccggttggtattaccaaccaggactaaaaatacatctttagtcccggttggtaactccaaccgcgagtaaagcttccaaccgggactaaagatgacaaggcctgacagatttagaaccgggactaaagatcatttttagtcccggttggtaacaccaaccgggactaaagatcaaatatacccgttgtagccaccaaccgggactaaagatcatttttagtcccggtttttagtggaaccgagactattgtggatttcgggcgaccgaccaaagacggtttctccaccagtgaatgcatccgctagctagtaaatgtgctgttatttagaacagttaaccaatggttatgtactattgttagcgatttgagttgcaatttgcaactcccgtatgatcactccaacaagcacaacacccatgctgatgacgatagcacagcaatataccttctttgtctcaaaatataaaagattttaaacagatgagacaactttcaggacatcaatatactatctatctagattcatagtctagaaagtatctcatccgttcaaaaatacttatattttagtacggtcgtagtagtaattattatgcagcagaggcagctggaatttttggctatctatgacaaagctgacctttgaaaattgcaaacttcaagtcaaaccattaatgcaatacttaatgtatggctcgctttaactgcaaagctgactactgaactcacggtgaa

SEQ ID NO: 77598 - DNA, 18826 bp, Oryza sativa
gtgttaagatcctttggttaattttggttttgaaatgcagctcaaaagatcaagtcattgtggattgcagaatgagagggtcacgttttgaagtaactgcagtcagcatgaagctattgtgtagatactagatactggtgttggattgagagggttgcattttgaagttactttggttggcatgaagctattgtgcagatactgtatactgtttttttttaaagttggatactggagttcctgtgactaattgaaaatcatagctctcttggattgagccttccaagctttgacaagttagatttgagcgtgtttgcatatttcgtatgagtacaggaaaatatgcattacatttccatgatactagaatatggagtaatctggaattagatggtttacgaagaatgtggtgatattttagtgctaaataattttatcttttctctctttttctttatattaatctttaatctatctcgtggattagcaactgaaaaaaaaactttttgtatgcgtgcctttaccgattaaaaagggcatactgtaaaataaactacgacaaaatacaacaaattcaacttcaaaattaagttttgaaattttaattttagctttcaagcataagacagacgaagctgatattgtttttttatttgtgttattatatagtcgttacagtcgtgatgatcagggaaaccacttaggtgttaatccttgctaatatagcctggtgatatgccatgttttgtctaggaagagtttaccaggatgtttactacgcatacatgattcaggtagttctctatggaggaacttgtatatgtagtgcactatggatgtttgccagcttaacatgattgtctgggatgatttgtagaagcgggctatattttactcaacttgtttctgcgtagcatgctgataaactaagtgtctggtggtttagggcactacgcaacattgtgatgagtgagccattgccactatgctggtcatggagcagcaaagcagagactatatgttaaggtgatgtcctctgttcataaatcctcaaataataaagatttgagtgtgaaatttgagtcatatcttttaggatgaatctatttatgtagttgcaatgtgtgcttatggttttgtgattggttagtgcaatatttgactactgatttgctccatccataaagagctcgaaataagattagttaaatcttatttgagttttaaatttcagtttgttaaatttgctctttttcatgccagtgtgagaaggaatatgatttgtgcattccttaatatacttatcagtggtatttttgaggttctgttcggatgtattatatctttgtgtccttggataaaatgatctcctatttacttattagcgtactgaagattttttttcttctcacaaattcatccatctccattcattatgtttcttcatcacattcgatagtaacacaaacagcaagacccaattatcttccttaactgatcaactaactttggatcaacacattgtcgctttcaggacattggcccttgtagtcctggaaattattctggaggtggctgtgacctgagcatacagtacagactggatcctccctctaaaccatgttatttcagtttctgacttgcatgctctatgctatttcagttggtgacttaaaccttggtagaaccctgcacaaataggaggcgtcatcttaatacaatgaaaaattatgggaactccatgccagatttgtcaagacaatcaagtctattctttcgtaagttatatcttcactgcctatctataattaataggaagaggcacaccaagttattgatcacataatggtttgatttgagttttcccggccacatgttataggaagaggcacactggccaatgtaacaaacttaactgctgctgaggttagaagaaagcatgacagggagaggtatgcttcactctctaaaaagcatgtggtttctcaatagtaagggttcatattgatctgttctatggaaattcagggtcttgaggtcaaggtcattgacgagagcatccaattaaggttgtgggaatttgacatgacagtatttaagtttgtcaaaccaaaatttcttttcaaaagaagcgaataatgtcaagattgtgtgataagacactatttgactatgaatgattgatgaattaagctatattaaaaggatcaacaagaaatcttaataaatatactgcaatatgatgaatagtgtgaaactcactcatgttatagcttatatgttattatctggaatcaactggcgaaaaaatggaatctttatcatgtaagcctgatttgcgatttttcactacgtaggtactttcatgaaggtaagtagcagaaattcggtgcccgtatcctgttgtttctggttgacgtcttcagatcctcaacagaatcgaaggtaaacaaactattttccctgttttccttgtgtgaatgatatgaaaaaatattttgcacttgttcagtaatttgtgcaaactggaaatactgaaaatactaaggacgaagaataatattcgaagccaatccaaaagcattgcaaaatgtcgaaggacaaaaactcccagtaatgcttgcatgaaaatagattaaaacaggctctccgcgaacaaaatacatttcttaatattgctcatttgataacgaggctggaaacctaagcttttttttgttatcaaatgttgcacatttgataataatccatatttcttaatattgtctgcacctttcgtttgcaagctccaagttgtaaaatccaatcctgactgcaagcttgtttacaattgtttggctagcagtttgaagcttctggagtattaccactagcaacagtaggagcaaggtctgatcgggtgctccctgtgcatagctgctattggttcattgttgttccaaagtgagcaatagtatactttagaaggaaatgagggtgttgaggcgattgtcaagcaccaaacttcttccgcaataaccctgacttccatgggaaccgttctgttatttgttttgctatagaatgagaaccattgtgtagaattttgtaaacaactttaaccattgcttctcagcatgcaaatgcagatccattcctttccaaaaggattaggtaccatttagttttttaaatatatgattagcaattgtctataagcattaggaatgagaagtagatgaaactatagacaaactttctaatttgtggtccttaatgtgccgttccattcattaattttgttatatgtggtactagcatgtgaatactataaagatgtgaaaattataaatatgtgacatacttatcattagttctatattaatgtttttgttacatccgatttacacccaatgattatttaacatcatttcacttggtgtgattttccctgttgcaatgcacggacaccctactagtatttataatttttaaacatatggcatataactccgcgaatacacaactttaaatttgtctttaacaaatataaccatgaacacggatactagtcagagtttaattcattgttttgttacagcttgtaaaaatccaatttaaccacgcatatttgtgaactgatatatctcatattatttaaaatatttttttatatctagataaaatgcaataaagcgaatgagaggacgcttgaagaggaaaaatcattattattattattattatttattattattattattattattattattattattattattattatttttattattattattattattattattattattattattattattattattattattattattattattattattattattattattattatgttgttgttgttgttgttgttgttattcagagctcatttcattcatcaagaaactgcagaattacaaccttcagtcactaggtgctcgatacaagctgggactgaatgccactcacccagcctgtcatcagcttcgctaaggcatgagctacacgattacaagatcggtgggtatagagtaaagtaaaaccatgaaaaccggagctaagctgtatggcatctctggtaatcggcgcagtatatatgccatctttggatgccaccctgcttccaaagttgtacttctctcgggaaattaacttactttctctcggccggcaagttgtacatcccatcccggcaagcaagggcctccatcatgtcatcgatgagagcatccaggccatgggaatgccatctagctacgccggccgccctagctttgaaccacttgatccaccctgcgggcggtggcctccatgtttgccgctcagcagtccgctttacgtacggggtctttgaaaaacaaacgagtaacgtacaatcgtgaatgaatgatttgatatgataaagggcatccgaggaggcttacccgactttacacagggagatccacaattaaaagagctaaaagatgaaatataagagaacaatgatggggttaaatagtagtggtgtcaatattccagtatccaaaactaaaactatagatggccaaacgggcggcacggcccaggcccagctgtgcctgggccgaggttagtgatcagggccgtggcgtgccagcccaaaggcacgacggtccatcgtggttttccacagaataagtctatttttcttccctcaactctgtgggctgggtccatatggctggaaataagtctatcttgtattcctcttctctttgggccctatctgatatggttcattaagtctattttacgtccctctacttttttaattcggtcatgccgtgccgggccagcccaccgtgccgagggtgcggcacgggcacgaccccgagttgggccgtgccgtgcttgggccaggccaaaatggcgtgccttgggccgggccacgggcctcgggccatatggctatctatatccaaaacacatacaattataaatttaccactgatttaaattgcacgttattaaatccgctgcctacttataatccaaggtttccttattaaatccgctgcctacttataatcccaggtttcctttgaaacgaagaaaaagggaagaatatttggtgggatttgttaagtaagaaaaaaaatccaatgaaatccttttcataaaggataccaaaggattgatccctatatattattttgcaatttctctactgccttccgtttcccctcctgtatatatatagggataaattcctatgaaatccttcaatgtccactatagggataaattaaggccctgtttgatttagcttaaaattattataatctagcttattaggagtaagctgaaacaaacaagtagattattatagcagattattataatctataagtcagattattataatctaataagctgctctaaaagagcttttttcagattattgagtggctaaaaacccactgcccctacatacttgagaaaaattacccacctatgccatcaaccgaacagatagctgagggcattatagactttagactttcaaacccaataatccatgcctccaataatccagacaaacaaacaactcacagcttattttatatcagcttattataatccagcttatagcaatctggtttaataatctagattataataattataagctgaaacaaacagggcctaggtctgatggaatccttccgtgtctcttcctcccaccacgtgcaacacgctctcaagcgttaagtatacataagcagatccaatgttttgtccatattgaactcatctctatttatatgggcctaatcctttaaaacgtaagagcatggcatgttacacccatttataatgagccaatccataaaaaagttttgattaaaaagagcacgaggttatgccttagttcctgcttgtttttctaatgtatcatccaaacattagtttggaaacttttctatggtttggtttctgtaatactccgaattcaacacgcatgacattttattggtacatttctattatgtttcagtgtttgaatcctgcattctaatggtgttttaagaatttgcggatgagaaaatgtgataaacctttaatctttgcttaataactaacgggaatgcccttgtgtgcgggggagaaaatgggagtctccggtgaaggaccacatgggcaccgccccctgtcatccgatggcctggtcgaggatgtcagacgatagacggtactccatctgtctcataatataagaaatttcagaagcatataatatatcctaatactttgaatctaaactttaataccagtctagattcgtcgtattaggatatgtcaaatccctccaaaatcctttatattttgggacagaaagagtaagacagaagccgcagtgtgcgggcaggaaaaaaagtgaaaatatatctctttttattggttttacataaatatacatgtttaaaagggattcatagaagtatgttgttgtcgtagaatggaagtgcgaaatcatgcattactgtacaacttcgcgtgatgaggacgcgataccgcttggggccacgcggcgagtgtgtgagaccgtacgatgctagactagtagaatatgtgcaatgtaggttatccatagcattgtgcagtgctacgtatttgttgcaagttatagaatttaaatttaaactggtatatttatgaagtgatatactccctccattatacaatataaggatctagcaatatatgagaaatactctagtactatacatgaatctagacaaacctcttatctagattcgtagtactaggggactgtttaaattcgcattattaggatgcgtcttatctaatactaaattattatattataggacgaagcgagtatcatatattcattatcctattatgtttctaaatatgttcataactattataatgacatgcaagcagtgatactaattggtgcaactgtgcaagcaacagcaacagtagcgtaatttaaatatgttcataactattataataacatgcaagcaggattactaattggtgcaactgtgcaagcaggaatagcctaagcatggtgatgaaatttgtcatagtttaagcaacaatagtttaagagatcattttccatgatctcctgatctcctccattgtcaaaggatggccacccaccacctcacatggtaggctataccattttctctgcatgccgcccatggtgatgaaatttctcaatttttctgctcagtttagttcacaccaaacttctctccaactcccaactttccatcacatcacatcacatccaaaactttcctacacacataaactcctaacttttttccaaactatcaactttctccaaacttctccctaatttcataaactaaacacaacctatgagataggagtacatgatattgacaacaatgggcagtaagtactcccttcgtcctaaaatataacaccttttaggtggatgagacatattctaatccctattttctataaagttaatgccattctctcttctctcatgaagccacatcacctcaattgcatctcttcacatcacctcaattgtttttagcctttggatgattcatcaagggcaacatatcctatgcacacaggccctcacgtgtacacacgtgcacactaactaaaaaatatcaccaaaaaatctagaaaaaatcatacacatactttcaattgtatcacacctagggttaaaatcttaacgtcaaattcattatattttagccataacaaaaaaaaataaaaaatctgacagttttaaggttgcaattttatcagaattttatcttttttgttattctctatgtagaatgaatttgaagatgcgactttgcacgtagatataatactattgaaagtacatgtatgaattttcctagaattttttgtgatgatttttagttggtgtacacggtgtgtacacgcgagggcctgtgtgcataggatacgctcccttcatcaaaagtgtaaattacatctcttcccccaaaagacacaccatacaacataaccatttataacctatggataattgataaagggacaaagatatataaacacatgaaaaaaatcatatagtaggtaagaaattttttttggaattcatatctactatattattacacagttctcccgcatcaacgcgcagggtatccatctagtattataaatctggactgccatgatacgacccgtccaggcgttccccctaaaattgttatactccctccgttcattttttatcattatattcggcttgtgcaacaataccaagataaacatcaattagcactatcaacctttcatgtccttgcatgcctcattgactgtccaattagttgtgattgcataaaatgcttgaccaaaatttctattaatagagctgcaaggcatacacgcaacgcagtatacgaagcatttttgtcacagtcccacctaatatgacgatcaaatatgaatttttatgttttgaaaatatgatgattaaaattgaacagagggagtattttgtacggagggagtagcttgtacatgcatggatgcaactcacggcgtggtcacagcgcccatgaactcctcgtcggcgacgagcttccccagcgccgccggagccaggcaaacctccagcgacatgctcccggcaccgcccggcccctcgtacaccgtcaccttgccgtcgaacttgttcgcgccgccgctccgcacgctcgccggcctcccccacccgaagtcgttgccgaacacgtcgaaccgcggcgagctccccgtgtggacggcggtgcctcccgccgccttcgcgaagttggcgaactccggcgcccgcggccacggcgcgatcgcgccccgcatggcggcctcgtcgagcgacgccacgaagcggttcagctgccacgccgtccacccgagccctctctccatgacctcgccggccgtcagcctcaccgcgccgggcacgacggcgttccccacgtaccccggcgagatgccgctcacgcgcccccggcaaccgatgaccagtacgtacgccgtctcctggcgcggcgtgaggccatgagctcgcgacaccgagcgccaaacatgagcgagcagggcctggagggaggagatggtggcggcggcgccggcgatctcgccgttcgccttcgccttgagcttccttatgctctccgcggagaaagcgaagaagcactcttgcaatggaggtggtgggtggtcgcgtcgcgggatgatgtgctcgagcttggcgaacggcagagggatcggcaccgggcaggtgtccaggaaccacctcttcaccaccagaggtggcgacggcgagatgtccagtttgcttctgcttcgactgatctccgaccatgtgttcatgaactcccagaaattggtgccgtcgccgacgacatggttgagcgacatggcgatgaacacgccgtcggagagctcggtgacctgcgcggcaagaaccggcagggagtccgccgcagcgaccgcgggaagcagcccggtgagcgggaagaaggaccagaccacccgcggaatgtacagcgaggcggcgatgtcggcgacggcgacgtcgggcgccgtggcgtggacgaactcagcgccttcgtcgttgcagcgcaagaacacggagatgctgctcggaggcgacgctccgtcctccacctcggccacggcgaggcggccggcgaaggggtagaagcggccgagtgcgcgagcgaacgacgacgccaggtgtttgacgaggtgctcgccgccggtgggcggcttgggcaggaggacgcccttctggatgtactccgcggtgagcagagggagatcccacggcgtcaggtgcaccgtcgtctcatgctccggcggcaactccggccggatcacgcgccgtgacacgacccgaacgccgccggtgttgccttccattttttggttgcaaccgtagtgatgagtgtagcttctagctaagcagatgatgatgatttagaacagcagcaaacttcttatctgattgatgagcttatggacatcaagtgagacaagtttattttttaacacttaatctgatagcgaatacaattgtagatcttgcatatttatgttatggcttatattatcataatctatctggattttttttttgcacaaccatttagttaagtcacatatatacacgatactttctgattctgggctgtgggggagaattgaagcaagtcgttttcatcccttgtgcgaatgttttctgttttttttacaaaaaatctttataatacgaacatatcttagtaggaatagcaggcatttttccacttttgtgtacaagtgtattgaaattcttgttgtgataatgaaagtgactcaaagcatagagatatcagatatacatgatatgatattatatcagcatatgcagcatgctgtgacagcaaccggagatgttttaattcgacagcatgttacgagtattaggctattagccaatgattagcaatccatttcaaagacttaatagtggatactggatagtatcatgtatataggttgcagaaagttcagtgccatgcatgcatcaatcaggtttggagttcagaacagcacacatcaaacaatataaactgcctaagaacaatccattttgtgtttcgttcacgttgagttgatgacattaatcacactgtctcatcatgtgatctaccgtacatcagattagcaaggtcaagttgggtcccatgaggcagtgacttacttttctgcatgtgggccaccaggaggctgttgactcgtcaactctagccatccgtcgttcccggcattcatgttctgaaactcatctcaaccatctaaatttgcagctgctgcaatatttgtacaagcatttgctaccagacgtgttatataccattggaaagttcgtagatcctaatttcgataaaggcaatttacaatcgattttgtgttctatgcaccaagataaggctgcttgaagatgggccgcggttcacggttcaggttcaggacacagcttgatgacaggaagacgattgttggtttattctcagcacaagctgcaagctcatttgaatccatctacagtactccctccgtttcagaatgtaagtcattttagtatttctcacatttatattgatgctaatgaatctagacatatatatctatatagattcattagcatcaatataaatgtggaaaatgctagaatgacttacattgtgaaacggatgaagtaattactatctactagctgataatatgaaagtttaagatgattgatcatcagaaagtccctggcatttgaatcctctggttgaactctggcatttctgaccacgacctcggcctccgtgggcatccttcaattttccttcaaattcgtctaaaaaccattcgaaatttcacttcacaaacatattgatttatccttgtttgatacaaaaggtaatccagtgatatctctgatctatcagctatagctgttgatgaattcatcacctttctactgacaaattgacataaatggattacatgatgtcgatgtgaatgtttttttttaaccaattgagctcgcaaatcgcaatgaatagaagcatgcatggatgcaactcatggcgtggtcaccgcgcccatgaactcctcgtcggcgacgagcttcgccagcgccgccggagtcaggcaaacctccagcgacatgctcccggcgccgtccggcccctcgtacaccgtcaccttcccgtcgaacttgttcgcgccgccgctccgcacggtcgccggcctcccccacccgaagtcgttgccgaacacgtcgaaccgcggcgagctccccgtgatgatggcggcgccgccgagcaggctcaggacggagaagaagtccggccgccgcggccacgacgccagcgcgcccctcatggccgcctcgtcgaacgacgccacgtacttgttcagctgccacgccgtccacccgagccccctctccatgatctcgccggccgtcagcctcaccgcgccgggcaccacggcgttccccatgtaccccgacgagatgccgcccacgcgtccccggcacccgacgaccaccacgtacgccgtctcctggcgcggcgcgaggccgcgggctcgcgaaaccgcgcgccacacgagcgcgagcagcacctggagggaggagatggcgacggcggcgccggcgatctcgtcgttcgccttcgccttcagcttccttatgctcgccgcggagaaagcgaagaagcattcctgcaccggcgcttggtgctcgcttcgcgggatgatctgctcgagcttggcgaacggcagagggatcggcaccgtgcagttgtccaagaaccacctcttgaccaccagaggcggcgaagtcgacgtcgacgccgatggcgagatgcccagttcgccgccgctacttcgactgatctccgaccatgtgttcatgaactcccagaaattggtgccgtcgccgacgacgtggttgacagacatggcgatgaacacgccgtcagagagctcggtgacctgcgtggacagaaccggcagggattccgtcgcggcgtgtgcagcaaccactccattgagcgggaagaaggaccagaccacgcgtggaatgtgcagcgaggcggcgatgtcggcgacggcgacgtcgggcgccgcggcgtggacgaactcagcgccttcgtcgttgcagcgcagcgagacagatacgctgctcgcaggcgacgctccgccatccacctcttccacgacgaggcggccggcgaaggggtagaagcggccgagtgcgcgagcgaacgacgacgccaggtgttcgacgagagtctcgccgccggtgggtggcttgggaaggaggatgcccttctggatgttctccacggtgagcagccggagatcccacggcgtaaggtgaaccgtcgtatcatgctccggcggcagctccttgaactccggccggatcatgcggcgtgacacgacgaggacgccgccgccgccgccggtgttggcttccattttggttgccaactccagagcagtgtgggtggctaagtagaggagggaagccagagcagtagcaaaattggtatctgaaactccggtgttttgtgaaggcaaagccgtgctacttctgaatttatctgaaaggaacaactcatcagcattcattcagaagagaaacagtcataatttctgactattagtatgctaggctgcctaaaagaatagtatggtactacatatctcaagtagaaagatatcagctttcaaaagagttggagaaagagcaaattccaaaagctgtcatttactgctgcaaatttcagtagtgaggaatttggtctggagggttgtgccagcttaatcctcaatctgaaatgaacacaagtgacataagttgcaataaaacttagcattgagcaatatttgttctcatagtaaatacaaattaatattatgattgaacagagacatttgctttgagatgaaattggatgcttctatctggattattctggcaatttaagcattgccaacaaactagagaaattagttgctatgaccattcatgaaagagaacaggaaatattgtttcacaacaaataaacagcaggcttatcagttcccttcaactgcctctactatttgatcgaagaggccaaatgatccttgctttctttttctttgagatcattcccgacttgatgcgaagggtagctgtctttccttagccgccggacagatagtaaaagtcaagagctagaggtgataggtcggatccttcctcttattcaagtcaattgtgaatgctgtgtacatacgtataaaccacttttttaattcttaatatcagacaagtaaaaacaattgaactttcattgagtaagtgttatcaagttttcctcaaaaaaaaaaaaccttggaaaaaaagtgtgattaggattctgttttgatgaggagaggtatgaacatcaacatatgcagtgacagtaacacgttagcaaaatgagaaacatgtcaaagggtaacagctaaacagtaataaaaattgtgtaattgtgatatggagaggcaacagttgataatacttcgtagctgaagaagagaagagcctccagttaaattcagtgcctgcgatgcgcatgcgtcagattttgcatttcagatcaatcgattctgccccaattctgtcgcattcatccgttgaacatttagttaagcgacactgtgtcagtgatgacataataatacaagtacatgattggagctcgcagtggatgtaattagcctgcagctgacgccgtggtcaccgcgtccatgaactcctcgtcggagaggagcttctccagcgcggccggagcatagcatcatcaggtaactgagctctctgatggcatgttcatcgccgtggcgttcttaaccggaaaggagtccagtccagccattgagcgggaagaaggagcagaccaaccgtggatgaagagcgaagcaacgatgccaggtggcgcagaatggacaaactccacgccttagttgttggagcacagctagatggagatgctgcttgggcgacgcacgcaacatccttcacctctgccaaagcaagtaaatggattataatgcaccagagcccaatactatttgaaatagtgaactggaatgattagatgctatgatcatttcgcttcatgaaaagagcaggaatattattaggcttaccagttctcttcaaatgcctctactgcttggctagaccctaaacataatgtcctcggttatcttgttctttgaattctttcacatcctcctggttcagaatatcgcagaaataaatcaaaaaaagttgtactaggcaactcaaatacaaatttacaaaccacagataaattgctactacctatgtctcaaaatataaggtatttttggctatgcaaaatagagtccagtatggtaaactagtttacttaatgatgaagcggataaatatcagaattcgaattgttacctcttgaaacttttcggaaagttccatggccttcacataaaaagcagtccaaaaataacctattccattcttgctctattactatccaccaaaagcttcactgcacttcacttcctcgctactagaggaatcagtatcagtcaggtggtcagatgacaaaccatatgtgacatgattcaggaaattatcttgctcgactggacacacgtcatattctgactccagcaaagaatgactaggaatcatatttagctccagggtgctcattagtgatctcactttagctagttctggccagcattttgctgctatatacatgtttgcaatcaatctgtaatgaccagggttgtttgtcctcatagccagcaacttctttgcagcccgatccccgatttccgtattaccatggattcggcaagcctcaataagagttgctaacattgcagcagttggttgaaatggcatcttgtcaattatcacctcagccatcttgagcaaaccttcacggcagtacaaatcaaccatgcaagaaaaatgctccactcttggtgcaataccaaatatagaaaccatcttggcaaatagtagctgcccctgagttactagcccagagtggctacatgctgatagaactgcaacgaaagttacatggtccggctctatactgttcacaatcatctcatcaaagagcttcagtgatacatgtccctctctttgcaatccataacccaaaaccagtgatgtgtaggcatgcttgtctcgaaattgcatcagttcaaacactctctgtgcaactaccatttgtctacatttggagtacatgtcgacaagtgaattttccattagtttagagctatccagctcatgcttaaggatgtagcagtgcagctcccttccatgacagaggtgtccaacccgtgcaccaagggaaagcatagttaagacagtaacaccatttggacagacaccaaaaccgatcatctctctgaaaatcaaagaagcttcctcgatctgttccatgaatgcaaatcctgcaagcagtgagttccaggttgtgatgctccgaactgagcatgctctaaacagaaggcaggcagagctcatcatcccacatcttgagtacatagttatcaacgaattcaccacgcactcaaggctatcaaagcatagacgaacagccaccccgtgcaactccctaccaacactcaaatacccggtcctaccacacgccttgagcccaatcacgatggtcacagaatccacccctgtcccatgatatcctctcacctgagacaccaacctaatcacttcatcgtagttccccgccttcaaattccctgctgcaaccgcattccacgtgacaacgtttgcaccaggaacctgctgtaaaagctcaaatgccttattcgacttccccgtcgacgcatacgcggacaccatcgtattccagctgacaacatctctcacagccattccatcaaacaccctccgggcatcctccagctccccacacttggcatacatccccaccaaagcattccagacatacatgtccagaccatatctacacctccgaatgcgctgctcaatgttccggccaatggtgacctcccggagctcgccgcaggcacgcagaaccgacgggtacgtgaacctgtcggcggcgacgccccaccccaccatcttctcgtacgacaagatcacgtcctcccacagcccacggccggcgtagccccatataagcaggttccaggggaacgcccgcgccttccccgccgcctgctcgacggcggcccgcgcggccgggaggtcggcgagggctaggtagaaggaggcgagcctggggaggacggacgggtgggcggccaggccgagcgtggcggcgcgcgcgtgggccagctcgccggggcgacgggcgcgccgcgcggtgcaggagtagaggatggccgagagggaggaggccgggtgcggcggcgagggcggcggcgattcctgcgcgggcgcggcatttcgccaaacggatgggaggcagcggcggatgcggaggaggtgctgcttgggcggcgaggtgggaggtcggcgcatcaaacggccgccgccgcatcacaccacggcggcggcgggggcggcggagatggcggggcgcttcccggcgtttggtttggcggcgagggcgccaaagagtaggcgattcctggggtttggagttcggatgtgttcttcctttttcaactgaaaaaaaaaaagtttctctctctctctctctgctattaatggtttatcacccgggatccatgaggactaagggtgccctttttaacagaagtactctctccgtctaaaaatggaaaaatgtaggattgaatatgacacagtttacaatgaatctcgataaagatatatacagattcgtagtactagaaatatatcgcattagtactatattggtttttttatgaggtaggggaagtatctacttgcattgccatattttggtaatttcccccaagaaactggtgaacatttgaattcatgtcaaaattttagtaattacaaacacttgttatggtattgctcattccaagtttccaactttggctttacccaaatttccaaaattcagtttgtctatttgtgttggtagatatggagatcggaccccaaacttgcctgtaaacattcaggatagcaggaatgacttacctttgctccaaaaaaaaaaacagaaatcagcaaggatcaagtgaaacattatagttgaacaaacaaaataactgaaacaaaagcaagacatacaaggtaaacaccagagggcaccaatgatctgtacttccattatattattttttctcttgtcatctgccaaaaaacaggtgtaagaatcaatttcaaggggaggatactctctcgagatatacaattggtggctgtggacaaccaaatcttcagcaaatattttcgacgccctatgctaagcttggacaggcggtgaatctctacaggaacaggtttccttttgctggtgaaaaccaaaccactgcaatgggtggaacatctagcagaaagaaacctctccgctttgacggcgcagaaacatacgctactttctattgtttttcatggctgaaatgggggctccacaacacattgaatcgcgatcctgagcgtttttttcgcctacggtctgccattctgggtagtgtacagaagcgattccgactggtctctctcgacgtgattcttgccctttcccatgtcgaggcgcgccctccgtacagcttgttggatctgccgctcgtgctctcgaaggatttcttccatgtttactccaggaggcattaatggtcctgagtagtggatcctgctcttcttagcgccattcacctgcacatacaggtttaatttctcagcatatgacaaaaatacaatcctgcactttggaagcatttttttccattactatcttctgtaagaaatagatcgttgaccttgataaatgagaatgtctcataatattaggaacaaagaaaaaacagtgcactccatatccaggacacaggccatttgtgatatttctcaggaataagaaagggccattctgtgaagagatttaggtaacatgtactctacattccctgataaaaaccatactcacatgttcactggtcataacttccaagaatgcttttaagggtaaatttcccaaagtttatctcagctttcaaggcttgaatactatggatcattctcctgatggatgttaggaggcaagac

SEQ ID NO: 77599 - DNA, 665 bp, Oryza sativa
atcttgtattaggttattatatggactcttattttaacattccttatttttaatttcgaatttcagatatttttaaattgtattcatacttggactctcatttccttttctaattttagattttattttatttttatttcgatttttgatttatctcgtattgggttcttatatggaaacttattttaatattccttatttttaattccgaatttcatctatttttaaattgtatttctacttggactctcctttccttttctagttttagatttttttttatttttatttcgaattttgattaatctcgtattgggttcttatgtggaaacttctttcaatattgcttatttttaattccgaattttagctatttttaaattgtacttctacttagactctcctttttctttttttctttttctccgattaatgtgggaatttctagctcccacagcgaatgtggtgcctcctttcaaagctgttttaataatataatagatagatttctttctctaaaatttttaaactaatacttaatgaatcatacgctgatacattgttttaattttttttaataatcaccggaggggagaggttccccacctagatttccattgaagagaaaaatagggtacaattgaagtgttcaagctagctagcag

SEQ ID NO: 77600 - DNA, 517 bp, Oryza sativa
gtcgactctagaggatccccttaatgcttcttggacctcctttcttttaaattggtttgcgtgtgttttagcttggcgcatactagctattgagaggtcgatagtgttcttagcataggtggatcactttgacgtaattgaacgagtttaataaaagcttcgattatctaaaacaagtagcctattaccatggtcatccactggacacctggctgctcggtaacgacatgttattgggagaaatgcacggtgacccacagacatggaacatatgcatgcaaccaaccaatttatgaccacaaagctcccgagccatacagactatttaaagcaatcacgtcacactttcataataacaagcaactcgttgatctaggttagctagttcttgttgcattgaatcatccctcatcaaatcattaggatatatacttcatgatggccaacgtcatcgcacttatgcttgtggttattacagcgtcaaccttgttagcctcacccgtggaatgcgccaaca

SEQ ID NO: 77601 - DNA, 12695 bp, Oryza sativa
cttggaattggtgtgtccattcaggtctgtcagagggttcagcagcagcaagttgactatatcttgaactagatcgatgctctctcaaatattgtctcctggcactctccccaaggttggaggacagcttagtggcattgcctcgctgcccaccagttgcagtagacatctcagcagcagcaatttgagatgtgtaaaacctctgagcattctgatcagtgccacttgatcggcccagagtagaggatgaacgaccagcatgcatcagaggcgcacgctgagggtaaacattgtctccagctcttcctggaggatcaattgggaagccagtgacagcatcctcctttggaataaacttattactgctgctttttggattaagctgaacccgtcgttgctgcaaagatatggaacagcagtcatttgagaaagaagaacaacagagtttatatttcacaatcttgcaatgtcaactatgtgattaattgcaatgtttaaactgcagctactgtactggtaaacttccaaacaagtcaagagtcgattacattgaatcacaaattagttctgcaagactgctaccaagtactaactacacaaattcatgtatttatgtattaaatgaatacattgaaccactgggaactagcatatagtatttgaattcccataaggtttcaaaattctgcaggaattaataatattttggaagctcaatagtgatagtgcgtcagaaaaccctcaactctggatatccttaagaatgacaattatcatctaatactaagagaagtttataatctaaagataagttttcattacctgcaattcgttgttgccatttggtgctggaagttgctttctacgcccagcttcagattcatgtcctttaactgcagctgctctttgcctgtgggcaaaacatgaacttaggtcaaataaagaaatcgccagcaaaagaagatagataccatatattccatctagtcaaaattcatctttagttctccacagggtttaccttctagcctcctcgtctcgaagcttagcatcatattccttgcttggaggatatttaggtagacttgatggatcacaagcataaggctttgtcgtgaagaactacagtccaaggtaaaagggttaatattagtgcgtcacaataaaaaggccagttgtagattatacaggaatagccaaatctctatgaattaccatcaagtaaaaaggaacagctcaaaatgttgttgctcatatcaacttaaaagatgtttcacttctctaaataattccatgccattcacaaacaacatatcatacgagaagtgacaataaacagattcataattaagactcatcaaacgaatattgtgacaatgaaatttacagggagatggacacaaaaggcagatttaacataatgtgtgtttccacatgtttttttgagagaccatggattctccttagcacaggcatgcaaataaacaaatttcagggccagaacttacttcgcttccaagggccgaagcagcagtacccctattctgaggttctacagcaagtaaacaatccaatagcgctaaagccggaggagggaaatccttgtatacatcattcacacatcgacgataaggatgttgtggcttgaatattgtagcacgtgacaacttcaaattagcccagaaatcctctgatggtgaaccacaaagcttaaatattttgtgcaattgttccacctgaaagaatgtggacaacaaaaataaacatcgcaaactcatagattattaaacatgataaacaatatgaccattcaacactaaagtagaaatttaatgtggaatattgttaaattttattggtattcgtccatgtaaaaatagatctggtaatatgcagtgattatttatcacactgaaactagagctaaccattttaatttataattgtacatctggctgtacaaactacaagctgatagatagtaactgatcaaaagatctcaaatgcaaggttcatagtgtcgagtattctgtattcaacaaaggtgcattcaccttcagcagcttcattttttttagtccagcataattcaggtttgtccggaagtgcaatacaagaaatggcagatactgatatactttatgcaaggcaacatcaaaattatctcagtagataatactgtgttaatcttaggttgcaagtttgtccagaatatgaatagctaaacaatacctctgttcgccctggcatgataggcttcccagacagcaattccgcaagaatgcaaccagcactccagagatcaacagcagcaccatagttagtagcacccagcaatagttcaggaggtcggtaccataatgttaccacacgacttgtcaaatgttgcttttggttaggattaaagaatgtggctagaccaaagtctgctattttgagaacaccattgttgtcaatgaggagatttgcgccctttatatcccgatgcaaaacaccacgattatgacagtgttcaagtccagagagtagttgttgcatgtaacacttgacctaaaatggacattttccatagtgagtacaacatcgaaactgacaacacaatgaaaaccaaagaacatgtcaagagggaaacctgaggctctgtgaactttatgccaggtgtagctgcaagtcccgctagatcatgctccatgtattcaaatacaagatacaagctactagacatgcgcgacgtcaccaaaccttcaagcttaataacatttgggtgatcaagtcttcttaagatgtgaatttcccttgccatgaaccgcacgctctcagggtccatgttggcaaaccgaactttcttaagtgccacaatttttccactctcaagatcacgtgctttgtaaacactactgtatgtaccttgccctatctgaaatatttaaatgtgaggatgagaaaaggtgtagttgcattgaatcagtaggtcaatagcaatttgaattctcatcaatcgctgcaatccagttgacaaactacaccactctatcaagaatgtcattactaaaatagttctagagacatgtctagtttagctcataacagtcatatgccatcggtaaactcaagcacttataaagcgagcgatgatactcaaccactaataagcatggaccacaatatacatggcaaatcaaggtcctaacattttatgaaacaatatagtgaatttgttacaaaattaaagatcggcatagagatatgaaccttgtccaacttctcgaaagactctgccttccgaggttgccacccacggactgcctctgctgcgacctctgtgagccaccttggccagccagctgccgcatgccccccctgcactccattgggcacaacatctgtaatcctcggtttcgcctcactccttgtaccaccactcctaggctcttgctccgccgcgccattcggagcacgcctccaattcgcaggcgcggcaactggcctctccacatcaaccacgctaaccgccacagaagccgcctcatctggcaatgcagccacaggcacagccacagcctcaaccaccggcgcggggggcttccggatgagcctagccgtgctcacatcattccctacacgatgtccagcactggaggaggtggctgacacaaccacaccttcttcatcctcctcctcaaagtgctcatgcctcttgctggaattgtaactaacaagacgcctcagagagttgctagatgggcgccgccggggcttcccctcgccgccacgctgctcctcgccatggaattgcttcgaactgacacagcccatagaacgagtgtggcgatccgggcaagagactccactccaaggaaaccccccaaacaaaccaaaaccaaaaaaaaaaaaacttcaagagatcttctcccaatacgcctcccgcatcaggtcacgcatcaagaaccctcattgctcgcccgaattagagttgaaaacacccaacacccgctcagatccgaaccagaacactgcacccgcgactccctccagtccagcaaccgccgaatcgcccaaaaccagaagcagaagcgggcgggccacgaactgccactgttaaaatcgggatctttctctatcacttgcagaaaccagcgaggccgcgccgcaagggcaaatcggggctgggcgaatccggagacggggatcaaaatcgaacctttttgccgccggaaatcgcgaggcagcaggagatctctccctcctccctccctccctcccttccctctctcactgaggtggccttttcttggcttgtttttttgtttggttttctggcaactactctcgctctgcttccttctccttctgtctgcttctctttcctttttctttttcttctttttttttttgcttctttttttttgtctctcaaagtcagcaattacgatggttggtgaaaaaaaaaagaggagagagaaagagagagagagagtaatggtcagagagagggaggagagagaaacgcgttagtataatacaaaaggaaaaatagttaaggcagtagagtactggagaaggtctcttggtgctgggacggcttggaatttgaatttgactgtcactactatctccgttttttaatagatgacgctgttgattttttcttacatgtttgatcattcgtcttatttaaaaattttatgcaaatgtataagatataaatcatacttaaagtactatgagtgataaaacaactcataacaaaataaattataattacgtaaattttttgaataagacaaatggtcaacatgtgagaaaaaatcaacggcgtcatctattaaaaaacggagggagtataaaatttgggatttttgattgggtttggggactcaaaaatgttctctcagtttgcttagctaggttagctttgattttcttgtggttttgtcaaaaccttagcacctagtaagaagattctaacttgaagaggaggtggtcaaaggtctactgcatccattggggattggcttggttatggatataataattaattaattactggtactagtataggaggaaaagattaacaagctagctacagcaagagaaacaaaagttggactccggattggaatatatttctttctaaaaaaattggaatatatctccaccttttcaacatccatccagctatctttgttactgattatctataaaaaaataactttgttattgatttccagcaagagaatttaattatgtatctgttaactgatccagctatccggcaagagaattttatttccattatctattaaaaaataactttgctatatgccattattgctatgagcattttaacccatttctggataatagtaacaacaacatatgacaatgataatatttttatttaaggaataataatagtttttttctgaaagattggacaataaatatggtgacacaacaccagatcatcacacgtttttccaggacaaatgcgacgaacaatacatgtgaccaagcaaccactccagagccatctggccaagatgcaaatgtcatctgacagcaacgtcctcttatcaatatgatcaaggtgtaagtctccagtagatttccactgcaaaaacacagattaattagagggccgtgcaacgaaaagcgagtcaaaaaagatgtgcatggtcaaacaaattctacgagccactaaggctgtaataattgtacttatagtgctgatgattaagatttttctgcggtcatcacacgtcgttgcaacgggtattacagtcttatttctcttggttgaaattgaatatgaacttagctagctagcattgcgaagaaagatttatctttctttggatagaagattatttagaggaactaggggatttgaactagttcctacaaaaattacaatttttttcgctgtattaattacatgaaaatgtattgattgtttgctcttcaacttcaacttattggctgcagctaaaattaaattttaaaccttaattttagagttgattctgattttttttattgttgttaatttttcagcatgacggttgcattcgaatgatggtcactagtgtcttgttttggttacagttaattatggcttgcaagcaaacagataagcctttttttctagtggtatgatcagtgcggtccttgcttgtgcttgcaaacaactctttgtgattgcctgaaaggaaccaacacaaatagtagtagtagtacgagtgcagcatcatgaagaatcaagtggttaattaagcagtggttagttaatttaacgccaaattatgtttaagcgaaaggaagcatgcatctgttaactggtaaacatctgaaggagacgtaaggccagttagactgtagctatctaattatgaagactaattccaagcttaggaatcgctatctatcacgacaagaaatcaatgacaattaaggtagcctgccgctcctgggcctgcaaatccatcatcagtatttgggatatcaatgcataaaaaagaaccaacactagcatactaaaaagaaagaaagagtagtttatatcaatgttttgttgaactacactattttttaagtgtaactttgtaataattggctgtaactcgttttgatcaaattaaaagccggaatattctatttcattatctaaaaaatgaaatcgagagagagagaaagagtgtgtgtattttttttttgtgatataagcagaagagggccatcttttgaagaccttaaaggcccacaacatctaacatggtggcccagctcgggccactcttgtggcctgttgaggggatgcattgttcgggtgattagaacgcctcttcatttttagagttcaattttggttggagcaataatagtagcactaaacttccgaagtgaagtggacaatttgcaaacatgctttcctcgtgtccacatcccaacactctaacatcacaaaggtaaattttgtacaacatatataatattcctctacacatgagctccaaaatatatggtacatgttatttggtgatgaatttgatatgtagtgaacgaatgcttccagcaccgatgatattgttcctaatcatatcttgctccatgtctgtccggggaaaggacaatggcgtcacagtactcgcaaggcttcttgtcatgcaggtacaagtcctcagatgttgtcagctccgaattaagttgatgatccggaggtcggtaatggcggtgtcggcgaggagatcgctcagcctgaatggctatggcggtgtttgccagagagagcgtggtgagacgacgagggagatggccacccaagtgcaggggcagcatggagccgagatttggaagctagctgacgagctaggtcgggaagccattggaggttaaccgtggagaagatgcagtaggtaagcctgaaaatgatcacaacttatctcctacagcgtgctcttctctatgtttgatgtttggcacaaattcgcgccgagggcgtatgacaagagagctgaaaaataaaacatcacgagaaattttttttaaaaaaatcctacgaaagaagagaagcaagcatcactgttcgtgtggatgagcttttcagagactgtagacttagggggttcggagtcaaaatcaccgaccctcctctgatcataaaccgtttatagccacacttaaatcgctgtaaaattatttgagagatactatcatagaatgttgcaccatggtacaaagtttctaggtgggatataaaatgtacgaggagaaattcgaaggcaaaagatgagcattgctttgcatcttcttcttccatcgatgttaaaggttcaaaagcactggaaggcagtgcaggttgatgcaatcgacctgaaacaaccaacaagctgaaacaaaacatttaaatttgatttggttggggtgtgcctagcatgagctttagtgcaacgctttgcaagccactatggtgaaccctctccccacgaaaaataaatttaatatcaaagtagacacatggcccacatatcagatattaaactgataagaacagatactacacttgatcttagccaaaaggccgagaaaggtatgagttgcattgttggatacccctgcttttgtagcctctccctggtactactctccttgatcctgcgatatggtacaaaacaatactccttcctaacaaaacatatagattatagcgtcattgctgtgtttattctcaaatgggctggcggcctgcatgagattagacccacgaaagcccaatacatccttgttcgcgaggacggcccagcccagcccggcccggcccatgagagcccgaagaaaccaacctcatcttctcctctcatccccttcctctctctctcgccaaggcaacttcttggaggtcggagaggaggagaggtcgaggagcgaggcgaggatggggcgcaagaggaaggagctgctgtcgtcggcgccgtggaggacgggggaggcggcggaggacgatgacgaggcggcgaggctgtcccgcgagggcaaggtgagcgtcaccagcaaccccggcgagacgcccaccatgcacgtcccgcgcaacaagcgccaggacctcgacctcgccgtcgacgacttcgacgaggacgagatcgaccccgagctccgctactccttccagcgcaactccagggtatcccatccacctttctcttcttctccccccacgcaatctttttttttcttttttatctctttatctggtgacgtcgcgctattggtggttgtcgaattatacacttgcttgatgtcgattgaaattgtaaattgaaaaatattcgtcaaaacaaacacaacaggattagtttgtttggttcaatcgactggtgaattgatacctgaaactttttgcacaaacacaataatgcccaaattaaaatatgtgaaatatattgtctcaaaacaacaggatttcactttgttggtaccctcgccgccctaagcacaggaattgagctggaggattaaccggattgctggagaaacttataaactgttatcccctgaagggattcacacgattccatgtagcctttaatccctcacgatggtgaaatctgtatatgccctcttcttgatgttttcatcttcatggaaatgcatggatatgaactattgatcttcatccacagttttcaatttcatgatctaatttctcaatactgtgttccagaaaatctttagaatgcgattgatatataatgtcgaatatgctatcacatgtactctcttcgtcccataaaaaaccaacctgacgtgaaacatgctagttgtactagaatgtgtcagatccaatcctagattcgttttttatgggacggagggagtatgtcactactatgttgtagtatatttgtattagatcgaaaggccatgttctgcatactctaccatgcattgtgtgctacttattgcagttatgaattatcattaaaatttatgctctcttgtgcattatatagtccctaatcgcctttttttgttgctacttgatctatcccatcatcagagcctgaaaacaggcatttaggtatctgtttttcctcaagcccccagaatggattttttgccttttttgtccactaaattctgctgtgacgtactcatccatgttttgtgcaaactctatgcgcttcacacagcctgaaagtcaccaatcacatatgttggccccaatggacacaatatgtgtttgtaggtctgcaaccagaaaggcaaaagtgccacttggatagtaacaccatagtaccgcagtgcattgtcactagttccaaccatggtccatgacatatggtccttgatgtttatagccaactgtgtttttttattgcacacaacatatgttaaaccaccttgttaggaaaagagtacttgtctacatgcttatattctttttccgcggtgtactcttaagtatttaggatcactttaaaagtttaaatgatatcactgcatttgtttgggataatgcagcaggataagcaattacaggtttttaatgtcttagtggcagtacctccattacatgttgaatcgttgtgcatgggttgtattcagtacttccaatttataatcctatatagaagcggaaccatgataataaataaatataaaacgtcttccttattggggacaattacttattctgaatacttattgcctcttcagtgacttcatcagttcttggttgccgtaagtaatatacagtgcatatttgttgaattatctgacaggaagactgctgtttttgcagtttctgcggagagtatttagtgtggatacacttgtcaagcctcttcctcctgtgatggcatacagtgtttctcgcaatgtgaactttttcttcaagatcttcacacagttctggggtaagctctgtcaaatgttattagcagtataacattggatgaatgctactggtgctccctgtttatttttatggtcctattctgcttgttgttttgtttattgtaacttgtttgccttggaattcccatgtattcttaagaataagggacagatggaaccaaaagttcttttgttcactgagcttagagcattctataatgtctggactatgtgagataaatctgcttatagttgttaaatatattattgatgtccttgtccaaataccaagggaaaaatatttcataagcaaatattacttattattcttaatttcactgatttgttgtttgcagatcaatatgtactcctcccgtcccaaaagaactcagcctaggataggatggatttgttgtcctaggatatgtcacatcctatccttacgctgagttattttgggacggaaggagtagtatactatagcagcataatatgtgtgagaaatcagggatacctgcatctagcccacttctacaaaacccaccaccttgtgtagatcatcaatttgtttttcgtttcttgttaaatcttttggtgcatctcttgcagatgaagagggaattgccaatgcacagaaatcccttggactggggaatgaggatggctcccggcggcgttgaataccattttgtagcaaaaccaagctatgcattgagagatcttacgctagattctggaggcctttgttgtatgcctcaaatgacacttggtgtggtctgtctaagtttggttctagtgttcgcgtcttgcattttgtgctagtaaagttggttgcgtcatatattcagatgttgtaagcttcgagacttgtactcagaaatctcgttctggcttctgtttaaaaagttgaaaaggggaaataatggcgtgtagttcatttcctattatgatttctgaatcagtttttttttatcaatctgaatttagatgtcatattttacaatcttcagtttctgctgatccttcatgtcagtttgctcactgggcatgttatttttggacgtcaatataaaaaaattgctaatagtgaacaagctcgttgtgtttcatacatatatcgtgtgtgcagcaatgctgatagcgtctcttactaacatcatccctgatggttgcatcaattaacgatttataaaatgctgagcggaagaaagctagagtttctattgattcgggcatttctagagcttagtttctgtagctagagactagtatagctgtataggacagactaaattcaatgaaactgaaaaaatatcctgggaagttcagtcaaaactgaagagctggagactagtgattagtgaagagctagatactatagcagtaactcccaccgtcccattttaagtgtaatcatggttttcagcgcctaactttgaacgtccgtcttatttaaaaaaaatttgaaaaaaaattaaaaacataagtcacgagcaaagtactaattataaaaaaatttcaaataagacggacaatcaaagttaggtacaaaaacttatggttgtacttaaaatgggaggatggagtatatgacagactagtaaattcaatgaaacgaaaaaaaatagatgctgggcgtttctgtttcttagttttttttctctctcgaacagtttctgtttcttagtcaaatgaaagaagatcatttcgctttttcttttttcctttttgttctccaaacaatggtttgaggggcaaatcatattgtccacatttgttggaccagcaagagtctctaactagaaaagctaaactatcagcataatcattcattataagggatcagatcatcgacaattctgcatttcataggcaggcatatatttttttttcctgctttgtactaattaaccgaccctgcaacttaacaagccctgcattggttgcttttggtgttccaagattcagagcagccaaaggcagtggtcctgaatggttatgcactctctgcctttgcatcctacaaaaaggccctctctttcagtctttgcaaggctaatcactcactaggttttgctgtcatgtcttgtaccattgtacgtcgatcatgcataacaaagattggagaaaattcagtgtactatggcagacattagtgagtgtgccactagcaatactggcaaatctttgtttgtttatgtagggagattagactaggttataggtcccttgtggattgtgcatgtgattgatccaccatttacctttactccttgcatagagaactcacaagatgagaa

SEQ ID NO: 77602 - DNA, 581 bp, Oryza sativa
aagacggtccagggaacaaccaaagggaggggaaatctcgaggggagaaatggattgattacctgctcgacgtggttgagccgctgcagcgagctgctctggctctgcgggagcatcgccgccgccgtcgacgaggaggacgagggagtagggttttgggtttcgccggagttggaagcttcgagaggatggctaagctggtatatagggtccttcgatgtatatgggcctcgcgtttgtttcggcctgtttacctttctccttatccttggattactttcaggtttcagaccgtttgttattattaataagatttatgttcaaattattttgatatttttgaactttttaaaatatgattttaagatgaaatgctcaaaattttaatttttttatatggttttcaaagtgatttttaattttgcaagcatttggggaaattttttttaaaaaattttaaattttgggggggaaatttaaaaatttcgtacaaatttatttttttaaaatatagtttttaagtgatttttttattttacaaggatttggatgcgggtctcgagcttgtggcatggctaaaa

SEQ ID NO: 77603 - DNA, 1711 bp, Oryza sativa
taccgaaaaagcggttggcgtcgtgggctttgtaaacccggccattgttccccctcctacctcgccaaggtgataccgatgcgaccatgtacgtagtacctctcgtcctcttcaccacgcacacccgcgtagcgacacgcgcatcacgtccgttccgcccacgacaacgactagcaattgcctagcaatctactcctactagctcgctgtctcactgtctcctcactagcttagcttaaattagcttggcttctggtatttttggccgtgtttagttgtttggtcaaaatttcttttgcgtccgtatgcatgtttgaaatattaaatatagactaatagtaaaacaaattatagattccgtctataaactgcgagacgaatttattaagtctaattaatccgttattagcaaatgtttattatagcatcacattgtcaaatcatagtgtaattaggtttaaaagattcgtctcgcgatttacatgcaaactgtgcaattggttttttttttccatatttaatactccatgcatatgttcaaacatttgatgtgacggaaaatgtgaaagttaaaaaaaaattaatctaaacacggcttgtattggatccctgggtctccatctggattaattaattttactactatactccgtcaaatggagactttgatctggatcgcgacaaacatataccgcctgcttcttcggttgcgtatgtagcagatgaaatttgacggaatatgctcgaattctaaataatactccctccgtattttaatgtatgacgccgttaactttttaaccaatgtttgatcattcgttttatttaaattttttgtgcagatatgaaaatatttatatcatacttaaagaacatttgatgatgaatcaagttataataaaataaatgataattatatattttttttaataagacgaatggtcaaaagttaggtaaaaaggtttacggtgttatacattaaaatatggagatatatatactagtagtattacttgttgctgctgcggcctgcagccaacttgtgggaggagaattcgacgacgacggcagcggcggtgtggacggcaaatcgttgttggctttcccatgttcgggaagaaggcacgcgatttgttggagaccatggagagagaggtagagaggaaagaacacacaccaagtacgcaagaagtttctgcgtcgacgtagacactatatatattctggccagtttttatttttgttgctcttgtgattacgccatttcgattgtcttttgcttttacattcgtttgatctggtatatgcttgcgtggattcaagagctggcagagctttactatgcggctatgccgtgatgacttgggtcgttcgttggatagatgtattcccacaaagtgttaactgtacccatcatagcaattcatttttgctatatatctgtcgacaaattttctcctgaaaatttgacagatataattacaatacaatcgtagtgtaattaacttgtatgtaattacactataacttgtatgtaactttcacataattttaaaccgttagatttgtttcaagatttgtacaagtgaagaaggaaaaaagtcgctgcgtgcacatatgtgagaggatccattcccacgaccttcgtttcatcgaaatagcctgttatagagagatttttaaaagttacatataagtagcgggctgcagg

SEQ ID NO: 77604 - DNA, 746 bp, Oryza sativa
cccctctatcaattcggccggagatggaaaggagcgacggaattttggaaggagacggcggctgcaacggctagggtttcgggcggcggcggccgaaggaggaagacaggccagacaggtgggacccacctgtcagcgggagagagagagagagcggcggctcggcggactgggccgaactgggccgagggagagagagaagagaggttttgggccgactttcggcccaaagccaaaagaagacttttaaaaacctttttcaatttaaattattcatgaaatgcaattccatttattaaaaatactcccttagctcaaataaatcccagaaaaatctaggaattatagaattaagcaaagtatttaacaaaattttatatagcccaattttatattgagatttaacaaattaaaattagatcttctcttttaagcttttaaaatcatttctaataattccttttaaacaacaatttataatttaaggattttaaacaagaaaagcacttaacaattataattagatcattattgatcaaataattactgaactgttctttgtatcatttaggaatgagctctgaaaaatccgagaaaattccaaagagttgatttaatcatggagaatttaataaaaattaaatccatccatgctttatattaaggaaattttgtttcccacatttaacttcacttgtaaattaaagatcatttaatataaattctattaataatttattaaataa

SEQ ID NO: 77605 - DNA, 5893 bp, Oryza sativa
ctagaaattaattaatgagatgagctaattatctcgagaagtcaagatgatccatcacaaaccaagaaagtcctcttgggtgtgctcacaagcttcttcttctgctgcctctgccactgcaagtgggccccaatcaacccccctcctcctaccctacggcctagccctagcttcgtcacctccatgccgccatggccgatcggcaacaccatcgacctgcccttccctaccacctgcccatagctgcaaaccctactgccatcgccatggccagacctcgagctccagctcgtcctctcttcttggaagacgttggtgaccacgacgatggcacccatggggtccacgtccacggccccgagcacctcgccgcagcgctccacgccggcgtccacgacggcgaagtcgacgcggcgcagccgccggacggccgccgacggcgacggcgcgagctggaagtccaccgcggaggtcgccaggccgaggcggcggaggtggcgcctgacgccgtcgaggccttgctggtcgtcgcggacgcagaccaggcggcctcccgtccgcgcggcggcgatggcgagcgcgacagccgtggccggggatgacgacgacgacgacgaagcgccgcccccgccggcggaggaggcgacgtcgaggaggtggcgcgcctggttgccggcggccagcgcggcgatgtactccatgctcctcggctccatcaccatgccactgccacgagcatcatcttgctgctgctccttgcactgaaattattaacaaaaattcaattagtttatttacacataaataaatacttcttttgtttcataatgtaaaaatttctatcgttgctcatattaatatatatgttaataaaaactatgtctaaatttattaacatatatataaatatggataatactaaaagacttatattatgaaacggataaaaaaacttatattataaaacggaggaagtattgatcaagctaaattgtctttggttgcatttgcaaatgctatgtagtacgtaccagttgcagggtgtgcaggtaggcatccatggcgagatcaggagaccaaccagctgagactagcttggacattatcaccgggagaagatgaagctggagctcaagatcgatgcagggtcaagatactagtagtagtagtagtagataatgtgacacaaggccaaggccttttataagcaacggcgtaattaagcagagtaaatcatggcagtttggacacgtttgcatctagcagtctccatcaatcgctcacacatatgtccacgtacgacttcttttgatacagctgaccggagtactgtatatgtgtccgacagcaggccgtatcctccctttcaaaatagattttttttaaaaaaaaaacacaaacatcgtcacgaatattaagcctcacaccttttaataacactattgagctaacaaaacaaaaggactccaacacctcacaaccaaaccatcgttaataaaaaccaaccaacaaaaagacaatgaaagaggatagtagacctctaaaacggtatcagctctattgtactccttctgtcctatattaatattagttgtcttcctaccatttaaattttgtcccataatacttatcactagcagtactacttatcccattaatcacatcttattcaaatttctctccattctccccctcaaccacccatccatcctcatccataaattactttataagggtattatagtctttttgaactttttttcaaaccttagaatataacaaacaatcttaaaagacaagtaatttatgatgaaggaagtaggaacctactgcccgcttaaggcaaaataaatagacactagttaggtcccttttttatcgagatacaaattttattccggttttcgttagtgtactttttaaattgctaaatgatatatttttgagtgaaaacattttatataatcgttactttaaaatgtcaataaatttgttttttaatttgtaataattaaaatttaattatgctaataaacatttaatatcgaacgtggccttagtattacgccgtatgaattctcgttaaattaagtgatgtctaacgggatgccaatggagtagcagcaaaaacgactcaaaggaatcccaactaaccgaggctctcgtggcagcttggcaatcaagtggatatctccatcgactatttgtgatgtggtggtcaatgtcgacacgctactctcgtggcggcgacgccgtccaggcccggctcgccgtcgccggccgtatgcatgtaacgacatgtgaagttgtgatcaatcgatcatgtgatgctgctaagccgtcttcgtcgctctcgatctattagagcagttagaataggagtctattagccagctataaatatattttaataaaataaaagatgaaagagaagagcagcgggctacatatctatagccagctacagcatggactctaagacgcagtgtgtgtatgacaggtgggatcatatattaatagtatagtaagcaactattatataaattggttattagattggctatagatgaattggaggttgtagtgggctatactattgaacttgctcttatcggatcatgcaattaatgaggctgcgaaattattgcgtctggccggcgcctcccttccttcaaagggggaagaacgcgttatgcgtgggtgccactactcacatgaatcctgatcccaacccttctgcgatgaaaagagatggtcaaatttagactgcaaaatgcaaattaatcgcgtcaaataaacccagaatattgttaacttgcgtcttctagttaagacgaggcaaaatcatgtacatatctgtcttcatagatgctgcttttagatgccaagcagttgggttgtttagaaaatgggtgtaaagttttaatgtgtcacatcagaaattatatagggtgttatatggggtgttcggtactaattaaaaaactaattacagatccgtcagtaaaccgcgaaataaatttattaagcctaattaattcatcattagcaaatgtttactgtagcaccacatcgtcaaatcatggagaaattaggcttaaaagattcgtattgcaaattagtcgcaatttgtataactagttataactagttatttttttaggctatattgcttcatgtaggtgtcaaacgttcaatgtgacaggatgtaaaatgttagtgtggaatctaaacagagcctcagcttactgttgttcatgaggtagtatttgatactcaaaaaagctcttctaacttttcctacttttgcgtacagtgaccaatgaccagtataaagcatatcttttcaacaatttttagttaaaacttaccaaattaaacttgcaacacataaactgatttccagtttgatgggacattgggttcctttcagacattgatgcaaaactaattagcccgtttcctgtgaaatttctatgctaaagcattgtacgcttgggtggactcccctgccaattggtcaaaactaatctcttttctttttccatttcctatatagccttatttgtacatgtacaacattacattttctttagtttagatacaaaagttgcacggcaaccgggcagattttatgtacaacattcacccgggtgctccgattctgtggtcaagtatgaactatgaaccacgcatctctttatctaagtgttcctccatgtctagaatctaccctctcagtgagattatcatagcatatcctgcagaaaagaaagagatgtcgcattgtgatttagtatcattcatcaagagatgcaaaattaagcaggttccagccaacctgccaaaagatcagcatgaccatatcaacacgcctgaaaagagaatgaaaagaatacaattgctcatccataccatcaggaagattcacagcttgaatcgttctcagattttcttgaataagttctcacttttcttgagaattccttaactaatgaattatctgaaaacgtcaagggagtctcttcagcaattggatccctcacataaaacagtcgaataggcatcctttcaggatcatcagttggaggttcttcaggtatatcacggtacagatgtttgagaatgaaaagagcagtatcatgatctcgccaataattgctacaagaataaacccacaggccagttaaatggtgaacaggcatgttaaacaattagcaaacaacaggattgattatggaacttacgtatgagatcccagggcagataagtatgggtgttgaaatgttttctcctgaaatcaaatgattcggactgtaagctacaacatatttgtactgacataaataatatacaataagccagaaaaaaaaaggggggggggcgcaagggaattggtcatgttggcaaaagggttcgcagtcctgacacagtaaccactaaaccagcggagacaggggaaccagccaattcaaagcttagccagtggttatatgatttccactgtcagttcttttaggccacagtagttggttaagataggttagctaaagggttactgaacaaattaggcatattttaaatcatgtcctcactcatttggtatagaagtgcatttaatagtatttaacatcttggatttatgtgctcttttatgagccaaaatttaaccaacttcagagtttatgggtttaactctcttgtgaagattaaccttgaagctaatttagggtgttaaattaatcacttatattggttagaatgatttaagctctcaccattcatgtcaaaagcaatgtacagtacttttcacatccaaagcagagtacacaatttcaatgcctatacatacaccagcagggagtgaaattgaacttgctttaataggaaaagtttaataacctgaagtacatggtcaatccgaccatctggtgaacctgtcagcctttccatcatcatgtaaccatatgacttctctttctcattattgctgtcaacgtcctctgaacaaccaaaaacatactcagagcattgttttttgtgacttgcaatgtgtagaagacaaaaaaatctactatatgcataccgtccgtgtcatttctgctcagtgatagcaaagcagctactgctttaacctaaacacaaaaaaggagattaaagtcccaactcattaagaaagagctacgtgagcagctatgtttctagatcattcacaggtaacaaagtgtctatgtaccaaggcccgcctaaattcagccatgtctcatattaccatcaccaaagagcaaaccttaccttcagtgacttgaactggcgagcaacagcttgagaccttgcagcaatatcttcagtgaattcctgcatgacatgtcaacctaaatcagataaatcagataaacaagagtaatttactataacagacacactcgcctaaaaggtgtccaagaatatactgaatcactcacctgcactcctacatgtatcctctttccccctctatggtagggtacaattacagggcgcttgcttatgtaatcttcacatacaagtggttcaatcctgtataaaagccaacttagattcatgagacatgctcctcgctttgcaacagataaggacagtcttctccagtacataaagagaagtgatgaaaacatcattaatatatgtacgaaagctgcaaacctgtatgctacaggatcaaagggatgaaaaatgttgaacatctgacggcagcatggcatctcttcaactatgttctcattttgccaataatcttgccccctgcctttagaagagattacaaacttcagaaataacatagcaaataatcaactgtcaattgccaggaatgataacagatcatgaatccactagtcaaagcactggccag

SEQ ID NO: 77606 - DNA, 589 bp, Oryza sativa
agaggtgtaccactgtacccacaagacacaaccccacatcatgtcaccatgtgcctcaataccaccacggtacctcggaaaggagttgtgacaataccccttgcataacacaatccactacggcgcacctttcctggatcataatcacccccttataaacaaggtatggactccccagcgacccccgtgggcttatctccgccacttctcagtctggtgccccgcaatgaaccatgctacacaaaagataaagccgttgcccatgctggcttgtggttggcacggttaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcattcagccatcattaaataacagtgagtcataagttaacccaatagtgagctaatgtttctaagcagggctaagcaattatatctaatatctagttgaaccaatatataaagctcaactagtcaagttataataacccaaggtatcaaggaataaag

SEQ ID NO: 77607 - DNA, 3460 bp, Oryza sativa
gtaaaacgaaaaagctcattattatatggttaattaattattaataattataaacttgaaaatgattttatttaaattttttaaacaacttatatatagaaacattttgaaaaaaacatatcatttaatagtttgaaaagcgtgtaaataaaaacaagatagttgtagtttgaagttgaagagaagaactaggcctagtatatatgaactgctaaaataaactagtattcctagtactatacaacaccgactatgtcataaagtaaattatcttgcttatagctattatgcaactactaattggcctaaaactatgattttttttcctcaaagtgtcttgtatatcgagttgtaaaactaaatgctggatcttacgtacacaaaagaattgtatgttttgaaatgtttgaataagcttggaagccatttacgtttgttttgaatagagagaaaaagccatctccaacaatgcttacagaggaaaaaacagcatgttatctatttttcgtgttcaatatataaaagtatatggaaaataaaagttaagagggctagagaatattatgcgggcaaataggagtatgcatttatactgataatatataagtattttcatttattttcttatggttgcacgtttatacggcatccaattatgatgtttctttccatgttggtattaagataagtatattttgtgcgagttattttaattgttattgaaatactgtttagacagcaacatagcgtgtacgcctcatttattaggctatcatgtatgccaattaggtcaatgaacaataaacctatacatatttgtgacttcataaggagtttattttttcaattatcattgaaaaaaactctcattcatctgtttttaacactggctcgtgaatataaatgctcaatcgcacaaggcttcatgctaacaatatctccacatgcatacaactttatatgtccattttagttttgcaccaacaatctaacacgcctctcttcttagttcttaggaaatactacttggaaaaaaggcacgggctacaaatacaaaataggtgtattctagccatatgcatcaagcaatcctagcaaactccatattgcatccagtgttacgtgtccgttcgttcgtttgcagttggagacaaaatacgccttcgaattcacttcgcgcaagaaaactgaaatacgcctctctccctcatacacgtattacaaacaccgcaaccgcaaaatacgcctaggtgttccctctataaagcggagaaggcaaagacacgagctctctcttccaaccccacacaaagcggcgcctccgcacccgtgtgtaaagaaaaaaaaatcggaggcgaaaacctctcaaaccctaatcccctcgtcccccccatggcggagtcggacgcggcggcgccgccgccggaggtagtcgcccccgtggaggagcagacggcccccgcggtcggcgcatccacgctggaagaggccgagcccgccgcggccgcggccccggccgccgagggcgagggcgagcacaagaggagctcgaggaggtcgacgccgcccccgacgcgaacggcggcggcgaggacgccaagcggccccgcgtggaaggcgacggcgaaggtggatcttctccctccttccccgcgtctgtttgcgcatagggttttgcatctcagaggggatgatgcttgtgtgttttctaattcattcggtgcttgaataatcctcgaagggtttatgctccgtgtgatctgattgtgttctctctttgaatcaggtgtcgtgcagagcaacgagtcctccgcgaaggtcgatgagccggtagctacagagaacagtgacgctgcccctgctgaggcatctgttgatgctgtgaatggcaaggttcctcctaccgaggattcgcagatgggctctggggagaagcctgcagcagaagcagcagtgactgaagccccgccgcaagaaggtggtggcgcaccaggacaggagacgtctcggataatcaacgtgcccaataacaaggtataattactggcatggggcaaatatggcaacctgtttggtttcatgtagaaatctgcagaacattctgtaactatttatacatggcctctatgaagctgcgtaaaattcaggacgaaaaccacggaaagttattaatgagtgcagacattcggacttgtggtttgctaatgctagccatgaaaattcatgcaggtcggagtcctaataggaaaatctggggaaacaatcagaaacttgcaaatgaactcgggcgcgaagatccaaatcacaaaggatgctgaggcagatgcaaatgccccaactcgttctgttgaactagttggaacccttgagagtattgacaaggccgagcggctgattaagaatgttatagctgaggtattccacgtgctaaattaattagccgtgatttccatactagtttgagctgtattttcatccaagcaacttaaacttgtgacattctttattacttccacttcaggctgatgctggtggttcgcctgctctgatcgctagaggttttgggtctggacagtcaggctctgagcagtttgagatgctagtccctgataataaggttggcatttccttttcaatgttggcaacgaagcaacctttcctttaaaatgcaaggagccataacattttatttatttaaccgtttgctttgacctataggtcggtttaattatcggaaaaggcggcgagaccattaaaaccctccaaactaggtctggtgctcgtattcaggtagagaaggttacttgttacgctgtaatggctgttgcttacatcaactgagatttgagtgtgatcataaatgttcatgtagttgattccccaacatcctccggaaggtgttacattgacagaaagaactgtacgtattactgggaataagaagcagatagaagcggcaaaagatatgattaagcaagctatgagtcaggtaatgtgattctgtgtttcgctttcaactgttccttcatgctgtaaataactagtgatattagatgatgctgtgatcacccaatgattgtgcaattcaatcatgctgtgaagaactgggcgatgctatatgatgatgagatgctaaattcctactttatgcgtttccattctattcatgctgtgattattttttcattgaaactgaatttctgttacctgctctggaatcatggtgtgtattatcgaacctattgtctctagcatgaccttactatcttcgtattatatgattggtataatccaatatgttttcctgttctccctgataatagaggtcttagaaatatagaaggtgttttttggttcttgttgagtaaacctgtgatttctttcaatcagcttaattaaatctgtgccctcttatggtttgtgtagatgttattttattgataccttctagaactggttc

SEQ ID NO: 77608 - DNA, 10333 bp, Oryza sativa
tgagagtattatgtatggttatattaatacttaatttatacagaataatttgtctataatatttcatgagttataatctcctcgtggtcaattatttttttgtgggaatatttgtcatcttccatataattcagtatcttgccttgctgccttttcaatggcaaaatttattccatgtccatgaattttaaggtttttgcattgtcttaaattacaaatgatgcatatgtttagtttcccatgaaaatgttgttcattcatggattaacaatatggaacatggtgtgcatgatcatcaatgttaactatgaatgaagttagaataaatgatttgactctgcaatggatagcttttgaggatttgtgagatatattcacgttgacataaaaagatagtttagtctcggtggcttgatagttcttcatagttcgtctagaagcagaacttaccttcgtgtatgatagtgtggttggacttcagtacttgatcgttaaaaccttggtgctgtcacatgatcaatgaacaattactgtggtactagtttcaatctttagtcggctagtcttttgagttttggtaactgcttactgctagatgagatctgattatgtttcctacataagaagtcagaactgactcatcaaggttcctctcgcttccagtttccatgatttattttgtttgaaggtgccaatttggagttggttgggtatcctaatgcagatacagctaggctttcatcatgggctccacatccttcatccattacatgcacagaagagggatattgaccattatcccttgcccttgcatggtttgtgtagttggtaactggtaaggctgcttattgctgaaatggaaagaaaaaaaaacaatgtggcattgggagactgcaccaaatgtttcattgccatgacaaggatactgcatcaccatgtctaggtttgctgaactaaattgttgccactaatttgcaatagctgaaaaagcagcaagttttctcgcatcacatacgtcagttatttgatgtgttagctttccaactagaatattcaagttggctgacagcctatattgttggagttaaatcatatatgtgagctatgcatgcaattttgctatgtttcttttttttgaattgctgcatgtaatatcaccatggttatgtgatgatgtcataacgtgcaactgtaatcccatttacttcttacttacccattggctctgctaaaggtgatggttctgttgatatatgcattcatcacattgatattttgtgtttgtctattgttcagatcccctggtccttttaaaaattcttgtttagatgtctgaaggaggttgtgaaatgccagtattaattagaatccttttatctaacaatgtttgtgaatgcttaagcataaattatgtttttagtgaatcatggtgccatagcttatatgcaggcttattttgttattgttggtatgctgcaagtatgaagtgaaacactggtcatcctttttaattatcttacaaaaatgcctttattcttctgtgttatatttgtaatttgtaattgtactatttagtattttgtttttgtcatttagtgttcttgttttgtttctaacgttccttcttaaacagacattttcaagacatggggctcaatctggtggatatggtcagcaaaactaccgccctcagggtcatggtgcagcttctcagtggggcccacgttctcaaccccagcctggatatggatatccaccaagagggcctccacctcagaacatgccatactcccaaccttatggtggctacccgcagcagccaccaccaagaggtggcatgggctgggatcagaggcagggccctccaccccatgcttcccaccatggtggcggttacgactactataaacagggttctcaaccatatgaaggccagccaccaaattaccctcctgggcctggaaactacaatagttatgggccatcacagggcccaaattatggacaacctcagtatccgcagtctgcacctccacagaactatgggccgggttatggtgatcctagatacaatgctccagcaccaaaccagcagtactatggacagcctccagcgggtccacagcaaggctaccctccacagcaagatccctacgctaggccttatggtggacctggacaatgggcacccagaggtgcaccagccggagatggcacttaccaggcgccaccacctacatcttatggcccaccatctcagcagcctcctgcttatggtcagacatatgggccaacgactggacctgatgggtattctcagcagagttacccacagcaaggtgcacaagcgccagcaacatatggtcagagtgcaccagcagggccagggtatgctcaacaaggcgcacagcaaggtggctatgcacagtatcctcaatcccaaccagcatatggtgatcaagcagctcaaaacaatgcaaactacggctaccagggtgctccagcagatcccaactatggaaatgcctacccacaggcaggatacggttctactccggctagtggccaggctggatatgctgctgcaccggctgctggccagccagggtacggtcagccaggatacactcagccacctacaaatccaccagcttatgatcagtctgcccagccaccagctcagagtggctatgctgcacctcctgcaaacccacagcctgctgttgcaaagggggtgtcaccgcagcctgctggatatggtggacaatggaccgcttgaggtttgtacctcattattgacagcaatgatctagttgaagactatgttttgcctcatgatgctgccgcttatatgaagtaggcggttgaatccccttgggatgttcattcagtaagcggtagacttttgatatgcctataagggatgtaaccccttgcctctccagttgttataccggatctctgtagtagttagtagtttgttaagatgacataaaacctcctgtttagtttaaaagtgaaccgaattatgtgttattctgcagcatgtcgactgatgtttggatgcttagtcctatccctttgcttcaagttgtttgtgctatgcttgccgctggttggttgcaatgtgaaaagatgttttgcctgctgctaccaacacgcagttagagatcatacttgtttgcgccattggctggcaactggttgacaaactttctcatgttactatgaatcgaaccgtgcagtatatacatatgctagaagtggtattgatgaactattcaaatctttactatgaatcgaactgtgcagtttatgcatgtaatagaagtggtattgattaaatagaggtttttacctgtatgccattaaaaaagatgatgtctgcctctgtgccactaaaaaattcgagcctccctctgtgccatcgttgaactttgtcgcgccctccgcaccattccgtcgctattctgtgtgggtttaaccgtttgataggtctgacatgtgggtccgggtaggaaaaatgtcgctcttaccctttcagagagaggacaggcggtgtggcagacaagcggccaggcgcggcggcaaggcggccatgcggccaagaggggcggggtggcgcggcgagaccggcgaccggcgcggcggcatggccgccgccgcagggagcgatggccaccgccacctccatccacgccgcccaccgcaaccaaatcgagatccctccccgtcctccaagccggcgactccttcctcgtccggcggcggcatccgccacctacaactccctccgtgccgccatcaagcgccactcccgcaagctcgacaccatgaaggccgactcctcctcctcatcctccggcgccggcgccttcggatcatcccagcccgcgggctcctcctcgttgcgaaccaagaagatggacgaggagcggcggcgtccggggagggatccctcctcccgccgatccgggtttcggagtgggccggcggggatgagatgaggaggagcggcggcgacgacatcttccccacatgtacatcttccccagggcattctctggccgctccttgaacacccacatatacatgtactccatgtcgtgctgcactagaaaagcatctagtgtagcattattaccgttcccacggcgatgggggccttcgccttgccgttcttgtcagccaacatgaccggcttgaagtagtgggtgaagaagaaccacgcgccccatatggtatcgttcctcttcacacacttgcaggcagcgctagaattggagcccttggcatgtgatacgacgatcgtggtggtcgccgccgccggggcaggggacacgccggtggcagcaggtgagtccgagtcgtagagctgcgggccgctgaggccgacatctagcatgtcgacgttggggtcgtggagggcgtcggcggccgcacggtagctacctcctcctctccttctccgtgctcgccatcgtcgaccaactcgtcaatttcccactgctcttgttcactatccggccggatgccctcgagcacgccaccatgtacctccacctcgctgtgtacgcgtccgtggcgctcaccgccgacgggtgttgcgtcttcccaccacggcggcgcacaggcgcagctcggggacgtagtggccgcgctcgccgcgtcagtgttcggccaggagctattcccctcctcccccttcctcggcgccttggggacaaacaaacgaacacgttggccccaagaacgaacggcaccggcaagaacgcctaagggcaactaagtaatttggctgcgccgttacccaccgttaggacaaaaacggacggaatggtgtggagggcgcgataaagttcgacaatggcatagagagaggctcgaacttttcaatggcacagaggcagacatcatctttcttaatggcatacaggtaaaaacctcgattaactattcaaatctggaaccaaagcgtatcccagaagtggtattgattaactattcaaatctggaaccaaaccgtatcccagtgataatcttgtgaatacatgctattcaatctcatgtactatgaatcgaactgtgcagtttatacatgtgtttgaagtggtatgatgtaactaattaaatctggaaccaaagcgtattccagttgtaattcaattgcaatgataatcttacatcagttgttatgactcatgatcatgatgactcatgatcatgatgggagcagcaattggcgaagagtatcatagagcgcccgaaggatccccttgtgctgctgctcctcaggcagcctcagcatgctcgctaccttgtcgaacttctcctgccccagtgcggcgtcctccggcgaggccgccaccgccgccaccctgtgctccttgtggagcaccggcggcgacagcgcccactgcatcgcccagacgccgagcgggcgcatgtagtgcagcgcccggtagccgccgtcggccgtccacgactccggcgtctggaacgcgtagccgaagccgtgcttgccccagccggcgtcgtggatgcccttggccgtcttgaacgccgcctccggcatcccctcgtggatcatcgcggcggcgacggcgtacgtcaccccgggccacacctccttggactgcgtcgacgacgcgtccacggcgccgtccggccgcatcccgttgacggcgccgatggcgccgcccttcacccgcatgacgttgtagtcgagcaccgtcgccagcgctcgccgcgccttgtcgccgtccacgatcggctccagcccgcacgcccgcgcgtaccactgaccggcgagctggtcggcctggatcgacgagctggtggcgccgccgctgttgtcgtagttgaagtagccgccgttccagagctcgtctgtgtacacgcgcctggcgcggtggtacctcccccggaagtaggcctcggcggcgccgtcgccgacgatgcccgccatggccgcggcggcctggagcgccgccacccagaggccgccggtgtaggcgctgacgccggacaccgaccacaggtcgtaggtctggtcggggcggccctcgttctcgaccatcccgtcgccgtcgcggtcgaactggtccatgtacgccatggccaggtacaccgccggccacgccgcctccgcgaagccggcgttccccgtcgccaccacgtcgcggtacacctgcagcacgaactttgggttgaggtccttccacctcaccgggtcgtgcagcatgtacgcgttcacctcgaaccacgggtcgttcagccccatgtcatgtggcaccgctcccaacacctgcatttttgacaccccaaactagtcaatgcatgcaactcaatataacgtactcttcacgcctaaccgataaactcatataactcaatatacaacatactctttacgtttaattgatcgacgtatgaagcataataccgacgtataacttcatgtcttattagtcgatacataaaaccttaaaattactgtatttttatatactcccttcgtttcatattataaaactttctaacataaagtcttagaaatggatgaagtatatattttattcatcggtgtatgaaactcaatactactaaatggtagaggaagtatgaaccttttatatttttactaatcagtgcatgaaacttaatacttgtccctccgtctcattttaagtgtaattgtggtttttcgtgtttaacatttcaccatctgtattatttgaaaaaaatatgtgattagtgtttatgttttattatctaaaaacaataaaaatattattcacataattttttctaagactcaaacattgaatacggaaaaccacagctgcacttaaaatgggacggaaggagtactgaatggtagaggatgtatgaaccttgcgcgccacggtggcgccgtcaagggtgcggcggaggcaggggtcgtggaggaggacgccgcggacgaagtcgcgctggaggttgagctcgagctcggggaagagggagaggagggcgaaggaggcgtagaagtggacgtcgtaggtgttccacatgttgtactccatcccctccaggtacagcacctgccccacgttctcctcgccgtcgcgcagcagcgccgtgcccatcgccgccgccgccgccgccgccgtgttcgaccgcgccgccgccaccgccaccgtgctcaaaatgccgtcgaccgcgctgccgccgttggcgactgtactgaacgtgtcgaggttgaacggctcagtcgctgacgaaaggctggtgttcttcggaggctgcccatctgtgacaattttgttttcttggtcagtttcaagtttctgaatcgttttgggtttcagatcagtgatcaagttattttggactttcagaatggatgtttaagaatttgggtgcagaagattatattgacctgtccaaatggtgcctccagcgttgaggtagtagagctcgttgaacagtgtaattggatacctgacaaaaacaacattaccatcaacgaccactaatccaattagtcaattacttgctccgtaaaaaaaaactcaacctagaagtttgtctagattcgttgtactagattatgtctcatcgaaatactaggttgagtttttttggactgagggagtagtgattagtaattgatatgcaaaatctgaaaaattcgatcaccattcaggtaggctcttgtcctgcagaataggcctctgccactcctcgatctgggactcccatttcatgtgttctacatgcagacaagaacaccaaacattcgtcgtcagaatcttcagacaacaaactcctgactcttgcgtaaattcagaaattaaatttgttatcttcaccaagaagagcatcgtgggccaggcgctcagcagccgcgtcgcgatcggtgccatggaacttggtgtacctcctgctccagccatgatcagacgatctcatcatgtcagtgttcgagaatttcagaaacagcaaagaaccaacaagagaatcgccattgctggctgctgatgagcatgagctgtgtcactgtcacagtgtcacttcacctgtggtaggttctccccgccgggaacttcacctcggggcacgaccacgacagcgcgaacgacaccgcgcgcgcgccacccgccgccaccgtcgtcgtcgccgccaccgccgctccgatggacgacccgggcctcgacgctcccgtcgccgccgccgccgcattgccgtccccgacgaacgaaccattctgttcgccgcgaacatgcagtgttcgtcagcctgtcagagactgacagtgaagcgtatgcatggtgtccgtcctccgtaccttgttgatctgatcccacatgtccttcgccgtgacatcgccggagttggatggtcccatcgtgaagcgcgggcagccggtgacgcggacgccgtcggtctcccgcgacgcgatcgcgaacgtcaccggagggcgcccatccgccgtcctgcatccatcgatcgacgacatgtcatcatctcatttgcaaaagagtttccgacacgagagcatgatgaggtgatgaactacgcacctgtgatggaggaggacgccatggacgccgtcgcgagctctgcgcaagaaagatcagcacagttgcaagaagcaacgagtccatgaattaactgattaaaattggtgagagacatgatggcaagatcagtaattacgtcattctggagttcttatgattcccggtcagttcagatttccctccaaccgaattctgcatgatgaacaatgccagtggtgaggtttttactggaaaatgctgtctttgttttatgaagaactaggtgttggtttgcacttactgcccatgtgaagagcagtgttacatctgcaggtgtgcttccagaattgtgtaactgcatgcacaggaacagaagttcagagaaaacaaaatgaacagatcaattggagttattttcatctgcagcagaaacaaaaaggattgtaagaactgtaccgtaaaagtgaaaactgcaacagggaagctgctctccttgtagttgtgaggaatgaacggtgatatctgacggcaagttattttaatttcagggtcaggttcacctgcattgtttgcaattttagagctcagattagtaaggatttgcacaattgatgtttttccaggattcgtgatcaatggtctagtgatactactataagaaatcagtgtgtaccattgtatactgtccatgatcttgggaacaagccatggtaagtgcaattcttctctttcagcttccagtcccaggatccaatgccagctttatcgattcccctgaaaatttcacatttcatgatattcctagcatgcaaagatgcattcaaataggctttgatataaattttgttgtttacttgaggacatcggcattcggtgccgacaacactgtcgagtatctctttccgtcagggcgcgaaatgaatgcctatacaattgaaccatgatcgtgatgattagaggatttctaggattaccatcaatgttcattttatattagaaatacaaaatgaaaagcactaactgaaaattgatttgctaggataggcttctcttcatatatactggggaatatctgaaactgctgaaaatatcccctgtagcttctccctatgctccctgcactgataaaacagtgtgctttgaacaaagttgtcatctattgttcaatgaattcaaatttagctatgaccaaaaggtaatagaatatcttgatatagttcctaatcgtagatagtaaggaaacttagctgaatttttagtaggaaaggcttaatttgcttacccaatcccaccgaggggtacaccgcggtagcagttgtccatccatttcttcagtggatcatacactgaagcctttgcaaaagtgaaaaattgtcagtaagtttagcaattcctgctgatatttcaacagcctgcaaaacaattattgatggattagctggatcttcaacagggtaagagtaatcaccaggccttttgcattgtctttcaggtttagtcccagcattttaatcatcaacggcacctacaataccaaaagcaccatgacttcattgcaaatggaatgcttcactgctaatacctaatttagactacttttcttgaaagcaacgagtgtcgttgccctttttgctaaatatgcaaaagaaacaaataacaatattaaacaaagttagtgctcatgttattaatttaacaacttttcttagaataataacagtgttcttgctcttctctgaaaagaaaggactacttttccttgacaacagtattgaatattgaaattt

SEQ ID NO: 77609 - DNA, 589 bp, Oryza sativa
  unsure (1)..(589): unsure at all n locations
caaataacgaatagacttaataaacgaatataaatatgtagatcatttagaaataacatcaaaagaatctatatataaatcaatttggaatggagagagtactacgtagtatccgatagtgacaaccttacatggagcaaagcatgggccacctcgagatgactagcaccgggaattgaagcagtgagcccgtacctacctatctactactactatatgccactccaaatactcgcagaattaaacggtagtctttgtcacttaattggcgccgaagcctcatatatactacgtatgtgttaaccttgcgaagctgcaatgttgcacttgcactgcactcgcctcgccgcgatctgatcgccatggatcacgtcctcgcctgcgtcggcatcctcgtcgccttcacgccgctgttcctccttgccgtgctcccgctcaagctgacgaacggcggcgacggggtgaagctgccgcctggcccgtggcggctgccggtgatcgggagcatgcaccacctgatgggcgagagcctcgtncaccgcgccatggccgacctcgcgcgccggctcgacgcgccgctcatgtacct

SEQ ID NO: 77610 - DNA, 3248 bp, Oryza sativa
aatgcttacaattgccatcatgtcattcaaggtcatgctaaacattgcaaccttctttccttcatcggcccaaaaaaattggtttgccaccttacctcccacgcaaaagatattgctggtggcttttcacaatccatgtgcaggactgcctaaagcaagaacagtactttcagagtgagactggctaactttctcaacaaagaacataatgaaacactgctcagatacaatccatataaatagtggcacaaatcaaggaaccaaagaaccaaggtgaagaaaacagttcttctaaacacaggagcacatcatttgcgtgttccattttccaaaaaaaaaaaaactttttccacaactctttgttaggttcagaaggtaccttggtttcctccaattctgaacttcccatcttgatatgaactccggttggattgcggctgggcagctaatatgggcacaaggacaagatgtaaatttaaagacttgtcgagatgtcaagaacatgactaagcaaatatcaagatttctgaatgtaaatcagcaataaaaaacacagcacaacacaaatactcaggtatctgaatgcaaagcatgcatttcaggaatctgcagaaaactaaccgagaactatcaagtatcaactaaggaggaggaggaggaagagagtaatacctgaatctgaacagcactagacacttagactgctcttctcattcagcagatgctaagattttttttcgaaagccggccggagtatatattaagaaggagagagtttaagcaaactgtacaagaaaacaatcagagccaaagctcacatacagaacaaactgtacaagaaaacaagcagatgctaagattagcttttataaaacattcgcagggaaacaacaagtggaagcaatagacagcacgggaagcacatgttagcatcaggttttctcttctttaatttttaggtgggtggaaaactacgcagctcacacatcagcgttaattgattaattatttcgatggtctccaatccccatggtgatgcctcttttgttctcttctgtgtggatatcgagatgatgtctctaattcatctagagcaagtttaatagtatagccaactaccggctccaaatcaattatagtcaattttatagccaattcatacaatagttacctataaacatatactacacaattaatacttgggcccacctgtcatacacacatgcatcttagagttcgtgctgtagctggctataaatctgtagttcgttgctcatctctatcctattttatatcctcgaaatgtgtttatagctggtttatagtctgctattgtacctgctcctatagccaatctaatagctcattcatacaatagttatatactacactattaatatctggtcccacctatcatacactcactgcatcttagagttcgtgctacagctggctacaaatttgtagtccgctaccattctttctcttcatttatctctttaaaatatgtttgctgctattgtacctgttctaacaaaaatgttctaccttgtatagtttaaatttttttttggaatagagcacatcattatattaagagaaatatcgaaatatcttttatgtacaagccgaaggaaaagagaaaagagaaggggacaagaaacaggagagcccaacggtttgatgtgaacttttttgatcaggacgtttggctcaatctgaactagaaaacctatgatttatatacgatctgaataatttgacatgattttttcgttggaactcccgcattcgaaactagggccagtcaatttattgtcgacgtgatgcagaacgggaaggaccacgaggatctcgaatcccaaatatccacatattcattcagaaggtacaattgaacaaaccacgagtaagtttgctgacgctaataaaaaaaagtttctctttcttttttgaaaaaaagatgctaatcaagaaagtaatttttttagagaaaggtattttggtctaatcaagaaagtaattttttttagagaagagtgttttggttttttttttttacctggcctctacatccaaccgatatatgcagcatttttaaattaggaacttagcctatcgaattgggaacttaggcgtcaaataacccaatctaaaattcgctcatataaagatttgagctcaggaccttgggtgttactcaggtcactgtaactattaggctacatcctttcacatcaagaaagtaaattaaaagcgtaaactatgtgatctcttcatatgtcagacaaaaccaacgaaacttatgtttctattgttctttctatcttgattagcaagtttgatgttttttttttgaagttagggctaaacctgtggctactgctcttaaaaccagcaaattaagctgcttgtatttattacctatgacgatatgcttagagtcaatggtaattttaatttcagccattacaagcagatagacacccatggcccatgggaatttgggaagtccactcaatttggtcaaattgtcgtatagtcattgagaaaaccaaagcagccaggctgcttgcaagtccatggtcatatgtttatggagtagcaagtaaccaagtcactcatgacatcgacatgctatctagaaggcaaaggtcatcttctttcaatccatttgctgaattgcagtgcaggcaatatccgtgcatgtttcctcctcaaattcttattggctattcagtacagtattcagataaacagcagtacatcgtgttcagaactcagaagtactacctccgtcccaaaataagtgcagccgtgtatatccatgcccaacgtttgaccgtccgtcttatttgaaaaatttgtgaaaaaattaaaaatatttagtcacacataaagtactattcatgttttatcatctaatagcaataaaaatattaatcataaaaattttttaaataagacgaacggtcaaacgttgaacattaatagtacaaaactgcacttattttgggacggagggagtagcaatttgtcttcctcactgggtcctctgctctgaattttgtgagaaaagaaacaaaatgctctgtagaagaaagatggagtgcacagtttgaagtgatcgtaagcacaacaagctgtcaggtttgaagatattgcccataatctcgcgatcttttcacatgtggtgggtatctgtcaattataatagttgaaagctagttcgaattttataatattaa

SEQ ID NO: 77611 - DNA, 696 bp, Oryza sativa
gccgggctcgtcgccggtggccacgtcctccgctgtccacgcgctgcaccacgtcggagctcgtcgccggcggccacaccgaagctcgtcactggaggctgcatcttccgccgtccatagccatgcgccggagctcgttgtcggaggttgcatcctccgccgtccacagccatgccacgttgggagctcgtcgccggcggccacgccggagctcgtcgcttgcgaccgtgtcctccgccatccacaccccggggtgtgccgcaccgagctcgtgcagcagtcatgctttgagagagatgtggtaatatggtagaatagataaggtagaagaagatagaatcgatggattggttggttgctaacttatcccatccatcatggttgggacgggatcccgtcatatagcacttctgtaaattctgatagagtttttaagagaggaagcttctagaactgcaaaatttagtaaggactctagcgctagcccgggcgtgcttctttccggaccatgcgtgcagcacgacaggtcgacgacagctgcaaattaggcaaattttgttggcttatttccgcattcttcccgttttaatgacctcacacaaactgttcacacaaagatgctcctcgcgaacacagatttccggcccgatctgtacagctacttcatacgtgttgcttgttaaggcggtgaacgtg

SEQ ID NO: 77612 - DNA, 10557 bp, Oryza sativa
  unsure (1)..(10557): unsure at all n locations
gcctatgattgtttgaaaggaatagcatttttttttgaattagagatgacagagaggatagatcataactactgtaggggtactgtatatagataagcagggacattagaggttgagaacacgttcggggatttggaggtgcatgtgcatgcagcagctgcgagatgatcttcctctaaaaataattagaatttggttcctaaatttgtgacctaaaaagaattagaatttggtttgatgcgcatgctgtgctctaaaaagaagaagatttgtgaggattagaatttggttccttgggcatgaattttcacattcatccagtcctgtccaatccaacaaggcaagaagaacaagattctacagctatcacatgtagctagaagtatatttctagctgtaggcgaagagactgaagagcagtgagtggggtgtagagacggaaatttttttttaacacctactactccgtaaaaaaaagatttataggtaggattgattttttttttgacggagagggtaggtgcaatcgcatctagggtgtgaatgtgatgtaaatagttgataaaaaaatatgaaaaaaagatatattgtgataataacgctttgtacacaaacatgcaactacaaattcaatatacatttgaagaaataaaaataacaaattttgtccgtatatattctgccgtgtcaaattctgttatttttatctaaccatgttggtatacactcctagcatcacagtcaacactatatatttttttaaaaagaattgtaagattatttagatacctagcccaggcgtagcaaatccatatccgggaatagactgaagagcacccttgaatccaaatccatatcagcagcacagtaacacaagcgctgtttaggttcctaatgtcgtccagctatgtctcctgtcgccggcatctgaacctctctctgcccttcattgatgcctttgttctcgccggaatgtggtgctgtctccggcgacaagacaacgtgacgagccatgtaaaccgtacttgggcccccttacggcccaacaaaaaaaaatgggccgcaagcggggcggttatgtatcaaatatctacatgaaaaattgttttaaaaaaatcatattaatctattatttaaaataaaatactgtagttgataattaattatatgctaataagttacttcgttttacgtgcgtgagagattagtttccaactcatttgagccaaacacagccttccctttcagacaaaccgttctcatttcggccttatcgaaagataacatgtacatgcctctttattactttcccatcaccttgaacagttaattttttttaattagaaatgttggacaggataaatcatactactacagtagggagtaatgtaggagtatacgttaagaggttgagaagacgtttgggaatttgtaggtgcatgcgcagcagctgagctgcaagattatcttacttatatataaaaaaggaagaagaagattttgagttgatgttcatgcaatccaagaagcaaggcaagaagaacaaaagattttttttcgaacggctaaacaaggttgctctggcgttatattaatggaaggaatttaagtactactacacagcaaccagaaatgagataacttattagcacataattaattaagcattaattattataaaattaaaaaatatatttatttatttatttaaaaaacttttacatataaactttttataaaaacataccatttgatagtttaaaaaacgtgctaacggagaacgaggaatttaacgtttagagttgagaaaaagaactaggccttagacattgttgataaattgtttgagagcaccttcaaatccttgttttttcttattttgcattctattgtgctaacttaccctatataattttacatatataaattgcagttacaaatgtagtaccaaaagtagattgttgtttttaatgttcagatgctagtattttcagcagcagcaaaacagtagtaggttttttcagaagaacttgttgtgcgcattcgtgaaaatctttcgcaacaagaagcacggtatgatgtgggctgatgctttggtggtaggaaatatcataatcctaacttcccttagtattctcttatgaatttgctcttcgcagctcttaaattgtttcttgctagctattactcactaatttcctcggtttctacatatgataaattgaatgggcagagccattgccattgtcttatgatttatagtgtagtctccttaatcaaatggacatgcccactaatgttcttaaaagtatattagcatatttgtgtaatgttgtcaggtgtattttttagcaggtcctcgtcatcctcgtacagtagtgcaacccatcgctgggactctgcctgatggttccccaaatttcagtacggtctgaatgatacacatcccgcaaacttgtatttatctgataattcaaattgtatttacagttttttctccttgcaccatctctttcaccaagccttgtcttctgttgcatttccacctgctttatatttatctgtgcgagtaatttattattctttgtttttgcagttctttgagattgggatcctacggtgagcacctctttcctcagataagtcgtattgtgaacctcgatgtctctcgaccaacacctgctctccgactccgaccaatctgcgctccacggcttcaccctccgtccgattcaaggggacattatgtttactgctcacacggtgagttttctctttggatttcaaatctcattgccattgcttcactcctagtgcacctaatgtcctgtttatttggacttcaaatcccattacactgcttcactcctagtacacctaatgttcggtttatttgacattgccttgcttgactactatgtttaggagattgttgaattacttgtttgacaacacattttgaaaatctgaaattttatgaacattgttaattaatttgtctgacaagacctcttaaaatccagaaaatatattatagaatttgttaatcaattgtaacacattttgagccgaaaaananncctttaaattgggggaagnaattgnntttatnntatttggtatgagaaaacctcttaaagtcccaaatttatagagattgttaattatttgtgtgagaaaatatcttgaaatcccaaaattatatggagacgattagttgtctgagagcaccttgaaatctttctttagacaaggtttaggtcaaacttttatattttttactataaataatttcaaaatatttaatttaaaaacactataaattgactataaaagcgtattcaattcaccaggtttactacctctaatatcataattcttggcgttttggacaatgttgaggtcaaaattttatatttttgactatacactataaattgattataaaagttttgacccagtattgctataaaaatatttgatagcagttctttttttaatgtaattcttttgaattgtaacataagtttatttctgaccttactcaggaaaacaattagattttattactctatgagatatctttaagagggattttaccgcttctgcgcttaaaaaaaatctttgtgctgcaaaagattttctgtgggattgtaaacctcctaagagcgatatggtggtatgttattacgaattaatttagaaccttttaataatggcttaattgatgagggtttttttttatataaaattttatttttgtaataaattatataagtataaatgagctttagtcttggtatatgggtcgacacaaaataaatctaaggaacaatttcttactaattaatctaaggaacaatttcttactaaataaactaggatgtgtagtcatgaaaacttaccaattattatttgggtgactttaatatattacacaacagaggaaaagaataatgataattttgataatagatgacctttttttaatgctattattgatggtctgagcctttctggtagaaattatgcccgggcaaataatttatcattgccaacttataaaaaaaatagatagagtgctaatgtctagtcctttactcttaaatacaaattcatcttctgtttataatagtcataagaattttaagtttaagttaggttggctattaagtcggtctgactgggccctcggtcggtcttaccttatagtcgtaatggcagtatgacacttcgagtacgagtccaattaagacagttattgtgtaagtttctacagtacttcgtcttgaggttttcttttaagtcctatagatcactaagttcgagtacgaatccattaagacagttattgtgtttctacacttcgtcttgaggttttctttcaagtcctatagatcactaagggcgctatggccctgttaaggcaactaatccttttataagagctgttgattcgattaaaaccctgacatacaccaacaaataatcaaatcattcttttacatcacatttaaccatgttattttgtctaccacgctagtccacaggccagaattaagtattattaattaaaactcattagcgtatgattaattaagtattatttataaaaaaactttaaaaaatgcattaatatgatttttcaagcaacttcatataattttttttaaaaaaacacattatttaacaattcagaaagtgcgcacgagaaagtagaaattgaaacggtagttccaaacactagacatgttagaaaaaaaagatgacatattcaggaaaagcgtacgccatattatgtgtagtcacatcacactcaccatccatgaatatagggcccacgtagatactgggatataactatatgagtggaattgaggttggaacagttaagacttaagatgaaataaggtgagaagaatgaacatctagggttaaaagttattttttgatggatgggaaattatttctattcaaatgaaacctatgggatagtatataaattctatcttaaaattattttccattgtttgcattaagtttcttcggttcataagctgcaacctctattttattataatgtttattttttttggtgtgtcaaggagtgaacgacgttagtttttacatatctatatatattcaagtaatctaaatataagaagtaacatataaataaattatctattgctagacaatagataaaatctgtcctttccttcaacagaaattacaaccaattaattatcacaaaattgtttgcgcaaatccaaataaaatgtaactaacataggatggaaaataagacaaatattaactccaccaacaaacaaattattcagatagtaatcctatcagtaaatattcatccaaagttaacgaaaattgatatgaccattgtatccatgattttgcatgcaagaggaatggattacatcttctcgtcacatctttgttgattgggctaaagccgaaattaatatatttccctaaagagcacctgcatataagatttagttggaattttatcaaaccatagagtccagcataaaatagaggttcatattaatataagtttttttttgtttttgtcaatgccaacaagccaactttcaaaaatataggagaaactacctatgtattgctttcatgccaaaggaaaaaaggcagttctgccaagaaattcagaaaaacagtaataagtaaagaatagatgctgcatagtttcctcatgcatacaattaactatatactcccccgtctcaaaatataagtatttttggacctcgacctagtcttcgaaatgctaccttgaccaacagtatctataagaataaaatattttaaataaaaagagttgcatattataatagtttgattaatgataaatctagtaacatcaattttatatgattgatttttttattttttttgctattaatagttaaaattacaaatggttgacttggcactatgctaaacatgcgtatattttgggacggaggggtatatgtttaacagcatattaatgtgatattattggaataggaacggcctgtcggtaccagagtattccattccaatagctaaaccgggataattgtctaaaatagaattgattggtgtacatagaggaccaacaaatttgaccatttcgagataagccagatgtggtggtggcactatataaagaggcaatgactaatgaccaaacaaattcatgacgacatacgcggttagacctgatccatgagttgacgccattacgagcagcatggccagtctcccatatttagtgttttattactgtattaattataatttaatactgctctatggaccatcatcactgtagtactgaaatttctgacgctaccagccaactgaaaaaaaaatccaaacagctactccctccgttttataatataagactttctagtattgcttatagatacacatatatgtctagattcattaatatctatattaatataaacaatgctaaaaagtcttatattgtagaacggatgaggtacgtaggagtagcaaataagacatgagacgcagtgctatatatatatcaacttgtcaagttgatgcatgcccatttaaagtattcacccatgtagagaagaattagaggcacctagctactcacatctagacacataaatactccaaatatattggaggtcacatgttatgttttttgttacatggaagacatatacatatacaaacttaagaaatgcgcgatagcagacgttcaaataaacggagatcatggtaaattctaacctcactaaaattcatattgaaaagtacgtcctactaaacacgcatgcttgtgtatacgaagctagacattgattatctgataagtcgatctctaagttttcaggagcctaatactctacccaaatgatcaaaccaacaaaagttcactaccaaaatatacattcaaaagattgaaagcgtagtaacttctataacaccaaatttattttattagattcaattgaatatattttacagtaaatttattcagtattaaaaatgttactatatttctctataatctagtcaaacttatgaaattttacttcaaacaaaagaaaacaaaacaccttacactatgagtactgaagcagagagtgactcggagagtaccaaaattttgttagtaataaggtgttttgacatgatatacgagaggtggaatggaaatgagtggacaaaatatagagttaccatattttggtagagcaatgaagtttaatcacgatgaggggagggtgacggcgtccatgaactcctcgtcggcgacgagcctccggagcgcgtccggcgcgatgcaaacctcgagcgacatgctcccggcgccgtccgggccctcgaacaccgtcgccttcccgtcgatcttgttcccggcgccgctcctcaccgccaccggccttccccacccgaagtcgttgccgaacacgtcgaaccgcggcgagctccccgtgatcagcgccacgccgccggcatcgccggattgcagcttcgacatgtacgtgaactccggctcccgcacccaccgctccagcgactccctcatgccggcctcgtcgaacgacgccacggcgcggttcagctgccatgccgtccacccgagccccttctcctcgatctcgccggccgtcgcctccgccttcccgaacatcagcgcgttcccgacgtaccccgccgggatgccgttcacgcgcccccggcatcccaccatcaccgtgtagaacgtcacctgctccggcgggagtcgccgggcgcggcacacacctcgccacaggtgggcgagcacggcctggagcgacgagatggttgacgtggccgcgccggacatctcgtcgttcgccttcgccttgagcttccgggcgctcgttgccgagaaggtgaagaagcattcctgcacttccggccgctcgagccgtcggacgatgtgctgcagcttgccgaccggcatggggatcggcaccgggctggtctcgacgaaccaccgccggaacaccggcgccggcgtggagatctctctgatcatcaggtcgtcgctcatggcgccgccagcgcggcggttgatctccgaccatgcgttcatgaacttccagaaggtggtgccgtcgccgacggagtggttcagcgacatgccgacgaacacgccgtcggcgagctcggtgacctgcgtcgacagcacgggccgcgactcggtggcggcgtcggcgccgagcaccaggttgtacgagtagaacgaccatacctccggcggcgtgtaaagcgacgagacgacgtcggacacggccacgccgggcgccgccgcgtggacgaactcggcgccctcgccggtgcaccgcagcgcgacggtgacggtcccgtcgtcggcgcgctcctcggcgacgagacggccggcgaacgggtagaacagcgcgagggcgcgcgcgaaggaggacgcgagggcgtcggcgaggcggtcgccggagagcggcggcttgggcaggaggacgcccttctggatgtagtcgatgctgaggaagcggaggtcccacggcgtgaggtggatgtcgcacggcggcgcgtgaccggacgacgacgacgacgacgacgacgacggccggacgaggcgtcgggacaggacccggacacggtcaacggcgagagctacgttccggtggtcattgcttcccatgtcacgctgctctcttctcttgtaatccgtacgcctctactggacacacaacaccttgagcatatacatatagtggcgctcttgggcatggctccagatccaatttgtttttcttttgcatgaaaatttaaattttaggctccgtttggcacagctctagctcccaactccaacttacctgtagcaggagatatgctaaacagtccaaatcctctgtttttgggagcggagttgacagagctgctacacgaatttgtactacgggggtggagctgggtttttgttgctccacagctccactccaacccaaaagacccactaccctttaaattttttacatatttataaaaaataccactcaactacctctaactcatctctcacctctctctctctccctcccgtcaccctcactctccaatccaacgggctcgacggcagccggcggtcagcacacggttggcggcgaggtcgacggtgggcggcgggtggtgcacggcgggtggcggggtcaacggcgcacggcgggcggcacgtgatgggcggcgtgcggcagtggtgcgcggccggcgtgcggactatggcaggcggcggccagcgttggggacagcgcgcagccggcgtgtggactgtggcaggcggcgcgtggcaggcggcggccagccgcacacgaggacgatgacaacgcagctgctgcggacgttgcgattgaggatttttttttcttttttttaaattttagatctggagcttaaaacctaacaaacacttttcagcaggtctccaactcccttttcagcaggtctccaactcccacagaagccagctccctctggagtggaagtttagagctctgagttggagtttggagccctaccaaactactataatttaacatataaacatcaaatttatcatagatctgagatctagagctctgccaaataggaccagtgtattttatggttgggctcctattttgagattctagtatttgaggagctaaagatcccagcaatcagaccctactataatatttttgaaatgcagaattaaaattgtatgaaatcgaacatagttataaggacaattccaatctagaaaatattaaagtagtttccatactcaccatatcatatagatactatatatatagaaattatgtacctatagttggttgtttttttcaaaaaaaaaaattcttatctaatcacctctcgtctctctcatttcatccacctattccatcgtttccattcttggttcctacgtagagtcggtttttatatgagaaatgattttttttcatctttttctttctcttcttattaactcttttatcacatcggtttttttcctacatgacatcatatttaatgctatagaaactaactgaggtggatggttggtactgctttaaaagttagatttgatatgctatcaatcaccctaatttgactatatctttaggatactccaatatcatatataattaatagttgaatattagtgttggatctcaatccagaggatctcttccatcccttgactatcttccttctcccaaaccctgtgtattatattgatggttccaccttgccatacgctatatttgtccctacaactctacctacttgcatacatcattctctcccatgcaaccggagatatatgagggtaagaaacaggccatttcgaggcttgatgctactcttaggaatattattgatacatcgcccttcaagcatctcgtagttgagaggtactgccatcaacagtgttgagcatggataggcgggagtcgaactcgctagtcactcttttcatgttagttagga

SEQ ID NO: 77613 - DNA, 738 bp, Oryza sativa
acgacatggaagaatggaagagagacctaatttttgttagcccaattatacccctgttaaatcaacggttagattagattggtacctcatgttacctcgtacctcatggtacttccttaaggatgggaaagatgctctaaacctatttctatctctctagtttattttgtgagagcgttttatccagctccattcctattttggatgagctgaaactatttagctgacctccaactctaagagatgcttttatttggcgtaaattgagcgttgtaagttattggctagtcagtttcaaaataataacaaaaaattattggctagtgaaaaccaacaactgcgaagttcagacaagaacaaggtggataatataacgggatcgacatgttgtgtacttgtgtggtagtgagctcctctagtcatgcaagcaggatagacccgcgagctgctacacttgtcctcatttaccaacacacaagctctcccttgtcttaactgttctccaaacaaataagtacttccaagaatttttcgttcgaaagattcagccttggtgcaattcaccttttctttggtgcgataaaatggaggccgccatcaccatggatgagaacttgggacgaagtgggtcatttcgagctgcgatgagcatctttggcgaaagcatcaacgggaggaaggcagacaagaacagaggaactgttccagcccaagaggtagtgtctgaattcacacgct

SEQ ID NO: 77614 - DNA, 13104 bp, Oryza sativa
tagttgctatcacggacattgatgataacaatgtaagctttctgataaacaagagatcaaacaagctgctcgcaatcggattgtagtggaaggagaatgcttccgttcattgtaagatgtagatgcaacaaaaaactagtgtttgttagctgtaaagccttggaatttactgggattaggctgacaacattgccagcgcgatattgttttcctgtcctatttgtttggatgcaaaaggtcatgtaattcatgtaaagcagcttgggaattgcttgatttgaaggtcacattgtaatctgtaaacaagaattgacctgctgtaatatgattattgttgtcctcttattccatgacatattttcagggaacaaatccaagtttcaaggagaacttgcagtggcggtataacttctatttgactgtataattcatctaaaaagctataaaacggcataccgtcaggacggtacaagttatgcacgatatcaaaccgtccaacccagcatcgcgataaactacccatctctcctcccgcatgggtcccatgagacccacggattaactctctgcgcatgcagtactagtatagtagtactacgtactatactactgactgccatatactactgcatgcactagtagtactggaggatacccatctctcctcccgcatgggtcccacgagacccacggattaactctctgcgcatgcagtactagtatagtagtactacgtactatactactgactgccatatactactgcatgcactagtagtactggaggaggagtacatgcactactagtctactattgtcgatgtctgacggtctaatactactcctgccttgatgatgccatatgcatcaaatcgaagttaaaattgccagtgcccatgagcaagagaaaatgacttgattctctattgctatatgtgatcctatgtgacctgatgatgaacggtcctgtttcaaggtaaaatagcgtgagtatatgagtcttatatatctaggtatcatgtctggtacctacatatatcacgaccgatatttgggtatcatttatggtacttataagtatcagacttggtaactacatgtatcatgaccggtacctaggtaccatgtctagtacatatatataagtatgagatctggtacctacatgtatcatgtctggtacctacatgtatcacgactgatacctgggtataatgtacggttcttataagtatcagacttggtaactacatgtatcacgaccggtacctggtatcatgtctagtacatatataagtatcagatctggtacctacatgtatcatgtctggtacctacatgtattacgactgatacctgggtataatgtacggtacttaaaagtatcagacttggtaactacatgtatcacgaccggtacctaggtatcatgtctagtacatataagtatcagacccggtacctatgggtatcaacctaatacatatatgtatcatgcttagtaccacaaatactagagctaataggtatcatacgtgataccttggtatcatactaggtatatgttaaaactgagacccacatataccggctgatatgtgcttggtttgctacccacatgtatcatgatagatgctttacgatactttcgaggtactattatagatagtcatattttgacatgtaaaaaatagtataataatataagatactgaggtaccagcccaaccactgagtatagctacaataacaacatcatgtcgtatagctaagcacgcaattatagaggagtttgtagttatgtgtgaccaaaaggataggcattcataatctatgggtgcatgagtgagaagcacttgtcatgtcatgcatggcagatgcacagagtagtagtaattagctagtgtttgtgaattgcttccccaaaagaagtatacagtaatcacgaccagcactagcacatgcacgcaacctgatgcgcgcccgccatcgcattagggttgaggtgtccgactaatgattatgtcgttccaacggtaagtggcacatgtgcccagtgttccaaaatgctttttaaataaattgagtatcaaggttcaagtttggacttgttcgcaaagattatgagttttagaatctttacctcgaatagctatgcataagctttgatattttcattcttgatgttatgactaacttcaatgccttgcaaaatttggttaacatcatgttttagcctgaggatctttagataccttagttatccatgatttgcttgggttcttatatcttagtatcatttttatcctttgcatttaagtatgcctacctcctttacttgacatggctagctatgttctgtatgcttcaaactcagtatggttaattttgtaagttcaagctaacttcaagctaatctacatgatgttaaagttcactaaatgtatgccatgagacttatcacattcatctgactagtttttgtttaccacattgcttcttcctggttctcgaaacttattgttcatttacttgaggacaagcaaatgtttaagcatgggggtatgatacaatcaaattttgcatcattaatctcatgatcttcctcttgttttgctattgtgatgggctaaaattaatcctaatgcatatttcagacattatttgtggtacaatatgtcccttttatatggtttcatacattatttaacttttctacagaatggcgcgatgaggcgcgtaatctgctattttggtctccaacggcaaacaaatgtcagtttttgtgtggcaagacaaaagaagtcaagtgaagcaaggacctaaacataatttctggggagatgaaggttgaaagtgccaaagagcgaaccaaatcgatggggattaaaatccctagaaatgctactgtacaactgggcctggcattttctttctccccttctcttcttcctcgccatctcctcccttctccttcttccccatcccatctatagctccggcaccagcgagggccaggcctaacctcgtcggcagccaccatctccagctactccacatcccctcccaccagaaagttgctccaattcgcctgaaaacgtcatatacatcctcctgcagctcttccaaatcgaccgggacagtggagacaacctaatctgctactgctactgttcttcctctactacttccttgacaactgatctgtaacctgttgctgctgcatcctcttcttccccttcttctttttccttcttactgcacgatttctatcttcttcctcctacttgtactgtttcagatttgttaagaatttaatatttggagcttgtaatttctgtcagtgctagtcaaatgcatgaatctctggttatgatatatgagagtattaagatcctgcgatagttaatttcttcttcatcctgtttaatttcttccgagttctcctgttgtttatttctattttttttctttgttctcaattgttgtttgacctagctttagctaaacactagtagccatggcctagtccctgtggataacacgacactcgccactactcggtggcatccgtgcgcttgcggggtgcgtagcacaatcaagatcaaatttttatgagaactgctagatcacggtatcccgtgtaacgggatagattataatgagttaatgacgagacgttgcccccaccaaccatgcgcatgtgtccccacgcgtttgtatctcttcctcccacacgtacgcatcgctctcccatacccttcacatgtttgttgcgctcccccacgcatccatgcgctcgtattgagtacctacacaacttttaggtatcagatccgatagttgatacctgaggtaccatatctggttgttacccgtattagatctaatacttgatacctgttgacagaaaacacgaggcctgggagatctgcttaactccagtgcaggtccaaaactcgcctttgggtgtatgagcgtgccagttgatttgatcctgcaatcaacaagaaatagaacaaaaaaaccgcaattaatcctataaatgatagccgatcggctaggtgccgatggcatatcatttatttcaagccgatgtcatgcgtacatcgatcggcaaatatcaataagcaaatcagaactaaatctacttgatcggctgtaaatattaatgatatataatccttatatcgatatatacttaaatcaagtgattgggatagatcggtcgccttgccgagacagtataaatcacttaaatcgaaatataaattaataatgggattatatacatttatagtatagccgatcaagtgaatctagcatgtatcggctaatactccgatatcactctatattaagatgttaaagcaagtagaatatactaaacataagcttaatatacttagatgcgacaagatcttaacataaagggcagatttaacatgtcaatccagcatatagaataaaagtagctaaatcagataagatcggctgaaactccgatactaccctaatcagcaaccagaaagcaggctagagattgcaattctaagcacgacttaatagatcaaactcaactgatgcagcattaagtatgaaaagaaaaacaatatctagacaatcaagccgctggaagtttcatagagtggtagatatatcacatgatctaagttaacatcattgtctaacctaatcggctgccttccattaacagatgttagctgattataggttaaataaagatattatcgaaaattatgtgagatatatgataactcgacaaattgtatagacaagattagagtatcataaagatggaagcactaatcctgagaacataagtcgtcatgacaagttttacctcttgttgaagatcgaaaccgatgcagctcaacccgagagcacgaactcgtcgaaataaaagtaaagcaaaaagggtggcgatgcgcctagattgtattggatgtcgtccattaacatagaccccgggtgtacatatttatacccatgggttgatacaagtccttgtcggacaagaaagaaactttcctaaagataaaaggaaaagataaagtccttataggacactaaacacactttcctaaagataaaaggaaactgacgaactagtcctaactaataaatacaattgccttcccaggactatccttgcgtggcaaccatcttgaagcacatcaacttgaacccgatgacgtacaccgagtcatattatcggaatcggctgtatcggctagccccgtccgactcgaactctgccgacctgaccttagctgatttggactgcagccgattcttactctgtttccgcagcgatctacatcttggattccacttcgatctgatcctcacctccgatgccaatagtgatagaatttaccaaatttggtcgttaacacatgcccctaagtccggaatattggataatgtttcggatttgccatataccgactctgagagaaacccgcacttgctgttttcccgtccgttatcgctctactttaaatactaatcgttgccccaaagaatcttcacgccgtgattttcgttttcaccgcttaaacagatcctgtcctctctctctccggcgacctcctcaacacgcagggcgatttccaggcgattcaactcccggccagatcttcacccacgacgatgtcgacctccaccaatccgaccgccgcatcatcagccgaatatgctgaggtaagtccccatcggctagatccccttttccgttcatcagaccagttttcgctcaccttatcttgttttcttcttctctattcttgtagcatctttccaatcttgttgcggttcccagtctgttgcatgaccaacaatactttctcggtccaatcggcaatctagaccccactgagtttatcatagccgaaaccaacagaatcccttttaggtcggccaatccaaacacaagccattggaaaaacaccttcaaatcctggccttctctggagaaaagttggcctgtatggtataagcggatatcagccagcaaacaagccctagccctcacagtagcaaattcggccaaagatgaacccctgatggctactgcaacttatttctggtccaacactctcaatgcttttcttttcaaccaagggccgatgaccccaacgctgctggatattatcatgcttactggcctagatgtaacctcatcagctaaccccatgaacctgaacaccaagaacacttttgagttcaaaactaagagcattgggggttggtcaggatatatcacagcatatatgggcaaagggccagtaactcctagagagcacgtagcttttttgctgatgtggttggaaaaattccttttctgcggatcaagctgcggtcctacaaccaactggcaattcttagccgaggccctagtaacgaagaaacaatttcccttaggcaaaatccttctcggctatctataccagatattaaacaacgcatcggccaagataattatcggctcagtggttggaacaggtggaccatggtggctcttgcaatcctggctgaacctggtagtcatgaaagttgtcaatcggccatctgtgacagaagctgaatttccaaggttggagccgattgtggaagatgatggagaagaacgcacccatcgcagatgtatgtcatatggagaatatgtatctacaccagccgatgcaggaacaaagttatcggctgaacttctgaaggactggttcttcagcttttatgacggattccaaaaagatgcccgagtttggttcttctatgccgactcaatggatttcgaactgccagccgatttcaggttcgaggatattaatcatgaaaagtttcagcaatccagagaaatctttactactgctatcagcccatgtatccttccagtcggcatccatcaagggagaaatatccaagtctcctatgagttttatcatccgatgtcatcggccagacaacttgaaatgggacaacttgaaatgggagaaatatccaagtccttatagtacactaaacacactttcctaaagataaaaggaaactgacaaactagtcctaactaatagatacaattgccttcccaggactctatccctgcgtggcaaccatcttgaagcacatcaacttgaacccgatgacgtacaccgagtcatattatcggaatcggctgtatcggctagccccgtccgactcgaactctgccgacctgaccttagccgatttgaactgcagccgattcttactatgtttccgcagcgatcttcatcttggattccacttcgatctgatcctcacctccgatgccaatagtgatagaatttaccaaatttggtcgttaacaatacctgaagttccagatctggttggtacccgtatcagaggtaccagatctggttggtacccgtatcttgatacatgaggtatcagatctggttagtacctgtaacggatctagtatcataggtatcagatccgatacttgggatactagattcaaacttgaggtatcagacctggtacccatggtactatggttggtggtacctagtctggtatcggtacttgatatctgaggtaccagatccggttgatacccaaggtatcagtttggtaccataggtatcagatccgatacttaggatattagattcgatatttatggtatcagacctggtacccatggtactaaggttgatggtacctggtctggtatccacgaggtgtcaagaccagtagttgcatattaggcttggtaccaacaaaaaaaaaagtatcaagcctggtacccagaggtatcatttgtaccaaacaagtcatcttcttcctctctccaacacactatatcctcatccatgtgttgattccttagcatgaaatcgaagcaacatcaacaacaagaacaaaaaaaatagagatgagattgtgagtagatgcaggcgacgaactactagaaaagccatatcctcatattctcccttcttcctgtggacatctagcctcatacaggctctgcaattgttgcactcatgtcggcttgctggggacgtcgccgatggccggctcagatggcgttgcggtcgatgcggcgagaaaacggctcccggtggccagcggctagtggtcgtgggcgtagagagggggacagaggatggagggagtagcttgcgcgcggtgggtggtggacgacgctgcataaacgagccaagatgaggtgtggggcgttgattattagtctatcccgttcgaacggtatgccgttctatagattttctattcatctaatcatccatattccgaccaatcacttgatggtacctcagtccgtccaatatctttattccctttttcttagaggattttactctacttttgcataggttaaaggaaccagattgacccatatggcaatcatggattgataatttgtatttttttttcctattcccctcttgtaaagtctcttgtacataaactatatgagcctcttctactgtttttccattaaaaaaatcctaaagaggtcaaggaagaaaagaacacgtgtttaatgattcaaatggtagaaaaccaaagaggttagagttccacaataatttggctattcttacacattggtggatccaaaggctggtccccggaccacccaaatatttgccggtccaaaggcccaaatagcatgcatatatgatagtaagaaaaaaaaaaccccctgaatcccagctgttaaatcgtgaaacagaaaagccgcgtcattgcttccgctccctctccacagcccgcctcacgtgatctcgaattctcgatcaaccgtagcagcgtgcgactgacgagtgcttagctaggttaggactcctgatcagctgtttccttcccgacgacgacgtccggcgatccagcggtgacgacgccacggaggatcgcggcaaattgccaatcgatggcaagccagcaagggtagcgcgtgtgtgggtgccgcgaccggcggcagcggtggcggcgagccgacgacgatggacgaaaatcctgcaagatgcgtcacctacacgggcagacggccggcggcggacaacatatcacggcaagcagctaagcaaagcaagggagctaggtcgagatctagaagcaagcaaaggatagccgatggaaatctgtaagtaagcaaagcaagaatagatgattaacagcttattgattattttgttagccgattaactactctaaagttagtaatcttttttcagcttttagttgacccttctcatattatactattgtattacagattgttgaaagtatggcaatcttctccaaacttgtgtagcatatctatttctttaactcaaatttcttatataattattgattttaaggtgtttgtaagatactttattaatatatcatgatcaacttttgactaattttgttaattatacttggattgtatatattagcattgttactttacggtgtttcaaaataattgaagtcgggtcacccatatccaaaattctagatacgccattgtaatcttatatgagggatctgtcagcatcgcacacggtaggagtagtagagagatattgaaccgacttgggctgttaccctctgcccatgtggtgtaattaagaaaaaaggtacaccgaaggtcccttaacttatcatcgagttacaaaatcgtcctccaaccgcaaaaccggatacaacgcatcccccaacttataaaactggtgcaaaccagatcccttagcggttttgtctgatgtggcggctgagtcatggtgggacccacgtgggccccacatgtcaggatgccacatcagcagaccggcctctccccttcctctcctttcctcctctctctctcactcctctctggactctgtgcagggccggccggcggtggggaggaggtcgccggcgcaaggaggtccgacggccaaccggcgacgcggcgatggaggcacgggagaaagggagggcggcgacagggcgaggcggtgtccgcggatgcggcggcggagaggcggcggcggctacgacacggggcgaggaagtccgacggtcgggcggcgacgctgcggtggcgcgctcgtagtagtcgtgctcggcgcccatgagcccgccccaccgctccaagtccctgacggcgaagccgctgccgtccgccgccgtgagctccacgctgatcgccgcgtccgtgccggccttccagatccacccggtccccatgtagtacagcatgtacacgcacttgttcttgtcgttgtccccgccgtcaaccagctgtccacggcgcggcagcgccgccacgccgcccggcgatctcgatccggcggcctgcacgcgcgtatgcaattaacatgatcagatcaactcacaggtcacagcagagcagagagacgatcagaaaagaaaatgcatgtaccaagaccaccacggaaacgagcgaggcgaagtgcaagaatctgtcagcagccattgtcaaaggcttgaagaactccctctattccagagcagatcacaagcaggtgacaatcatgtaatgcacaaggagagagagtatgggaagtaaagtcaaacaaacgagtactacatgatgagcatttttagatggatttaggacttcacgagttgtctaaaaaactgataaatcaggtacgttcgcctcctccagctccgcgtatgtgaacctcgccggcaacccggggatgaggacctcgtcgccgtcgccgtcgtcttacttcgcgctgctggtcctcgctcacatacgacgcctgctgcgacgacagcatcggcaacttgaaccagctgcggttgccgcctagctgtggccatggcgccgccgctcgcccgccgacgccgtgtcgccgccgccgcatcgccggccggccgtcggacctcctcgccctgcgtcgcagccgaagccgcctcgccctaccgccgccctcccctttcacctgtgtctccgccgccgcgtcgccggccgaccgtcggacttcctcgccccgtgtcgtagctgccgccgcctctccgccgccgcatccgcggacaccgcctcgccctgccgccgccctccctttctcccgtgcctccattgccgcgtcgccggccggccgtcggacgagtcctgagaggagtgagagagagagagagaggaggaaaggagaggaaggggagaggccggtctgctgatgtggcatcctgacatgtggggcctacgtaggtcctacgatgactcagccgccacgtcagacaaaaccggggtcaaaaccgctaagagacctgatttgcactggttttgtaagttggtgcggttggaggacgattttgtaactcgatgataagttgagggaccttcggtgtactttttcctgtaatcaaacacgcttcctcactttatgaaaggggcggatgtatattagtatcattggtctcagatgacacagatgccatccaaccaatccagtgtattgctagcatttatacacacttaccccgacagtgcaagcttgttgaccccaaccgctaaattgcagctgctcagaggctaaacaatatagctccatctttgaaaacttaaacagtttaactggtgtggtaggtgttggagcctgaatctattttccaacatccttcctatttcacattataagatcttttagattttgaatagattcattcatacatccatatgtgctacatatatatgtttaacttcatatgtatgttagaaaatttagacaagagataaaaataccataacgtttataacatgaaacggagggactatatgttttggtaccgtcagccaccactaatgtcacagtttaaaatatttgatccgttgactataattatttcttttagctaatgtttctatccatgtaattaggccaataattctattatcaactattaaaagttaaccatatttttacgtattagtgaaaacaacttgaataacttgttgtctgaccaaaagaataaaggatttgtatttcttattactcttaagagttagtctgaaataaacatgctcattgaaacaacagcaatattctaccggctctagctaaaaataacagttcaaggacaccttagcttacaaaatatttagaaatgaagcccttccaaacactatataagtataagtgagtgctgacattggtgccctaaaatcctagatcagcaagggagtccaagtcaagatggaggtccacatcaagtcgatttcgagtacgtttcagagtccaggaccaatctacactaaaacgggtgtccaggtcgcatatgtgctcggattggagcgttctttatatggatggaaagttaagaagataaccttttcaatggttctggtcccatatccaaattcttttcgagtcattgggaatcgaccgaacaagttgatgttcagaatctattccgatgctgcgtcgccgtattttggtctttgggccgtgtatcgtgttggagctcgttaggattgcgtcgtcaagggttatttgcacgaccctaaactctatatattagtagttgtcaccacctttagggtttgggttttgcttagattaatctgtcaagaacagtttcgccaaccttcggtttgtaaaaccccaacttgtgagcttaatcattcatgcacaatttggttgtattctttcttgttcttgtttgtgtgttcctcaattcacaaacagagattagccttatcggcgaggtcaactggttttcgacacggttgataatcagaggagacatggtgctgtgactgcggggctcaagagcgtgtttgtttagaagccggatcgatttgtgtcgcgactccaccaaattgactgtttatcagaacctctcgaaagatcggaaacccttgtccacatcactttatgaggatgcatgataagcatatagaaaaattctaacagaaagattaaaaaaaatgagaatttccaaaaataccgtgaacactattactaaaactaggaactaggaaggtaacccgtgcaaatgcgcgggcgctttatttaatgttgcttgaaatttttattacgaatggttatatgtggttga

SEQ ID NO: 77615 - DNA, 630 bp, Oryza sativa
tatctgaggtctgtcatcatatccgatccaacaaatcgatggaatggttctattatgttcagtattccatctactacgactagaagaatcagcacaatccagtcatacatgtgtaggcgagcaattttggatccatgagatgttatgtacggagttggaactcccagatggatggatgccgatggtgccggcatatcgtacgtactgacttgaattcccagattaggttaagcaatccaattcgcaagataaatcagatggatgttttgcctgtccatcaaaagaagtacagaaatcatactcagaaccttgaattcgtgctatttaacaatagttgtacttgtccctagaactctaagaactagccatgcatccaggatagccgaacctcagcatcatcagtaattagcatcaacacagcaatacggttttcttctgaaacggacatgagagatgggacaccgaaccttacacgaagcgttcacgacggaaagaacggccgccttggcttgcgcccggacaaatctctcgtcgtctcccttctggcttctcttccacttctccttttccccggacaccatgcgatacgattcacaattgagatatccttccgtgcgggggatgaaaaag

SEQ ID NO: 77616 - DNA, 11807 bp, Oryza sativa
  unsure (1)..(11807): unsure at all n locations
taaaatagatagatagatagatatagttggtgtgtttgaccctagacagggtggtagtgtgcacgcaggacgcatcagctggcggcgatggtggcatggggttgctaagctaatttgaccgctgaaagtgatggaaagcaagcaagcaagtcagagttgccatctccaatcggtctccttatccccatttttctctctgtgctgtactacagtggagtaccacgactgtgtatgtgacagcttagctaactcaatgattaaaatctcgccagatccctcctgcgttatcaatccactgagaagtaagcgaacgagatcgcctgggccggctcgtcggagaaggctcacacgcgacgcgcgccatggcagctgcaaccgcagctgatgttgccgaggatacggccagtgtgtactccggcaagcttaccctctacgtcttcctcacctgcggcgtcgcggcgaccggcggcctcatcatcggctatgacatcggcatctctggtaaacatgcgatttatctcatctatcttttagtatatatgtactggttagagggaattatacgcatggtgacttgtagtgggagaaaaaagcataggagaaaagagcagtgctagcctttgcttatacagacttcatgcaaaaactcttaagataatcatttggaccttctatatctatgctatttctaaaagacattctaccaccaccaccactgatacgtggaccatggtgttcgtataagttgagtgcttggtcaatgtttgtctcattgtctgtacttttgtggagtagctgtgtgctttttactctttatagctagtcttgcattactctgtgagctgcaagtctttatttttctattaatttacttcttgccatcctaattaaaagacctcacaatttaatttaggtttccattaataggcaacacaatttattgacgagtacatattttaacatcatatcaaatgacatcttgttaacatgattggagtcattgatctatactgaaaactaataatgacatttatccttttgtttgttaagaccaacaaattaatactttcaacagggataccttttgctattttgaataaatcgttgcaaagcacggatatttggctagttcctactgaatatatctgttgataacttgatatcgatgatcagcatgtctacacttctttatgtggttaaaccttcgaggtaaactcaggtcggctgatccggagactctagccggttgagtagttcagaattgctcctgatcgaaaactgttcaattgctttcgaaagatgaccatttcttgaagttggtgtttacagtacaaattacctacatttacacatcccttaaactataaatttgaaaaagtatactatgattacattgttaattttaaaaattaagctatgttttctctaatacacaatatataagagattaattaactaatttagaagagaagattggcttgatacaaacatacttacatatatataaagaaaagactgaaatcaattaagtaataaaagtggtgccaaattttagcaaaactagctagtataatgagtgtcgacattcaggtggtgtgacatcgatggacacgttcctggggaagttcttcccgtcggttctccaccaagaacagacggcgcagggcacaagccagtactgcaagttcaacagccagccgctgaccgcgttcacctcgtcgctgtacctcgcggcgctcgtggcctccttcttcgtcgcgtccttcacgcgcgcgctgggcaggaagtggtccatgttcggcggcggcgtctccttcctcgccggtgccaccctcaacggcgccgcgcggaacgtcgccatgctcatcgtcggccgcatcctcctcggcatcggcgtcgccttctgtggtctggtaagtcgttggagaaatcaaattagacacacattggcagcatcaacacaacacattttgacagatcgttcttgaatgtgtagtccactccgatatacttgtctgagatggcgccaccgcggctgcgtggcatgctcaacatcggcctccagctgatgatcaccgtgggcatcttctccgccaatctcgtcaactacggtgcggccaagatcaggggtggctgggggtggcgtgtcagcctcggcctcgctgccgccccggcatgcgtcatcgccgtgggctcgctcttcctcccggactcaccgagctccctcatcaaccgtggccgccacgagcaggcgcggcgggtgctgcggcgcatccgtggcaccgacgaggtggacgacgagtacggcgacctcgtcgcagcagccagcgagatcgaggtgtattccggctgctccgcgagacgacggccgtggcgcgacgtcctgcagcgcaggtaccggccgcagctcgccatggccgtcctcatccccttcttcnnnnnnnnnnnnnnnnnnnnnnnnnnnnnnnnnnnnnnnnncgtgctgttcaagaccatcggcctcggaggagacgcgtcgctcatgtcggcggtcatcaccgggctggtcaatatcgttgccacgttcgtgtccatcgccaccgtcgacagccttggccgacgcaagctcttgttccagggaggctgccagatgcttgtgagccaggtacacacaaatatatatagaagctgatatatatacacctatgacctactccctctctgttcatattattagtcacttttttcctagttaaatttagtcaaactttgattaaatttatagaaaaaattagcaacattttaaacaccagagtagtttcatcgaatctagcattgaatatattctgataatatatttgttttgtgataaaagtgcttctatatttttctaacataaagaagtttggctagaaaaaaagtcaagacatatcgagtgcctgcaaaaaaaaaaaaatgtatgcatgcatgcttatgatcgattcctacaggttatcattggaacgctgatcggtgtggtgtttggtacgagtggcgatggcaacatctcgagggcgttggcggtctgcatcgtggtgttcatctgcgtctacgtcgccggcttcgcttggtcgtggggcccgcttggcgtcctcctgccgagcgagatcttcccgctggaggtccggccggcggggcagagcatcagcgtggccgtgaacatgctctgcacgttcgccgtcgcggaggccttcctcccgatgctctgccacatgaggttcggcctcttctacttctttagcggatgggtgctcgtgatgacgctcttcgtctcggccttcctgcctgagaccaagggcgtgccgatcgagaagatgaccgtcgtgtggagaacgcactggttttggggtagattttactgtaaccaggatgcagatgcacacgttcaagtggcaaacagcaaagtttgaaatgcacaatgccactgctgtctgattttatacagatgtagcaaatgtgagatgcgtattttgggactggttaatttgctgctgatatccagcatgcgcatctcgaagtagcgcggagcaaagttcaaatatccataggaatctcaaagcaatggttttgtttatcgacgtttttaggaaagctcacaccccactggtaataggaaaaaagaccaattaatggtgttatgcgatcatagggggtgagcgcgtatatatatatgaacgcttacgtccgtactgtatttcgaacacaaaaagacaaatggaatggcgtgaaattaaattctgaatcagctaggaactgccggaaagataacaggcataatatgatagcctagttaaaccaaaatgtatggatgggtttgtcgcgcgattcctgtagttgttaaggattgcaagaatgaatttctgaatataaacacaatgtcgtaaatataaaaagccagaattgtatttccctaatacaattaattgtttgaagcaacaatgggaaatagatatagatattatatatagattgatggtcacattaacttcaatgaaaatttataacacaaatatgatgcttagcgctactgatcgatgttccttttgtatctgaaattccataaactcaccaaatgggggaggaccagaggaggaaaaatcatcgaataataagacagaccgagactcaagaatataatctatgagtgataaaggatgccggagctgtagagtctatgagaaccaataatctaaatcttaccagtgggtatgtaccatgcttgttgggcacggccatatatagcttcattatttgtttttgtttttgtttttgttttttttttttgcctgtgggcacgcctcaaccaagctcgaatcccagcaggcgtggcgtttgcattatgcctgtggataacacatgccttttgctcatccctgtatcttgtcccatttgtcccatctaatcatttttttagatataatagaatagaatatcttgacttttgctcaacgagttacagccaattattacaacatataattacataatgtaattatcatgacatgacatgatatgcggtatatatacttgacatggaatgtaaccctaaatcaattcccgttctattttctatccactcactcctctccatgccaccgtggcggcgctcatcatgtaaactagatgattccccgcgctttactgcgaaaattcctaagtaacttttaatatatttttaataatcgagctaaaagtaaaaaagtatattagttattaataacaaataaaactgggttgtcaaactatgttaagaaagaaatacatttagtagaccttgtatgagattatatatgaaatatgatatcccgcactttgattataggggcaattgtatatttgacaagctaactaccaatttgatcctatttttttaagtttgcttttttgaccctactttttaactatggacatcagacatgaccccatttcgtgaaaccaatttgacggtgttaatttgaggtcgaaataccgtttatacccttgctcatttgaccctgttatcttagagtttttgtatatttaacctaattttatacacttggtgtacatgatgcaatttctaaaaaatttcacttggaattgatatgttgtgtgtgaatttgaattagatttgaattttagccaaaaaaatacaattgggaatacaaatcagatcgccacacaaatggatctagaacaatatgacagcattgattcaaatccattttcaatacaatgcctttaccactgattgttaacagaggcttctcagaagaagaagaacaaaaagttgtttcgaaaaattcgagtaccggccacacttcagtatccatagacatagatagtatcaacatgcaaagaaatccttgccaagaacatcatccaacaataacatttcaacaaaaatttcctcaagtctggcaccggcgcatccagacaccgccgccgctccctccacgtcccaccgccgccgccgtcgtcactccctccaccgcaagccggcgccgatgtggatccatgcccctccgctgccgccaccgctccctccacgagtcggcaccgacgcggatccgtgcaccaccgtgtcccgccgccgccactccttcccttgacgagccagaaccggcgcggatccgtgcccctctgccgccgccgccgctccctccctccacgagctggagctggcgcggatccgcgcccctccaccgccgccgccgctccattgacgagccggcaccggtgcggatccgcttcctctgccgccgtcgccgccactccttcccccacgagccggcgccggtgcgaatccgcgcctctccgccgccaccgttggtcccttccgtgtgccgccgttgtcgcccctcctcctcgtcgtcggccgccgccaccgctcctcctcttcatcaagctgccgccatctctcccatgccgccgccgctcctccacctcgtcgggccattgccgacactcctcttcatgtagccaccgccgcgcggctgccgttgcacgaggagggcggcgggaggaggtagggagaggataaggatttccagtctggtgagagagaggagagggagaggataagggaaatgtttatgtgtgcaagggtattttggtcacttgtggctcaaaaaacattttttttctattttataaatgaaaccctaacggtgtcaaaaatgaaaccaaggtcagacggcaactccaattttgaaaagtagggtcaaataagcaaactgtaaaaagtagagtcaaattagtagttatgcttcaaaacatggtcaaaggagcaattgtcatggatatatgttaaggattaaaaaaatgatggatatatatattttaaaaatattgtgaaaaataatgtgaaggaaaatgatttgtagaattcaatgaattctagatgatgttgcatacttgtataagttttgcatgttattattgctaatggatgatgaagtgacatgtttgcattttgagctttagaattagtgagttataactttatagtaagataggatatttacctcttaattgttaaatgcctgtgctgcatgagtatatgaacatccaaccacatcaaacttttgattgaatttttagtgaaaaacaaagaaaacgagtaataactattattagatgattcaggtcacaatggtcttggcttgattcagcacatatataagatagaaagtgtcatgtaaagtatagtcacgcagaggggaaattaaaacacaaagaaaatagcatacaaaaatcttgcgtcgaattaatccaagtttgcagaatcagcagaagatccagtgccgatgaccccaggcggccaccagtgcttgccgacgaatcacaccactaagatgcataacttgttttcccaatggttactgacgtctaaaattgtttgtacacatgttttacccaagctctctagaaaatttctaaatcacccgttggttcagatgataacaaggagaagaaatgaaacttctgaacccaaattatattgtttagcccagattgttctccattagttttaattgttaacttatataatatgaatacccagaaaacattataatcatgcattaagtgatcataagtttttactgatctgcacgtttgtagctggaggcacactttgttttagtcagcacgagtccgagtcccatggaatggaccgattgtgtgggatcgatgaagcacaatgtacgggtggttcatggcgcacatgtaggtggcatcgaaagactactatttttagtcgttcctttttttcttcttaaatagagaagcgctgcaaagtttggtggcacaaatcgttcgttttgctttttctctccgctttcatcttctaggagttcatccaggtgttcaggtgtgttagattggcttggagtggtgacaactggtagcagagcaatgtcatctccacttgccggttgttcctggtatgtcgagggatactggtgctgacattgctctgataccaattgtcggcactctaggccaatcatacacacttgactaccgagacgaatacttggaagactaaggcggaaaggaaaaacaaaacgataataagaaaatgctgcaaagttggatgcatagacaatgcatcaacaacatcacactcaatggggtgcggcaagagatgtagttgccggtgcacttcctcctcatgtttagctgcatcaggcatgcaaagattgtacagccacaaaaaaaaaaccttgatggttggagtatatggtgatgtgggacatcgtcttcgatgagggagctcggagggactaaatctcggaacctaattgaggtatgccaaacagtacctcgtgcatgtagacgaagtgtttcttgtatcactaggtgtaggtagcttagcctattcatgtcatccttgattagtttgtcttatccctgaacttctccctcacctccgtttgggctttctgcatgacttgtggatatttctcattagctcagatattgcccactaacgtgtcgttgagctgtctcgctccctgctgaaaatatttcctgagattaataggcaatttgtaatggtgactttgccaaatggtcattttcaattgtaattctgaaaacgataatgctgaaaatgcagtacagtgctgtgaatttccagagtgatttttttttctgtaagtgtcgtgagttcgtaaattgtccatgttgaaaaatgtttcggccggcctaccgcagcgcgcgaacgctccggctgcaacgctcggccggcctaccgcagcgcgccgctgagccagctcgctggcgacgacgatgggtacaggtcggccaagttgaacccgcccgcgagcctgacggagacctcgagcttgtacgtggaggaactcgtcgcgccgcgcgcaccggctcccgatggcggggcgcacgacggagtcgttcaccatgcgcgagatcttctcgctgatggggaccacggcgccggcgccacccggtgcgcactcgccgaccactgcgtggactaggtaccccgcctgctagtcctaacggacgtggcgaggcgactggacgcggcgcgctaaagagctcgagtaggcagatgtatagatggtcatatggcccgaggcctgatggcccgtccaaggtccggtgattttggcctggggcaggcatggcacggcctgacttgggtcgtgctcgcggtggcccggcccattgtgctagggctggtacctcagcacgctggacatgcatggttcagcccgaagttaagggatgcgaaatagacttattctcagccatatgtaaggcacgtcacagagaatagggagaaaaaaatagacatattatatggcacgacccatagagtagggatataaaataaacttattttagctatatatatgtcacagccaaaaaaagagagaaaatagacttattttaaaaaagacataataggccgcctgtgccttcaggccggcacggcacgacccgacaactggtgggctgtgcctgggcctggtgtgcagcccatgggccagcacggcacagcctgaagtgtcgatcgtgccgtgccggcccgatcgccttggcccgtgccggggccgaggcgtgccgtgtgggccttatggccatctataggcagatccttcggagctagcaccacatgtcaccatggggcatagggaaagaacagtgtatcgattacgagccattatagacgaggggtcatatgtaatggcttctagttttgtatcgttagagataaaagtgattacatctgtaatagctgttggttaagagccgttacagaagaggaggcttcaatgatggctcaagggtgctttggtcatctataacggtcatcaatgccatccgttacataagtcaaaatttgtaacagttttaaccggtccatggcacattatagatgtgagaatccgtgctactgaataatagtgataatgtacaaagacatactaatttacacaggtttagatttattcggagagaggtatacttacaaaataattaattgtcatcataaaatggtgcacacttttatcatatatcaaaattacatatttttggtactatctagttcaaatcaatacatttcacatcactcaccctagggtgacattatctataagtaaccagagaattaagtttagtctaccagataaagaggagccataagagcatggagaacgtgcctagttatgcaagagttcacatacacaaaacagttaacccaaacatggaatacgttgtgtagcatacaccatgagcttcgacttcctctttgcagtgataccaaatgtctcggacaagtcaatctcgtcattcctgtctcgatcgaggaactcccagtcaaaatggtataggaggctggcaagcatgagctctatattggcaagcccaagtgcaatcccagggcatatcctcctcccagcaccgaaaggaatgaactcgaaatctatacccttaaagtcgacacgattgttctcgaacctttctggtttgaatacctcgggatcatcccaatactgattgtccctagctatggcccaagcgttcacaagcactttagttcccactggtatgtcatagcccataaccgagcatggctcacggcactgcctaggaagaaggaatggtaccggtaaatgtagtcggagtgtttcccgaatcaccaagcggaggtagcttagcttgtccatcatttcctctgttagcttgttttctcccctaaatatctcccgcacctctgattgggccttttccatgatgtgtgggttccttactagctctgttaaggcccactcaagtgtcgtagacgaggtttcactcccagccgcaaacatgtcctgtggttttgtaagcaataatgagttcacagagtaatcatttggatttgaagcaatgatgaattcttcatttctctagaagaaataggtaagcatcattgtctaaactgcaaaatgcaaacaaattcaaaatgtagatctgatgatgttactagttgctactccctccattccaaaatataaatatttttaaaatagtgctaagtcaaacattttcgactttgaccattaataacaaaataaaaaaataaaaaatcaataatgtaaaattgatgttgctagatttattattaaacaaactatcataatatgcaactctttttatttagataatcttacttttataaatgttgttggtcaaagtagcatcttaaatactgtgttgaggtccaaaaatgcttatattttgggacggagggagcagtaagtttgatactagcgtttaattgtttcaaaattaactggtataattatgtacctaatatggaatagtactgcacctaaaatacacaaaatcaaatactacttccgttccaaaatataataatttttagctataattaggacgcatagttattcagatttatagctagaaatacttataatcgctggactgttttcgtggatgtgtgcgtacggtgcatgtgcatagtaggacatgtcttctcagtggcggaactgggcctaggtaacttgggcccgggccctactcgtgaaaaaaaaattagtacctataccttgtgaatttttcgatgatggtgtgtaaagaaatatcagatgatggtgtgtttaattaccaagacgacgttagtgatcaaatcggtggtgaggggacactgcacatcgccgttcctctgcaatctgaggagtacgccgaggaggtcttcctcgccgtcgccgtgctcccggatgatgtcgtccatgatggccatcaagctccgattgcaccgctccgtctcccgcatcgcgccgctgagccggcgcgccagccacgacgacgggtacaggtcggccaggttgaacccgccggagagcctcaccgactcgtcgagctcgcgcacgaactcgtcgcgccgcgccgaccgggcgccgacggcggatcgcacgacggagtcgttcaccgcgcgggagatcagctcgccgacgttgacaacggctgcgccgccgcgggcggcgcactcggcggcgacggagcggacgaggcgcgccgcctcgtcctcgcgcccgtggcggagcgactggacgcggcgcgcgctgaggagctcgtgcacgcagatcctccggagctggcgccacaggtcgcagtagggggagaagaggatgtcgcggccgccgcggctgaggacggccagggtcggcgtgaggtagcggctggcgaaggcggcgtcgtacgtcttgagcacctccctggcggcctcggccgacgacacgacgagcgtcggcacggcaccgaagcgg

SEQ ID NO: 77617 - DNA, 1939 bp, Oryza sativa
aagcatcacgtcaatgtcacgtaggacgaaaactggtcaacaccaccatgtagacgcacgacagcgaaactgctcttcaaaaccaccgaggaagacaaattgcatcagttttaatagttggagggtcaagatacccggttagtcaaggcagtcaaagtgaacttattcaacctgcaatccctctgtctccgaacgcaggcccgttggcccagctgcgcaatgcctgctgccgtgctccgtctcgaactctcgatcccctgtaacctgtttctcgtcttcctactcctttggactactagcccgacgcgaccaaagctgaatcaacctatggatgcagtggcccaatgcccactggccagctggtccactccgtcgatctcgtcttcttcctttccacggcacacggcagcgctgacggaatcactcactggccactcaacttgctactcatacccgatgatcaactgagccaatatatacactcgttctcttcagacttcagtgcaagatcacgattcacgagtccgcgatggcaggacgtggtggaggaggagagctgcggctgctggggacgtggtcgagcccgtggtgatccgggtgagagtggcgctggggatgaaggggctgagctacgagtacaccgaggaggacctctccagcaagagcgaccacctgctcaggtccaacccggtgcacgagaaggtccccgtcctcatccacggcggccggccggtgtgcgagtcgctcgtcgtcctggagtacatcgacgagacctggggagccaccgggacgccgcagctcctccctgccgatccctacgaccgcgccaccgcgcgtttctggaccaactacgtcaacgacacggtataatgactggacatcagaacggcagataggaattctgtttgattggttgatttcctttgcaattttttctgcagtttttcccgtcgtggaaagtgctgttcaggtcgacggcggcggagcagagagctgaggcgttcaagaacgtcgtccctcgcgtggaggcgctggagcgagcgttcggggagtgctccaaggggaaggccttcttcggcggggacgacgcggggctcgtcgacgtcgcgctcgggagccatctggtgtggatcaaggtggtggacgaggtggccggcgccaacctgctcgacgaggccaagttcccgggcttggcggcgtgggcggagcggttcttggccgtcgacgctgtcaggcaggtgatgcccgacgccggcgatgttctgaagcagtacaaggggttcctggccaaatggactgcaggcgctggttcgagctgaacctgaacacaacggcgttgcctgctttcgtcttcgtggattttctaggtgtagaaaatactttctgcttcggggatctgtactttgaggagtacgttgacacgcgtgatgaataacagttttcttttttgtttcataaaaggagggaaatgttgacacgctgttcagtgaactactttagtgtttctagacgaaccacttagttgatttgctaagcacacttttaaacggcaaatatcgttcttccttgtcacgaaattcgtatcgttccattaagttgcattcttttggaaaactatatttcatccttaaggtacatcccctcgctttgcatgtcacccaaaaaatcatctaaagtcttaaaaaaagaattggtatgacagattgatctatcatgtcaaaaattttaaaacttttttgatgacacgtacaaaacgagcgtatgtcttctgttaagagataaaatccacttcctgttccttttaagcgtccgaagacatttttggaggatgacaaaatggttctccatgtttgaaatcgtggactggaagtagttacagacaccaatatacgatatatactgtattatcttactccctccgttctattttgagcgcaac

SEQ ID NO: 77618 - DNA, 905 bp, Oryza sativa
tggtttgtatttcgtttcgtcgatgaggatgctgtagtttgaagttcacgcatgtgtcttttgcagagatagattagagcaaaaattggatcacgtgcgtcagtacatgagattcatcgatcaaaactgtgaactcggagtgaccattgaatcatcggttcattgcacattcacacaggggcttcgttaaaatatcgtcgtatcatgtaacatttcttctacttttgcgtattggagttaaatcttaaaatcatgatcttaggctatgcacgatcacctaatttctcttatacagaatttgatggtgtactgaccggatgaagaagccatatggttgccttagatgcgtcggtgtagtagttgtgaggcgacggtgatgaagatcaccatgcagtgacggcgatgggaattcgcccttcactccccttcaacacgccttaaaatcggtagtttgagggtttggagaattggcttagcgtacatgagtcgtcgctcgtgcacggggttaaggttccctttttatgcgtattgaggggatcaggggtgattccttctcgaggaaaatgacgcttccgatcataaagctaaagagagaaacgtgtgagagaatgcgtgagactcgttcctcaatgttagggatcgcgtgggctttggtgggctaagcccaacgctctcctttctggctcggtggccagacatcaaccaacattgcgtactcgttttgcacatgtactatcttggtgttatgcatctatttatatatgccctctgcgttccagacttccgggcgtccccaacctgcaatggaataagttcactttgagtccctcaaatactgctccaatctgattcatacccctcaaccacaataccatatatcttgattcttgacccttaaactatat

SEQ ID NO: 77619 - DNA, 1733 bp, Oryza sativa
cctatggcggttttcactgacgtggtgcctacgtggctaatttgactcggttttcatatgacgtagctagtgacgtggcgcttacgcggtaatttttatttggaaaattgctatttgtggtcccacatgtcagttacaccaaaaaaattcattcaaaaatggtgggacccatatgggccccacatgtcattcttaccccctcctcttcttcctcctctctccccaactcccctctcctttgtcctctctccaggccgggcgaggctaggcggcgcgcggtagtcgggagaggagggcggtgcgaagcggccgggcagggcggcgcgcgacggccgggagaggtgggcgggcgcgcgacggccaggagaggcgggtggcgcgcggcggccgggcgaggtggggaggcacccatgaccccgctccgccgcagcacgtcacgcagatgcgcgccacgccacacgaaggttgagatggcgctggcagttgaagccgacggtctggcgcaccatgttctgctccttgtgttggttgcccgcgcaaaccaacgtgacggggaactccacggtcaagctgttccatggtggcgagcaatgagtcgtcgagcaacatcgacttgttcccatccaccggcgacaaccgtcggttgggctccaagaccgactccgacgacgatgacgacataccaccggactgaaggtagttgtaccactcgcgcctcgaggtggagcctcccgtcaatgacccatgcgacgaggccacctctgacgcagtgacgcgtgggtgcgtcgcacccggtgtcgtctggctcaccggcaagcacccctttaactccgagccgctgctgccgtgcctcatgcttgacggtttcatcacgccgacgccagtccactacgtgtgcaaccacggcgccgtgcccaagccggactggtcgacaaggatcgtggaggtgaccgggctcgtcaagcgccccgcgaggctccaccggcgcggagccaacttttattcaaccgagtcagccattgttgccgaagaggggagagagaggagaggagatggggagaagggaaaaggaagacgagagtgttaaccattggacgagagtgttggggcctgcgtgggtcccatgctaactaagcttatcatgtcagctaaaaccagacgtaaatactgcctaggacctcatatgatccggttttgtaaattgtgagggactcgttatatctggtattttggtatagggacgaatttcagactcgacaataatttgagggacgactcgacaataatttgagggacccaaagtgaacttattcctaccatatattggttaggaataagtccactttgagtccctcaaaatatatgtataatctaactcgtatccccaaactgtaataccggatatcttaacccctcaactattaaaatcaatgtattttgactccctcagtggcttcaaagcagtttttacaaaggtgtcatgtttacctcggttgacttagcatatggaaccatttgtcagtcacccttctctttcttctcttcatttccttacccatatttcctcactctctcacccatatttcctcatgacggcaaaatggcagcatggcagcggcgagataatagggtggtccggcaacagagggtgggagttggggactccgttgttttggcacccagagacggccacagtagccatcgagcggcagcaagttgagggagatgggtgg

SEQ ID NO: 77620 - DNA, 668 bp, Oryza sativa
tatcatgaaaaagaacatagactctgatatactaaatgataatatctattatattcaaacaaaaaatcactttatcccagttatgtgtaactcgtctatcaccattcttcgcaaacatataagttaatatatattttttattatacatttgatccacctgtgtatgtacataggtaatatacaaaataatctatattgccaaaattattgtgctaattgttaattaaaagggatataatattgtggctaccacctgagtaacctaggtctcggtgttcaagcatgagcgaagaatgcagcggcagacggcatcgtggttgagcatgagtggagcagatggtagctggcggcatcggatcatgaatgggagggagtagatgaggtgatgaccgttgatgttcgcaagagagctggagaagaggatgcaatggtcgacaccaatgcggcgatgcgctggaggtagcggtcaatggaggaggcagggaggtggtgtacgagcgtacgagggagatcgggaggtcgctcaatcggaatcgggggaaaggttgatgcaaaattataatcttaccctcccacgaccaaaacacgattggtacacttgctctcgcatgggcgcaatatttggacggtaccgggctctttgagctgttagatcacgcgtaattaac

SEQ ID NO: 77621 - DNA, 4683 bp, Oryza sativa
tgtgcatctatcgtgtactccctccgtactcgtaaaggaagtcgttttggacagcgacacggtctccaaaatacaactttgacttgtttctataaaaatattatttgaaaagtaatatatgtatatttttacgaaattatttttcaagacaaatctattcatatagtttttatattttcaaactcaacaacttgagagttattcatgaactcgtaaaggaagtcgttttggacagcgacacggtctccaaaatacaactttgacttgtttctataaaaatattatttgaaaagtaatatatgtatatttttacgaaattatttttcaagacaaatctattcatatagtttttatattttcaaactcaacaacttgagagttattcatgatttatattcccaaggtttgacttaaatattgtcctaaacgacttcctttacgagtacggagggagtataaaatagcattgatagccaacaacataataatatgtgacttgtatgtgtccagctaagcacaataaaggatcaacccgatccatgtcactataaattctatggttttaaatactccctccgtccctaaatatttgatgccgttgatttttttaaatatatatgatcgttcgtcttattcaaaaacttttataaaaaatataaaactatatatatatatatatacataaaaatatatttaacaatgaatcaaatgataggaaaagaattaatagttacttaaattttttttataagatgaatggtcaaacatgttttaaaaaatcgacggcgtcaaatatttagggacagagagagtattacttaaaggatgctatcataattttagatatgtcactacttatacccttcaaagcattataatacttttttttaacaaactaccctctttattccttcttcctcttcgttggatatgttcctccagcgcaaccgcctcaggaaccgaaaaaagagaaaaatttcccagccgcccaacgtcacgatgtcctcacttccaaacccaaacggcaaccggcggctaccaagcaaagcaacgcccctgctccaggacaacagagcgaggtgaggatatggtgacagcggcgccatcatcgatcgcgccggtagacctcctggcaatgcaccctcacctccctatcttgtcgatcgtcgtcctcctcgatcaacagcccacctcttcttcggtgatggataatgtcgctatgcatgcagcgcgaggcagattagttagatgggactaaaacttcttttaaagactattaataaaacccatccataatcttaaactaattcacgagacgaatctattgaacctaattaatccataattagtctatgtgatgctatagtaaacattctctaattatagattaattagacttaaaaaatttgtctcgcaaattatcttttatttatgtagttagttttataaatagtctatatttaatactctaaattagtatctaaatatagagactaattttaagtccttgatcgaaacaccactctggtgtgacgagaggataagagacgagtccaacacaccccggtggaagcggaccgaggaagagtctgacggaggaggatatctccgatcgatccagatcaagctcgtaatggagcagaggctacaccgtccagtgattgaggacagtggggccactagaccggtggctccacaacacccggagccacgaaacggcatatttacgaaagaaaattaatttgtgaataaaaattttagggagtagttatatttatggcgctatatttttcaaaaaaaaatagtcggtatgtatttacattgtaagtccctaaattacatatgtaattttagtatatctacaagtatgtactaaaattacatactaattatatatgtaagtggtgtgtaagtgtggtgtaccagtgcaatgttaaactttaacgctaatcaaccaagaagatttgggcagcaatgtcgcccggcgtgaaaacatccaacgaccagcgaatactcgtggagcaatcgtacggccagcgacaccgactaaaatcagcccaaaaaactgtcgacatatttttagcaattctgaatttttatatatgtgttattattgatctaaaagtaaatgctgaaaaataaacttcgatgaaaaaaccttaaaattatttagattgaaaattcaaataattgacttataagtataagcataaaaaaaaagtctgccatccccaacactgccgccatggctgctcccgcttgctagtctctctggtcactgccggtgtaatcgatgctacacaaacattctcccagctccgagctgacaccaagctcctcttctccgactccgagcaatcaccgtcgacggccactttcctctctagaggaggaagggaaggaatgctctgagctcctcttgatctgtttggcagcatctagtaggacaggacaggagaggaagaaataaggaggaggacaatttggtccaacattttaatataatacattaaaatggtaagtagttacatgcctccaatacatataaagttgtaaatatgcaagttacaatgatatattttaaaaccaaaatgtttatagtggtacaagtataattaacatgaaatcttatcttatatagtgaaagcaaccatatttcttacacgagaacacgtcacatcatcgaaaacttatcagccgttaaataaagagtttagataaataatagccattggataaaaaagttacatatgcactgaaaaaacaacaattggattaatgtatggaaattttcggaggtttctagtgtctccttttagacacatggtacaaagagagagaggggcaaagataatgaagaaaacaaaaaccacgaagcttctagtgatttctcatatagtatggtttagttaaatctatagttagctagaccaatagatactttgtaaataaattaactcatgctaaaaccttctgtaactaatagatcatatccaataaatagttcttatacaaaataaaaagtcgcgcaacgcacgactacgtggcttgtaaatatgaaaatttcacttagatatatgcctggttatgtaacacttcatctattccaaaacaaattaatctagtatgagatatgatttatgaaactggacataagcatgtattaggttaacttattttggacacatagagtactacatttgtatctttagggcttgtttagttggcaaaaaattttgcccctgcatgtcacatcggatatacgaacacacatttgaagtattaaatgtagtctagtaacaaaataaattacagatttctccaagaaactgtgagacgaatttattaagcctaattaatccatcataagcaaatgtttactatagcaacacattattaaatcatggcacaattagatttaaaagatttatcttgtaattttttggcgaactgtataattagttttttctatatttgatactatatacatacatgtatccaaacatttaatataacaacgtgaaaatttttgtttaggaataaacaggccattactcgtccacgcaacaatggccaagacttctgaataatattttcggggagtaggttaattaagagtgtatacactcaattaatttcatggtataccgacaggttctcggggtgagcttattttatttcaggataatgatgtgcaaccaagtcaaaccatcttggtctcccaaacttaatcatatccaaagtcacgtggtttctagtgactgtcagtcgatggggtgcccatgtcaaatccggccattggtcctggccactgtaaccgcacatatcactgacatatgtgtctcattacttccatactagtcgtgtggtgtttggattctgacttaactttaatctttatatttagacaccaatttagagtattaaatataaactatttacaaaactaattatataaatgtaagctaatttgcgagataaattttttaagcctaattaatttataattagagaatgtttactgttgcatcatataggctaatcatggattaattaggcttaatagattcgtctcgcgaattagtccaagattatggatgtgttttattaatagtctacgtttaatacttataattagtgtccaaacatccgatatgatagggacttaaaagttttagtcccatctaaacatgggctaatagtcagatgatacctttccatgattattttctttcattttttaaatgtgtcagggttatggataccacatacctaatagtagttgactaaatctcggcaggacccaccatataccatgtctcatacggaaacaaccttcggatataggaggagttccgcataaggaatgatgaatagagttctacatgaaaacgataaaggactactcggattttattcatattggtctccttagttctacttggacaagaggacacctatgggtataaatacaagaccccctaggaggagaggggagagggaacaatagatcaagacacaagatcaacatacaagccaacatacgccaagacaagacgccggatatcgacttcagagacaagcatagctagtcccctacggtgtctacggatactgtcaggagagacataccgctgtcattgatctcgccggatgtggattcgaggaggaaggctaccctgt

SEQ ID NO: 77622 - DNA, 12327 bp, Oryza sativa
gacccctcagggagatagagggaggggcggcctcatcaccctcgggcccgacccccccgagggggtcaggccacgtgggtgaccgcggctgccccaaacctctagtcaagatatccccggtcccatgtcaccgacaaagatgttttgactttggtcaaagtcaaactactttaaatttgacaaagtttataaacaaatatattaatatttataataccaaattagtttcattaaatcaataattgaatatattttaataataaatttatcttggattgaaaatgttattattttttctacaaacttagtcaaactgacttagtcaaatttgaagcagtttgactttgacaaaagtcaaaaacatcttataacctgaaacggatgtagcagtttatactcccccatctcaaaaaaaaaaagacaaatcctaactatatatcttgacatgatgaatgtccaaatacataggagtatgaatctatttgagatagctaaacagacgacatgttctgagaattttctttttcgcgaacgcatattatgtgaattgtctaggtatgaagtgtgccctgtaaactactgtacttaactctatacctcccttgtatttttgacacaagattattgagcaatgagtaaatcctagagattttcactatagcagaatcatttgctcataattatttattttgagaggacattattgttcttgattaacaatgtaaagtatatattctcctcaacacccggtcccaatgtaaccgtgaagacggagctcagccacacacgcatggcgcaactgccgcgacaccgaccaacccttcgccatgcctaaatccggcacctccatcgccgccttttatatcctcctctccctctcgccgtcgtcgtcgtcgtcgtgccgtgttcgatcgcgccgcgcatcgcattgacatctccgaggaaagctttggtatatattgttgcgaagctagggccgccatggcagcgtcgacgcgcgtgtgggtgctcgccgcggtgctcgtggcgtgcgcgatcgccgtccgctctgcccgcgccggccacgccagcggccacgccgccgccgccgacgaggaggacgccgccgccgcggcgccggcgccgtcgaaggggcacgggtgcaacccgctcaaggacaagacgtgccggcacgacgaccgccacgatccggagaaccaggaggaggaaggggggttcggcgtccggctgccgtccttcccgtccctcaccggagacgacggcgacgacgacgagctgccgtcgttcgacacccacatgaccatcctcggccactgaaaacaaggctgccatggctgcaccatcttcatcgtcatcatcatcatcttcttaactgactacgtagctctgttgattggttcttgcattttgcattgcttgctctgtatcgagaagaggggaaaaaaaggttgaaaacaagatggaaaatgtcatgtagaattgttgctagagtgtgattctcctagctgatatctccaaaatgttgttgttaatatatcggtattgttcaatcttcagtgttcatcgatctccttcatgaaagcagaggatgcctcttcctctgttcagttcatcttcgatcacaagcaaatctatagaaaatctttaacatacttatatattaaccacgtcattcaaaatggaacaaatttctacaaacataatcgcctgcctttctgtgcccgcgtctctcacaattcagccattgaaatcgcgatgcatatccatgctggattgagcccttcccgttctcatccgatctcgatctctgtatttccggcggcggagcgccacgaattcgccggaggccgtcgtcggagatgaacgttgaaggatcgggcatagacgtcgaagcgtctgtaattcgaatcctatggaaggccgattcggccataagcggcggcggagcagcgcgaacggcgagaggggggacgtgcggcggcggcgccgttcgattaagattgtgtggataagataaaacgaggcgaaacagtagcctcaggccatcggcccagtcaatgtgaacagctactagcccaacctatgaaggcccacaaaacgtgggccgctaccattattgggaaaaaagtccaccgttttttttattaacgaacaagacaaccccgatttcattgaatatagcatgagaaaaatctaggcaacatatacggaatatttaaaaaaagagagaaaaagctcgagtcattagggaccaggccacaaaggctctttgctcccgtcagggtctaagttcttgcctcctctttgatctcaacgaccaaatttgttaaaaaaaacgagtaggacaactcctcaaactaactttcttaagttcactttaacttccttaagcaggcagaatctaatttttacccattgagttaaatagaccgggtagggcgactgttcgaacaattgaaataagtgtaatttgacccccccccccggcagaggttttagaggacagtttcgctgacatggtgcttacgtgattatgttgacctagattttattccacacggtgcttatgtgactttagaattaaaaaaaatatgtgaggtctatttattgtttacacacaaaaaaaataatggaacccctaacatgtagggcccacatgtcatcctccctccaacccttattcttctctccctcccttatctctatctttctctccttagcccgtctacaaggagcggggtcgggaggacggacgctcgagcgacggtgtgggcggccgagagctgaagcggtggcagcagcaacccaaatccagcccaccaagtttggactgcccaatcaggcccatatgggagcccatacaactgggcctcggcccatcacaaccagagccaggagcccagaaacggcccaaaatctctctctctctctctctctctctccgtgtcgtcgggccagctcacgcaaccccagaaacggcacgacattcatccccctccaacggctaccgctgcttccaacgcagcgccgccgcacgcggcctcctccttcccctcccccctcaacaacccaaccgcctcctcctccaaacaaatccacggggaaccatctctctctcctcgcccccgccgccgccgctgctcctcctccgatcggtggagcagcagccttcatgtacataccatttctttctttcttttttattcttgtttttttcaatttcttgatttcttgatcggtggatttattatttgtttgtgttcttggaggagcaggaagggcgaggcgggtctcgatcggtggagggggaaagatttctcctccagttttcctctagttttgatcctggaggaggtggctgctgcatcttcttcttcaccgaagattggaggagtggatttcgtgtggttgttgcggccgaccgctttcttgctctcttggctcgtcggcctccgccgccgatgctgcgggatgccgtcccccgacgccgccgccggcgatattgagagcgccctcgacgacttcgcccgcgccgacgccgactgcatcgccgccgccctcgcctgcggccgcaccagcttctcctaccgccgcctccccgagccgcgccgcctccgcctcaccgtccgcaagctcgacgactcctacttcggtataccaaatcggctctcttccttcttgccatggaatcccctcccattggatttggggtgacgcgttgctgtgttcgttcgtttcttgctgcttgggtagatgtgcaaatcgcgaggtcagccgcggtgtgggagctcaaggcggccatcgaggacgtgttcgccgcgctctacgatgaaacggacaacaaggccatctcttggtacggctgcatgcacatcaatcttgatttgcaaatgtaccaacaaatgcggcgaaaaaaaaaagtttcccctctttgcattacattgtgaatttctaatattcattatagtttcctatcttggtttgtgaaaatgatttcggtggttcctgagattttttttagtttagtctgtgtgttgggttgatatattggtaactaagcattgttttgcttgttttaggcagcacgtgtggagccacttttgcttatgtttcaaggacgagaaattgacagatgacaaggcaacattgcgtgcatttggtataagagatggtgatgaggtatatgcatgatctctatttgtgattggctcatggatgaatctttagtgccgactaattctcctatttttcttgagtatgtgtcatgtttatgcaattgtgacacattagtacacgatagattgctgtatttgcaaataaaaataggcataatttctttgttcatgcacaagatatgcctatgatattaggcaattttcagaatagacactattgcgtgtgggtaagctctctagtcaagtactaccattgatttgtctgaattcctgttgacttttcatgatgccatttgtggtcctctcacatcaaattattgtttcagttttcagaaatagggtaagagcaaatctaattcagcaaaatcttgcactacttttgatctcttctatttcttggtcttagagatttaggtggttaccgagatcttgcatggtctgttttgtgtaaagaacgactaaactaagaaaaggatccactcttacagctcacatgggtttgactggataagcacattcaagcatgcatgtccactaattacatctgttcgagtcttaagaaatcctttgtaaattgagtcatgattctaaataactctccttgtgtttaccgccttcaatcttttgtgcaggttcattttgcccagcatctttctgttgaatacagaccctgcaagtccctttccctcagaaggtaccctgagcttcaaacgcccctgagggcttttcgtctatttgatctacatcttccattttgtacaactttattggatgttcagaattgatgacattcctaatgatttcttatgttaggtcaaggacttcattggatgatttcagtgctaggtcaaggagtttgttggacgatctcggcgaagatgatggtgataagtttatcgacacgaggcattctactagtgttttggaggaagggctatatgtttatcagcacgatgaggagcgcatggaagagagtcgcaagaagggaggcttctttagcggttggttctcctattctagattgaggggcaacagtaggacacattcagaggatgccatccaatcctcctgcgaaaagagagatactcgaactcggccaaagctggggagatggttgtcttccaaaaaaactaaaggcacatagcaatctagattgccaactgtatctcacacgtgttgctttgttcttctgaaatgaaaatcaaaattacattcttgtcagcatgatatgaatgcttcttacttcaacacgatgagaagtggctcctggcataacttggaatatatacctttaacttagtcaatatcagagttttctctgtatgtatatatacgtatgtgtactgtctgactcttgtgcagctatgcttggttgaagaaaaacaatgacaagtcctactatgtggtgcaaccgtgcaatgaaatatttctcctctctactgaatctttcgttgcataagagataagagacatgcttgatgcctaacagattttcacggaacatttagtgagccaactctctcaaattttgatgctttacaacttacaatttattgtcatcctacacatagaatgaacccaagacaacttgggccaaaaaaaaaaaactatccatactaaaatgaacaaattaaacatttaaacagcagcagcagtagaagatcaaagtgtagaagctaactgagaagaaagtgtagaagctaactgagaagatcttgattatcacacagagcttgagatccccagggctatgtctccagttctccacaacacaagactactaatgcccagggcctcgtggactcggtccggccctggcgacggcgaacaccggcagcctccccaccgagaacccgccgccgccgccaacgtgatcacgcagaggcctcgagcactccaccgccgtgcaaagcagcaacaccaccaccacaagaacagccagctgcatcagcgacaacgacgacgacgaccgaaaccccatccccaactccgccgcgctgccaagaacactcgaacaagctagctatcttgaagatgaagaagatcgcggtcgtaggagcaggagtagtaagggtgtttgattggcagaggttggccatggctgggaggaagaagaagatgtgtatataaatggaggaggcatagcagaagtgcaggacaagagacgtgcgttgaattgaacgcgcggactttggatggatgaaaagcggagaggagttgacaaaatggatggaggaaaagtggtgaagtaggcttgatcccgttaaccttcttcggattctgaacaaaatcttcttccttcccctctccttttcatcatcgtctttttctttttcttgctgacgttgcatttacacctcctgtttgaccaccagtgcagtgcagtgcaaatgcatggctagtttggaggtctggtgttttaatttgatttatttaacatgatgcaaatctgcatgcagttggtgctggtctgaatgttttgtgctggaatgacacattcagagcttttgcttggtgctttgataatttaatagaggaattctaaatgtaggggaaactggtgttgcggtatgttcaaagtttcttttttgagtcattgttacggtacagcggtcggtaccagtaccgcccggtaccaaaatcctagccgttggatctggcccgatccaacggctagtagagtttggtaccaggcggtaccaattctatccctatccagtaccacacgaagaactgaggtagaagggcaaaaacgtaacttcgtgtgcaataaccagatcgggagggatggacgggcagctcgaaccctagaagcggcgggattctcgatcgccgctgccgcctcgtggatcgacgccgctgactcctggaggtgaactcagccatcgctgtcgccgccgccgggaaggacgacatcgacgccgccgcctccgggaaggacgacatcgacgctgccgccgtcgggaaggatgacatcgacgccgccgccgccgggaaggacgacatcgacgccgctgcctccgggaaggacgacatcgacgccgccaccgccgggaacgacgagttcgctgttgccgccgacgggaaggacgacttggacgccgacgccgccgcgcgggaaggacgacatcgacgccgccgccgccgagaacgacgagttcgctaccgccgccgcttgcttcaacgccgccgccattgggaaggacgagttcgatgccgccgccgtgacctgcttcaacacatgccaaaatccgccgctcgccgccacttgattgcttcaacgcatgccggtgtcactctcttccgatcctacccataccggaacaaacggcagatttgtactggtactgagcggtactagtaccaagcggtataatttgctggaccataaaaaaatctcttcttttttttccctacctaatgttatgcagtcaatggaattctgagtgttgcgttgcttctaaattgcgaaggtaaattaaattggagtacctcctactcaaagtaaattcagcagtggtgttttctttgccagttagcaaagcacgcactaaattcgtcgtcggtaataatcaccgggaggtgcactttcaaacgctttctgttacatatttgaatggaatccagtccattcattcaaactgttgaatgctgaatcttttaccaaaggcgtccatactggttgttgctatccccgttcggtcatttatactacatatttttttcagctccttttcttttcctatccctcccgacagatttatcttagatctcgtcactcgtcagacgatcaactgtcatgcaaccttttggaaaattttcccgcattgttgttcgtttcttgtgccatgcaaccttgtgtcggtcgggtgtggcagaagccatgtgtcgccgatgtttagttggtggtttcggattaagcgacagaccatagcggtaggcggttccgagcgaaagcttagcccaatctttaggccaacagtgactatgctttcgggcgtgagggcattgttgaggtacccctcctccctcggtaaggagctctgggtgaaaaccttgtcccgtttttgggacggatgacgacggcgtctcttggagtcgcgaccctcgtgagggcgtcattttagagtctttacgccgttgtggtgttgttggcccggtggcgatcggtctcacatagcgacggccagttcggtactcggcttccctctctgtagcgtgtgtttgggcggttggtacatggttcggggtgtgtgccttggtgcacttccttcctcgacagccagctgtcgatgtaaaacttttcttctaatcttaattatattgaatgacctccttcggtcattccggcaaaaaaaaaaagttgccgctgttcaacaaaacccctcacaatgtgagtcctaaaaaaaatgtaagtctgataatttatcctgtcaaacaaattgataccagtgcccctattccttgcattttgtttggaagttcctactatattggtcccttcgaaccttagtcagatcaagattaaataagagcatgtaaaatgagaaaaccattaacgtatgataaattgtgttttaattattataaatttaaaaatatatttatttgatatcttagaacaacttatatatacaaagttttcatatgaactgtatcatttagcaattaaaaaaaacatactaatgaaaactaaaataaagtcgatatcttaattagaaggataattttaccatacctagaggtaccatatttttttatgtagaatttaacgaaacgaaagaggcatgtgtgtggcaaagcagctggacggctcaggtgcatgctggtgaagaaagccttggagctaaggtggcggccgaccaccacccgtctgcgctgctttgcaggactccgcggcgcgtatgcactgtttgcagctacgaaatgagggtgttgcattcgcacgcggcgggcgacgtacgacgacaccgacacggcgacacccgtgcacgaccgaccaatgcaccgggagggagagccaaatctgccaaagaatatcgatcagtagagatcagatcactgtgtgtgttgacagggaaacaaatctgttcagagaggtttcatcccgaaaaaaacaaatctagaactggatattatatattctagtacaataaatctgaacataggtatatccaaattcgtattactagaatatgttacatttagcataggttagttttttatgggacaaatggattacgagttacaaccggaccggggatgttgtcgtcttgatgaaagcatctgtgcactttgccgatggaaaaagaacgggaagaaaaggctcctgtggattttcttttcttctttttttcatttttcttgcataccgcgcgcgcaggttaggcaggttacagcttacagcgcgtggttgtgccgctggtgaggaggcgacgattgtgcgtgtcgtcgccgtgtcgcaaaaattccttgcttcggcgtgtgcatggcgtttgacccccggggcgtcttgacaccgccggcgacgtggctgacttcctcaattctcatgttgctttcgtcctttctccttgtgggttcggtaggttttacatcactccgattttttttcttttaacattttgatatttttaaaatttgttttacaaataaacacttgaaaaaaattatttcagaaataaacatttttcgtggctagagttattggcgttattcatgttaagtcattagcgtgaagagggtcgacaccaaagaccaatttattttttcctgtttgaaaataacttatttgtaataaaaatatatttataaatagattctagacatcagtttcattggccgataacctattttaaaaaaagatatatttacatgtttgtcctttttatatttttttacaaatatgtcatttgcgcagatccccttcacattgatggcttagctttctgggggataaggggaacggcgctggcgttgtcatgttagggtaagacaaactatagagatgttccacaaacatcttacttgaagctctgtttcgagtgcactaagcgaagaggcaagtgatgagtacaaatcatggaaaggtcagtatagcttgaatgaactacgtagtaaaggtttagtacagagcatgattaagtcacggtaactaagtacccgtaacgtttaatagatagaagtaagtaacaagatcatggcaccaatgatctaataagtttttaagagtgtatttgtaaaataagtttttaaaaaggtataaaatgtaaaagtaatcagttttacatcacctcttcatctcttcctggcctgcgccagcgtgagtgcgcgccaagaagaggaagatcgtatgatttgtgccacgaagggagggggacctagattgattttacatattcagaaattctatttcactaacctgagcctaaccttttccaggttgtttgccttcagaattcagaaaaaggttgtcgatttgcaatttcacagacaatcttcagctaaattttccggtgattatgagtttctggctgcgtctctgaaacttctagtgtatctgatttgaacaaggtgaatacggatgcacagtcatccttcagaattttatcatctgaagttatcttcaggttctggtcttctgaataactcttgagcttggcacttctgcacctctcatatattcagttcttcctcctcttgtaaatgagcacaaaacgttgtttatcttcatccgtgtaagcgcacgccgcgtcttcatcaacatcttcaatcttcatccgcatgaacaaatatgttttagattttttttagaacgaaataagttttagataagtctacttcaaaattctgcctccaaactgtgaaacgagattataacaaggaaaaacgaactactactgaagtactgattaactcgatttcgggtgtgttctttcccgactcaccgctctcattttgcacgcgcacgttttccaaactattaaacgatgtttttttcgaaaaagttttctatagaaaaattactttagaaaatcatattaatctattttattttaaaaaataactaatatttaattaatcatatgctaatgagttgttttgtttcacgtgcgtagagatagctcccaacagcacaaaacgaaagcagccttcggattggtctaaggcccattctccatgttgtgaatgggctcttgtatatcgtagcccacctaaaacaaatcgcatgtagggatttggaggattttactaattacttatcgtaaattcgctaagaaaattaactatccgaactatcctgaaaaatcatgtattttaaatgagctacatactataaccctatatactatcggatgagatacagcattttctgcttgaacaatatgtttttctactctttttaatttctgggtgggccttcaacaccggtttcacctttcgttgataaataaataatgttttgtcttcctcgcttggtgcccaaagtgcccaagccgaaaatctttcctcgccaatgggccaaaataatactgcagtatgaaatggactattaatattagccgtgctctatgtattactactagctattaatatttcaaaattagtattagctccccctaccctaaaaaaacgaatacatccacaattatatatacatctagaacatccaataaaaccagatctagcattgaatatattttgataatatatttgttttgtattgaaaatactattatattttttaataaactcaattaaacttaagtaaatttgactatgaaaaagtcaaaacgatatataatacgaaacataggtagtattattttttttcgaacggccaatcaggtgattggcattatattaatagagaggagtttaaatatagtattaatatttcaaaattagtattatctcctcctaccctaaaaaggccttacacatatatccacaattatatcctatgttcctcgtttcttcaaaattcattgtattgtttcgtgatgaaaaaaattacataggatacaatgaagggatcacctatacatttgttaaaaaattttctcctaaaaatttgacagatataattataatacaatcgtgatgcaattacactgtaacttactccctccgtcccataatataagggatt

SEQ ID NO: 77623 - DNA, 8901 bp, Oryza sativa
ccactagcagcctcagctccaccgtcgagtcgttcggcacccggccgcggccggtgctcccgccgcggccgcccccgccgccgccgatccccgacggtgactgccgcagcgactgcgggtcgtcggcgtcggtggtggacgacgactgcgcggacgccgccgcctcgccctcgtgccggctcccgttccagttcgacctcaacctgcctcctggtggaggcggcggcggcggcggcggctttggctgtgcctacgacgacgaggagctgaggctgacggcgctgcggctctgagcccccaaccccaccggtcgttggagaaagaggaaaaggagaaaaatatttggttcttcccttctctcgtagccgacatgatccttccgcgctttgtgttgttcttgtttacttgatctgatgatgattaatgtggcccgatctgcgtatctgcctgcttgctgctggcgatagatgatgattgctgcgtctcgcagcagctcgctgtggttgtgctgttgtaatatagcaacattttacttgcttccttcctgtgaggaagcagacagctaaagtaacttattttcaatctttagctacatgtgctcatcttgttcttaccctttatactcttttagtttttctttctttttggaattgggaagcttgaaacatcccacctatttactagaatagtcagaaggcttgtagcaaacaggaagcttaaatgccagaaatatacagctgaaattcgttctgttaaagcaatgatctagatctgcataagatcgtcttgcttccttgatgcttgtgttgttaacatgttattatgtcgatccacacctgttgttcctacatctagtttcacatttgctttaaatttgtgttatagcataagatcgctttggatgttccatataattccatgtttgtgtgatcaaaagaaattcatatgaaccaagtttagaagctattatttagtgggtaatacataaagaccttcagcatgaaataatgtagcagcctttggaatttagctgaaaaccattagcatggataatttggcatctgattagctgattcattgggcatcaagccataataggctctgttgggcagccatataagctgcagctgctgcggctgctacatcagaaatttgctgcaagctgcagcaatccttaactactgcagctgcagccgcagctgaaaaataccagccgaacacacccataaaagtggatgattctatgtggtgtaaactcaggttaactgccctgtagcaccatatgacattggcgtcaagatgataacgggattaattcttgcaggtggaaaagttatgctagtaacataatgtgttgtggcctaatatgcggaacatgtatttttctaatatatcattgttttgcaaataatcttttctgtatgatatagctaacatttgtttttgtgttttgtcaaatcttatgcctacactgatttgcaggctttcccactaaacctcatacctgttcttctgcgcaacattggcaatcttattagggttctcttgttacatttatgggaggaggcattgaccaaagcaaacgacaaggaaatattcttacataaatgaagttagtaataagttttgttagttgcatgatactttgtttatatcaggggtgatagtttcttataaataattaagttccattacaaatataagggtataatatgcctatgcacctaactcactttgtttttttaacgcaagtcatgattttatcttgaatatcatcaattcatgtccgtttgcattatcctttcttttgtgtgcattgataacattttattctgatttcatcatttatgttgggatgcaacaaaaatgtgctggctcctttctcttaatgctcccactgtttcaatttatgcgaaatttggatatttagtgtcatctagaaaacatggtctgggaaataccattgtagcatatatgaaaatgtagacatgttttccataattgactttgcaaattatcatgctattcgcctaatcagaatctgagcatgatgcactctggtttttttacctaataatgtaagttaatctttaacacgcgatatactttctacttgtagcttcaggttatcaaaattttctatgttgctattaactttggtcaattattatgcagttatctacatgattacatttcttcttcaataggaaatgtccatctgatctttaaacatcaccagtgagaacctatggtaggaaaaagtagtccagatatcatgtgaacgcatcttattatatagtagctattaacatggaaaacatttttatatttttggggtcccagtggtaaaactagcatgcagtcatgcacttcttttatcctttcttcatgttttgcctgacataccgtgaactaataatcctgctgatctactattggataaaaccagaaacattgttgccaacaaagtggtagaagtccaatgggaatgagaatgatttgggcctgtacagcagatattggaaccaactgatgcatgtgatctgtttgtgagtgcttctttctaaacacttacacattactctgaactggtgacgattcttccgaactctgggttgagtaaagtgcaattcactaaaaacatgtttttgggatagtatttgctggaccatttgttttcttaacttttctgttctgctttgcatatttgtgcttgcatgtccaatagtcttcggtactccattgccccagctgcctggttagatttaagggcattattgagcatggtagtgtttatttcctcacatactattggacagtgatactgataacaagaagtaataactactcttcatagatagatttaagttccctgtaccaagtcatgaggagttgagggctgggaaatatgtcatgacaattagatttaagggcattattgagcattgtagtgtttatttcctcgcatactattggacagatactgataacaagaagtaataactattcttcatagacatatttaagttccctgtaccaagtcatgatgagttgaggactgagaaatatgtcatgacaattagatttaagggcattattgagcatggtagtgtttatttcctcacatactattggacagtgatactgatagcaagaagtaataactattaattatagacagattcaggttccttgtaccaagtcatgtggactgggaaatatatcatgacgattgatttcctagcttgcagattcacttttggaaaacctctctctgggaagaagcatagctgatagctgtgaggataaaatggaaactggtttgttaaaaagcacttacctgattagaatcacttctaaaatctggatctttggatgtaatttatcttgagaaaaggtgtaatttagcatgtgtggtaggcaatatgtaaaaacaaaatgtacatttgtgctattcttctttctcaagttaactgtcttgttactgtatggcatccattgcttgtcttgattgatgatggctttgggtttctgtttttgtcttttcgtgctcaagttcattatgtcttattttattgatttgatgatgcctccagagagaattgatctatccaggtgtgcttcagtgatagcatagagtattgaaattgtttcatatagtcaagttggagtggactctaatctactccatgagccaaatggtgcaatcatgggcaaggacaaggtgaggcgaaacagaagaaaacaccccctgtactaaggactggtgcaaagatgtaatataccttacggttatgagttatgacttaagttgtttgacatgttgggcccctatttatatttgtctggctaaaatgctaaatatacttgattgcctcccattgtatgaattgttagtcacattttctttggcctcttattgcagcatgactgattaaagaaatagctcgatgactattttctgccataatattcccagctatgctcatcatggagtaaattcatcactgcatttgctgatttcatttctaaccctgactggtttgattttgcttggtgactctgggatccatacggagttacagtgatattagtgcatcagttttgcatgccttctcttatttctcttgttgagatctgcttttctccttttcacaatctaaatctattggggcattcaatgattgttggtttcacatgcccctggtttctttatcattttaggtattattggtggcactagttccaacagacccggccactgactacccacttgtttatccagtagtaaaatgcaacatgagcagattatggggtaacaagtatggtaatgacctatttggctatttccctgtgtgattgtcttatggcattatttataacactagtgattagtaccattttctgttgtaccttctttgttttgttgcaacttatttaaataaaaatggatatggtgattggtgacctctgttcattcctttaaatgcgtgtatctgaatgaatgctgcagtttgttttcctccatactttctcctgtccagtactactttctttttaatatcatcttgttagtttctggagctaaccttgatattgctgaacatatatatacctcacgatgctatttgctgctagaaagctaaagaaaaccatgaagctagccaccaaaggtgccgcaaatcttgcgtgcacaattccaggttttttccatgataatctggacgcttgtgctgttgtgcagagttagctgcgctaatggctatcactattatactaacattttatcttagcacctgctccgacattgttgccattagtttattgatgatgatctgattagtttcttctcttcttttttacacactggattaaactgactactgctctctgctcctttgtttcagctgctgctccagatcttgcgcgtcactgcctgctcaccagcacgcaggagcaaagcttcccatgtgcctgatgtcgcgccggtggtgtgcaattccggcgacaacgacggcgacggctataataatcgatcatgggcgctcgtaatgaagcttctttcagttattgggatcaggaaactattttaaattctcgagaggacatcctcttgttatttgtactctcgttatttgtatgtcatctaaatggttataaaaaaatttaaaaaaatcaacaaaataaattaatgtgtgataaatcacttcagaaacatgcaaggtcaaatttaaattctacaagttgcaaaaaaaaaacaaatttaacggtggatatacattaaatagcaatagtttaatttgtttttttgttgcaacttgtagaagttgaattttaacttctatgcttgtggagtgatctatcacatattaatatatctagttgattttgttttaaaaaaaaattcataaccatttggatgacatgcaaataacgatggaatgtccactccctattgaggtcgccatttcaagattttttttttctttcttttgcatcatcatcaagccacaggcggtgcgtcggcttgcttctcttaaatttctcttgcaatttggtcgctttccggtttgtgttgatatcttaaatgcatcagctatttgatgaaatgtgtgagccagctaatgtggcctgtactgccagtgcttttgatgtgccggaatgggtacaaattgctgcttgctttcatatggcaccaacaacatgagagcattgctgaaagatgtgtactcgaagtacgacagaccgtgcaagattgcacgatatgtatttgctcttttttctctttttggtgaatgtgaacatgtgattatctgaaatgtacagcagaagaatacgtgaagtttgtgtgaaaacaatagaaaaagatcactggatcaagacttgtgaggctctgagatcttgaatttcttgccctagttttgttattttgagcaaaggctcggttcagtttactcttcgttttcatccaatggctgagaaacatgctcccaattcgtgccggaacgggtacgaattgctgctggctttcgtatggcaccaacaacatgagagcattgctgaaagatgtactccttttgtccataaaaaaacaatttctggctacaaatctggatgaagaatgagtatactcgaagtatgagagaccatgcaaaattgcacgatatgtgtttgctcttttttcctttttggcggatgtggtcatctgaaatgcacagcagaagaagaatacgcacagtttgtgtaaaaacaatcaacaaagatcattggatcctgacttgagaaaatctgaactcttgaattctcgccctcattttgatatctttgaacaaggcacgttcactcttctttttcatccaatggctgagaaatactcccaattggggtagaaaaaggtttgttcagtctgaacaaacaaccctatctgacagagatcttgacattgcatacagcacacaggaacaaaaagaaagatatgctatgcatgagtagctcaagttcagtccagtaaaacaaacctgttgccctaggacaaaaccaggtgctgttcataccttgcaacttgccaaagatacaactccttatgaacatgattgcattaccaaaagcctaaaatactgcactttgcatgttcatatgctgcaaggaccaggtgagaagagagagagagagagaggagggttgcaaaagcagaagccaactcaagaaacaaacaaccaccatgtccttgggtaggtaggtagaaggttaaaggcttgagctgttcttcttctctcttttgcctttccagtttccttcacctgcaactctgttattgttacacctctctatctccataaaggcagtggtacatacactggcaggcagggcaagggcagcacattctctcttccagctgccaccctgttgagttttgcttgcacagagtcacacagctgggtgatctcctttaattaggaatttagggaggctgtcagttctgaaccccaatcataaaaccatccctggtttctctgtcctgtcctgccatcattcctgcctgcttctgctttctctctcttctcttctctcctttcctcttgagaaagaggaaagggagagagaaagaggagaagagcaatcagcccaagaaggagaggccttcatcttcacctgatcggttcttcttcttcttcagcaggcagcatagtacttcatggctgtgagtacaattaactgattaattttacatcttcatcttcttgtttgttgattgcatttgcatatgcttgtctctgcatctagaatcgttcaattgcttccaaacatgaaaatggtactcccaatccattcttgcttgatcatgtgagatgttcttctttctctgctccaattacggtgtgcccatgattgctgcacataatatcaccatcaccatcatttttctttaaattactcgattaaaaaaagcaaatattaggaaatgatctaatatcaaataattagaaggggttaggcttcgaacccagatcgtctagtccaccaccttgtggagctagccggaaaatctatgagtgtttctcaaattactcgattagtgtcgttgtgttcaagccaattactatcaaattaggctcatgagttgggcgaggctactactaccacccccatgtgcaagatgcaagttggtaacatgcataactgcacaacagtcacggcaatggattatggatggacagatggatgggttaggcagagttggactgacggatctgaacatgcgatgctctgagccggctgcactgcacatgcatgcgtgacactatgaatctatgacagcatgatccgtgctaagatcttcatggcaaagagagaggaaaaagaaatttggctggcctttgcttggtttagacgattagtagacgtcaaggagactcatgctggaaatgacaacgacataatagggtcatttgtacagattggagttggctggatgttggactagtagttggcttttcgtgtttattctcccttttttttcacctgacttagcatatgagacgcgtattcgtacatttatatggtgattcttcttaattaggagaggtcggaagttatgctcccttcgttttttttaataactgatcattttcttttgctttctcatttatactttgactattacttacccttaaattggtaaaccagagtacacatatttatgttcacatataggacatacctcactttagtaacatgacaccaattttttagtgtatgtaatattttttaaaagttccaaaatgaatattgtctagtgccagctattataaaacggaccgagttagtttctttggattttgtaaacaaagttagagtaaaaaaaaattctcatggtgaaattaaattacgttgttatatggcatggttaatctcatctcgagattcgtgcagggacaaggccccgtggtgcccaaattcggatcgtgggacgccgagaacatcggctacaccgtcttcttcgacaaggtgcgcgagaacaagaccgcgcccacgccggcgacggcggcgccggcgacgcacgacgacgactacgagttcgatccctacgagcactacgagaacctgagcaggaaagcggcgtcgcgcccgccgagctcgcacggccacgggcacggccacgcgccgccgccggcgcaccaccaccaccaccaccgggcgccgccgccgccgcagcagcagcagcatcaccaccactacccggcgtcgcagcgtagcggcaatggctaccaccggaggagcggcagcaacggcagcagcgcggcgtccgaggccagcagccgcggcagcaagttctcgccgcccaagccgtaccagccgcggtacagcagcaacagcaacagcggtggcggcggcggcggc

SEQ ID NO: 77624 - DNA, 9383 bp, Oryza sativa
tagtttcttttcttgcattatctgttgggactatactgtaatgatgatattatattgtaatgatgatattaggttgcatttctttcttcttttgtgctatatatattggaaacctccatagctattgaacacagcacacgcagactagtacaaatgtaacaccatgatgacatgatcagtggcagaaatgatgttcataacggtattatatattgacagaattatagcccatatggactttaagaagatgtaaggttcggtagaaattcagaatgatgctcctccttatagtcgaggagtaatagaatcacaaagcaaaaacattagggcaggaataatcaattttacctagtatcggcttgtaattcaaaattcttggctttcagatatgtgtttattaatttatttatgcaactgcttccagttagcacttcttttttctaagaacctaatgagccatgaacaatgcagaaaacttccttctgtaacttttgatgtgtggttcaacaagtagggacacggttttttttttcaggaatagccaataccccaacactttttttttctcatatcaacactcgcaactaaggagtatgaaatactcgtatgaactaaagcggatttctaagttactactgctaaataatgccacttctccgatccaccatagactaatggcgagaatttcatacaacaacaaccaacatcttgcagcaaaacaaattagtggaattccgtaacgagatgattcaggccagtacggtgtagtttcgagtttatcacctggtgggggcgccgcggcggaggggaggagtagccatcgtcgctcgtcggatccctagaggtgaggtcccagacacacgacgagttcaccgggcgccgcggcggcggagccaggaggggaggagtggcgcacgacacgatctaggagatggggggttgggcgcgccgcgcagcgccgccgccgtcccgctcgaccggcggcggcggccgccgcttcgcgcttccgcgtgccgtttcgggcttcacgctcccggtgagacctagtattggaccgttcagcagttggcacaagtttctaaggaataagttcatcggaggtcccttaacttaacagcgagattttttgtggtcccttaatcacaaaaccagaaatcttcatccctaaaatatacaaaaccgttcactcaaggtccctaggcaatatatatgggtggttttgctgacgtggcattctagtcagaaaaaaaaattaaaaagtacgtggggcccacatgtcagcagcacattgtttctctttttcttctccttctcctcttttctctcttctctctttctaaactttagtgagggaggccggcggtaggcggagaagcgcgcgcggatgcaagtggtgcagcggaggacgagcgcggcagcggagcggccgcgggcgcgagcgaggcgggccgagcagtggagtgcgagcgcagcggcgggcaaagaagcggagggcgagcgtggcgacggagcggcgatgggcgagcgcggcggcgggtggagcggcggagtgcgagccaggatgcgggtggcgcaacggagggcgagcgcggcagcggagcggcggcgggccgagcagtggagcgcgagcgcgacagcgggcagagaagcggagggcgagcgcggtggcagagcggcaatgggcgagcacgcggcgacccttctgccgccagcgacgactacgaggaagacccctcccagccttccctccttcctccttgagctccctcgcaccggcgccggtgctaggggcggaaagctgacagtgctggccgtcgtggttagctcgcttgccgcagcaacgctggtccgggcactaactggctgatgcttctgcggatcgatgccctggctcaagagcttgagcttgatgcgcgtgttccacctgcaaaaccaatcaatcagcaccaagaacacaagaagagctaaccgaagcagatggcaacatgttgaaatttgttttgcttacttgttcccgagagggcgtggagcctgatggtgagctcgtcgtcgtcgtcggtgaagttgccgcgcttgaggtcggggctgaggtagttcatctagtggaggcagcagctctttttggcagcggagtagccccaccgctttggggagggagagagggttgaccgggagctccgctcgccggcgggcggtgacgggacctgtggtcgagcacccggcgcgttcgaacatctccgccgccgagctcgccgtcgagccggccgccacctttcctcctctcccgccgctgccatcgggcggaccgcctctctctccctctcccgctgccgccgtccccgctccgccgccggccacctctctccccctctgtcgccgcgcctgctcgagagaactcggagagaagagaagagaagagagaaaaaaaagagaaatgtggaacccacaacattgtctcacttactcgtgggccccacatattaattttaattttttttgctgactaggatgccacgtcaataaaaccacccatatatactatctagggaccttgagtgaacggttttgtatagtttaggggtggagatttctggttttgtggttaaggtacctcgaaaaatctcggtgtaaagttgagggatgaccagtgaacttattccagtttctaatggcccagatgaatgggccggtcaaagtgggccgtatcgatgggggagttttttttttggaataagttcaccagaggtctttcaatttaacagcgagattttttttaagatcacttaactacaaaaccagaaatgtttacccctaaactcacacaaaccgtgcacacaaggtcctatggcagtatacatagttggtttcgctgatgtgtcatcctagtcagaaaaaaattaaaaaaatatatataagacccacatatcaactgcacatatttttttttcttgtcttttcttttctctcttatctcttctcttattgaggcctgcgctggcggagagccggcgggcgagcgcgacggcgggcagagcagtggagggcgagcgagcgcggcaggcgggctgcggctgttggcgccccgtttccttctattttcttcctgaatgccgtcggtcggaatgggtgggtgaggaggccgactattgctgttgctggcgcccgtgccgcccaactccggcagcgcccgagggaggggacggctggatccgcgcacagtggcccgccccctcagccaccgccgctctcgaggacagaggagctcctcagccgcatccacctccgcacaacagcaagggcatcaactaccagatcctctctccaacctaaccgtgttctcaccggcagccgcgagacgcctgagaggaggaaggccatgcaggctgcgattctatgtgcgcgtgcttgctctgcccatgcaactgtggggttcctatggccactgtatctttttttcctctcatcaggatggcgagctgagcttggcaaaccccatgcaggaatagaatttagcttcttgtttttatgtttgctcttctcctttccggttaattgtgggtgagagggagctcaaggtggaggaagacaagaaccagttgcccatggtggtggtagcagcagcgagtcgacgcccgtcggcgcactggccactgcattcggggtaaggccgcatcgtgtggtccgcgtccaggagcaaggaccgacacaacaaggtgtgcacgaacgtctccgaggtcgcctacgccgtccgccgcgctcacccgccgtccgctccgccagcagccagccgctgctccgctgccaggctcccccatcgccgcttcgcccgctgccggcctggagaagagagaagagaaaagaagagaggaaaagaaaaaaaagatatgcagctgatatgtgggcctcacgtaattattttttctgactaggataccacgtcagcgaaactacccatatatactgctatagaaccttgtgtgcacggtttatatgagtttaggggtaaatatttctggttttatagttaagggaccttaaaaaatctcgctgttaagttgagggacctccggtgtacttatttcttttttttcttcttcttcttctcttagctgttttctttttccttccggaaaagggtactcccatatgcttagagaaaaaatacatctcaaaatttgttgcagtatctactactagttaggtacaatggctgaaagtaagcttgctcgaacactcgaatagtactcctgatattcgcaactagcatatatactactaaaatacaagtcttctatttattaataaataatatcgttgacttttggacatatatttgattattcgttttatttaaaaatttcacataaatgtataagatataaatcattcttgaagtacttttaatgataaaacaactcgcaataaaacaaatattagttatgtaattttttaaaataagatgaatggttaaatatcattcctaattaaaatagcgaagctaacgtagctcaatgggttggttttccggtagaaccaacccacccgaatctagtcctatatctgacacttatggtcgtatttacgattcacctgtcgataatgaggttaaacgcgcttgtgtttgtatcgtatttctcaaacagaaagtaagtgaaatattctgctatttagccagcatggcaagtaacaagttcaagttctcattaacaacatatcctctgtccatacagttttgatccaacgatggcgacgccatctttggtttgctctcaacgagtctgtagtgtacacgtaaagtttgttatggcttttgtctggcacggcccaggtgaatgatcattaggagagcttgaaaagaggagagccattcaccaactgatcactcaacgccgccccggtgtttcttctgcaaaaggaggagagacgttcacgctctctcccctccaccattgtgtctcgctatcgaccttctcttgtacgctcaagctacacgtcttttcatcagcctagtgacatacaatcgccatactgattaatgaaacgttgtgcgtcacatgaaattgagagggtgtgttctcaactaagttatcctaatttttagttttcggttaaatggtatgtttattctcaacagttaaacggtgtgttttctttataaaagttgttttcataaagtcatataattttttttaaaaaaatatatcttttatttaattaatcatatgttaatctgttgttcatttttttcatgctaggagaagtgttcccaacccaaaacaaatgcatggtgagaatttcaatgtttaaggtggcaaatactaattccgtttcaaaatactcctataactgtaagcatatatattttcatgttttctaaacttttgaaaaaaaagcatagacatgcttatattttagaatataaagataataattaactgggcgcagagttcccaagactcaagtctcgtgttgtcacctgtcagaaggcgagatactctggttgttgttacggataaaatataaattttagagttaatttcgaggttttcttcgtagtttaaattttttagaaaattcaaaaaaatctattgataaacactcaatttaataaagactttatcctagaaacatcattgttgttatggttctagctgttcagattcgtaaatatagaatactccctccgtcaaaaaaaaagacaaaccatgggtttccgtgtgcaacgtttgaatgtccgtcttatataaattttttttataattagtattttcattattgttagacgataaaacatgattaatactttatgcgtgacttatcttttaattttttttcataatttttttaaataaaacggacgatcaaatgttggacacggaaactagggttagccttttttttcggagggagtatttcacatcggtattaagtttgctgttcactgggctccacagtcctttggacccacatgtcagtgaagaggatcccaattgtgttatattagggcggagggagtcctaataacacgcgcgacgacaccgcgcatcacatcaccgatcggcatcatgagccatggattttggtgtaacccccgcgcccccgcccccgtgctccgtagtggaatagagtaacatgctcggagacggacacacgatgggatcgcccgccgcccgccgcccgccgggcccccgtatcatctgccatccgcgcccgccacattcaccgcttcgctcggcccgcccgcgcggtcgtcgctgcacgccgagcccaacaaacaaaccgaattagcaaagcgccaccacaagcagcatgggttttccatgcatctgtccatccaccgatcgatcgatgaatcgatccacacgcatgtgtcgtcgttcgtcgacgaggcggatcacgtatgagctcgggggcttttattccctccgatccacggctgatcggttggtggggttggctggctgcttgctgctgcctgctggtcgtcgcatcggctggtggtggttggccgcccggtcggtctaacccaacccaacccaactcacatctctctcaggtcagagatacagggcatgttcactttcgtgccaaaaaaatcttaccaaattctaaaattttggcaggatttcttatatagttaccaaaatttggtagcaaactaaatatagccattttttagcaactttactaaaatttcataaggttaaaaatgacatcaaagtgaacaggcccgtagatgcactagtgcttttctcttttttttcattcgttttttttattttgtttgaaaccaaactttttttaacgatggatggaaaggcggtgggcatgattatggggtaaaaaccgagcaatggagcaagcaaaaaatagatgaaagcaaaagaggcaggctaaacaagacaatggggggtaaagtagtaaagaggggacaggagtaaagcactaaaacgttgttggggggtgggggtggggggaagggggttgttaattttcacaaaactatatgagattagtagaggtagttaaagcgggaacgtattatatacacacaaatttttcaatgtacactttatacaaaccaactagtaaatatcacaaaaaatatataaaaaattggatacatactttcagtagtattatacctatgtgtgaaatgttatctttaaatttattatactttcaatattataccatactatgccaacttgaatatccaattaactgcgtattttgactgtgtatagattcaacgtggttatccttctttactgctcttaatttgttatttcccgcgacagtggcatgtgtgagtgtgactaaggagaaaagtccggtttggtggatttcttattataagcttggtaaggaaaagtccagatccaacataccgcatttaaagtttgttaaaaaacaaacaaaaacatggatagatcacacacgaattctcagttattccatgcagatacatgaatgagttgctgttttgtttttccatactcataacattacacaatgttacaaaatttagaggcgacgtcctaaggtctttagtgtcttaattacacgtgcttttaagctttattgattttctttaccggaatttttgccctttacttgtcattttcacaacaccaacatacataccatgttaatagaacataaatagatcttctaaaacttactagcttttcagagggctaacatgtggaccccatagctcactatatttcatatgaaactttctatataaaaattgctttaaaatattagataaatctatttttcgtgtttgtaatgattaaaattcaattaatcatgcactagtggctttttccgcacttaactttatcttcatatttagtagaaataaataccacctaagtttactatagttgtctactatagtcttttgattccgtcaacattgcgcgggtattttaactaacaacgccttatttttctataccttttactatgtcttacactatatgagaaatgctataggcactactagagaaatgcctttctggtgccagttgccaaccacacataagtgccggatttggcaaccgacacatcgcaggtgggacttttgagttctctcaaaggtgtcggcttcaagaatcggcacatttgaggtgtatggatcacaaaaaaagagtacggctcggctccgctcaattcgagccgatgcctgcaaaccaaaaaagaaatcgaaaaatctaaaaaaaacatcggttcttgttcatcacaaacaaaaatcatcaacaaacaaaaatccaccgcaatcataatcataaacaaaatccgtcgctgcttgtggggagtccgccgccgccgacgggagaccaccgctgacgtcgtcccggtcgccgccgacccccctccccggccgccgccgaccctcccgccggatctagcggaggggagggcgccggccgctgctgccgcctccgccggctagccaccgtccgcgggagagaagggagggagagagagaagggaaggagacagagaggagagcgagagagagggaggagacgagagagaggagattgaaacttatctccttgtcgcctcgtcatggtggggcccgccggtcggctcatctaattactggctcggctcgatgacacctatattataggtgtcggtttttaatgaaccgatacctataatatattaaaggtactttttttttaaaaaggcacctatagaataggtgtcggtttttatttagtgccggcaccgataattgtttaaaggcgtcgttttattgcgatttcaacccacgaaagtgggaaaagatctataggtgtcggtttcagcacttccaagacctacttgatgctttgtagtagtgagggatgcatttggtcaattgatttacacataaattatggagataatgtgttaccgctggttagcatgaccctttgtcgtatcagcaagctactattgcgaaagatcttgtttccatatctttataaaaaaatataaatacataaacatgcaataataatcacatggaatatcaaaacatctcgcggtagtccatagaaaacctaaccttacacaaaagaaaaacaaaagaaaagacccccaaaaagcaattaaattttcttttaaacaacaacagaaccttagacaaaagaaaaacaaaagagaaacccaaaaagcaattaatttttcttttaaacaacaacaaaagaaaagaattaaagaggcctgcgagaaagaaaaagagaggagagagggttgagaaaagagaaaaaaaaggaggcacgcggccagggacggtggcggtggtggcgagtgggcagcgtcgtgggcggtggcagcacaaacaagcaaaccttcccaattaactcctcccccca

SEQ ID NO: 77625 - DNA, 673 bp, Oryza sativa
aaatgtaggtgcattattttaatctggtatagatttacatgagaaatagctaacatcatcatgttgaaatgtacaagtaacaattctacacggctatgtaccaaagtgaacctgaaaggtctccgtataattctcagtctatcaaaaagtacgtcaggtatgtctgctacaacagtagcaggtttttatctcgttattgatatctacgaccagcttccatgaaatctaatgcttggccttggcccgtgtttcccatttccaatccattagggcttctaaaggacccgttcggcagagagttagggcgatccacggacgtgggttgcgcgttgttctccagctgatcagggttgagaatgtgccgggcgtatgcgtgaggccataatcctgtcatcgaaaatttgaacaatgtaaagccgtcagaaacattaggagagacagatatctgaagctcgagaatatacaaaattacagtacaacttcagatatttcgtacagaacatggtattatcaatcacgcgatgcccaggaaattggccataaaaatttcaggtcagcgtattacagtacgaaagatatgtcaaaatacagtatcaaattgtactactcaaaatgaccctttgggggtgattttcatctctgcaataatcatgaagaaaagtagtctgaacta

SEQ ID NO: 77626 - DNA, 739 bp, Oryza sativa
tcttcaggaatcaatatcaggaggaatatgtctggcacggttcgagtttgcatgatttgagagttttgaacggttgcaaaggagaatgtcctttgcaaaaaaaatgctcgaacctggaatatgatggcaaccgaaccgatggttggcacagcggtactaaggctttcagcgcaaagtttggattttgattaaaattgaaaatgatatgattgaaaagttatgtgtgcatgacaggttaatgtgatggaaaagaactgaagtttgaagtttggatccaaattttaaatctaaacacagcctaacacatggtgtttgacttgtcgtgagcaaccgggcagccggcgcgacccgaccctgacagacaggtaagcgacgtgagatcaggctcagcagcgaaccagcaccacggatgtgagatcacgtgaggatgatccgaggccgctgcccgcgggcgcgccggccaaaccaccccaaccaggcacaggcagaggatgggcgaagcagcgaacgctgcggaatcacggcagggcggggacgcagtcacgcagccgcacgcggtagctgtcggctcggtgactctacggtgcgcgcgggcggcaacgaggcggccgcgtgccaaccccccacaatgcactcgttgcacctccgcccgtgcgtgcgtgcgagattcttttgttcgttacgggtggacgagggagaccggcggcggaagggcatgccttctccgcgccgttggaaa

SEQ ID NO: 77627 - DNA, 1496 bp, Oryza sativa
aaataatacgtgaataaaacttttatatacgtgttcttagtgatctaaaagcaaatgctgaaaaataaactttgataaagaaactttaaaatcaccttcaaattttaaggttgaaaattcaattttgatgataaggataagtgtaagcgaaaagatgaggcgcttcttctcccttcatctcaaaatataagacgaataaccttttcacaatgtctcataacatatggtatatacacgtataattaactagcacatccctctactgtaaatttgtttttttaatcctttagtacctttgataccattaggtgattttttttttaaatccttcactcttaatatttctaataccattgggtgcttgagccttgaggtgaccaaagcgaagaaatgataataattctcttatggtatttgtgtttagagctttatattttgagattgagaaaatatttggatttgccacaagtttaccgtgcaaataatgtactatcgtactataaatcatgtagagaatcaacgtgacttgcacaaatgcaacttatttcatcatccgttaacaagttcaatgagataaacgtgtccgaatgtaagtggtcaatcttacataatcgacgagataggatagtgtactccgtttcatttcataaatcattttgacttttttctaataaaaatttttaaagtttgattgagtttatagataaagtagcatttccaacacagaacaaacatattaccaatgtatattcattgaatctaatttagtgttctcaatgttactaaatttatctataaatttaataaaacttaaaatgctaaactaaaaaagtcaaaataacttataatattaaagtagtacatgatacgacctacgcgcaaatcgcatgcaaattttgaagtcacggggcaggcctatctgatcacgtgagtgggaagctgtagctgcaaatataacacaataacggcccaaacctcctgtgtggcaaactgtgtcgacccgaaataaatcagaaacaaaacttgacaacgccacagaaggaatacaggagtgatgacactccaaatggtctattgtacatgtggttaaaagaacagaaaaatcatacgcattagattgcactatgacctggacctacaacaataaataggtctgcttcatctttaacccttacagataaaaacatgacttctaaaattgtacaattgatgaagtcagaggaaatatgggacagcagtcctcggtcctcgcatctggttattctcctctgtctctgtgaagaatttgacctctctttcctgatgttttagacaaaggatataaaagatcagaatcagtgcgagcttagagctcatgaaacaaatcagatacttcacagcagtatttgcaaaagaagacatgttaacatattcagatcaactaatgcaagagtcagaccacagataagataacaatttcacactagtagcaagaaatcttccagtacttgtagatg

SEQ ID NO: 77628 - DNA, 750 bp, Oryza sativa
ttatgctacaaggaaaattcgtcttaagatggagattggtaaatatgtgatccaaatttcagcatgcaatatgttcagattgtcaaaacttggtggtacatttggctacaaaggaacgcaaagatcttcagaggagaagaaccggacatgcaaaggacttcacaccagatcatccaagatattcaagaaagcttattttgtctttcaactatatgtttagtttgttaactaatcacatagttgggggctacacctaattaggtgcatctattcgatgcaccatattctttatcttttcgccctttacagtccactcggcagattttggcttgaagagtttgaagtactcggattatcatctttgagaaggctatgatggtcgactgcaaaggactcgggggctactgtggagattatgggtatcccatatctacacggcgatggtattcgaactgggtacaggatacctaatgtagatagaatatcttatctgtatctcgggtttgtttcttaacttgtgtatcaaggaaacacccagagacttagtcggttacgactgtattttatctgtatcttcatattccgttaggaatatagattatcttttgtaatccggactccttcccatatataaggggggtccgggcgcctctaggggcatatgctgattttttcccgaatcatacaatcaataatacactccgcggattcatccccggacaggagtagggtattacttcttttataaga

SEQ ID NO: 77629 - DNA, 16370 bp, Oryza sativa
  unsure (1)..(16370): unsure at all n locations
gaggtatagttctattagtgtatgaaatatcttatgggcataactaagtatattaattaattagttggtgtgtgatttggatcgatctcttgtacatatatgcatgtgcatttgggtagtctttgattcaaaggatatagtaattaatgtaaacgtagattacaattgatttgggggtgcaacgggatgcatggttaattaattagtcagttaattactgtaattaatccaatttgggagagaggttggtcgacacagttgctgcagtgtcttgaccattagctttggatgtgaatgggctgtacatgtgactgttaatctgttaaatatacggtccaattggaacaaactgtgtcggcctgtacataatcaattaatggaataattaagttggtgatgcatattttagtttttgttacacccacaaaaaaaggctcaattaaacaatcaacacgttggttggatgaaaacattgataatatatatatgtcaatttggacaaatatatacgtcgccccatagcgacttttcatggatgtcggctctcaaaacactcgcagctaattcgtcaacccaaacaactcatttttcatccatgaacagttttaaacacctccttggagatctataaaacaaatatatattttcgaacatccaaatgataagacaataaagatgttgcttggcaacggtatgataagtgatcacaaacaaatttatatgtaggttaattatgcgccgtgcaataatattaacaatttaattactaccttactttgataatatttacttattgtttccattgaaaatgtgatccgattgagcgtgtgactgcaacagctagacggtactagctgactagtcgacccttgtatattttgcggcccttaattagcaaaacaaattaagaaattaatttatgatagtggcctctgtacccaacaatactgtcgatcgatggaaccctatgtactaaatcaatgctacaattatatcgtcttaggaagaaggtgtatatcatatctaatcaaaactagtgctgtagatcgactactatagaatgagaaatagctccaaccattttcaacctatatgtatacttctcaagcttgtaattttggagtcgcattgatattttttaaagatatattgacgttggataaatgtgaatcatatgtgtctagattaaaatgattttatagtattataattaatttattccggttatgtacctctattgcaacagaaattaagtcgtttgtatatattgattttcaaatttcaaagcatcatgttttcaagaccagagagatatcatatatatacatcaactgatcgtgtaatccctaacaaaagctagaaattaattgagcttcctccttagttgatgtgcttattattattatttttgaaacacgttgcgctcttataaacgtgtgcacgctcaatctatgaatacacacatgcataccctatatatccttatgaacacatccaaaaactaggttggcatcttaagattcacaaagttacaatgggcatctcgtcgttgatagatacgttgtctagctaccactgaaagaataattagtcgtaaatgcgcgcgcacctataccaagtctaggattaggacttgaatccggctagataggttccaccaccaggaaccgaatcaattgagagctgattacttcgtgatgtgctaattaattttgttccatcataatatatatttcttaaaacaaaacatgatggagaaaatttcaacatgaatttcatgtacatgcttttttttaatgtttggagaatataatagtcaaagagatattaggatacagtaagttcttgtttaactgatcgatctaaatccggtacaatgtataaataaatacccacaaggcttaatattgtatcttacataagtggtgaagaagccaacgacactttcaaacccaaatgactaatactccctccatttatttttgataggcatatttccaaatctgaaaaaattatttttgataggtatatttcatccaacaacttatcatcttaataactttctcgaatttaatacatgactctctattcttccacacaagattagctacataggcattgaaaaatgtaaatattaataaatcgcttgtttacgaggaatgactagtagcatgtttaaatagatgataagtataattatttatctttggtctgtgtgccaatataaaatgaatagcatttatcgatggtcaatcagtttaatttcacggaaatcgatgccaatcggtagcggcggagcccagcccgtcggccacctggcttgcataggagctggcttcaccactgtccagtactccacggtattatctcctttccaatcttacacatatataccctttttgttgtagaacttgtgtgagtacgaatttaattgattgatttaaccatatcaaggtagatctaccaaattgtgtactactgctgaaaaggcccagtgacaatggattaaaggctttaaagctgtccaagatgcaatttttgtgggtagccctaagcttaagtgaaggcaggaaaagtgacagcacaaaagataaaaactaaagcaaaagatgatcaaggagagggtcgacatgcacgtgaatgtgtgtgttcggttgtttctgaatggctgcgtagatcgagcagaactaagcactattgtgtcctatactactatgtgtacgtaattaattaaaaattaaatcagctggctagctctcttgttcttggagatgtgtctctaagataagagcaggtacaataacaggctataagccagctataaccacatatcgatatcgagaagaaaaaataagagagagaagaaaacgggctacaaatttatagccggctgcaacacagactccaatacgttatgagtgtatgagaggtaggaccggatattaatgatgtagaatatttttataggtaactattgtatgaatgggctatagatgatttggagccagcggttggctatactattgaacttgcttaatcagctgggatcgatgatctcgtacacgaggctcgatcgtacttactatatatatatatattaattgcttgttacagtaattaacaagctagctagctnaaccgttttagggaaagngtttaatccattgggcgaaaccaatccaattaagcaatggatatgatgcaattggtcgaattgttgatcagctaacataactactgggttcatttatctttatgggcgaatcaaattaattagttggtgtacatgttcaattatgcgtctgactagatattattatggtaaccttgtttacgggtgtacttcctctctaaaaatttccaagatataattctttatgttttatacttttactagaaaaatgcccgtgcgttgcaacgggtgaagtctattttaatcttattattgttatatggtttagttaagatgaaattcactgtaagaattcgtttggatatatatatttttagaaaatcatgagctgcaattaggagtctgatcatctcaagttagcatgtgagttttttaaaaacaaatttcttatatgattccttctgtattaccaaaagtgaacaatcttgaaaactgactcaaatacgaatatgtatttctaaaagcaaacgaacttaaaactgactcatacacgaatgacgtaccaaaataccggcaaaaacatcttcaatttttataatagtatagatgtaagtctttaaaaattaataatgtgaaagctttgggtaggatgaaccttctcttttcagataatagaaatagtttatatctcttgcctctatcaacaggacacatgaccaacgagtctaagaaaagagataaacaaaaagactcgaggttatgagacaaatccacacatctcctgtccaataatatttaactaaaataccgaatagaaaacacatatagtctgtaatgttattttacagtaactacgccattcaaagtgaaataaaagacttttggctattgattttaagactttacctctattgtgtacattatcctgctcctatcgtgaaagcatcaagaattaagaatgcagttagctaaaagacatgaaaataacctacattagttagacaattttttgttattgaaaactactatatcatcgcgacaatgccaaattcaacagtataaagcattagttccaaacaaaatcagttttttaacggatctaggtactcccataagccaattaccaaaaagtatttttagcatttcggggaggagaaatgttgaaagaacaaaaagaaacatcgccaatcttaccgtgcgacatggcaatgaaagaaaaaaaaattgttgtatggtttgattttcatggcaaacttggctacatcattttaatacaataaaactatattgtaaacctggttataattaacgtaagactaactcggatgataaaatggttcctatattctggtaaatgcatgggtcatcttctcccttaatcagtgcaagataattgggaaaaatgatggtttgtgtcagtaaatttgtgctaagcttcgaggtgaacgatcgatgagtaccaaaatttacacagcgaatcttttgaccaaactttagctcaaaattggtgaaatgcatgaatacacgaaaggacaagtgggtgatattgaagacggtgtcacgtccaaattaaaatgctgaatgcggacgaatatatatagagcctaaatatatcctaatcccttcacagaaattaagaaagtaagtgaaattaaatggtgcaacatttgtgactgtttgagaaagaaaatagatagagaaattaaatagaaaatagttgtaattgcttaagatgaggggtagatggagaatagctatatattaaaataaaattgaactaaaaatatatatattttgagacgaaagaaatagcatatatcataactaatttaaaagtttcataacgtactctctgaatgaacctccaccaaagaaaatttatgtccaatacttttgttgttaaacgtcatatcatagtatgtatttgctgggccagctaactgtggaatggcatatatggtgccataaatgtggaacagtgtagaattaagccctaagctagccactgctgaaaaaaattgattttgccttcaatctggttaactttcttttactataagtaacttggttgatagtgttttaggtcatttccaacccaatgattaggatggtgtcgccatctaaaatgaaagatgatgtggcaagtgagtaaatgaggaaagagaaggaaaccaggtcttgcatgagacatggtttctacataacattctaggcatcatgtgagataaatagcattaaatttaagtatgaaaaagtggtgtttgtattgaaagagtagtgtctagtactagtttcttaatgatgtggagtttatgaaaactatgtctagtgtcttgggttgggactggccttagaccaccgctgtcttctatcagtcactaattttggatcacattagtctcttctacctgtcactaattttgtactgctaaataagttcaatcacaaaatttttttggctaaatagtgtaaatgtttcagctaagtactgtacattagttgtgatatttttcatgtagacttttcaaaagaacaagccataagcacctaattaatcaagtgcatgcagttcgacctgacaaaactataaaatcacactataattatcatggagacacactctaatcaaatcatgttccctcaaatgttcatttgccatctgcatttggggatagccttaaactgcattgtctgtacaaagattcaattccacaaatatctttaattaaccacggatgttagaactagcattgtttggaaatctagtaggctgctataaacggttgtataccaggtaatatagtactcctacttcagtacatggcagaggaaaaaaaagtttgattagacagtcattggcatcctttgattcttttctgtgcatagacaaaaaaaaacatcactcaaactgaaaaaaactgttgcttctacaagagcaatttaaccaagaaaccagtagcagttgtggaagtcagttagtacactatacactggctaccacagcataaaggttgaagagatctagggacagttacacagctgcctttgcctgtcctcattgttttttttttcctaggttcatgttttctttgcttgctttgctgagttctgttcccaatggttgctgctccagttcacagcttgactatatctggcaagtggcaaagtaggttaggatgataaagttcagtcagagtagtgcttactagaataaataatgttggtgaggttgtgcagtatgtgatcactgtggttagaggaaatcttgggtatgtgtgtcttgggttggttacttggttggcatggctggattgttggctgacaagtgtaattttagtttctgaaaaggaaaactggagcatcaaaatatatatttttggaacttcggtagtagtttggtagaaattagagaatctatttgttacacaaatagaatgaaaagaaaacatatttttgtttaatgttggacgcctaagctaatcatggtatatgttcatgactaatcaactcacggtcatatgaaattgtgtcgacatcggtaaactagtcaaaacaacgtattatccatccatacacagttataaaacagggacattgtgatggctttcatcctctgagcaacaaattatggctagcccaagcgccacaatgtgaaaaacaaaccaaaaaacacacaaacgatacaaaaacttacgcaggtttatttagttgcaaattaagaagaatgggcctacctgaaagggtccatatgatcaatgctctggtgatgttttataggggcagccgttgtgcaatggtacatcatgaacagtgtttcgtgttgaatgctgcgcagagtggctggccacggaagatccaaggacggatggcgattgaattaattttaataatcaatgatactagtagtaacatctacttactgaagttttggaaaaattaccacaagggctttctttgtgtcacgaaagcttcctctcattggccagctccagctgctgcctctcctctcttcctgccttggattcagcagcagcttacctgcatatatacacatagaggtagagagatagatggtcagatagattgagctaagcacacacacacactgcatcagtaccttggtttggttgatttctctgagtttgtgttcttggcatcatcatcattattagccatgagaagtgtaggtggcttggtgttctgaattagtttcagtgttctctttgcacttccatgtgttgcacttgcatcagctatagttccaagaaattgtgtttttgatgatataggcttctctgtctccatttctgcatatgtagtttgctttcttgggctgtggtttcaaacttccaagcttttcttccctctcatggaagaattttccgttcttgcaggcagctctgagcttccaagatcacggccatgggcttcaggcgatcaccggccgtggcggcaatggcggcgccgccgctcacgcattgccatggtgggctggagccggagccggagctggatcccaaacactgcttggaacaggaggaggagaagaatcattctgccaattaagcaacacaatcatggaggacacccgaatcctgcaaaaccaccaccaccagatcctcgccgccggccggcagctgcagcagcgccaccacttcccggcaatgccgccggagcgacaccaccaccctcctcctccagctcctggaagccctgccatgaagttcccaatcatctcaggtgagtcccaagaacttgtccaagatttgtagtaagatgatcattggaggtgtgtctcgttcatggcgcattcacgccgtcgcggtggcgccgctgtcctcccatggtggagatggtgtaccggccggccattccgggtgttggccgccggccatttcggttaattactgcggtgcagtgaagaaaagattgtagatatgatgctgtggtcctgaaaactttcatggtccaagtcctaggaaactttaaatgatgatgattttggggtcactgattctgtgaaggaggtgaggttgttgttgccacagttattaagaggtgtttctgctcctaatcatctttttgtttcttttcaagagtaagcaagtagtactgggcacataggagattatttactgtcgagtaggaaagctgcccaatgtcatgcagctttacaactgaagaaaactgaaaaagaaaaaggagagatgttaccactggaaatctggtagtaccagcacacagaaagggtgggcctggatgaactgagttacaaaacttgggaaaaagaagtgttttattttaaactatgttttgaagggggtacagattagaacattattttagtgttaattaatttgttttgtggaaatctatgtacttgttggaatgttcattactggcagatagtatggccatagttttgcaagaatggaatcaggctcccctctaaaggctttggactgaaccagtgcattttattcccttttataaaagtggaactgaaagtcttttgggagactgaacaagggaaaaagctttagagcaaatgacatcactcttatcagaaaaggatctaatgcttcaaatgttttaataggcagcactactctcttctgtattctagatgagattccaaaaacattcttaattgttattccctggttggaatcttccctgcccactaattcccccagcagaacatagtcagacaagatactttgataaaaataaaaaaatatattgtcaagtactaagaaatatccatgatgacaaaatacctctgtggttttcaggtgactctgatcttggcaaagatctgaagttccatgagtcctccgcgccgaccatcgccgcgtactcgccattgcaggagtaccaaggacactttgagctagcccttggccactccatggtgagaattctcttacccaattcaagatttactccagaaactgaatctcaaaaacatctttggttgaaccagctaactgtttgtttctgcaactctgaaggtttgcaccaacttctgcaactctgaacaaagctatggtgtttactccccctatggagctcaaaccatggtatatatgttcttcagttcttgtcttcttgatctctgaacatctctgtccaaatccatgtgtaaacttcagttcagattcagcatcagtatgccatgccattttgacaagaatctgaagaagtttcagatgcttactgtgaatattttctctgaatgttttgtgtgcttcaaaggctgggaggatgctgctgccgccggcgatcgccaccgacgtgggtccgatctacgtcaacgcgaagcagttcaacggcatcatccggcggcggctggcgcgcgccaaggcggagcgggagcaccgggtttcccggagccggaaggtaagacggcggcgacggcgacggcggcggcgagtgctcgtcgtcgtctccttcccttgtcaattcgccggcgaacaggcagtgacagtgactgactcgtcttcttcttcttcttcttcttcttcggcgacggcgcagccgtacctccacgagtcgcgccaccgccacgccatgcgccgcgcgcggggcagcggcggccgcttcctcaacaccaagaacgcctcctccgccgccgccgcggccgccgacgcggcgccggtgagctccggtggcggcgaccacggggcgagcaacaagagctcgtcggcgtcggaggcgacgcgcgtgtacgacgacgacgacgacatgggcgcgggcggcggcggcgacggcggcgacttccaccacgcgatgggtcacctccgctcgccggcgttcttcccgtcgctggccgcgatgatggacggcggcggcggcggcggcgaggggaagtgggcgaccgcgacgcctcaccatggctgccgcgtcgacctcctcaaggtgtgaccgccgccgctggccgtcgccggcgaacctcgccggcgccggtggcaattcatccttggctgtagtagtagtagtagtagtagactagtagtgtatgcgcaatggaaatcaatttcatgcaactgatgcaaactgcttctcagttgctcatgtaaaaaggactagaatttgattttattttgatgcagatttgtttaaatctaggctctcattttgtgtgtcctttgatttttgatgtctagtttgatcttggtgcttagatgactaggtttattaaggtgttaacactgttttaaaaacaatcagagtttgctgacaatgattgtgttgtagaattagttgcaagtcatggaaatcttatttcatagactaaattttatttgggtacaacatttttgtagttaataacattacttaaaagttgaaacaacataacatttttgtagttaatagcattacttcaaagtacagtaatccagtctccataaatcttcataagtgatgaatcagaacaaagtcttgcagatggtaaactgccaggttttccatttgagcaactgaaagaattctcatattatagaaatgcaataaacagcagggcaaagctgaagcatcatccatctataatttctcaggaaacagctgctcttccttgtttgaaaaaaaaaagcaacaagcaacaatcagtgataccaaagcagccaagcaatcttacaaaaacctcaagaattcagaaggtttggttcttgcagctcgtcattcagaaggttaattgttagggagactatatcagggagatgagaaaaaccacctagcaagtagaaaccaagacaagtcatggaaatcttgtatcacagaccggattttattgagagttgaacatttatattagttaatagcattactgcaaagtgaggtacagtaatccagtccccataaatcttcatatcagatgaataagaacagagtagatgcacagtagatgatgaatggagggctgcagatggtaactactaccaagttttacatctgataaagctgaaattctgataacattgaaacacaataaacagcaggacaatagggcatgctgaaggatcatccatctgtaatttctcaggttagtcttctcccttgtttgactacaagcaacaatcagtgataccaaagtagtcgatcaatctgacaagaacataaaacacacactcggtttggttattttgcagctcatcattcagaaggtgaatggttagggagactatattacagagaagcaaaaatcaccttgcaaggaaaaaccaagacaatatacgagtatatgaccatatattctgaattagtctaggcatgtctgtaatctgctggttgctttagcctacacaacaaaaacctactagaccatggaaattttattaatttggacaaacaggagaaatactcgagtcaacatagcgagatgtaaatgggtccatcccaatttaaaacactcctcagttatctcacgtaatactagcagggtaaatcttggatagttaacaagacaatgtaactaaactttttattgcacaatattccaatcctcagacaaatgaaatactagcctatccatcaagcacaatacctatgacaaatttatactgctgctaacagacagtttccctttttcaccacatgatcagaggcattggtcacattagtaccatataaaggccttgttacacaaatatggccaaaatgaatcctataaaagtttaaccagaaccaggtaaaaaaatgcagtaaaattttcaataatatttaaacatcagattgcagtcacagtattgttcacctgagatttctataaaagaagcatttctgactaaaaaaacgctagcaagttactaccaactaaaaatatcgctatcatttagtacaacaaaagcaattgcgattgaagactaaaacctcacagctagtgtatgtatactatgtccagttctcaatagattttagaacattctgctcatggttcatcacttaggccaaacttatccagcatagcgatttcagtggaactcaaaattaaacaagattagacattgcaatcaccagcagtaattagtaactacccagcagtataaaatcaatgcaacaagagacaacaatccagtacaggcaacctcctcatgggtgtgccaaaacaacataatactagcatcaaaatttcctcagtaaattgcttatcatgtccaacaattattccgtaatcggctttatttcccccacaaagggacccaaaaattagcttgacgaatctatgatatagtagctctgctcatatcaatcacagtaagatcataaactcaattgctaaccaaatttgaaaaaaactgttaagttactcaggaatcagccttttcagtcaccacttctttctcctttctctcgtcaatggtggtggtcggcgaggaagaagacgacgacgacttctcctcaacctgttgtttcttctcgtcggcggcggacgcggcctcctgggccaccgcatctagcttcttctccccgccttcctttgccttgtcggcggcgatggcggcgtcggcgtggtcgttgacggcctgctcggcgcggagcacgggggcgtagtagtccgcgtgcgcgtccatgcacctcttgaggttggcggtgacctcgaagcagcgctccaccatgtcggagccctcctccttccccgccgcctccacgcactcctcccacgccacgaacgcctccttgcatccccctcccttcatgaacaagcagaacccacactccccttcctcctcctcctcctcctcatcttccccttccccctccttctccacatccgccgccaccaccacagcctcctccgccgccgccgccgccaccgttacgacggcgggttcttccgcctctaggtggggcgctgcgatggcgggatcagacgccggagacgccattgccgtgatctggtggtggttacctctgcttctttcttgggaaagaagttggggaggaggaagaagaagaagaagaggaggagtcgcgccgccgcccgccgccgagttggtgtcggagagggattcctcctcctccaccacctccttgggccctaatgggctccaggcccaaccaaagataggcccaattacaatgagcctagttattaggacgtgttgaagaagttcattttacatcccacaattcgaccgtggcaaagatgagggacgtaaataagacttatttagtacggcccattaagaagcggataagagattagtagtagtagcaacgccaccaccgctgctccactcctcgcttctcccgccatcttctcctcctccacggccatggccgccgtcgcgttccgctcgctgctacaccccgccgccgcggccctcaccgagcgtgtgccactgcctcccgctcacctacggctccagggccttcaccgccaccgcgtcggcgtcctcaacctcttcgtcgcctccggtcatcgccgccgcattctgcttcccctcgccgccgccggtggagagttctcttcggaagaggaggagtacgccaacgaggaggaagaagagggggaggagtacgtggaggaggaagaggaagatggggaggaggaggaggcgcggcggtggcggcgcctcgcggatactacccgccgagaagccggccggcgctcgggcaagagcccggccgcctcttcgtcggcaacctcccctacaccatgacctccggcgagatctcccagaccttctccgaggccggcagggtcgacaacgtccaggtttccatgaccaaccaatcaaaaccctcaaaaattttcccccattttctgagttatatcttggtctgaatctgatggtggatctcatactggtgcagataatctatgacaaggtcaccgaccggagccgcggcttcgccttcgtcaccatggccaccgccgaggaggctgccaccgccatccagatgttcaatggggccgtgagtttttttcacacaccaattcaaagcaattctgctccatttcactgaaattgagctattggagtaaatgaagttatgaaatctggtcaattttgtggcattgtggctgtgtgccttatgtgtagctgcttggagggaggactgcaagggtgaactacccggaggtgccgcggggaggggagagggcggtgggatcggcggcggccacaagggagaacaggcgcgatgacggcacattcaagatctatgccgggaacctggggtggggtgtgcgtgccgatgctctgagggcggcgttcgaggggcagcccggcttgcttgatgctagggtcatcttcgagcgcgactccggtcggtccaggggtttcggattcgtctccttcaggactgcagaggatgcacaggctgcattggaggcattggatggagtggtatgtgttgtctaaagttctcaactatctaaatctttcttcttgatggacctgaattagctgatgccaactgatttaatagcataagtgaactactggggtgcaaatgttagcactttagcttccattatggaatgcagcaacaaggttactaaggtttgatttgtgatagtattttgtgctcaaatgatggtcacactgataatttctttgttgcttctttatcccatggatagataataatcatacactatgcaaaactcttatgtttgctaaattcaaaatcatgttctagcatgattggaagcttcatttacaaatcagtggctaacatgattgtatatgatctgcaggaactggaaggaaggccactgaggctcagtatggcggaacagaacccaacagctggttctcctagcacagtgcagtcacaggaggaagaaactgcttcagaatcatctgatgcagagacagagcagagcattacctcagaaccttctgaagctgaaacggaagagagcaacttgcagacagctgccagttattagtatctaattgatggttgcactgatttacttattctgccattcggcattccaatctaaattgtacttgtccaattgaaaattttgacacaagagatgctaaaatgggatatgagccatagccaatagaatattattagacatagaggtgctccgagtttcagttattgctgtaatatattgtgcagaaatctaaagtgcaactgttttgcttcctatatttattcagttaatatgttctctgtgtaatatgaagtaaaatattggattcattaaggtgtacctattacttgaataaattggggtgatacttcgtttctacttttcttcaatttgtttctactttttagaaaaccgttacttctagaatataactaaacttgagtaatccaatgtgactgttatagtagatgtagtggagattcacttccttattaacatttgtagaacatgaacgacactctcatagcaagccaatttggcaattgtcgaagtacaagatctttaaccaagcaaaaaaaaaaaaaaaggtagcaaacatcgttaagtgaatatcaaagtaacaaacgctctgtcatgtcccatcagctattttgaataaacgcaccactctcaagctgtgcatcagcagaagcatccaggtcctgagggaagaagagcctgcaaggtagagaaatgaaagattgagctcaataacatgatctgatgaaaattggagacatgcagagctgtagcatcaaggacaaaattactagtaaaatttagagaaattgactgcattagatgagtacttagaccagacagcaaggcatgacgcacggacagcttacctgcacgtgttgtggtacagagttttacttaagccttcaatgtcagcaattcctttgcatccagctacaacctcaagaacttgcctgggattgatgtatcttcagttattaattttcttggaggaaaaagttaggcgcaagtgtaaagtataaacaaaagaaaaggttgatgaaatcaatttccgttccatcgaaagattcatgattgattatgataagaatttaaattgatttaaaatctgggcaaatgattctgcatctatggaaaatgctaaccaaataaatatctgcaaaacatcatattgaactgccaatggtcagtattttgttagtcaagtaagacatttcaacaagcatgtggtaataacaaaatagtttaatgttctcagaatgatgagcattacttctactgtgtttcctcagaagaaccaagtaaaaggagcatgaaaagcaaataataacttcaggtgttcatgcattgcaggccagtcaaatacttactgaa

SEQ ID NO: 77630 - DNA, 9948 bp, Oryza sativa
aagtgttgtggtactctgagttctataattatcaaggtgcagcacatgcaaatttgtaacatcaaggggtgggaaggagatgacctataaacatcttttcaaaggaaagaagcttatcacggtcctctgcagttccagtgaaggagtgtgtaacacccccagggaatctgcgatggagaaatatggttctcagacttgaaaatatgcaaatacgtcaaagtgattttcagaaagtgagacataaagaaacgtaactaaatcttattgtcagcttctttaattgtgctgatctagaacactggaggagtacaaagcagtactcctcagtagtccttggctccttgcctatatagtattggtatacagattgagtattacctatacagattttctgacacaatctcacagaagtcttcaccagcagcccgcatgtgaagaaacattggcaattttactgcttcagccaattcaaattgcttcttgaagtacctaaacagtataaaattgctcagaaaaatatgtgaataactatcattattcgatgtgtttatgtgagagtatacttcttctgtacatccgatggacaaaagtgaagtcgatcataatccagaccacattctcccactgctacaacctgtaggaattgaaagccatatcagaatattgcaagttttgactccgaaagacagaacaaaagagtaagtaaataactgaactacttatgcaaaagattatatgttcagggaatccaactcagggtatatttataactagatattgttacatagtgagtttgtttgcactttacaacaccattagaaaatgcatactgcaaagaagatagaactctgctgctcaatgattttggtcttctgttaatagtaagaactacagacataattcagtgagtccaattattttcaagcaaaatatatggcaagattgcaataacatttcactacaggacacggcttgggaagtctacaagcagatcaagcactaccacagcagcatttcagcactttcttcttactattcttctggagaatctggaaacactgtaatgggtgatcttcaatagcttacctccctcaagaacaagactgctacgacaatgcatttaagatatctaattcctgaaaaaaacccgatggttgacatgtaattcctatatggaaacaggtactttctgccaccctatatgttctcttactatttgcatggtctttgaaaaagaaatgccaaatatattatatatttaggaggggatccccaggtgaacttaaaagaaacatttcactacatgatagacctgcaggacaagtgatacacacaccttgcctttcgcaattccttccttcgccagagccagcagcgcctggaaatgcccttccgggtctccactctcctcaaactcctaacattcagcaaagcactaattacatgacccaatcgcaaaaggcacccgccaatctcaggtaccagcaatgaaagaggaatggaacacaatccacccctaccccgcatctcgtcgggtgcacgcccaccgtgcagaacagcctccctgcatcgtacaagcacatcacagcttctcaggcacattacaacaaacaccttgaaggcaccaaggagaacatagtcaaaacaacccgcatccaagcagctgagctcaccgtcggtctcggcgatctcgagcgcttccctagactccttcagcgagcctccggtgaccttccgcccggaccaaaccaaagaaagcaagagattaagcacaccaaagccgagccataagaaagtagaaaccaagcaagaaagaaggcgaaagggggaatggccggcagcaaagcagcgtacgatgatgcggtcgacgccggccgcccacgcgcgggcgagcacggcggggatgtcggcggcgtggcattgcttgccgtggtagatgcccctgaacatgccatcttcagttcgttcgcatcgcagcagcaaagagcaagacgcaagtagaaaagcgtgagagccagacagtgagccgagaaaaacgagataagaatcgtgaggagaggaggaggtgggtaccggtgaagttgacggcgatgtctgctcgtcgcggtggcgccggagacggagaagaagatgagaggaggagtagaagaaggccgggtcagtccaggtagaagcatgagagtcgcgagcgagagggaggagagggaggagagagagtagagcactcgccgatgagcttgacgccggtggacgccatcgccgccgccgccgccgccgtcgagatggggagagagtccgaattgggccgaggccggtcttcgtgtttgggcctccaaggctccaactaaccaaacttgagtttcgtctcgttcttttaattttctttaaactagaaaaaatgcccgtacgttgcaacgggtgaagtttattttaatcttattattgttaaatggtttagttaagatgaaatttattgttaaatgcccgtgagttcgcttggatatatattttttttagaaaatcatgagctgcagttaggagtctgatcgtccaccggtttccagcgctccagagcggagtagagcagtttggtagctcacgaggctcataaccttgaggtttttaaacagatttcttatatgattccttctattatcaaaagtgaacgatcttaaaaaccgacccaaatacggatatgtatttccaaaagcaaacgaacttaaaaattgactcatacacggatgacgtaccaaaataccggcaaaaacatattcaaaatttataatagtagagatagagatatacgtgacgagcttcatgatatgcccgtttgagattagtcatctgtgacaggtgccataactaatctcgtttgactcatatgctgggccaaacctatctatgacaggccttatacttagctcgattgagatcactataatccatgccggccaaatacccgattaagataatatctcatatcagtgatctttgcttagtgacggtagcccttcccgacaccgattgagacctatcccatgctagtgaatccagtggctaacagaaggtcgcagcacaatcgaacctctgcgtcgtgactccatggccgtgggataagcagcagccagtcacctcctcatcgcagaagcttgctattgatccgatccgatttatgaaaaaatcggagggagatttttttttttctgaaacaagaaggcatcgagtaatgaactgcaggggaaaagttgatgtttcacatgaactgtaccataaaaatagttttgcaaccaaaaaagctaaaatttgctcaacaattaacccaccttacaacaaaatcacgatcagttccttcaagtaaacaagctcacagccattgcgtacaaggatgaagcatcatgctcaccggaggtcatggactcctaccagggccgatgcagccacctggcctcgtcctccttgtccaatcacgaaaaaagaccgtgtgattaatgaagcaaatatgggcgttgttatatggaggcagtgaaacgcaagagatcagttcgaattgagaaagaggagacgaagagatcgagtcggagaagcgtcccttggagaagcgtgggacgggacggacaggtcaggaagaggtgaagctgacggatcaacgtgcacgcctaccgaccggcggaaccgacgaaactccaaactcctgaatcctgatccgatttggacacacaataactgacaaaaaactacggcaaaaacatcttaaacttttataatagtagagatttaaataaatttatattttgagtttataataattgaaacctaattaatcctacactaatttttttccttttttttttgcttccaaatgttgttcggattcggaattattgagcacttctttataagcagcagcaattgcagtgattgattcgttcaagaacaaaactcttcaaaatccaatcctttttttttatcggatcgactgctgagatggctgtctccggcatccgcatcctgtccaagaaattcacgccgctactgtgcagatcatcggtaagtagttcatgaaatttcttaggctttatgatggcagtgtgacaaacagattaaaccctagtaatctttgatcatcatgatgatgttgattaccaatgcatgttccaacctgccatatgtgactggccagttttccttgtttaatattattagaatttaacttgtggttttcatcttaattatacaggtagcaagaactggcatggccttgactaaaaccaaccacatgagtacaccatttgtggattctcttaatggggctaagagacctttttcatccagttccatcatcgaggaccgtcatttgtttcgtcaatcttggtatccatggcctccagtgccaaagtaagtaaatcatatattactagagcccatgcgctagctctaattgtttttttctctgttgattgtgtgttcattatgttgctcaagtacaaattttgcagtctcataacatttctctctttctatttttttgtgctttgcagtattgaggaagaatttacgagacaatggaggattcgtttccttgctaattttctgttcttagtatattccagtggatttatcgcacacaagcgtaggaatttaactcataagatgaaattaggagctactagctttcaagcattgggagcccctgcctgcccacctgtcctccccagagacagagaagagcttgtaatttaagttttggttgtttgatcaacttgtaagtgttgttagttaagtgttactataatggttgtggatgtgatccgcatgattgatgtcatcatgaatatatgcaacatatgtatgaacttgatgcttattatctcaattaaaatctgtcattatgggtgtgtttggttgcctgtacatagggtggctcgcatccagcgccagcgggatgtggtgcatgtgtttggctgcctgctcgcacgcgcgaaccaggatgcgctgatgcaaaatctgcctcccagccaggctgagggggaacgcccgattccttcgtagctcctcgtccaggctcgacttgtgcagcgcgtggggacgagtggatgcaggcgcgcacgagcgggtgcaggcaacgcgtaggggtcggtcgatcccccatctctcatttgtttctctcgcccatccgattgctcctcgccgctcttcgccctcgtctccatcgtcgtcgccgcccaccatcgtctccaacctcgagatccttaaccctcgccgacttctccacagcctccgtctccgtctctacttcacgggctagaaccggcggcctcgagcacgtcgccactcgccaagtcgccatcggatccagcagatagaggctcgacggaggacgctgctgccatatccaatagagggaggcgtgaaggagctcgctggaggtttcggcgactgcccctctctgcgccaccgcctccaacctcgccggccaccggattcctcctcactggtcacggattccccatcttggctgcatctcttcccttccttcatcagccaaaataccaatggatccggcggccacgagctggacgctgccagatccagcagcctcgggctcatggccaccggatcctgttgctccgacagctccgaacagcagcgcacacacgacggcgaacggcaggtcggggcttcggcggagcggcaggcctagcgacatcaacgaagctcctctcctctctgtttctttttctgtttttttttcttttcttttttcaccgactagcaaaccgtgaccatgaaatgtgggaatataatgatgtttactgtatgcattgctaattatttcacttattttataactttgtgccgtgcagatgtgctggtgtatatatatcctgcttatttgacgattcttaaaataattgttgccacgaatcaatatcaataattaatatagaagataaaatcaaatgtttagtacttagaaatttacactcttcatgagttaaattttagcttatctaaatggtagtccacaagttttaggtggtaatctcaccctttagaaaaagagatacctacccctaccatccatgcaaccaaccaaacgaattctctttcaaactgtatttcttatacgagtaaccaaacaaaatctcgtgtcagcctagctagtctaatgcaaacaaccaaacagctgcatgtgcatcatctcaaccaggccaaactcagcctggatgagagagatgggctaggctaggggaatacgagcaaccaaacgcactatatgtgtttgtgatctcgtatgtatgtttttcttttgagataggtatgctggatgaagagaggcgacaccgggacatgcaactatgtcatcagcttcccttgttgagcgagaaagaaagagcttgtagttttaggttttgcatgtttgatcaactagaaattgttataaactgtggttgttatggtctgcatgattgatgttatcatggcacagagtgcccaaggctgcaactctgttcgtgcaagtataaagtataaacaaaagaaaaggttgatgaaatcaatttccgttccatcgaaagattcatgattaattatgataagaatttaaattgatttagcttaaaatctgggcaaatgattctgcatctatggaaaatgataaccaaataaatatctgcaaaacatcatattgaactgccaatggtcagtattttattagtcaagtaagacatttcaacaagcatgtggtaaaaacaaaatagtttaatgttctcagaatgatgagcattacttctgctgtgtttcctcagaagaaccaagtaaaaggagcatgaaaagcaaataataacttcaggtgttcatgcattgcaggccagtcaaatacttactgaacaattaccttattagagtttacgcataattgtgttgaattacctgactaagcaggcctcattgcgaccttttactgtagaatccggctcgtacttttctttcttcttggatggccagacagactttacgagcttgattccagcatgagtatttttaatatcacagtatggagagtctgtctctatcatcattctctctgcaggaataccttgtagaacctcgaaattttcactagtcttcagagagcatccattaatacatgcattggtacattaagtcagtatggtttacctgacataactgaattataatggaatgagaacgttttaattgctactaatatttttattcacatctaattgcccaaatggaggtcttcaccaaaaaaagaacaaacttgcagcagaaactgaaatgaacttcgactacaaatagaagtgttgtggtactctttaagttctataattatcaagatgcactacatgcaaatatgtaacatcaaggggaggggggagatgacctataaacatcttttcaaaggaaagaagcttatcacggtcctctgaagttccagtgaaggagtgtgtaacaccgccagggaatctgagatagagaaatatggttctcagacttgaaaatatgcagacacgtcaaagtgattttcagaaagtgagacataaagaaacgtaactaatcttattgtcagcatctttagttgtgctgatctagaacactggaggagtataaagcagtactcagtagtccttggctccttgccaatatcattatttgtctttgtggtcattatggtattggtatacagattgagcattacctatgcagattttctgatacaatctcacagaagtcttcaccagcagccctcatgtgaagaaacattggcagttttactgcttcagccaattcaaattgcttcttgaagtacctaaacagcacaaaattgctcagaaaatatgcgaataactatcattcttcgatgtgcttgtgtgagactatacttcttctgtacatccgatggacaaaagtgaagtcgatcataatccagaccacattctcccactgctacaacctgtaggaattgaaacccatatcagaatattgcaagttttgactccaaaagacagaacaaaagagtaagtaaataactgaactatttatgcacaagattatatgttcagggaatccaactcaaggcatatttataactagatagtgagttcgtttgcactttacaacaccactagaataagcatactgcaaagaagatagaactctgctgctcattgagttcggtcttccgttaatattaagaactaaagacataattcagtgagtccaattattttcaagcagattgcaataacatttcactacaggacacggcttgggaagtctacaagcagatcaagcactaccacagcagcattgcagcactttcttcttactattcttctggagaatctggaaacactgtaatgggtgatcttcaatagcttacctccctcaagaacaggactgctacgacaatgcatttaagatatctaattcctgaataaaacccgatggttgacatgtaattcctatatttaggaggggatccccaggtgaacttaaaagaaacatttcactacatgatagacctgcaggacaagtgatacacacaccttgcctttcgcgattccttccttcgccagagccagcagcgcctggaaatgccctttcgggtctccactctcctcaaactcctaacattcagcaaagcactatttacataatccaatcgtgaaaggcacacgccaatctcaggtgtcagcaatgaaacaggaatggaatacaatccacccctaccccgcatctcgtcgggtgcacgcccaccatgcagaacagcctccctgcatcgtacaagcacatcacagcttctcaggcacattacaacaaacaccttgaaggcaccaaggagaacatagtcaaagcaagccgcatcgaagcagctgagctcaccatcggtctcggcgatctcgagcgcttccctggactccttcagcgaacctccggtgaccttccgccggaccaaaccaagaaagcgagagattaagcacaccaaatctgagccataagcaagaaataagaagcgaaagggggaatggcaggcagcaaagcagcgtatgatgatgcggtcgacgccggccgcccgcgcacgggcgagcacggcggggatgtcggcggcgtggcattgcttgccgtggtagatgcccctgaacatgccatcttcagttcgttcgcatcgcagcagcaaagagcaagacgcaagtagaaaagcgtgagagccagacagtgagccgagaaaaacgagataagaatcgggaggaggaggcggcggttataccggtgaagttgacggcgatgtctgctcgtcgcggtggcgccggagacggagaagaagatgagaggaggagtagaagaagaaggccgggtcagtccaggtaggagcataagagcggcgagcgagagggaggagagagagagtagggcactcgccgatgagcttgacgccggttgacgccatcgccgccgtcgccgccgagatgggggagagtccgaattgggcccggtctccgtgttgggcctccaaggctccaactaatcaaaaggaaaaagtacacccaaggtcccttaacttatcattgaattacaaaatcgtcccctaaccgtaaaaccggatacaacacgtcccctaaattacaaaaccagtgcaaactaggtcccttggcggttttgatctcggttttattcgatatggcagctgagtcagtgtgggacccacgtgagccccacgtgtcagtcccttcttccccccccctctcttctttcctccacagttcggctcggcagtgggcaaggcagccggccggtgggggaggcgggagaccggcggccggcggccggcaacgggtgacgaagcggcggtggcactgcacggtctcccgcgcatgccctcccacattgccgccaccgggggaggagctgggcggggct

SEQ ID NO: 77631 - DNA, 662 bp, Oryza sativa
  unsure (1)..(662): unsure at all n locations
tacccctttcttcttcctccaatccttcctctcttgagcaagccgggatcagtggaggaggagctgagcaggtcctaagtgcatgtccacaagctccttgtccatggcgcattgcacaaccgagaagtttcctccagtatcagaaaagcagcacactgaatcctacaaatgttgctcctcttcatcngatggcagattgngaaatttcgatttccccaaactggctgtgtagctcggcacacagcctgcagccatggcgctccgtcgccactgccgcttgaagagagagagagagagcatgcacgtctcctccacatcatcgggttggcgaagacaggcccaaccccatcgccggctacaccacctccatgaccacgaccatggagatgtcagaggccaccacgaacgtgctctccgccacctactggatgctcagcgaccctgtgcagcaccagtgtcacaaaccgtcgctcgtcgagcacccagtgtcacagaccgtcactcggcagtgtggcagccccagccactgcggcgagcagggagagcaggagacaggttgaccgccgggggcctcgaactgctgtcgtcaatgctccgagctgtagctcgccagccaccagatccagaggatgaacagaagagagagagggagaggagatgaa

SEQ ID NO: 77632 - DNA, 905 bp, Oryza sativa
agtacttcatcaatgagtataaaacaactcataataaaataaattataattacgtaaattttttgaataagacgaatggtcaaacatgtgagaaaaaatcaacggcgtcatctattaaaaaacagaggaacagagggagtactattatacacccgggctgttcgcttgcagtcctgtccaccatcggcgccgtcgcgtactgtcgcctgcgcgtcaccgccgcctgctcaccgttccggcttccctcgcactcttctgtgccccccggccgtccgcttccctttgcccccgctcgacatcatgctccttttctacgcgcttcccgcacgtactgatgcttcacggtgaccgcgcgtggttgcagcccacgccgacgcagcgacgctgcctcgtgctcgccgacccactcacccacacaacgcgtgcggtcgccggagcaagccgacaccgtacgttagcccacccgcccaaacaacgctcgccgccgccacgcgattgccagccgacggatggactcagtgatggcgtcacaggcgcgcacacacacaaaaaaaaaaaaaaacctgcaaccaacactgcggtccacaccaaccaaccgccttcttttttcgttctcgaagcgtgccgcccacggggaacaccacacgccgagtcgacaatatataacccacgacacagccgcgcgcggcgcgcggcggcacaaaacgtgagcaccaaactgatcccctcctcgtctccacgctccgcttctcctccaagccaaattctgaaacaccaacccagatccttctctctctctctctctctctctctccggccatgtccgaggcggtagaatgaacagatatcggcggggaagcaggcgaagcacaagcactggtggacgaggaaccggaaatggatga

SEQ ID NO: 77633 - DNA, 1053 bp, Oryza sativa
ccctgctctatataaataatcccccccagttgctgaagaagatgaagcggatcccgctgacgaggagttcttccaggagcaagccggctacgatgagttttagggtttcagcctagttcccaagtcgcgcctgtgatgtttggtccaagtcttggcttccgcttcccttttgtaatgcagttgtaagctcgggatctgtccgcagcccaacatgactgtactcctactctataataaagagacctctgttgctgtgatattctgtcttcctgtgataccagcactgtttcctgggactgttatcgattaacaggttaatttggagcgtcacgggctagttccggtcgggactagttcggggcgtgacaagagatggtatcagagcacaggcttggccctagggcgaaacccgacatttaggacgaccctaaggatactaagttcaaaactacttgcgaaaagctaaggcttcttttggtttctttattttcaatagtttgtttctaaaatggttactgatcttttctccctccttcaaaattgtagatggcagtgaacgccagcttcagttcccacggttttggtgagggtcaccacgtcgctcagcttcgtgacctcgcccgcttccttggcttttcgtgtcccgagtacacggggtactccgtggaccgtgttccccctcgctgtgagctctctgtgtacctttaccctcgtggaggtatacacggagctggccttcgcccacaccacttcactgtggccaggcccactctccagatcgcgtaccaggacctctcctgtcgcgaccgagaaaaatacattttcccgaaagctagtgtattaatccccgtcccaggaaaagccggggtacactacacaaacatgatataaaagacacatctttattatatcgataatatttacattattacaaaggcacttaaggcctgacaatcaaaaataaacagcagcgaaaaagcgggcctacggctccatcttcacaggcgctcaactggggtataagccaggactccacctaagacttcttctcca

SEQ ID NO: 77634 - DNA, 1815 bp, Oryza sativa
  unsure (1)..(1815): unsure at all n locations
aatagaaatcacaataaaataaataatcataatattattttttatgaaacaataatcagatgtaaattaataacggcgtatattaaaatcggagggagtactctctatttgaaagcacgagcttccgaatatgatctgtagctctatcctactcctctataaaaaaaaattcaaactggtccagattcatccctacagtttgattttttttacggagagacactactacaggaatgattttccttgacgggggtcattttagattgcaaacggcgtgtaagtagttgcgtctgcgaaaatcgtgctccattttcacgtgcgactctttaagatgactgcacaaaaaaaatcaattatcgcaggcgggccacttaataggtccgcatgcaaaaataggcttgttttcgcgtacggacctgttaagtcaccgcacacgaaaatagcctctcaacttttaatccgccgtcgctgccccacatgcacccactctcatcgctatctccttagatcccatctcacacctgctcctcccatctccctctccgcctcctcctcccatctccctatccgcctcctcctcccactcctccctctccctatccgccccctcctcccactcctcccatctcccagcgacggcggcagcatcggagcggattcgttgccggccgccgcagtgaggatggatccatcgcctgtgaccgcgaggggatccgtcgccggcgacagcggggacgacggcggcgggccttaggcaaggcggcgatgacgacggtggtgacggcgacgatggcggtgacgggtttcttgttttggttctgcgcatgtctctctgtgacgttgtgtgacgcacggctagncaaccaagcggctgcacacagatacgancgcatttatatgcacaagnaccaccttgcgatttccaagcacagcggctggaaagagtgtcgcatgactcgaccgcacagaaaaatcattattgccactagtgggagtatatgttagcagatttgtttcgagcctaatcaacttttattatagttcgtgtgtgcgcctggatcaattatttgtgaacctagagagaagcctgtgagccaaaagccctgaaaaccgctaaaagaagagcnctggaactctcatctctggcacgccgcgagccggtcgcgcacctgtcctagacgctttacctagtactactattgatcgagtcaatgatcgctctactagtactactattgatcgagtcaatgatcgctctactagtactactattgatcgagtcaatgtaacgatctgtttggtggcatatgatgtattcttgatcagcaaaacgtatgcttgagctgcaagccgatgtataatcaaggaaatgaaaaacaatgagttccacttgccatcttgggaccaacaatatcttttgatctctccgaaccagagactaccattaaattagacgagcttcagaatcttctagttcttccggcgaggtgaatggattaactcttttttttaaaaaaaatccagaaacatgaataccaagttcgtaaaacacgagagaatcgatccaccagccgaacgactgccatcttcatcagctataaaagagccgacaaatctaggtgctccgcacagtgatacagatcacttgcgccatcacaagtcgcaagccaaaaccatctcactgactagctcgagctcaccatggaattctcctcgagttcaacgtctctcttcctcctcctctctatcctgcctctcctctactttctttgccagcgccacgaccccaagaagcagcctcacgcccatgggctc

SEQ ID NO: 77635 - DNA, 789 bp, Oryza sativa
ataggttcataagtgttgaagttagatgcagtcgaaagaactttaggaatgtttgctgaaacgtgtctactgccgtgatgccaaaacagagatttttacttgtattaaatgaggtcacaaacacagagcccttccttagcttattatgcacaaccctttctcataaactttatatttctttgtcggtgtgtcctgagtaagtaaagtcctttgctttttcagtgactacaagtacttgttatcaataaaataatggaaaatgagtgatttattccacaatatatttgtatttgattctagtacatgagaagtttcctcttttcccccttttttggatgaaacatatttcagttttcagtcataaaaagatacaagtatggaactaatagtcacaatgcatttttaaaattcttatgctaaagcattcctatcatcatgcatatttgcaattgcatcttttgatacaactttcaacttttctgtcacattattccaatttcaaccaaacttccaagtttggttgaaattggaacgatgtgactgaaaagttgcgtgtgtatgaaaggtttgatccgatggaaagttggaagtttggaaaaaaaaactttgcaactaaacagggcctaacattgcataacttattatatgctctacttcttttctttgcagacctaagccgcaagtccttggagcaatatgtcccaggctgctcatcagtcaggctctctgacgtcaagatcttccggtcttgggaacggtcaatgaagctgacaacggaggcgttcgtca

SEQ ID NO: 77636 - DNA, 730 bp, Oryza sativa
atgctggtggtgccgctggacaccgtaatggccttgcatcctcatccttgggttcctgctggtaaccaggcagccctcgctcttgctggtggccattcgtcgagcaggagcggccagacgaagcccactggacaccagcggcagttcgcagcagtgcacgctcgatccggcgatgacgctctcataggaggacctagagtgaacgatccgacgcgacagggcctgatccggcgagacgcaaatgagtgggggatggacaggagggaggaggaggcaggggattaggagagactgaggccagggtaggagcttgtggggatgggaagaatggaagatgcggcggaggaggatgaagccgcggcggcagcttttctttttttcttttttttttaacgcgtggatgctgcctattcgcctacctctctcgactctgatcgaagactcctgaaatctcgtcttcaccttttgactaaagctatactgaggcctattcaaaatctaacggcatgggttcaatgtttgttgcatccaacggctaatattattccgatgacatggcgctttgtggtggtgaaaaactttagtattttcactactttagatttccaatcactaacaaacagcgaaacagaggtctgattagagatggcaattggcaacatgtcccataacccgagatcccataggtttttatattattattacgagtcacatttttaattctgatatc

SEQ ID NO: 77637 - DNA, 1508 bp, Oryza sativa
cggtcggccaccacggcacgcgcgcgcggcttgcaacgggaggcgcggcggatttgagcggcgcggcttgggcacgcacgctggcttgcggggccgggcggctgcgcggctgcagggcggcagggcagcggggccggacggcgcggacggcgcagacggcgcggctctcgcgcatgcgcgcgcgacgcgcgggcagagcggagggaggggcgctgggcgtggctctcgcacacgcgcgcgcggcgcgcgggcagagcggaggggaagggggagagagagagagcgcgccgggagggagggggagagggagatgggccgagcgagattcggcccatcgaaccctggggtggcaaaatagacttttgcggaggaatttgatttggaaggattggattcggaattaaactcgacgatagatcggggatttgagatcttgagatggcacggacactagacgacaagcgaagaaacaaatttcgcaattagggtttttaggagataattttcccgctaggcgccacgacggaacgggcgctacaggttgataggtatgattcggttctttagccaccagtaccccacttacccatgggtaaaaaaaaggtgtgcctaaggtaatagctctaatccagtttatatgagattgatatggaaaaccatatagtacaaagacaacagatgaatccggcgttactgacgagatccttgtcgagatggttagacgagatctcccgacgaatctggcttcgtaaactatggtgggtatgttagcgctataattcgatgatctgaaccccttagggggtgtgtcttttataacgtgagttgccttagtctccaagtagatcttggagagaatgaaccctacacgatatagaatagacccaattctctccgagtaggactctgttaatcaccggcctatgaggatattttctataatatcttatagatttcccttatcacctacggtcgtatgaccgatggtataccatactcgtatattccgtaagtcataggatatgaggtatgccttatccgtaaccagtcgtatatgacataattcttacatgattttttacttgcttttgaatgttaatgttaaaactaaggttgcctaatatgatgttggtgcttgccatcgtcatcatcggattattgtaaaaaatttaagtgctctaaattagtgtagtggtatggatatccattacctgtatgggtatggtttggggagaattttgcacccgcggttagatgtgggtattagagcgcgaacttttaatcataagtttgagtatgaggtaagaaaacttgcagtagaattatagttcatgtggatcaatttatttgtgtactgaagagaagagagttgtaccaaaggtaacctagtaaccagattatttgagcaggcgaccaggcatgaggcatccactgtctagctttagtagtactactattgatcaagtcaatgtaacaatatgtttggtagcatatgatgtattcttgat

SEQ ID NO: 77638 - DNA, 679 bp, Oryza sativa
acgacggtgacggtgagctcgccgtccgcggccgcgaggaggcggcacgcggccagcatcgggttgatgtggccgcggcccgggtacggcaccgcgaccacgtgccgggacacggctgtcgacgccatgctaatctctatcggactatctctgctggaatttgtgtcttcttggtggaactaatataaaggcagcacagattggagagcttttgatacactgtagtacttgataagtgatacatagacccagctgtgaattgggaggtcagagcaaacaaaggagaacaaattggcttgtcatttcttctgctcccaccgtcgtagcaaccgacgatccaatcctatatgtccaaattcgcagtggttgctacatattgagatgaagagagtacaaactagttatataaggtttactttgttgagcccaaatatcgatagttatgtgaggttcactttgtgggacccaaatattagtggggtggtgcttgtgactctgtctagcgaacatttcttgcttccatatcccaaattacatgctattccggagttgaactccattgttgctcttctagtgaacaattaacagcaaaattatagcccttaagggtttattcggtttggaggggatccggtttggaggggatcgaagagtattagaggggatgtggaataaatct

SEQ ID NO: 77639 - DNA, 2455 bp, Oryza sativa
caagttcagcctgaagtgcaggaaccaaaacagaactacgccaaattcgtaccctcatttcaaaatcatccaatgagccaatgtaccaacggcacgaacgtacgattacaaaactactatcatctaaataattaaaggctgccactgccacggtcctgcaacatgccggatctaaacgtatcgaaccgtttgaaccccatccataaaaaccagacaataaagaaaaggttaaagacaagccgaacaacaactcaacaagcgtttgaatctcctgggctcacaggggaaaaaaaaaacctccagtacagtaattactccaccaccctactgtgccccccacatgcgctggcccaaatagcaaatccatactactcttccgcacaaaatataaaatgtatatagaggtttatatatataggccatgtttagttcacaccaaacttttcccaaactcccaattttccagcatatcacatcacattcaaaactttcctgctcacataaactctaatttttttttctaaactaccaacttttcccaaacttctccataattttaggaactaaacacaaccatatgtattacttctattagaaaacgttccatcggattatattgttccatcggattatattttaagactagcacaacccatttctaaatcatgagagcaagtttaatagtatagcccactgctaagtgtctaggtccaattcatttatagccaatctaataaccaatttataaaatagttgtttcctatactattagtatatggttctacctgtcatacatacattacgtctcgaagtccgtgctgcagctcgctacaaatatgtagcccactaatcttctctctcatattctatcttaataaaatatgtttatatagctagctaatagtctgctattgtatttgctctgagccactccgatgaccaaatcttgacacgtgtgacgatcccgtcggccgccgacgctgttgctgcgccggcctcccgcagcggatggacgcgtgcacctctgcctatctttccgcgctcgatgcagctcggtcaacttcgcggcttgccccctgaagtttcaaaatattactcctacgagttcggggggtgaaacttgaaaagctttgcctcgtggatgccgcgtggcccacggccacaccgtcttcctcgggccccggaagtttttcaaatagagggagccgttgcgcttgcgcagcagccacacggagagagaagggaagcagagctgcgtgcgatctgagtgggtaggcggtgacgtcggcgagctcgctcgggagtcgcggcggcgatggcggcggcggcggagggcgggaggcacgatcaggggatggcgctgcgcaaggccgaggaatccggtgagcagctgttcgtctcttctccctctccccgtctctcgggtgtggcatttttctcgctcgcgcgatctgcgccttgcaatgcgctcgtgctgtgcgtgtgtgtgtgtgtgtgtgctggcgtctggatcattggatggcgtttgaggcgagacgcggcggcgcgggcggtcacctcacctggtgtactgtgctgcctgctctccggcgcgcgtgccgcgtcggcggatgcgcggtggcagcgtgcgagatttgggttgagatcattggtgtgatttgtttagtgcgctacttgttgcaattaaggctcctgcatatggtaagactcttgcatgcgccatgagtgtggttgaagcattgagcattgacctgggtggtttgcgtttggttgaagttaactttgagatgcatttagtagtacacgcgacattctcgtcggtttaatcaataatcaggagttgcatttggtcatttggtaatcgcgcaaagcatggtggaaaaagaaatgcagctcgaattcaggatccccaaaatctccgcctcttctgtttccgattgactcagaattcaaaaagtaaatctgcatcacggggggagagaccatgttcatcttctgcacgaatcgcgaggcaaactgcccctgttgccgatgtggctttccgctgactctgttgtgatctgttgccgcagccgcgcggaggtgcgaggcggcgcgatggctgcggcagatggaggcggcggcggcggagtccctgccggagaggccgtcggaggaggagttctgcgtggcgctgcgcaacgggctcgtcctctgcaacgtcctcaaccacgtcaacccgggcgccgtccccaaggtgcgttgcttaagagttcaagacccaaacaaaaaatcgatcggattggaagtcatttttttttttgaaatttgcaccgtatccgtggtagagttggaatctaacgagtgctcgtttgcggacaggtcgtggagaatcccattgttgcggtgcagtcgtctgatgtggcggcccagtctgcgattcagtatttcgagaacatgaggaacttccttgttg

SEQ ID NO: 77640 - DNA, 14789 bp, Oryza sativa
attcctgcagcccgtctggaatagaacaaaatctgaaattaatctccagccagggttccaaaagttttgataccacagagagtcagatatcactatgagtagagaacacaaaaatggcatgctttatctattggttgatcatattagtagcatattttatctattaattggtcacgaaacgttttaaatattatcataccagtagtatggaggtagaaatgaaaaggggaagaaattgaaaccttttcgtggaatgaacggtttactccccacaatttctttgcatatactaacacggaacttttcaaccattcaggtccaacctgaattttggatcttccaaatttcatctgaggtttctttacctcttgaatacatatgttacatattagatccagacagtgaagagctgataataatgcttcacttgactgagcatcaatagttgactttgcaaaaagttctgaaactgagacctctacagaattaacgagaatctggaagaggttttgaagcttcattaatatattggacatcgcaaatgctcctgcagtgcatcaggtttataagacataatatcaagcctgtcttaacttaatggcacaagaaaagaaataacaagtactccttccgtcccaaaatataagggagtcagtccaaattcatattactaggatgcgtcacatctacccaaaatcctttatatttttggacggagggagtattcatgtaggatgtgcataaaacttaaaaaagcgtaaaagatattttataatacaacagtgtcatttccatatagtattgttcttccactgtattctaaactaaaccaaacaaatttccattaacaatcaattaactattctgattaaacattttccagtccacataaccaaaaggaaagtgcaactgtgacccccccccaaaaaaaaaataataataaaataataataaataataataaaataaaataaataaataaatcaacagttcattggagatagtaaatttgttgtttagtgtgttgtttcatgaaaaagctagcaagctagaaatgcatggtaaacaaggctaaattgtaaatgaatatagattaagttgagtggtctgatatgtttactgcagagctttctctggttatcttacaaatgaatttgaatttaaggaggcgtagcaacataaattgaatatcaaattagggaccaataaaacatgggaaacatgtagaagacttactacttcctgagttatcttcatcaagagtacatttccaaagttccctaccagaaagattatgaacctgtagacgattagaaaatattctgatcattccaatatgacaaagaaggtgtttgatacagatacattgctgaacatgcaaattttctgtttcactaagttagttgctatagctccaactaattttaagagtaaaataatataaaatgatgattcaactgtacaaaccagtcgatttgatgcatcaccattttctgttgcataagcaacctgagaaagacactgcccgagcccactaaggacactgttaagtttactcttatcctggagatgaatcctgtcattgctcagtacagcaagaaagttgttgaagacctatcagaagaaataatgaaactgagattattactaggtatgaatgtgctaaatctcacataaatcctagcaggaattagaagaagtttcaatagcatatgccttggtacatataattagttgatgaaagatagactatgaaatattttatgttaatttaacacctcccatcttctgtaaatagagataaaaggaagaagggcacatgtcaggggcaagtagccaccaatacattgcctcctaacacaagaaccttttcaactttcaaaacaccaatacatgaaagaaacccattcacctgttcagcgtatcctggaaaggaggatgggaaattaataacaacaagctccaaaaatctgaaagacattaactggatatccatggatagatgggtcattccgttcaaaatattggccatcagcagaaacagtgtactgcgtgtcgatattgcattgtcctgccataaatagataccaattgtctcacatatgcagccaatagcatagaactagaaaatggaaatgatagaaggaataagatatggaaatccattagtagctagaagagcccgtatggtcagcatgatgaaactaaaatagacaattgggggaagaaaaacagtgatcaagttaccaatagcttgtgaatcatagcaacctcgtgagatctctcacgaattcagaaataactggcaagaagtggggaaatacctctttcaaagatgggaagacgagagactgcagtatactgaacaaggattcacgaaccaccttgtcagtgtcacatattctttcctgtagcttctcaacaattgcaaccttgtgaagtttaagctctgatggatgcttagcaacaagatcctttatcccattcagcgcagcttcaacaaaataacataacaatgcagcccaagttagctagtctcatcaagcacaggccgaatcgatcgatcgaatcaactgtttatctggccatctgggtggcagtccgcgcagagactgcctatcggtggctcacctcggcgcacattggcattgtagtggcccgtctgctgcaagagctcccgcagcgtgagcccgcgcttgttcacggccatgccagccctctccgacgccatgctctgctccggcagcacgatcgctgcaaccacacacgcgcacatcacaatccgaaaccctaaattacgcgccctgctgcgaaaacctcaggccaccgagggaaaaaaaaaaaaaagaggcgcccgcagctcacctctggacttgatctccgtgtcggtggcattcttcggcggcggcagcttccgccccaccttgtgcttgtacttctgcgagccacgaagagaaaaaaaacacacacacacccgaacaccagtgagctcgtcggagcgggcgtcgcttcagttgggggaggggagggggggaactcaccttgaagtcgacgccgccgcgctgcttcggcttcgccttgggcttcttcgacgaggaggaggacgccgcggcgccgcccttcggcctccccatggcgcgggcgcgtctctctttctctctctctccgggcagcgcttgctgacgagacggcggcggcggcggcggcgtggtgggggttttgcgcgcgacgggcggtacaagggctaagcccccgaggctgcgggccgtggcggagacggtctctcgttcatgggcctcggagacgtccctccccctcgtgtactcccggccccagaaaccgacgccgaaagaagcccacgttagagtccggccttctgggtcgctcagaaacccagccgagcagtgtactgggctgggccacgctagtactcaagtcttccctaatactgggaaatgtttctaatagagtcagggtaccaagcagtaaatagatcgcctgttaggtttaattattttatgattgatgaagattttatatcccatagatcctacttttctgtgtaggccatagcagcacactatagtgatgagattggtaggtataccgtatacaatgcaaccaaacttacgcaaatagaaaatacttatagaattttcacgtactaactgtattaggaaagtttgatgatatgcagttggggataaagacacatgccgagccgaagcgcggaatcgggggtggtctcgccggtcgccgccgccgttggccaaattcgccaattcgggctgcgttgaaccggcgaaaacaccggtggagtcgcggagatacgccgcttcaccgagaaaatcacagggcgcgtttatttgtgcgatcgtgccaatgccacggacgcgcgagccaccgcattgtgagacggccgcgacgacacccgtacgtcggccgtcgccaccggtgacgcgcgcctgattttacccaaccgctcgctctgaaccggcgtggaggcatcaaaccaacgggtggcagtgaactcaatcaggcgagcgcacggtggactccatggggagtagcaagaatccctggtagtgaaaagtctccggcaaatcgcatccctgaccctgaggctgaacaagtgaacaacgtacaaacctagctggttaattaactttacagcgattttacagtgggcctctcggttagtaaaaaaaagctttgccttacgcagaaccacttggtaattagttcttttttatccctgtgagatctgtacttctctactcgtgttacgtgagtgcgcgcgtaattctttgacgaccgggacgaggggtgtggggttgggatcggcagccgcgcgcgcgcgcgtcgtacgatgagcgggcacgtggccgcgcgcgaggccggccggccggcggcgacgacggtgcagcacgccgacttgccatgtctgcgtgcgtatgaatacatgtggattcggtcgcgcgcgaactcgtcgtctcgtcgtacgtccaggcgcgcacgcagcagagaggcagcgagctcatctcccgaaagccacccaccaccaccatgcaccaccactcgtcgccagcaggttggcacttggggacttggggcagaacgcccctcgtgcgtgtgcatgcccgcccccgggccccggccacggccactgctgagtgcacacgaccgtaccctctccggctctccctgtaacaaggctgtaaattgcaccaagttctctatcttcaaagtcacgtgattttatcactgacataattttgataatttagagctattttggattgataccaaaatatgccctaccaatttattagtaccttaaatagtaatcatataggtttggattgaagccaaattgttagtcatacctatgattaatttgtcactaatctagaaccttcttctctatatcatcaatacttgtcatcatattggtagcaatccaaacatatataatgaatctctacccaaccaaaaaattgatagtaccaaaacatgtcaagaatttggcactaccaatgatttggtaaggtagagatctaaacagcctcttaaagtcgtgtgactttatcgctgatatgtgaacctaataaatactacatccgttttttaatagatgacgccgttgatttttctcacatgtttgaccattcgtcttattaaaaaattttatgcaaatgtataagatataaatcacacttaaagtactatgagtgataaaagaactcataacaaaataaattataattacgtaaatttttttgaataagacgaatgatcaaacatgtgagaaaaagtcaacagcgttatctattaaaaaatggagagagtattggattcatatgtcagtgacttgtgactttgaaggtggggtatcttgatcaatccccacctcaccaactgcagggcgggcaagcaggttgaaaaagaaaaatacaaagagaacccaagtaatcaagtggtaatataaccgtggtctgagtcctctgataggtaattaggtagatatctgatgctaccggaaatcaatctgcaatctggcatgcggagcggacctcatcattttctcagttaagtggctaattaacgcctgatcttttccgggcatttttatctgaatccgatcgataatacgcacgatgcaattttcacaggtactccacagtgtccgtcgatcggcatgcacgtacgcatgaatcaacacggcagcttttcgatgggtagcatgttaattaccaccatggccaaccgacgttaatttgcatcaaaaggggttaattagctgccagagtgacacgtcgaccactgaagctgtgaagactgaagaatcatcccgctccatgatttgccgcgcccatcgaagcttttaaacgtacgatcgacaaggctttgctttttttttgggtagcgatacttcaacgagagagaacaatacttccatcgttttgttttcccacatgatgatgttttgcacaggtattcagaaatgatgcagagcaagtgcagaatatacaatataatgcactcttggatactttggtgggtgtagccttgtatatatatgttcagaaaataatggttgatacttacctccaggcataatcaggaccatgggttaaactattcctagggcttggtaaacaaaaccatgacagatgtacgggttagaagagatgtctttaggccttgctttgacagtttgactgcatatcaagttatgaaccctatagctaagctagctagctaaacctgcaatgcatttgcactgtatatcttcttctataaaaggcctacaacccccaacactgcatcctctcccctatccgtcttcatactaacaagagtacgtacaagatttcgtatcgatcgtatagagagatcgaagtcagaaagagagaagagattataagttaatttcgccatgagcagcagaaggactagcgcagctaatcttcttgcggttgccctgctgatcatctccttgctgttgttgcctcttcttcaccttcccgttgcccatgctcgccatggtgagttcaatcttcattctctcatgagctaataaacccatgtgtcctagctatatcgtttgctaataatccgtcgatcctgtgctgattgttcctgcagttgctgtgctgaaggctactgacagttctagtgccatcagcatcagatcgggacatgtggtcagtgaacacacacacacacacacacatatatatatatgcctcaatatcttgattttctagtaggcatcgcatctgtacgctgtactcatcgatcctactgaactttttgcattttctggacgaatgcttgcaggagcccaccccggcgagcggagcagtgcagaggaggccagctagctccggtgcaagtaaccgcggcggcggcgggcggcggcggcgagcggcggcaagcagcaggagtacggtggagatgcgcgcgtcggcgtgggcgaagcccccccgcgacgaggtcgccaggatgcacgagatgctgaagagggactacgcgtccaaggcgcgccgccgctcgccgatcaacaacggcgagccgtcgctggaggaggaggacctgccctaactaagcttcagctgcatattcgtagtgtagtgtagcgtagcttagctatagctcctctgaaagatctgaactgacacacataggtagtacatacagttattactagagctgctcttttagttagcaaattagcaggcaggatagtgtagttactcctatggaataacagcctttggtttagtatagcatccaagctggggcgtcatttgttagccctgagagtcagagagccatgaacaaacagtctgaaactgggcagttttgtccctgatgatgctcatgcttggtgctagctaaagcttttagctagcttcaccctgtaacatacataaatgtgcaccagtgtgtcaggtttgcagttttagcttgcagatattatgtcacaggcttagtgatttacatgcatctttttgtgcctcctgccttgctcacatggtcacagagagagagagttacagactatggcgatttgtgttcttctgaacagggtaacacagtccagtttcagttttacagtctccagggatgctcatcagctacaatacttttcaccaagtataccttcatttctcactctcaatgcaaattacaagccactaccgaatccagacaagccattaacctgctatagatgagtaaaaaaaagagagagcaggacatggagggaggggggcagcaagaggaggggtggtggggaaaggggagaaatgagcaacattttgaatgaatttaacacggctaccacgacgagctcaggggcgcgacgcgaagagctgatctcaaaaagaaaagatatgcgggagcatgcagattcagaatttacagcagaggattctataaccccaacctcggtcccgtctcaagcgcctgcggtccgctttcgccatcttcacagggctgctgttccactctgtctgtagcctgaaaaattgagaaagaaaaggaggagcttgatccattagcttcatggagtatatgggaagcataaattctgaatgttatgtggattggccaaagagaaaataattcaatggttaatctgcttttccagctaagatctcagtctgctgtgtttagataaaaagaataagcagatgacaccatttggatgtgaagagaactttgaagctgcttatagagataggaggggaagagtgacaacctccctataaggttgccttcctagaaaacctatgtttcctagcttctgacttctagttccttttctagattctatagctatagattcctagaatctgagtgacaatctgtactgtttgggggagctagaaattccgggagaagctgtagcagctaaaaactccccaacatggccatatactatttacctcaagagttttcttgtgcaggcaaatgaatgattccaattaatggaacagattgggtggaaaatttatgtgaaactaacagaggagaggaaatgcacacaaatgtgtaagaaaacatattaagtaatggttttctttttcagaaaggtccacagaatatacagtacgatccattcacagttggctattttcctgatctcaaagaaaaaggccgtccattttcctttgaaatagaggggtggcagcatgactgttataaaaagcaatagcaatgcaggcaagggagctactctactctgagaaaatttaattgaagtgcatcttcacttacactggaaatgcgaaggaccgagtacttgttgtgctgctatccgatcgaagagaaatgtttccagaataaggtatatgacctgatggtgttagtggacctgatataatgctaggtccagaaaaacttgactcaaagggattgcggataacatttcgagctgttacttttgcactgtcagcttcatttggttgagctacagattctgtttgcatggtcacttttgcactgtcaggttcattccgttgagctacaggttctgtttgcattgtcatctttgcactgtcaggttcattttgttcagttactggtcctgtttgccgtgtggaactcttactatctttgttgtcctcacttatatttgtgccatcgtttgcttctcttgggttgaaatcatgtccgtcttggacactatcgatctcgcattttggatcattctcacttttcgcatcaataggctctgtcttaccagttaacggagatgtacctgaactcgtcccatgtgctgcatcagttctaattccataaacgaaattatccacctgatcatttctatcttccgaaggttggacatacgacctacttggacttgcttcagtagagtctaatctactgtcttcatttctcgctccatctgtttcagtagaactaagtgccctgtcaacaggatcactcaaactgtctgaattttcaacaggacttctctgatcaacaggaatttttctctcatcactcaaaatgtcatcacttcttgcttcatctttttcttcagatgcttggacatcagtcatacttgaattttctacaacagaatctaatgtactgtcttctgcaatggattcaccagtttcaagaaaattaaatcctcgcagtgcaccatagacgatatcactaaaactgtctgtcttttcgacaggacagggcactgaataaacatcatcaacaattgtaggtagggagtacttggttcccacgtgtcctctaatgatccatatgcgatgaagggattatagtgattaatttggttgatttctgtcttatttagtgccacaccagaaacaccatcttcagtcaccaccccagagtggccatcagcagttgactcaactgataaaccattgacgttagtgatcgcagatgcaatactagctccagtttcatgggaatcatttgatggaacctgtaataagagtatcatatttagtggtccaattgtggagagaagtcatatgaatgctaaaaagatcatcattcagtgtgcaaactcatattttgaatcaaaaaaactcaaatatagactacagaaccaaaagaacatatagtcttatcataataaagatgaaatccaatcaatgacgatgcatgctgatggcaacaatgagttttaagaactaatgtgacaaacatattgatgattttctaagtgtctgtaatactgtaagttgcagtttacctgatcaactggttctccattgagatttggcccatgattttcactgctctcagaaacatctgcacccatttgttggcaatattctgcattgtcattacttactaattgtttgggcgtcgatttctcaacatttacaacagtcaatccatctacactactgttgccttcgagatcatgcaatttgcaaggatgattttgttccacagtatccccatcagtaacacatgcttcgggcaggacaactatttgcgattttaaatcattaacagattttgcaggttcatctgctgtttcttttatccgaataccatttgtatctccctttgaagaattcaggttcagtgacaccttttctgctatagccttctgatcagcaagtactccctcatcaatgcagacatccttaacaaactgaacgccataattagaagagaccattatatctggcaatttgatttccacaacatccttgtcataagaaacatcctcaggccgtatctggatggctttatctacattttgttgcccggccttcataaaactatattctgatggattggtttgttgtaccattgtatcaagcaaaatatgttgtttagtttctctttcaatttctccatctactttagggccgccattggatacaagctcatgaaaaacattactatggtaaggccttccatcatctgcaagcatacatcaaaatcatcaaccgttgagagagtgaacagagaagaacatgatttcacaacatagcaacatgtacaattctcaccattgattagttctgatttagacagtcaaacagtaactaaaactatacttgatgtctaagtgatgagacttttttccaaaaaatttttgaaaaggagaccttttacaatggaatgagcaaaagagaacctggttacttctgctgtcatttctctttcatttcagttgtactgtcatttttactcatttgcaaacacggattcttttggctgtgactgactcaaccatcttactgcatcataaaggtggaacataactgtgatagagacaaagctgtcttgttggttaagtaaggggttgttggtattattgaaagaacgtaataaataacaacccaaaacgttaattttgggatgaaattgacaatcttcctaccaaacatatcaaggttcaacaaatcaaatcatttattttgggtcacaatcaagtcaatttgatgaatgagaatttaaatgaaatggatggataatgcagccgtcagtagtcagtactgatccatatcatacctatcaataaagacatctgtcacagcaagtcactgaacgaatacatttttcatttacaaaacaagatttcataaaatgaatcatctactaattcttatgagggcattaatctccacaagtccaaattcacctcagaacatatcccaacgccatagtgtgagataatgcaactgtaaagactagaagctacaccgtagaaataagatcagctctttaaagccgcacaaactgtgtatcatctttaatcttctgttgatgaatgatgaatagtaatgttacgttcaaagcaaaccaatctctggaatatcctacaaaccaagcaatcaccgtgcttaatttctacagctaagccaatgtcatacagatacaaaatactcctataaggtagcagaagattgataggtgagagattcccttaccaatcttcatgatctgcattgtgtgcttaagtcctagtcatgcctcaaacaatttccttgaaaatagagctgcttatttcctgccaaaaaataaaaaaaaatcaatcaagagtcaatgcattgcatccggcatccggcatccagattacattaaaaagaaaacaacacacagacctaatgccgatgtccatctatcgacaaacaaatgccgtgctttgcgtaaaccagattccctctagagagaaaagccccccagcatcctgataaaaccacccactttacacaaacctttatacgagaagacagtacaccccaaaagagaggaagataaaaaaaaaataagaaggaagaaacaaaccaatctcacaaaacacaatgctagaaaaagaaaaaaaaaaggtttctgatgagcaaaggcgaaattgtgtgacgagtgacgaccagtctgtctcaccaaacgcacataggtacagaacacagcacgaacaccgaacaagaccaccactactagagactctgctacagagcagtacaaggctaactgaaaccacaagttttttttttccttcttttttttacacggcggagcagagcagagcagagcagagaccgacaggtatgcaaaacgcagcaagctttactagacgaagcaaaggatctctcttcttttttttctttttctgccccttctctgtcacgaaaggggagcgaggggatcgacgacgggcgaaatcagcggcctttgcaccgatctcggcgtcggcggcggaagaactctgacgcaggctttaactgcgcgcatcagatggtgtcgccatggggagtagtaaacgggagcagtaagacagtagcagtaggaggagaagaagacgacgactttgagaaaattttataatctttttttgttgctcttgccgttggcgaatggaagatgaaactctaatcaaccaaaccgctgatgtaaaaaaattccacaatccgtctcatcagttcataccgaaattcatcaaaagaatcgataagggaaaaaaacagcagagaaaaaacaggggaacacgaacacgaacaagatagccactctagcagccatcagccgccatgggcggcgaaggaaaacaaccaacaccgagaaaaccaaaaccaaaccaagaaaacgacgagacgaggaagaagaagatgaaaaaggagaaggatcaagaactgacctgagttcacttctctctctttctctccctccccggatagcaccggcaattcacttcacttcaccgcgtcgagcgaaaaaaaaaagtttccgggagaatcgccgggagcagcgggaggccaggccggcgaggagaggaggagtgggatcgcgtccgcggcgagcccgagaaccaaaaaaattctcgaaatatattaaaaaggatttcccgggcggagggtggagactttaataagcggcatgaagaggcagctcagtgcaataaattttcatggggcgtttttacagaaaggggcatgtgatttccccatatttgcagatgcatccctctaggtagcaacaaacaatgcccctttggatggagttttgtgggactattttcatcctagtgccttcgtttacaattctgagggctgttcagattgatgttatttttaattattttatttttgggtaaagttatcaaaaaaaatctacatttagtttattgctaaatttggtaaatacataagaaatcctgtcaaaattttggttatattatcatcttgccaaaattttagcattgctaaaatttgataaagtttattttggttacaatctgaacagacccttggcattctcatggagatggattattcaaaaggatgttttttaaattcataaacattgaaagggttttatgaaaatgatactacctgggatggatttggatccggtgcagtacctagtgtgactgcaacataagcagtcacactaggaccttttgatgcaaatcaaggatccaaaatctacgaagtactgttcacatctgaaaaaactgtagaactactgtagcatcaacactgtagtatcagatctagaccgttcattgaaaaaatggatggctgagatgatgtgcagttcctaacttgcagtcacagttaggactgcactggatctcaattcacttgggggatttggatccggtgcagtacctatatgcttatagtatgccttgcttggacacgagattttcgcgggtataccattgttttggaaacaacattatctgaagatagcgtgtgccatttccttgatttgtttcaagagcaacaatttcttaagctcatttggaaatgatttacaagaagtgattttttttatctctcttggaaatgatttgtatactactagtgttttctcaggtgtacactgcaaaacagggaggacaattaagtgctgaatcctggagatagaagagaattgatagcatttcatcagtaagaaatccataagatacaagtgcattgatagcaatggcgtcagttatactctacgttatacattgccacatcaagggacaagctaactacgtattgatggcataatctcaacaaaatacaccaaaaaggtgatccatcaaatatgaaatatcccaagacttggaccagccgaggagtggcatctgtcaagatctccctttcagaacaacactgaaaccgaaagatatcaagaaggcgatctctgaattttcagaaaggtattaaatacctttaccgtcacacgatctcatctagaatcatggtaagatagcatcataagaaaacatagcatatgacatcgactccaactaatagtaccctaatactgcactgaatattgttagtaca

SEQ ID NO: 77641 - DNA, 16906 bp, Oryza sativa
aggagacagctcggcggcattgaagtattctaaagcctaaactacctctatggaccccaatttattacacacacaggatccaccatgcttcaatttacctaggataaattgaagaaaaatacactagtggtagcttaacaagtgtgatcgatttacaaataatccttgtacgtgtttctagctctaggttacatcagggggagcaccgttaaagatttttagaaagatggaaaaaaatcctcattcatatgtgagtttagagaggttttctcccataatttgttgtagattttctgtaatttttcatttaaaatgggggttaaatgaaattgatttgtctgaataggacaaaaaaaagtgagaaaaatagatattccgtacccaatgtcgctatctaactataataccgttagaacacatatgtacaacggttaaagcgactatcatcgttatatattttacactataaatctaatatatagaagcaacatgaaaaagagacggcgctatggcgtttaataccactcttttttttccttcatgtcttatgcgcaacccttcttttttttctatttttttctctcattcttgtaagtaaaataagtgttatgagacgcctctttatatcaattgatattatatatgtcctcattatgtgcagtccacttgtcaatatgtaggagcaataggtttggaaagagttgtacttgattttgcttttgaattcctccttttgaaactataaacgcctctttcagtgacatacaaaccaagtacgtttatctactaaacacaatctgtcatggtaatgagaatacaatatacactgaactctagatgaaaactagagcatacatacaagtgacatgtcatttcaatagaaaaaaggagagagaatctattatatatggatagttctaggaatatatgccattgactttgcctcttttccgaatatgccatcaagcttcttatttagtctgcaatgttgaaactaccactagttttcccggtgaaatgttcttttacaaaaggggggcaaatgtctccccccttctatactcatagtcacttataaaatccaccaacttattttttttctccgataactagcataacgatattacaactttgacaaacttttttttaagaaatgccaaagtgaatatatatttcaatgtaaaatattactatagtaatttcgactacaaatcaaatgatatatcattgatgctaaatatttatattattcaaaataccgttgatcaaattagttgactctaaatagttaaacttatggacggacagagtatcatactaggacatcagagacgatcacatataagtaaattattaattccagaaatcattttgtggtgcccccaaggacaaggaggcccttttctgggggccaaaaagaaagggttgagaggaaatgatgccattgacttgtgcacctctaggcaagaggcagaagcaagaagggagagagcggtggtgcatgtaaacttggatgattggctgctgccgaggccactatggagtggcaacgatgaaacagcatttgcgctttctctggactcatctgtttgacctcagatggctcgccatgatgcagggcatcatgccatgctcccagcttggttttctgatgtgtgttccagcctacaagggcaggctccctggttccctctttcagggatgcagggtttttttttttttgggtgattgccatgtgtgtccatggtgtagacagtagagatgatctatttctccctgcatgtgtgctgttctatctggaaattggaactgtcccaattcagtgcttgtttctgcttattggtgaaaatagctccgtttttttctcatatgacctattatatatgctaaaaaaatactactggaccgtcttgaaatatagatgtataagatctttacatagttcgcaacattatattttgatcattagtttgttatatactccatattgtcaacgctataaaattaatataatataataatacattcaaatatataatgacatcacatacatgacaaatcaagcatatatataattattagtacaaggttacgaatgttttttctcttaaaataaggatgctttagtattttggaactgaggggttcagaagattgaaaaatcaccacaacaatcgagaaaacatagagagctgtaacattatttattgttggtggttataacgtaccactataaaccaggataaaatatcccacgctaaatacagttcagaaattccccgcaaaaaatacagtttagacataattaagattcgaactaaaaatacttttgcaacgatcatcatttttccatcgaagaatatacatcgcgtggagtaatgtaggagaccaaaggatcaataatttttcttttgaaagcagaaaagaacctactacgactactgcccccctcctgtttcttttggaaataggaataatcccattgagagccacagggcaaagcaaggcactactctagaaacagtagatccttttcccctcttgcggggacagcagaggggtagatctaagttctagctagggcgagctgagctgccctggtctgtgcaagttgagggcgagttgattggcactttggcacggcaggcaacacctcaaaaggcagaaattggcgcaagcatgcctgcaggatcgatggtgctgtgggccattggcataatacaagtgcaagcatggagctgatagcagctgttggacaaggaagcatgcatatccatacaattttgtgtgttaataatttcctcctggttttaaatacagatggcattgtcaacttttgaattaatatatgctttgatcattcctattatatatatcgtgtaaatatgtaaaatgataagtaatacttaaagtatacctttagtggtaaccaaaatacaataaaatatatggtaattacatacttttctatgagaggaatgatcaaattaatatatgtacagaaatcagaattaatagatattgatttgggggaagaaactaagaaaatgaatactttttctttctttttggcgttggaaacttaggtgcacatttggaataaaagtctactagatagttatgatgtgatatattctaatactacgaatctatgaatcgggataagaattatataaatttataatactaagatatatcacattatgtgatgattttttttacgaaagaagtagtatatttttcaaggttcagaaagttgaaatattccaatatacagtggaaacgtatggtttacgtggttcttttgttacctcgccacgtaattttcagtacctatcagctttgtcattcttttttggcatagtccaattggtaaataacctagcaacctccactacgtgcgattcgaacttgtaatttttttagtagtcttgcatacgcactggacacacctcgtcatcagttgtcacgttgctagctagctagaccttttttgacacggaagcgcatgcggatgggtgttaacgttgcgcacgtatatacgaaatcacacacgtacgtgacattgtgacaaccaatctgtggtacacatgcatcattcatgacatcaggtttacaaaactgacaataaccatatacagagttactatggtactcacgtttataccattaagacatgataaattttaaaaccaccgtaaccacactaaaattttaatagtaatttaatttttttaaaattgtacacggtttcttacggtttaacacgattacccgtccgtgacatacttcgtcctcatatactacaccaaccgtcgtacgtcatgacacatagcgataggtgtgtgcgtttgatcgatcgatcgatctctctcgcgcgcgcgggcaatagacttgagtactcgacccgatccgtcctttaattcttccgatcgccgggacaaagatgtgtactcatgtaaggcagtttcctctctacatctgatcgatcgcgtacgaactaccagccattgatctgtttgttgcccgcctaattaaggaactgttcctgcacggccaccaccaccattattcaccaacctacaccgctacaccttagatgtactagctactgctgtagaattgaagctagctagattgggaggacaccaacaatcttaatttcctttgtggaccaagcaattaatccaaaagaaaaggaaagaaagaaaaaggcaaaaaaaaaggggagggtaagagtggtgtggtacactacttagagcaagtttaatagtgtagccaattattggctccaaaacaactatagctaatataatagcccattcatacaatacttaactataaaaatatactacaccattaatatccggtcctacctctcatgcacacataatgttttggagtccgtgttgcaaccggttacaaatctgtaccgctttcttctctcttctattttcttctcgatatgctattatacctgctcttactattggtgatcgaatatcgatggatggatggacggatgggagaagtgcagtgagagtctgagttcagcagagcagcagcagtatatggctgcatgcccctaatcgagtagcagtcgttagtggtgcggcgactagagaaaaggctcctgaaaaaaaaagggcttcgcgcgtcgcatgccgctgcagatgcaggtgaggccgtgcggccgggtgcagggcagctgcacctcaccagagtccaccggccaccaccaccgcgcgcgcgcacgcacgcacgcatgatgcaacggcccgcgcacggcacggggaacagctttgctagctcgcgcgcggtcacgaggctggcatgatggctagttggctacgcgcgcccgcggccgcgccctcctcgcccgcggccgcttttgcgcgccgccaccatcgctggacgtacgctgggtttggtttgtttggtttggtggggtgggtgtggcccgtgtgggttgggttgggtggcgcgagcgcggtggcggggtgggcgcgggacacgggtactctctcccgagacgcgcgcgcgcatggatcgccgcggcacacgcccgccccggccggccggccggttaattcagcggtttgcacgaaaccatcgatagagtgactgacgagatctggttatggcgcgcagctggggcaaagggtatccaatgcttaatgccaagcaacaatagaagtgcaaccgacaatatgtaatcaatctagtcataaaacccgacgtctctctttgtagctacacctcaccttgcccaccttccttttttcctcttttagtaaaatcctagcctatccggctattgtacagggtttctctcttctttaatacaaatacaccccgcggggtttaaaaaaaaattagtggtttgatgcgtggaagtcgaacgggtgtatcagttaggattagagctagctaacatcaaaactaaggtggtgcattaccattgattggaaacctaggaaacttcaatctaacattgtgcattccaatgcttttaaagtgagaattcttggctttagataggctcctgtgcaccatataagttgaacgtgactttgcaattgttcctcggtctaacctaggatcaggcgaaacgtgttactacaaatttaaatataggactttttagattattagtagtaagatatatgtctcatccaataaagggggtactatattatgggatggatgaagtaattagttgtacgaaataccatgcagtatgctattagcatatgattaataaattattatttagtgtaaacttttaaaatatatttatttgatttttttaaggaaacattttaaccatataaaattttagcataaaacgtactcacgttattaaacgtggattagcccaaaccaacgcggccgtagctaggtgatctcgctgcctgcctgcctagctagctgctggcactctcgcgcgtggacccaaaattaatcaggaccgtacgtacgcgagagggaggaaaaagtgcgtcgccttttttttcccgatcgataatttcccaccgcccgtgccgatctgacgagagcgatgtgttgcgctgccattagcgatttcagcatgcgggtcgaggttgattgatcgaacgatcgggtattcgggtgggtggaaccgtggaagacgcggaagagatcgatcgactgagtgcgtgtcacagtcggattatcgacggatctgatggaaattaaaggacagtttgaatagtaggaataaaaaaacaaagcaatagaaaaacgtggaaatttaatttgaatgaaagtataaaatacaagaaaaacacgtgaatgatagtttgattgaaccgtaagaaacacacaggaatcggatgagatagactcaaagagaattttcccagagcctggccagagctttaatcttttgctaagtttcctttaaaatctctatagtattactcattccatatgaattttaatggattggatatgatttaatcatttaattcaaaaacattcgtaaaaattttctatagaattaaaatccttcaaaattcatatgtttttctccctattaaaggagttctaacgataacgattttggcgttgattaaacatgtccctgtcatgtctaggggtgattcacaggatccatttcctatgaccataaaagttgttagctaaaattttggacgtttatgtgccagttcggtgctgtgtctgcaggtctgaagaactggcatgtggcactgtcctctcgttcatcggccgaggctgaagccgtgtgattttttctcctttgacaagtgacgacatatgcctgcctctccaggtcaggcttaaagaagatggcattttcttccttaaagaaagaaaaagaaaaggaaaagaatatgacattttttttcttccaaacttccagttcagttatgctgccttttcacatggacacgcctttgcgtgaccacgctggtttcaggacacaggtgctgcagtacagttgttcatggagtgctcgcaaagaaagaatccatggctagctgctggccggctccggacacagcatgcattgcatgaaacatgcagtttcttgtgatactattcattgtctcattctattgtgatgcacctgatacactgtccggtaaaagactggctacgtagcaatcgcaagaaaaatccctcccttgatgacccataagtcagaacacgtccagaatcgtataagaacctccaacagcctcgtataagagtcaagaatcgcaaatgaatagtctaatttgcatttcactctaacggactcttttttatgtactatccaatctaaatgtgggtcccacctatcagcctctctactatttaaccccttcttcttcaccctctcctctcttctcttctctgctgagccactagccgaatccgcacgaggttggtggcggtggaggccgcgtggtgccattggtcgctgttgccaccaccgtccttgtcatcttgggcataggtggtggatgccgcatgtggacaggggacggtgacatggattcgagtgaacagcggtgacgcggattagggaagacgacggtggtgtggatttgggcggacggggcttgtgcggcaggggcgacgacggcgttaggccgatgaacaacaatggtggtcattcaaagcgtcacttcttctccggcttctcctgcaaggcgtcgctgccttcggagatctcactgccggctcactactccgaggggatcgggtaccacacctttgtcgggtcgccagagatctcgccatcccggggcttttgctgacggccaccagctctcccccttagccacgttgctcccgaatgaaggaaaagtgaataagaggtggtgggacccacatattgcaagtaggataggctggtaaagtttggcaaatgagggaaagagtttggccatccgtatggcttggagagtaagatgaagaggctgttggagtcggtcatttaaagttgctaaattttggcttgaagagtgggatggagagactgttggagatgctctaagcacatgaatcttttccttttgtctccctcctattagcgatgtgaggccacaagtgaggtaacctcgcctcctccaacacaactgcctccactacccaacacgctgctcctcagccccattggttgtcctcctccccaagccgtgcggctgtcgaagacgccacgccaccttcgtctcctaactactccgtatctaatgcaccacaatcctccaccgccctactatagccccgcggcttgaatggcgacacaaccgcccaccaccattcgtccaacattaggaaacctcaaatcctaatccataggttctttgcgagagttggggtgtcgccaacatcgaagaagacagggagtttaccggggacagaggagaaggagtccgaacatgaatcttgctgtgcggatacaaatggtggagaaatcataagaaatctccctctgtccacaaatataatggagtttgagggtacaggtttatctgcaattttaaggaattttgagtactacttgcatcactcaaccacccttcatttgatttttatttaattatattcctaattgtttctcatttattgagagacattatatccatttcccttaaccttaatctcctaaaaaaactaaaatgcattatatttgtggttgtaggagtacatttaatatatatccgtaccttttaaattatttgtaacttaattgaaacctatatatagagactgtctttcaaaattaaaattcggctcataaaaatcaacagagctagctagtaagttctaaaaaaaaaactagtgcgtccttactaattagtacttctagttaataaaatggtacggcgcttgattttcgttagtagaacgtctgcttccagaacatgctaggcataattcgatggggatgcgcaccatcactcgacgcagtatcaaaaaactctaattgagaatcgacttgtcaactaaaaccaaaaaggtttctgctttcctccctttcaagacatccatgccatttctttttccttatgagaatatatatatacactttagttaattattagcttctcctgattgaacctgttagcttggatagagtgactagtgaatccaacttgctaagtcaacacagcactatatgcttgacttatttaattaattgatttgtcatatgtgttcacatgatatcatgatagccgttaagcaaaccatgcatatgaatctagctacccggtcccaagtaattaacgaaaaggataaggtaaggcaaaatgtgctcactagctagatttgatctgagcaatcatttaggtatggatgagatgataatgttaattagtatattggtcctttgatcctttaattttttgtgaaaggtgtattaattagcactaatcttgttaagcagaagatgtcagtacgaccttaatttaaaacctttctaaaaagagaagatatcacagagctgatctgaaatgttgcaactattactactagtttttattcttttctctctaagtagagtgtttcctatccaacttttcacaaatccaaatctggctccacgcactactacaatacccattttccagtggtgtctgggaaaatcgcgattttcgcatacgggtgcttatatcacccgcacgtgaaaaacaaaaatccaaaaaaataaaataaaatttcacaaaaaatgaaaaccctagattggcgcggcgatgccgccgctcccggccgccgccacctcgtcgtcgacgcccgcctcccaccggcctccacgcccgcctcgtcgtcatcaccgcccgccggatcccgcgcctccaccgtcgcgctgtcgtcgctgtcgccgcgccgccgccgtatccgtgcggggacggccgccgcccgccagatcccgtgcctccaccgccgcaccgtcgttgctgtcgccacgccgccaccaccgcaccaccatcgccgtgggccgccgccgccgctgagaggcagtgagtgcagagagaatcggctgagaggagagagagagaaagagagagaagactttgggagctgaagagacttttgggctgagagaatcagccagataaaagagagagaggaccgaggcgcgcggaaaaacggtaaattttgaagtgggtaggaggaaaaagagagagtactatttttaggtgcggctcttttaatagatccgcatgggaaaatcggtttattttcccgtgcggttcatttaagaggaccgcacggaaattttcccgtgcgggcgatagcccggcgccggtccgcctatttttccgtacggttccacttacgaatcacatggaaacaaaagagggtagcgtccaggaaaatcaatccagtagtagtgacggttgaacagtacgatacatactccactaggaccgtactccactggttccaaaatggaaccaacttagtacggataaaacatattctagaaatacaaatctagacatgccacacatatccagattaatagtattagatattctcatttcgtaccagtgttatattttgggacgggatagatatagattgaagccatttcaaacaacctttgagtgtagcacatcttttgtgctagttcgaaaatatagctagaaatgtaattaacgctgaaattagcagatttaagtatttaattactccctgaaaaaaaaagcagtatcattcacatcacgccctattgtgaacatggagatttcagtaacagagaaaagcgtgtggacacctaaaatgccagccagccacagaggcagtatgtaggactgattaacaagggttaattattaggaggtcctacagataaaatggtccatttagtaaggccattggaggatggagctctcatcgatcctaacttcatgttacttttaacatctagaagttcacttcacttccaaagggcacaatagaaaaacgaagatgtaggcacataccacacgtacgtccacactcagattgccatgtgaggcgatccgtttgaccaattaacttaattaagcacaagagcttaattaaaaccaaggcctagctagctaggcataaactaagagcaagcttaatagtatagccaactactagctctaattcatttatagtcaatataatagccaattcatataatagttgcttactatactattaatacatgatcctatctgtcataaacacattacgtcttggagtccgtgtaacagctggctacagatatgtagcccgctgctcttctctctcttcctttatatctttaaaatatgtttatagctggtttatagcctactattgtacctgctctaattaaacaaagatcacccaaattgcatgcatgtgaggctggggcaaagtccaaccgggggaatgcagcgtgtgcatgcgaagagggacgcagcccaatcatttgactgcatccgtgcccccactgcaaggcccaagatttgagaattttccaaggatctgatcgatcgcagtcgcaggcaggggagccacttgcatcctctggaatgcccactttgtttaaggaaacaaattaagcagtactagttcgttaaacgtacacggtttcaggcctacccgcatgtacttgtttcgatcagagagacacgtgagcttagcttagcgttgcttaattagttccttgtggtttaatttaagaagccatcctacctagcatgcaatgcaaccggtcagttcttttcagctaacttcaattcaaataggttattgtcacggattatttcctcaacatctttagaaatgtggttttgtgttaaacaaatgtcttctacaattctactactacattgcttaagcacttgttttaagctattcatttttatatttctaaaaattatataatttatttctataattaaatacttccttcgtctgtccagatcgatccgttgtcctagtaaaggtcaaaatcccattgtaggtgacaatattttgagacgaagaaaatagataaaccataccaataacctaaagaaaaatttgttctgtacagcgtggagtcgctgagagaggaatggactgagcgtactgtggaggcacatgagagatgatgagatgctgtgtggttaaagttgcgtgaagcaacaacccccccgtgttgtgtgcgtgcttgcagttgcaggtgaggtcggtacggtgctagcttggcctctccgtgtttttctttcttttttcttttttttttctggcagcgtggcgcatgccgaattccccgagaggaggcaggttgggtttgggcgtttggctaagggattacctattcatttatcgataaatcttctcttaaaacggttcaaaaatcaacaaattccgaggaagaaatttgccaacagatttatagcaaaatagtttgggcaaaatatgacgatcaccaaccgagcgcaaagagtgtttatgggcgaaaaaaggtttgtaagcgagcttagaagcttactctatctgttcacgtagtattaaaatatggccctgtttggatcctatcttaaaattttttatccgtcacatcgaatgtttgaacatctgcatgaagtattaaatataggcttaaaaaaataactaattgcacagattgcaactaatttgcgagacgaatcttttaagcctaattgcttcatgatttgataatgtggtgctatagtaaacatttgctaacgacggattaattaggcttaataaattcgtctcgtggtttaccaacggattttataattagttttttcattagtacccgaacaccccatgcaatactctatataatacctgatgtgaatgggggtgttattataccctatataacacccccatatatcacatctcgtattaatttttttttgttttgtgatggaaggagcacacgagccaaggtaggcgccgacagtaaacactttacagcacaggtacgtgtctgtaggtagccaggtgggtacaccggtacaacctattccctccgtcctaaaataatacaaaccctgtgtttccgtgtacaacgtttgaccgtccgtcttatttgaaaaaattattaaaaaaatcaaaaagacaaatcacgtataaagtattaattatattttatcatctaacaacaatgaaaatactaattataaagaaaaattatataaaacggatagtcaaatattagacacggaaactcagggtttgtctttttcttttttagacaaagggagtatatatacacacatacacggggttcgtacgccggtacgcgtagcagcagcgtgtacgtacgtacgcgcatgcagtgtctgaatctgaagactgaagatgcctgttttggctgtatggtggtgccagatgattgaagaggaacggaagaagccaagccagccgcgcatgtgggcggcggtcatggaccgacggaattaataagaccccgctcattaaatcggagcgccagctgctgccgttgcctgccgctgctgctgctgccttaggagggtctcgttcggtataggtccggtgaaaggcaagggttcacacaaccgatgaaatttcgcgataactgattagcttttatgaaaccgctagatctcggtttataaaaaccggtcaatattgaccaaaagttattggtttttaccggttttcaattggatttcggcaaaccggtgacgagtggtttttacatcgaaatcgaaaagttaaacctggtgaaaagcactgaaaggtacggcgcggccggcctggtgctggtgcgggtgctcgctgcgcccaagctgatgatgatgtgccaccgttagcaatcgccgcagcctgtttgcccacatatgtactctccagcgaaatcaaggcccagcagttatggaccaaaatctccatctgccgattaaccggcgtaaaaggccagcgagcccacggcccagcagctatggcccacacgcacacaaggccatagggcctctgtacatagtacatgaaacaaagctgattgccacattgccagggcagcaagtcaggagctaatgaaaggattctgccacttcttttgcaagattgaaagaaaagagagagagattttgcgaggggaacagttattagtactaatagtttgcttatggttagtatttctggagtagtgtaacattacaccaccacttcatgtcataagtaaggtcacccaccactcgaccgtctttagagtttagattagaggggttctcaaaatgtactgccataagttatgtttaactagtgctgaatatataaggttcttcttacttgtgtcattctctgttccttcagttaatagttgatacggctaagcatggtttctacagttactccggggggactgccggactggggagcggaagtaattgtccaggactgaaaaagaactgataatttatctgcatatatgaataagcaaagtcagcatatttgaccaaatcaacactcaaaaatgaaactgagcatattattggtgttccaattatccagtacaattggatccagcaaacaaaattagtgaaggaattgaaattgcaatgtaaaatttaagtcgaacttcctagcagacatgaagccaagtctgccttgaatatgcagataagcaatatcgtcgattatatctcatatggagaaaaggagctagtggcataaaagcttcattccacacgctactagtcacatctgacaaaaactaactgaatctgatgttttttttttagtatgtcaaactccacattcctaattttagaaaaagtgtgatcatatgctgcatgacatggcccaaacatgtctgctagatactgctaagatcaaatgctggaaattaaagagaacaagaacaagaggtatctgattctggctgatgaatttcaggggtattagtaataagtaactacttgcaaactcacatgtttcctgacaccgtccatgaacaggaagaagtcttcatttttgcaggattagcatggagtaaaaacacttagccagatagaaaacagcattccaataaaaacatcaaacagaaaaaaagggtaagaatataagatgtggccaacacatatggtgagtaatagtacatggaaattacataaaataaataaataatcaaacaaaatactgtgagatattatgattcatgtttaacattatttccaaaagaactgaaaatgatataataatcgactacacagtaaacaacaagttgcaactattacagtttagttcaaaattctaaaatgaataagcaggtcccctgctcattgtcaggaaaagagcaaaagacacctaaaaaaatgcacaaaattgtttgtcacattgactaatgcatcataatggctattggttgagtaaaaaagaaacagatatgacaccatactaacattttgaagagaagcaccgtaaaattaatgagatgatgcataagcctgagtgaaaacttccataaaatccacatttcttccacaccataaccttgtgaggtctgttgtgacgttttgcttccatgttcatccaaaaccttcctatgtttttggtacaataaaacatggactaaagggtactaccaatcaaaggagcttctctatactgttacacaagaatatcagaagaacccctatacatagttgcaaaagtctaacagaaagtgtcaaaactaaattacaagttagagcataatgaacagtttctccaaattagtgcctgggtaacacaatctcagcgagtaaacatcagaaagagacactgagacactgcttaaactacgtagagaagatatataatagagaactgttaataagagaatgcttattggagttttaattaccatttggcctgaagacgataggaagtgcgggaaatcagcaatgccttcctggatgatcatcatcatcaccatcccttgatgaactccgtgacctcacccggcctctcctctcgaagtcacgctcaggatactcctggtacctcctcctgtcacctccataacgatcactctcatcccaattcctttcatgctccctctcctcctccagcactcgcggccgatatcgacccctctcctcatggccatgcttcctggacagatcaaacccatcacggccacggccacactgcctcctatctggataacccctctcattgccattggcattgccagtgtccccctcattcctaccacctgcaggtcttccccgccgcgccgtgccacgcaccgttccatagtctccattgcggttgggctgctgcattggcggtttttgctgatgccgcggcatcccgtaacctccaaaattccatggctgctgtccaacccacatgccggtcatccgctgatcataccacatccctgtgccacccatcgccatgccgctggctgccaggaacgctgggttcacatggggcgacatcaccgatggcatcatgctggtaccaatcgccgcattgcactgccctatcatcggcgcgaacccgccgtagccagcgccgccgccgcctcccaacatcccaccaccgaatggaagctgaggccgtggaggtggagccagagccggcggatcaccaagaggaggccccacattgccccgagctgtcgtcgagttgcccccgtggccgccgcctcggcctcggcctcggccgcgcgcggcgcgcggggcgtggacgtgggggtcatcgccgccgccgccgccgccgagggggagcagcgtgggcgggcaggagagcgaggcgacgcagtggcgcccgtcgaaggtgcgcccgtggagcgcggcggcggccgacgcggccgcgtcggggctgaggaagtcggcgcggcagaagccgcgggacttgccggtgagcttgtcggtgaagaagtggaggccgtggagcgcgccgtgcggcgccagcgcgccctccacct

SEQ ID NO: 77642 - DNA, 3217 bp, Oryza sativa
gggttttgggaggggacgtcgggtagtgggagggtggcgagagggggaggaagccgaggtcgacgtcgccgtagaggtcgtcgcagtcgtcctcggtggtgggagagggggcgtgggagtcatggacggcggcgatcgcctccgccggcgggaatgcggcgtcgacggcggtgagttcgccgccggcgtccatggggggatgggtgggtgggtttagcgtgttccgtttggttgggtgattttgttgagtagtgtaaaaaccagagtccaacagaccaacaggggaagaccagtgtagaaatatcaagggtaaaaaaagaccaagagtagattaaatactagctcattggcttactcaaatcatttctcaatcagtaaatataactaaatactttctttcctccagaataaaacaatctcataccggatatagcacatcttagtatgatcaatctagacatacttgtgtatatagattcatcgtactaaggccctgttcgactgttcgactctagatttggagataaatttttgttgcacacaaaacaataaatctcattagcacctgataaattaagtattaactattatgaagttgaaaaatagatttatttgttttttaaaacaactcctatagattttttttttaaaaaaacgcaccatttaaccgtttgaaaatcatgctaatagaagacgaggaagttaaagtttggagttgaagaataaaacagtgtctaaaatgtatcacataccgtacgaggttggtttattctggaatggatggagtaattcttattgaaatcatttcattcactaagcggttaagagctaaaaaatgtgttttgagagaagtaaaaagggggagtattattgctttatcatgcaaaacttgtgcgttcaatgagtcctcaccatacacaaactgcatgtaaatttcgttcaacggaactttcaaaaaaaaaaaaaagggcgtagaaatggtatgtcataattgagaactgccatactttaaaggattcaactatagttgttctttttaggattgtatttctatggtgtacaacatcttaaaaactttcctttgatttgttttctttttccgttgatattgtcaaagggtcttcgttgtgtttccctatcctgcatttaaaatagagccttaatgtgacaaaatatcggcttacacagaatattttggaccctttaatttatctagggaaatttcttttcttggtttaaaccgaagaatacgtagaaatggtatccaacaagaaaatgagaaaggcactgtccagattccagaaacaaccacccttgtaaatgagatcagaaagttttttttttccctttcatcagtaaaaggttctgtagcctacagtgcaccatgtgcacacaataaacagcaatcttggcatcctgccaagtagattaatgaaataagatacccatcaaaacaattgttattcagagcagacaggcccaaggagaaggcaaaaatgtaagtcatgcgttactcattcgtttgccaactgatgttttgccatcctgtagcgcatctaagatatcctggtatgaaaaatcatcgtcgcctttattcttggagccagacttcgctcctcctgactgctgcaccgaggcaggcacagttccatcaagagcactcccgtatgctccggatccatcagcagcattgcactccttgaacttggactcgctgtttgaagttgaacaaaccgcttcagcttgatccgcgaaggagaactttgatacagaggagcggcaaatatctctgtaggtatcatattttgccgctcgtgttttgcctccttccagtatagttgacaaagggtgcaagactgaaatagcactatctgcactctctaaggtagccttcagatccaagaaatcgtttacagactcttgtttgctgaattgaacaagaaccgcagtggaatcaatcgggaagactgatgtaacagaagctcgaccaaacactttgcagatgcagtcctttatatcctttggtctcaccttagactggaatccccagataagaatgacgttgtcatacacggcagcaggatatctacgcttataacctgcatctggtctctccgtgccagtactcaaatcaagcactgttccactgttccagcatgggggcagcagattgatgtgtttcttcagattaatgtttgttgctaggtcctccaggggagagagttgctcaaatttaatgccatgataagcacagagctgaacaaaaacacatccagtcatgaatgcatcataacctgcttcatgcttagcacctgaagtgaagcaagataacctgcagaataggaaaaaaaacaacaaaatagaaacatcataaatagtaccagttggtaagacctactagtgctactaaggatgagtataagtgtacatgcagaaacaataattacattatatttcaagaaataacaagaaatcatacactgtttcatctgcctcgacttcaattctcacagaaggaagggtggatgacttctcatcaggtgcatgaagtgcagggcacaacaatgaaaaggctgacgaaagtgatttgcttttgtgcctcatacgatactgaaccgcgtcattaacagacataagatgcctggtatctgccatatgtgggaacattctgttgatactcaaggcaaattcctccatggatgaaggaagaggaccaacaaatttgctgtagatttgtgcaatatctgtgtatgcaaataaagatatttagtagaagatcaaaacttatgctagacatcactcatcaattcaaagttggtcatctaccagagcaaattccaatacattcaggagaactgtgtgagagagagagagagagagagagagagagagagagagagagagagagagagagagagaacctaggaaacaactatgaccaacaatcaatttcctttctgaggcaagaagatcaatgacatgacggatccctactgctgatttgacttttgcttccctgctttttagtagatcttcccgaacatttttctgtagcaaaatagccagggtgattattgatcattaaaaatatctcaaatagaccatcatacatgtttagattggtgaagtaatctaaaatcaaagaaaaatacaaatgtaaatttcaaatgcgacaaggcatcatttgattctcagtcaaatagtaagcctggagcag

SEQ ID NO: 77643 - DNA, 736 bp, Oryza sativa
caacctaatttggaagccctgggctcctcgcaaatgcaaaaccttcgcctggctggtcattcagaatagagtctggacctctgatagactatgtactcggggatgatcaaatagatccatatgtcccttatgtcgtcgggtccaggagacggctctacacctcctcgcaggctgctgctacacaaagagaatatgggcaaccctagcggaatggacggcgtgcaacaatattcaccccaaccattgacggcaggcttcgtcggtgttagaatggtgggatcaaaccacaagtgtaaaagaggcacccaaaaaggctctacgctccctaacgctcctagtcgcctggttgatctggaatgaaagaaatcgcagaatattccagcataaggagctcccaccgagtggtcttctgacaaaaatcaaggacgaggccgagtggtcttctgagaaattggcttgttccttagttgactagggccaaaggtcctgagttttttcttttccttttcactgtacagttttctccttctatattcaatgaaattggcggctcgccgattcgttaaaaaaaaaaatcacgggccagtttcttgctcctcgtccagcaccgccctatcgggcaagggtggcagcctgcaggtactacaatagttggagctcggcacagggctatgcattggctgaggtggagtccatgcgggcgtcaaggccgccaccatcgccgctagcacatttt

SEQ ID NO: 77644 - DNA, 4879 bp, Oryza sativa
atataccctttcttcaacttaatccatggcaggccaaattttttggtggtttcctgacggcagaagctgtgatcagaaagatgaacaagcttctgggtatcccagaagacaccgaggaaggtgctccatcgaataggaacccaccttggatatggtgttgcttgaagtcttaccgtctggacaagaacgatccctggggaagcagaaggtatcggatttttggcacagagatcagggattgaataggggagaaagatttggagcaacttggaaattactgtgtacagtggcatttgcttgtggtacagacacgcaaattgactgagttgtaacagctaggtgacagcctttcggttggtgctactacctacaatgttactgtgatgctgttagcatttggtaatgccagatgatttattttagtttaatcaaatgaattatatgtatcacataaaacttttaattgattttattaaaattatcaactggcataaacagaatttcctctctcccaatctggaaccctaatagaacaactctttcaggaatttgaaaagaatactagcagcaattcagtactcttcttaacttaaaatatactacctctgttttatactccctccatccctaaatgtttgacgccgttgacttttttaaacatgtttgaccgttcgtcttattcaaaaaatttaagtaattattaattctttttctatcattcgattaattgttaaatatacttttatgtataatatagttttacatatttcacaaaattttttgaataagacgaatggtcaaacatgttttaaaaagtcaatggcgtcaaacatttagggaatgagggagtattatttaacactttgatttttcttaaagccaaacttttttttatctttgaccaaatttataaaaaatatatattaatattttccacataaataaagaaactatcaaaataaaaatgctataaatgttgctatatttttctataaatttgattaaaattttattaggtatgattttaaaagaatcaaagcgacttataatatgatgaagtggagaaagtagcaatataggttcagattgaacacaacctgaactacgaatttaggtaagggacatattcaaattcttaatgaattcagataggagaaatattcaaattcgtagtgttatatttaggataaagggagtaaataacagtataacttccatagtaatagagaatttttcgtaatctaaggctggaagtaatgtcgaagacaatgaaaaaaaaaaggctaaaagcgatactagtactaactaaatgcccgtgctttgctacggttaaacgaaaatgtattaatgtggtgttcatctttttgctaaagggaatgttcatcttaatctaatttttttgtgtttatccatttagatttgaatctgttttaatactaagaagttcaagtggtaacttgcaaaatttacaatggaagtaggtggggtgacagattcactgccaccatcgttaccttcttttaaactactccctccgtttcaagttataagatgttttaactttcgtcaaagtcaaactgattcaggtttgactaagtttatagaaaaaaaaattcgatccaagataaatttattataaaaatacatttaattattaatttaataaaaactaatttggtaatgtaaatactatatttgtctataaacttagtcaaatttgaaacagtttgactttgactttaaccaaagttttataaactgaaaacaaatatagataaatgcaagtagcgtccacttcacctctcttctttcgacgcggatgcggccgtccactggataactcacggacgtctggggaaataactaaccccccgtgccgcctaaacaacggctaacgtccaccccaatccacgcgacgctatacctcgcggttctcccacttctccttcctcctccataaaccgcgaaagaaaatggaagctctcgctatcggatccgcacctccccgcccgccgggcctcgcactcccacccctcacccgtcaccaccacctcctcctccaccgctccaaaaccctagcccctcgccgtttcgtcgccgccgcgcccatggacgccgccgccgccgccgccggccggggcggccccgcccctccccgctgcgcccgcgccgagacggtaattaagctacgatcccctcctccttgccgcctcggagctggatgccactcggagaaaatctgtgagaggtttattaatttgggtggcttaacttatcgttgcaggattcggaggatgcggtcgcgacaacaagctcgccgcacttccgccgaggccgcgggcgcggcggagcagggaacggggccccggcccggtggcggatgccgccgacgtcgagggggttgacgggataaggatccggaggcgccccgtgaccgggccgccggtgcactacgtggggccgttccagttccgcctcgagaacgaggggaacacgccgcggaacatcctcgagaggatcgtgtgggacaaggaagccgaggtttcacaggcacggttcatgctttttttttcctactctccgaggagcaaacaatgtgtgacagtgtgtgtgtgtgagagagagagagagagagagagccagtgtacgctactctcggatgtgaatttctggaaatttgtggctctggcagatgaaggagagaaggccactgtacatgctgaaggggccgctggagaatgctcctccggtgagggatttcgttggggtgttgaaggcgtcttttgatcggactggtctgcctgctctgattgcagaggtcaagaaggcttcaccgagccgcggtgtcctgagggaggacttcgagccggtgagtttggggggatgaaaacacatgctaagattaggtgtatggatctttaaatgttaccctgtatgatatcggaattcacctgctagatggatgtgaatcatagttggtacactatcattgcagcgagtgtttgttttactaagttatctgtagaattttagcaatttaaatctgatatttatttagtgaactggttattacagcctgattggtaacgattgatcaatttatctcctgtcatacaacagaagggtagaaatgtcatggtgactgtccttttatttactttaagggattggaatcgatcatttcaaactttacacacacatattagctgtgcgctcgctgaaatgttgcagaatagtcattgtctttatgttgaataacatatatttataatggtcatagctctatggcattccccctgataccgacttatctcaatcttcaagcaacaaatttttactatgttacatagaatttcatgatgccttccttttatcttttagttgtgtacttatggcactaccactttaattgcgtaactaccagttagtgatatcttcatttgttgacattctgaataaagattcatgcttttgtcttaaagaaacaacttggttacttttcatgtgtaagaagaaaatgcacctaaatagctaactgatgtttgtgggggacaaacaggttcagatcgcccaaacatatgagaaaaatggagcagcatgcttaagtgttctcacagatgcaaaatactttcaggtcagtaatcttttcccttttgacaatttggctactcctctgatgcattacgaaattatgcatgctgaatttgtttccgtttgttatgtaatcagggaagttttgactatttggatgctatacgcaatgctggagtacaggtctgtaaatttgctcatatgttgtacttccacttacagcagtcaaggaaattcagttgtgtggttcgaatgtatggaaaggctcattctcttgaatttctaaatgcagtgtcctctgctgtgcaaagagttcattgttgatgcctggcaactttactatgcgcgtttgaagggagcagatgctgttcttctgattgctgctgtcttacctgatcttgatatcaagtatatgttgaaaatatgcaaaatacttggcatggctgctttagttgaggttagctgagttatttgtgatatgttttacatgtcaaagcacttccaactctcttatgttagctgctttggagtcattctactagtgttgcaacttccaattcattttcttcttccaagtaaatcaaatgcaacctcaatattcaaattttgatttaataaacaagctaaatgtgttctgaaggtgcatgatgaaagggaaatggaccgtgtgttagggatagatggtgtccagctcatcggcatcaataaccgtaacctcggtatgttattcttgtttcacatgtttagacaagttactttggcacatatattatataacaatgtatggattcaactgccagtgtgaccacacaattctttgtcagatttgttccctataagtcactgtggctaagctatcatggtgccacctgaaaacctgttggctcatattgaactagtggcttgtgcattttcatctatcgccacactagtggctcatgttgaagtttctattacacatggttgaaaagtgatttgggaaattatggataaactaagctatttgattcttaaaactagaactagagttcatttataaatctagcattcagtcagtcaaacatgatagtgtggtccgtttcagaactgggcttttagagctgctaatgttatatttcaattcttcatataattcactgcaaattaaatattattgcagagacttttcaagttgatatttcaaacactaaaaatcttcttgagggtgaaagaggacaaactatagctcagaaaggcataattgtaagtgcttctttaacttaagttctgttgaaatacaagagaattc

SEQ ID NO: 77645 - DNA, 1217 bp, Oryza sativa
gcccgcgcgctggctgcttactcgctcagccgccggcccccccccatccgcgtgcgattagcacaagctaattacgattgttactgttaaataccataattaaaaaatacatgtataatttaaaattttgagttatcagttttaaaaatttgggttaaaacttttgaattttgatatgaaagttttcaactagatatgaaatttttttaattttgagttggaagttttgaatttcaataccaaagttttaaaatttgagatgaaaatttttaattgagttgaatgtttctgaaatttgaattggatgttttcaaaaattgagttgaaactttcgaattttgacttgaaagtttttgaattttgagttgaaagtttttgaaatgtgagttgaaagttttcaaatttgagttaaaagttttcaaattttgagttgaaagtttttaaatttgacttgaaagtttttaaatctgagttgaaagtttttcaaatttgagatggtaagttgaaagttttcaaaatttgacttaaaaaattcaaattttgagttgaaagttatcaaatttagggtgaaagttttcaaaatttgacttcatgtatagatttcttatcaatctgttataaaaaaacaaatcttatcttaattattatcattatctaaaactaaccgtattagttagcatgtatccaaaaaaaatcccggaaaaaataaacacagaaagctcaccgagtgacaagggcccgccacgtctctaagtcgctagtacgcgcgaattagcaaaaccgcaatattactccatcactcgaactctgatccgaaaccaaaaaatccacctcttttcgcaagcacttgcgccactcgcaagtcgcaagccaaaaatcacctcactgtttccatggaactctcctcaatctcagcttctctcctcctcatcctccctcttctaccgcttctctacttcctctacctgcaccaggaccccaagaagcagcctcgtgcccatggactcaagtcctaccctgtcgttggcactctgccgcacttcatcaagcacaagaatcacatcctcgagtggtcggccggcgtcctaaagcgcagccccatgcacaccatgtcgttcaaggcgcttggcctcaccggcggcgtctttacggccaacccggccaacgtcgaacacatgctcaagactaactttggtaactatgtcaagggtgaggcc

SEQ ID NO: 77646 - DNA, 11919 bp, Oryza sativa
gtaattgcattgtcaaatgtcaagccatgtttgaatgttggaggacatgctttgttgctactgcacattgtaacaccttgtgaattgaatatcatcgataacagggcttattaaggtgttggtgccatgatctatcttacatgtgtttactctctgcatctttgctaccttaagagggggatttgttgaccctagggatgaaaacggatcaaatacggtcggaaactagctctatcatattcgttttcattttttttctctcggaatcagaatcggaaacccagatacaaaaacggaatcaaatattatcgaatatagatatggagcgaatatgaatcgaaacgaatacggtgacgaataattattgaaatatcaagacccctcaaagtaagcttcttaaatcgaggaagagatgtagccattagttttcaaaaacaaaacatcaacattttcaaattttatctctatttgtaagggcagggggagatagaaaatgttgtgtttactttccatacaaatttatgttatcatgaaacaaataaattaatgtgtatcactgaaattttcgcaggcacattaaaattttgaaaaatggttgaatgttttaaattttgggttgaacatttcaattagagttgagagtttcgaaattgaattaaacgttctagaatttgagttgaattttttaaatctgagttaagagttttgaattcgaactaaaacttttcaatttttgaattaaaagtttttaaaattttcagaattgaattgaaagtttttggaaatttgagtggttatttttcagaattgaatatttccatttgtttgtatgtgaattgctattccttgttattttttcatatggtttgtttttgttccacctaagtagagaaaagaaaaacatgtttttgcataagaacaccatatatctgatgggaaataacggacagtatccgaccactatccaattccgacgtatatcacctatatcatattcattttcatttctgaaaaaaaaccgaattcgtttccgatttcgaaaatttccagatatatgcgaccgaaactatccgaatccaaaaagaggtccggtcggacggaaactatccgaatcactttcaaccctagttgaccccgcctaaactccatgaatcagttgggctttcctcactccactgaacattttttgaagacccatatttttattagaaatagtggttggaaacaagtatatgggtgagggagaattcacacccagttagaaaaaaaaaacatatcatgacaaataggggtgggcaaattttgactaaatgactgatcgaatattttggttagatattcgacaaaacatttttcccccacccatgcttcatggaaccctttcttttggctgctgggagtatttgaaaggagcgaaataatctagtttttaatggagtccaaccttaggtccttgcatggaagagaaatctgaaagctaatttgagtcaacatttacctagactcaaggaaatgtatatgactttagtgcaatcgtggatttatcttttgtaatgttgccctttctccttcttatttgtaaattttcttaaaagttaatatatttattgtgctttcttcattaaaaaaaggccaataacaacatgtataccttagcccagcccaacaccgaggaaaatccaaaccaatccccaccccctcccccttcccaacacccacactcgagttggtactccccctttgcaataacctagtcgactccttgtcacatgccttccttccctcaatatacacaaggtggatcgagagatcggcgatggagatccaaatcgactatattgtggatgtcaacattgtgtgccctaaccgatgccctctcctcccttggggcgacgagagtggattgagggactagtgagagagagctagagttggcatgagcacggcttgtcctagcggctagcgcggatgtcaatggtaagtgttggccccgcgcgctctccgcccctcatggacgaacgtgacactgccatattctacctttttttatgatttctttgatttttttccatcgtttaaatttgttgatgattatagtaatgagaccaaaccgaaatacctaaacctaatatctctgtcttcattatttttgcaatgtatttcgatctccacttttagattaccagatttttcacataaaaaaatgagagaccaaacctcaatccgactgaatgcccatcaacaaatagtgtgatgataaagactgacaaactcatgtttaagttcacattgcatattcttctaaaacgagcttcgtgtgctagcttgtcttctatcccaagccacacctcaagtgagattgtggtgttagttgcgagatccggagatcatgagaagtagccgagaaaatctacaaagcttctagctagctattagtttgtttatgaaaactgtatctaatgggactcgaaatctggagtagagattatggtagcaactatagccatgagaagctcaccccaacacaagaaatgcaaaccccattgttagtacgttacacatgctacctctattgatgaacgaagattcctatgcactatcgattatttgtattatttctttctaccacggaaaaatagtttttgaattaattgtttggcctcaactttttccaaaatgttaaggcttatgaaagtgatggaataatccttaggctcacgttgactacttggctcttagttatgttgaagatgaacactgaacactgctctatgtgagggaatatttggtttagtgttaaaagcatacatgtaaatgtattttcaataggaatttagtgagattgaggatttgttggtaatatccatctcttttgagttaagaggatgcgctcgtgggtgtgtgatagtttagagtttggttgtgagtagtggggtgtgtgcatgtgcaacattgatttaatcgaaaataataagcattacaaattttaacgtcaccacattttaagtgaggcaaagaggcatgctctaagcctccagctagcacaatcctcaatggtatctatatatgctactgtaaagggggagcgtatcctatgtacacaggccctcacgtgtatacaccgtgtacaccaactaaaaattatcacaaaaaattctaggaaaattcatacatgtactttcaatagtattacatctacgtgcaaagtcgcatcttcaaattcattctacatagagaataacaaaaaagataaaattctgacaaaattgtaaccttaaaactgtcagattttttgtttttttttgttatggctaaaatataatgaatttgacgttaagattttaaccctaggtgtaatacaattgaaagtatgtgtatgattttttctagattttttggtgacattttttagttggtgtgcacgtgtgtacacgtgagggcctgtgtgcatatgatatgttgccctgtaaaggagaatcgttctccgcttcactttcccggggccacatgtatgcgaaaaatcagtgaggaaatagatcttgcacccccatctcctcttaagaaaacaaaatattttttttctagaaaaccggccatcaggaaaaatatatataaaaaagtccgaataaaaaccaaaacgctcggttttatttttatcccatgggatatgggtaatttgctactacatccatcttatattattctacccttcaaacttgtcccacaatataacagatattgatgttgtggtgcactgtactatttatcacatcaaccaactataatttaactttcttcatatcttatccccaactacaactcacccacaacaaactctcacttaacaggggcattatagtccttttattcttaatctttcaaaaagaaggaataatcctagtattatagaatgaatgcaatactatttgtaaatataaactcgacggtatgaaaccaatttttctttgtttagatgggctcaaatattggtcatcaacgcaaaacaaaaaattgtaattaacatatgattaattaaatattaattattaaaacttagaaattttatttatttgatttttttaataaataatttctatgtagaattgttttagtaaaaatacacaccgtttaacagtttgaaaatcgagaaaacagacaagttgaaacggagtttagagcgcaccctcagtttaatttcctggtatgggccaggattttgcatccgtttcactttcacacacggtatcttcccccggcgacggaatccacctattactccagtccagattgagaacgcgcgcggcccacggccgtcgcgcttaaacccggacaaggtggcgagtcctagtagtagaagtatttacggagcggcgcgacgcgatctcccaatggcgtcggcggcggcggcggcggcgtccgacgagcccccgcgcaagcgcgcccgaagcgccggcgcggaggaccggctgagcgagctgccggactgcctcctgcacgacatcctcgcgctggtcgggtcccggcaggcagtgcggacgagcgtcctgtcgcggcggtggcggggcctgtggcgctcggcgccgcgcgtcgacatcgaccagcgggagttccgccgcgcgtgcgggggcgaggagggagagccggtggtggactgcgacggcttcgaggacttcgccgacggcatactgtcgccgacgctcctgggcggcaccggcacgccgccgctggacgcgttccggctgcacctgctctacgaggggaggttcatcaccttcgggaggtgggtccgccgcgcgctcacgcgccgccccgcgtcggtcgacatccacgtcgagtacggcggcacggtcgactggccgccggcgctcaccctcggcgacggcgccggcaccggccgcctcaagcggctgcacctcttcggcgtgcacctgggcttcatctccggcgacggggggcggctcgccgagctcctcccggtcctcgaggacctgcgcatggagagctgcacgttcgggcacgagccatcatcacccaccaccaccatcgccatccccacgctcaggagcctcgccctcgccgtcgtgccccgccgcaccgcgaggccctacgcgctgaccgtcgcgtctccccgcgtcgcctccctgcgcctcttcctcccgttcagccgcacgcgcgcggccgcggtgcgcgtcgcccccgcggaggagggcgaggcgctcgcgtcgctcgtcaccgcgtcgatcactgtcctcgagacggaccaagagttgaatcggcgcatgaacaaacacaagctcgacttcctggcatccacccgcaacatgctcgaccgattccccaatgtcagaaacctagatttgtcagggttccccacaattgtgcgtaactgcgtatcccccattgctctctctctatttgaatctttcaacagttcagagcacacgtcgtttgcttttattttttttttaatttctagtttataagtattttcaacacaaaacaagcatattattaaaatatatttaatgttagatttaataaaactaatttaatattttatactctatgttgctaaactttttttaagaaatttggtcaaaattaacatagtttgattaggaaaaaaaatcaaataacttataatataaaacggatggtgcatttaagattgccatcattcactgcagtttgcagcgcatgggtccgagggacagaaattcagtaacctgcgtataactgcaaatgatttactggttcttttgtttcaggcactgctagacaaggcatcccaagaattcccaacgctccctagcttgacaaccttgcttctcagcgaatgcgatgttggagccaactgctacgtgctgaagagcgtcctccggaacgccccaaacttggagcatcttagattgcaccgttgcaaggtaatatgaaccatctgcgtcgtatcaatatcacatacgcattgtcagagtttcaaacacgatacgtttgaattcttgtgcctttggtgtttagcctctgaaattggatcactagtgcagttcttaggtacgccgaagaggaagcggggaaactccaggtcgaaggggaaatcttcttccacatgccttgactcgctatcttccaagtgcaagagcttgcagtcagtggagatcaagtttcggccaattgataatgctcgtcaccacgaccttgtagggttattgaaagaatgttaggtgaaacaaaacgtcagcactgcaagaaatcgatcagcgaaggcacggtaactatattaatacctattacatagaacatctcttgcatgactgcaaaggaagcattctcatgaagccacagcatcagtgatttgttatatattctagcccttctgtcacactcgagagtgtctattacatgcatatgatgtaattaatcataaactctttttactgacaaactgaagagattagtacaccaaagtcaattagaatcttgcattgctccttcactggggaatttcgcaatatagatgttggcagatgctaacaaggagggggggggggggggggacttttgatgtcatcctttcaactctgttgacttagtctactactacatctggcagcttaaagaaagtgaaaaatgtttctgttggcagaaaaatgactctttgtaagagcttcaccgcaacatggtttgtccctcaccacgattagttttgcaagtgttgtaattttaattttcagatttacaagtttttatttgaaatatttcaatcagtgttaagatctttccaattaaagaacctcaggtttcaattcaaatgttttgtttgagttcattgaggatggttcaaagcttagagcgcctgttgaagggcattgcctatcaccgtttcccgtcctgcacaccctttgcgtctacgatggtgtgacaacagaaaaggtttgcacgaagagtcagtcaggttctttcgacaccaaggtgatcctagcaattcctatgctcttgtaagaacatagttaaattctttcaggatgaatgtagaacgaataaacggagctagatttttttttaaggaatgagtggagtgcttacatttctcgggacaaatatagaacattagagataaaaattacatgaagagttgcggtcatagagctccttatgcgtcatagcttattgttttaatgttttaagttaaggcaacgtttggctaatgggaaagggccgaaaatgatttcccacccatcaaaaaacatctttaaatcctaactgttcattctcactctttcatttaatcataaccctacattcatttccaatctcaatcccaccttccattttccattatccaaacacaccaaggttgatgcgataaccatgtgtccacgttaacattattgttcttaataaaacaagacaatacattgtccaccgctatatagttagtatttaataagtccagagttcaagacaaagaaatgtatcatcagactttccatgcttcctattactcaccccgttctattttaagcacaatcataagtttccgtgtcgaactttgatcgtttgtcttatttgaaatttttttatggttaatattttattattattaaatgataaaacatgaacaatactttatttgtgacttatgtttttttattttttttctaaaaaaaataaataagatagacgattaaagttgaacacggaaactcattactgcgcttaaaatgagacgaatgcagtagaatcttaagagggattacgatgacttgcttaagggatatttgttctaggctattgatggctcaagcccgaattgctttaagcttctgtaccagttacgactgcctacatgatatttgtgtgtacaatgtattaacgaaactgtaatatatatatatatatatatatatatatatatatatatatatatatatatatatatctcattgataaatatctaatccaataataaaaatattttgacataaaaaaactggcaactcactatagcagtatcccctacacttggcggcatcagtcagcagcacgaatcttagagcaccacacattctccttcgtctacctccgtccgcccaacgccttatcctctactactacgagctctgctagttaaaccccgacttctccctcccaccacgcgcctcccgcgctcgcgctactaccctcacctcccccacacccaaatgctcctcctcttcctcccccacccttccccacctctcctcccccccgccgcctcgagaacccgacccccgccgcgcctcctcctccctcccatccacgcctccccctcgccggagctcctcgccaagtcggctctccgccgcatctccgacaagctccgcagcctcggctacctcgaggccgaccacccggaggcggcccccggtccggcggcgccggaggcgggcgccggcgcgtcccccggcgagatattcgttcccacgccggcccagctcccgcgccaccgcgtcggctccaccctagacccgagctgggccacgggcgatggggagggggccgccgcgtctcgccgcaggaggcgcggcgggagggatagtagcgccgcggcgtcggcgccgccgtccgccgcggagctggcgctgccgagggacgagctgcggcggcttcagggggccgggattcggctgcggaacaggctcaaggtcgggaaggccggggtgacggaggggatcgtgaacgggatacacgagcggtggcgcaacgcggagctcgtgaagatcaggtgcgacgacgtctccgccatgaacatgaagcgcacgcacgagattctcgaggtgagcgctgccccgcgcatatgataatcgagtccagcgtaggtttgtagctgtgcgcctgtgcctcgcctagtaagtaaaacgttcagaaaatttggatgccggaaggcatcggagtgctactatatgttgaaattgcacagagtattagttgtatgttaattctgaatttcatcgcacaatgtgacagggtaagatgctgagtatagtaatatagtgctagcatatgattgtgcccacttcggaagtccctgttagcatggaaatggcagcatgtttattcaaaagggatacaactttgaagtgatcaaggattcaagatagggatattttatttttaattgtttgaaatgaatccatttagcagtgtactggcatgcacataatcattccttcttcgaagcattttattataccaaattccaaggcatttcttggattttctcttaaagtaatctatctcaatttttgttttagggcatttctatctcaacgcttttcagtttgcaattgacatgctcaatgtgtttttttatagagaaaaactggaggcttagtcatttggagatctggaagcaccatcatattatatagaggaactgactataagtatccttacttccatgatagagaaatgaagaatgacatggatgagtcatcagagcatacaagttctgatgacgaggacgcggatcttgctataatagcttccgaacaaagtggcagtgaagaggattctgataatcctgcagaacatggtagcaatcatactgaggagggcgatgatcttactagacggtttggtgttgatgcgcttgagggaaatttagacattggatctgcagagcaaagcattaacagtgctacaaaagatcagcaagcaatattacatacaagcactaatgtgtctcgtcctagcgagatcagtggtcgagctcggtcaaccttagttgctggtgttggttctccaaataagtttcggttacaattacctggggaggtcaaactcgcagaggaagctgacaaattattggatgggttgggtccacggttttctgattggtgggggtatgaccctcttccagtggatgctgatttgttgccagcaattgttcctggataccgtaggccttttcgtctgcttccttcaggagtaccaccgaggttaactgatagagaaatgacaatccttaggagactagctcgtcccctaccctaccattacgcacttggtaatttctagttatttgtcttgtataatatctttcatggctttgactttgataaggaccactgttatttactttcgtggtgtcatttatctaggacgaagtagtaaccttcaagggttggctgcatctatgatcaaactatgggaaagatgtgaggtagcaaaggttgcaattaagagaggtgcagagaacattgatagtgatctcatttctgagaaactgaaggtaggttggtaaagaacccagctatgaggaattaattgtagatatgtaattattcatagcatttgacatttctcgagcattcttgcgataaaacattgatgacattacagatttatctttcacgtgtcatcgaattttgaaatgtaaatcatttgcctgtattcctaatttcctatcataattgaagttgaaccatagcagcccagaatttttacatgttgaatcaaaatcacttctttttatgatatatgttccctcatactcatgcatattttacatgcagtatgaaggcacttaacaatagattcatattttttatgtgtcgccttgatttatgtggcaccaaatattaggaaaatacactttagtatctctttctgatgtgaaccatttcagcacaggctccaggccttcaacctattatatcctaaactttccattatgagaaattatcattacaatcatcagtttcaaaagaaaatcagagaggagggggggggggggtatgttccaccatgacattcttaatcttgcagggcttgacaggtgggacccttttatcaagggataatgagtcaattgtattctacagagggaaagatttcctgcccacagctgtctctcttgcaatagaaaagcgtagaaagtatggcaattctacaatcagtaaccctaagcttaattttgacaaaagcacaccgcaaaattcttctaaactgaagatggctactgatgtctcactagatgggcatgaatgctatgaaaagaagcataaagatgaaactgcagtttcagataatagagcagaatctcttaatgtgtttgcccagaatgttgaggccagattatctcaggtttgcttttcttttctagtagtgccatctcttgataattttgatttggtagtttgaaaagaaaaacacttgaaatagttaaattcatatagaaatattgttcaggcaattgcagagaaagagaagactgaaaagcttattgaagagctagaaatgtcgtctgagccttctagagctgaaactagagaggttatctcagaagaggagaggtacatgttgaggaaagttggtttaaagatgaaatcattcttattgctaggttagtattctcctcaaccttgtattgtgcagcatgcatctgttcagaagtcaaaatgctacctaatttgactaccaaattagttataggaaagtagattaccagacagtgttctccttggtgacccctaggcattcggtgtccgctccgcctaggtcagcaagctgatttttcccgcctaggaagcagttaggcactaggtcccacctatggccgtgccatgtgcctactgcctagcaccaagggaaacacttctatcagactgtaatattaccacttctagagttttcatctgtttagctcataccaagtggcattttaatccttgtaaatcctttttgtggagacagtgtgagtattatgtggttttttgttactttgggagtgcacatatttgaattagttcggtcatctgttgtgattcatcgcataacctccttttgtaccattctatacctgtacatgatttgactattattgcctttccaagcagtagcatccgcagccctaaggtcaataaacaaaaagagagc

SEQ ID NO: 77647 - DNA, 16518 bp, Oryza sativa
tattcgttccatgccacccattagatctgctggtacctcaaggacttcaggtctcatcactagagaggctcctgatgcattaagaactcaaccttatgctggcaagtctaccatttctattgatacaactcagccagcaaatggagttgcttcatctgctacagtgatgcctacagctcctgtgatggtttgtattttgtacttcctcttgtatatttaatttagtcatgagtctgagtaaaaagcaaaacttagctaaattagtttcattatttattcttggcatttggaattattttgaaccatgtgttctgttttatatttattattgaataaaaagttaccttaagaaagatatatctgtaataataaggttcatcttgtagtcgtttgttactactgcattggaaccagaagacctttagtcacattgtttaagcatgatcttttgcatttacttgctggtacagatcatacagtacaacttccatttgtgacaacggacaacactctgcttccattcaatatgatatgataactttagttatccgtataagagctcaactagttatgcttgtaactagctgaggtgctctactaattttattagcgagtttctgattttgtgttttcttaactatcatttgttcttgcaattctctgacattgctgtatgcaattttgcagccagaagtaccgctaacagttactgggttgctgaattcactaggacttgagaagtatgtcttcctcttccatgctgaagaggtgattgaccattactgattcatttccaaccttaaacctaattatggttctaatatgattgctatatttatggtgttcttttttgtggataatcatttctgttaaccatggagtaccttactggctcatgtattagtatttgaatgccttttgtatttgaccttttgcttgctacgggttatttggtttctactttctgaaaaaagctcttgtgttctttcctgtaagctattcattagcagctttgtttatactcacgcacacaattattcactacatgctgcatgttccaagtgtatgtgggtcaccaccataagcatttttttaggtcatgcaatatccagtaagcatatgcctgttttagtgagtacttatgcatgtgttcaagctaatagtaagttttttgagtgttcactggcgatgccaatgtttctttccttattgtttattatttgtttgcccacaggtggatatggctgcattgagtcagatgggagacagtgacctgaaggaaataggggtaccaatggtaagatgtactttttattcatactagcatctttacatatatgtactctctccatttcatattataagtcgtttgacttagtcaatattctttaagtttgatcaattttgtagaaaaatatattaacattttcaatacaaaacaaacatatttggtattgtaaatgttagtattttttttctataaacttggtcaaacctaaagagctttgactaagaaaaaagtcgaacgacttatagtatgaaatagagggagtagaaatgttctagttctgagtattttgttactgaagtactattgttcttatcattggtttgaattattatctggatactgcataatggactgtgaatctgtgattagagttagtttgaatcgtcaagtcaaaaggacctgcaaactatatcaatcactcatttagtacataacagattagtgcaccagcctaccagagcttgtctcgatgagagtagattattgtgtctcactaaaagtttccactccaagaatccaattcattcaagctggtcacgtttgctcaactttcgaacataatgggttacacagggctgtggcatgcagtgctgcctaatatttgtgctagcaacttgccatctcatcacatgccagcaagtataacattttaatgtcaagcctgatttgtaaaactatgattctgtttgtgtatttagacatgtgttgtaacacaatccatgttataggtccaccatctcatttaactactattgcaaggatgtgttgcactatatgctgtgttttcctgaagtctgctagcatgcttaattaattgaaccccacgaaatgggaggtctcctttcacctagagcatctagcagagattatcagcatctcaaacatgctagtgttatttgcagtaattttgactcgtggaatattatttgatggatcagggtcctagaaagaagattctccaggcagtggcaccttattcaaaacggcgtagatgaacagcatgctcaggaacttggggcgttcgtgggcaatgacaatttattggtgtaagctgcttcattgcagatcttgtatatcccaatggtctagtgctctagtcaatccgtttcattgctgatagatcaacgcatcgcttttcttggcatgcataatcttatctgtcagctgatgatcccaatcctgttattcacgacctgccccttgtgtagcaggatctgaaacatggatatgtagctttgctacactaaccagtcagttttttcttcctctttgggaattgggaacatcgatgacctgtaatcgaaatcccatgctttatgaccttgggagcgttggcaattgagtttactggaacatactagtgttaagattgtgtacagaatgcgaaacagaccgttgtgttttttgttaagtattttcggtgttaatacccttcctgtttacctcggttgctagtttgtacgcgtaagtccgtcatggtctataattgtgtgctgaagctataatggtataattctcctgtagaatgataatctttggtcactgtacaaaaaaatgcactgacggatggttgcatgtgtctcgtttatatacataggccaaaccccgtgcacatctgtcaattgggagccaccagctctaatgggcgttcagtacgagcaaattagtacggagtactataccttaagctcggtcctaatttggcaaattattgcgcatttacgccaactgttccctcgaggcgaccatgaacatcgtacctaattactgctaatccagattataacaagaaaggagtgggatctactattgctgcagcacccagatgcttcctgtccctgccgaattaatcatcaggataggatgcttcatgcttcggctctttaacggcgctacctggccttcgttgtcagccgatcaacaacgcaaccaaaagctcccacccgacaagtaccggccttgcactgtttcatcggtctagagcagcagagcaacccacaggttggccgatttattatgccccgtgctggtgctgcgcttcaaccgctcggtgggaagagtacgaagcaaatgccgcctttcgcctccatgtgcgcagcgggcggctatcccgcttgttgtggtggattggtgttttttacagcacgagaggcaatccaccgtttgttttttctgctcgcagctggggctcggtggcgtggcttttcacgcgagattaagcttttttttctaataagcgcgtaattgagccggtttggacaacgacatcgacatgaacatctttcctattgtaggatgtagggacgtacatggttaacgataatgacatgtagtaacagcaaagctgagaacaccaacgttgagtcccggccttgttcaccctccctcaccttccactgcgtgtagagtatcatcacaatttcgacgtaaacacatcacaaattcagacaaagctcgttgaatccaaaatcctaataagttgccagattttggccgcaccattacacacgaggagaccgaatcagatgatcagaggacgtcgcagtgccgcctgacgacgccctggcggccagtcttgacgccgacggcgccgagcttctgcatcgccgcggcgaagtcctcgaagaaggccgtccggttgtcggcgtagcgctggacgaacaccctcgtcgccgggtactcccacagcgcggcgtcggaggcgagcaggccgagcccgcgcggcaggttcttgaagtagacctcgtcgaacttgcccggtgtcatgatgtcgttgaagatggagatggtcgggtcgctcctgtagttggcgcaggagctctgcagcgcgcgcgcgaacgccgggttcagcgacgggtcgtacccgtcggcgctcctgaagctgtacagcctgtgcgcgaactcgccgcagtgggagaaccccacggtgtgcgcgccggcgagcgccacgagctcccgcggcgtgaccccttgcgcgcgaacagcaccgccatggcgcgcgcggacatgttggtgcgcgggaggttcccctcgacgtcgcgcgcgtcggaccggcgcgcgtcgcggcggcccagcgcgacggggaaccggggcccgccgaggatgcccacgaggtcgcgcgccgccagcgcgaggatgtcggcgcaggagacggtccccgggcaggccacctcgagcgcgaccttggcgcgcgccaccacgtcgaaggagtcgcccgggagggagaggttgatctccgcggcgcgctcgggcgaccggtcggcggagagcggggagacgaggaccgaggcgtcgcaccccccgacgaagcagtcgtggaagaagaggcggagcgtgcccgccgccgtggacgggttggcgcgctgcttggcggcgacgacgtccgcgacgatccgctccacgcgcgggcagctgtggcggtagtagttgggggacagcctccccgccgcccccgcgccgccgccgcctccgccgcgcgcggcgacgaggccggcggcgagggctaggagggcgcagcggaggagaagcgcgcccattggcggcggcggcggcggtgattcttggctcgatttgggggaggagagagaggggggaaaggtggtggagagagagagatagaaagagaggaggtgagggggattagtggagagtgggagtgtagtggagagtgaattaattgctggggtttaaggggtggaggcggtagtacgcggtggattgtaaagacgggagagcagctcgaggccgggaacggacggatgttcctcctctgcttgcggcgccatttcagcatatacagtttttctttacttttaccaacggaaacagtctcaaattactactagtacttacttttagtacttgcagactgttaaaatgactcatcatcatggtagtagtatacatgatccgtcttactcgagcagataatgatgatgggaagaagaacgatagctccaatattaattggtgcgaaacgtagccagcggccacatagcacgctgcacgccatatatactttgtgtggcctggccatacgcatctggtgcatgggatgggaagccctgcacatgcactagactaaactgaaagctacccccaacgtgtcctggagattttacgctcccatcctagcttcagtagcctgtgtgggctgtggtgtggacctgatcgttacgtgcaaatttctttgtccggatatgccttcgtttcgttttgactcttataattttaaccttccaacaaaactccccagattagagcatctccaagagactagccaaatgactctacaagctaaaatttggctaacttggacaaaaaaatctactccaacagactagccaaataactctccaagctatccggctggctaaattcccctcctcactggccaaagttggccagccaggacggcttgccatctggtgtgcatcccaccctctatcctatctctccccctttccccatccgccccatccgcgcaacgccgccgccggacgtcctcctagcactccatctgcccagcgccgccgccccatcctcccggccccggcgccgcgtcgatgttctcccggctcatgctcttctcgtcaccggcgtcgtctccgccaactcggcccccatcgtcggcaccgccgcccgcctcggcaaagcagttagcggtggcggcggccaaatcctcgtcaaagctgcaacccccatcaccgtctcgaccaccgccgatctcgtgtggcgaccccctccgtggctccgtcgaactcctcccgcggccgcctcatccgcatgcacgcgggctcatgtgtgaaaggaaagaagtagtagagactgacgtgtgggacccaccgttaaattggagaatgggatggagagactgttgaagtaaaaggtaattataactagctactttttttgatagttggctaaatagacatatgaagagtctaaaatagctaatctgttagagatactctaacgttacgcttcagtggagtagcgatctagcagcggtaggtaactagcctagcgcggtactgttgcttcactgatcgacaacggcaggctgcatttgcgctgctgtacgtagtgctgttatgtgtggccagtacggcagcaccgttgctggtgtgggtgcgttccacggagaaaaaaaaagaagtgcgctcttcacgggcagcaccgaagaagatcgttgttgcgacatggcaaagccgcagacaaagactccgagagaggagcacgaggagcagtagcgcggaagccgccgccccggtcacccggccgcgcgcgcgcgcgcgcccctctctgcgcgcatcacgtataaccgcgcgcgcgatcgacgcggccgccggaaacggatggatgcaggcaaactggctgcgagaggtgcttggggttcacaccgggcccggtcgcagcttgttttggtggtctccagctgtgtggttttagtgcgtcttctttcggccgtggaggccgggtagcgtagcgtaggctaggtatggacaaacgggagagaatcatcacaaggggagcagagcactagccctaaggccatcaccaatgtatatggcaaattgatccatatagatgggactcacataaataatttatccctatagtaatctctacaatgtatatagatataatgtatcattagaagaagagagaggagcagagatagataatataatttatttcatatgggtagtccatatgcatatgggtatcttttgctattttttttatatggactagttgcacaatagtaataggtgtaataggtggctgaatggaatattctattgcttatggactacttttacaccacattgtgatgccctaatggtttactactgctttggagtttgaagccatacttagcgcacacgcctcagggttcacatgactactccctccgtcccaaaaaagacaaacactaatttccgtgcccaacatttgaccgtccgtcttatttgaaaaaattatgaaaaaagttaaaaagacaagtcacgcataaaatattaatcatgttttatcatctaacaacaatgaaaatacgaattataaaaaaattcatataagacgaacagttaaagttggacacggaaacctagggtttgccttttttcaggacggagggagtatacattactccatccgtccaaaatacaagagattttaggtagataaaacatattacctttgttttttaaatagataacgctattgatttttttctcacatgtttgaccattcgtcttattcaaaaaatttacgcaattataatttattctgttatgagttgttttatcactcatagtactttaagtgtgatttatatcttatacatttgcataaaatttttgaataagatgaatgatcaaatatataagaaaaaagttaacgacgtcatctattaaaaaaagagggagtacatcctccgtctaaaaaaattaatctcatactaaaataggatacattctaggaggcataaattgttcaggggaccgaccagccaacccggctctcgtatgcacgcacggcagcatgtgccaacaaaacgtctcatctgtggatgtaaattaatttgcccgtgtttcacagcggtacaacacctccactgtcaatgccagctgttcgttaacataacatcaacaagagaaagagagagagagggaaaaaaaaacgtgccccgacgagaagctgcgacctgggaatgcccaaaaccgaagtgcgaccgagcagacgacgcatcgcagcacccaccaccagaacgcggcggcccaacgacagctttgctgtgctactgcagcgatccgcggcttcagttccagaccgggacgactccgtcttgacgcgtcccctctcgcggttgggtgggacgatgtgcggactgtgaggcgtacgcgggtgggtgggaggacatgcggcgaccgtggggcgcatgggcctggattccgcaccgcgtccaaaacaaatttttggaccaccaacgccgtggcctgtagtgtttctcgcgaggattcaggccttcagcctgatacggcccgcgcaacgtagtgggctttcaacatgtcaactaccagacttaacgaagcaaactcactgctcccaatggccaggacacgcgagattgcgagtaggcgagttgcaatggccgggacaccgcattcccaatggctggtcagctggtgcgtcgtacttctgctgcgcatgagcagtggtcactggtcaatggagacacattcagccgaaaatggttggtgtcacgactaccggtgtttgcatccacgaatcgtacgtgacacattgtgtttgcaaccaaccacgatgaacgttctggatcttgggctaagcaaccacagcagcacaaacggacatggcaccagtgacaaaacttggtggaagttggtagcgttactccccccgtgcctcctctttttactcccatagtattccacgacttttagcttaaagatagtactcctccactactacactgtagtacatggacaagcatatccgcggtcctggcaacacgacaacgcatgcgacacaaggactgacagagtgtatgtacatggtgataatgcagacggtacgtgcagcatttgcagtgtgtgctatggatggattggtggaggcttggagctgggaccggaggctaaagtttttctttttcttcgagtttttctttgctttggatgcatcatgcatgtttatcctccgtgaagattcctctcgcgctttctcgttaattgctcatgatctcagttgacaacttggcatgcctcctgtctccacgatcttgtggagtttgtccctatcacaacttcgtagtggcacggtgggttttggtgaacaacgcgtgcaagatttgtattactctcttcctttccaatttgttataaatggtagtgagaacaagattgcatcgtttcttttacaattaaacctcattgatcatttttatttaaaattaaacctcaccggtcaaagttttatattaaccataccacgatatcatttattcatacacagataaacgaacagatcatatatatctataaagttcatacccactaagtatagttaatgctaattctctcttctctaatgatgtcacattatcctaattgtttttagttttttgatgattcgtcaagggtgtaaattgcttctcttcacatcacctcaatttaagcttttagatgattcataaagggtataaattacatctcttccatccaaaagacacaccatacaatccaattatttataatctatggataattgataaaggtaaaaaaaatggggtaccatctagtatatagtacaacaatgactcttgcacacgtaaacaacaaagatgtcatggacttgaacacgaatagatatcggttaaatgatgattaatttaaaataatctcaaaaatatttagagatgattaaattgggacggagacatgatcaaattgattaggatggagggtagtacatcggttattcggtttcacgtgaacatcgagaaaagttttttttttccaggctaattccgaccagaagtctctgtttttccaccaacagctcatgctgttatggaaaaagcatttcctctaccccaacatgttaacccatcgtccccatcccagagttactgaccagaaaagggcgcagatatcgcagagcattgtctcgagcaagaacactccttcgaacatgtgaagcaagcgagaccaaaatatatcaagcgtgattcaagccgagatggatttcactagtccttttttacacaacaaaacatactagaggtccagaatactaacagtaacagctcgtcaacaccctctcttctctcaggaagaaaaaaaaagaaaaagaaaaaaggataactctggaaagacagaaacccaacggacaacaccaactactcaactaggagcaatgcaaagctaaattaagctagatctaggcaggcagacggatcgtattcgtgcgcgcttagctcacgggcacttggtcatgttgttgtgcgagacccagtcggtgtagcacctgccgcaggtctcccggttgccggccgtgcccgccgggacgcagcggcacgcgctgcagcacgtgaggcaggagcggctgcaccgcttcttgtgcgagtgctcgctgcaccgcgcgtcgcacgcccccacgcagtctgccaccaaaccaaccaaccaagcgcgccaggttatcatcagtagcacaatgaaatgagctgcctcgggttgttcaggcaaatgtgggcaccgtgcagtacatacctttgccggggtctacgatcttgtggggaggcggcccaaggggaggagccggagggtagtctgcggcctacaaaatacaagcaaccatgcattcggccaactattagagcacaagaagagaacacatgaatgtgtgtgtttatgcagctagttgtgcatttgtgtgtgcttttaccttgatggtgttgaggaggaggagagacgccaggagggcgaacaccgcgagcttgccgggagccatggcgacggcggccggccggcgggcgaggacgggccgaggtagagcttctcttgatggagagaggaggaggggccttgagtgattgatgagtggctggctggctggcagtgtgctgggagggcagtgaggcgggttaaatagagtgagcagctagcaaagcaggggagtgaaggaggctggagagtggcagtggcacagtgtgtgggaagtgtcagggtaggggtgaacgtggccgtggtcaagggctcaaggcgccaggttggctccggtcggagtgaatgcatgcatgcagtcagtccgtcagtcactcgccagtactccctccgtcaaaaaaaaaaaaaaaaaaaagacaaatcctagtttccgtgatcaacgtttgaccgtccgtcttatttaaaaaaattataaaaaaattaaaaagacaagtcacacataaaatattaatcatgttttatcatctaacaaaaatgaaaatatgaattataaaaattttttatataagacggacagttaaatttagacacgaaaattcagggtttgcctttttttacagagggagtagctttgacacgtacggaaaaggtgagtaaacaacgttcactgggcggcatatgttaaaacatatcatactttacgtgtgaccgtttttttaaaaaaattatataaatttttaaataaagcggatggttaaacgttggaaaaaaacctaaaattatgtttttttaacagagagagtatattgactagaaatgtgacaagttataataaaaaaattacgactatgttatatagagatataagttaaaagaaaatatggcatgttataagtgtggcgataaaccaaaatatcaagatgcctagccatccttgtagtgacatcgcaagcaaacaagctgctactgctcctcttgcttgaggaggaaatgctacgtgtcctcgtctctattagagacacgactagcgactagcacgatgagttgaccggcaatgtgctatcaaaaactaagaagtggagatgacaattgaaggatggggatggagagaaattgtgagggagtgatacggttctaactttaaaatattacaatagcatctaacagattttctaaatagtaatattatttttctaatataatatatttacgatgatatagatctaattaatccttagtttttatagtatttgttggctataagtatgatgtgtcatggcaaaagtttgtaagtactttgctttagaaaaaatgtgatgttacaaatgtgacaacaaatcaaacactagttttacttgatgaaaaagcctagccataagtttagcaaattgtagcatctaaacaaaacaccccggtatcgtagggcaccacactcttctgtgcaaagctagtagtccttcagttttaactttagaacaaatagcagaggacaaatcactctaccacatccaaccgtccgttacaagaaaaaaacaggcatatgaacacggtagcgttgagggggtgtttagacaataggcgtaaagttttgacgtgtcccatcatgtattatatagagtgttgtatagggtgctcggacactaataaaaaaactaattacagtatttattagtaaaccacgagacgaatttagtaagcataattaatcaatcgttagcacatatttactgtagcactatattattaaatcataaagcaattaaagcaattaagtttaaaagatttgtctcataaatagttgtaatatgtacaattaattattctttaagtctatatttaatacttcatgaagatctttaaatgttcgatttgagggtgtaaaattttagagtgtcattggctcgcgcgccgtgcaacgcgacacgcggggaagacagacacacagcgtacggtagggggtttggtgagtggcacgccggtgagcgtacgagaggagagaaggcgcgagagggctgggcgatccgtgcgcagtgggtgcaggtgctgagctgcattccaccgagagccgagagggagagagggagagggaaggggccaggggagcatgttgcatgtgcgagcgtgcgatgcactgcactgctctgggcgagcgcccaggcgagaggctctggagcctgggccatgtcgtacaacaaggctactcctacatggagtacatcgcgtgctggggcacgtcacgccgccccaggctttgtcggatcggcttggaaaaaatcagcgccccagcaagcagctggaggccttgagtactccctgcaccatccattcttaaaaaaaaaatataaaatcaaactctaaaaataaacctgaacatatgttcctacaaattcatcccaaaaattaatttattatgatacagagtgagtacgttttaaaataaataaatctaatatagaatatgatacaccctaacactatttagattcgtagaactataatgtgtcacgttttgtattagattgatttattttaaaacggatagaatagacttgagcattttcgtctcttctttattttagtcttttcccctctttcttggcataagttggtctgactgattgcgtcgtgtaacaaacattatattattctaatatattgacgtgtaatccttttgcacgttcgagaaaaaaatagactagaggagaacagaaagtaaatcttaaggacttaaaaagtgaattatgtttttcttacaaacccaagaatgtgttcaaaccttggtaactcattctaaatagctcattagtgtataattaattaaggaagctgctatatcataaggtcccgtctggacacgatgatgccgtataggtatcgaatcctaatacttctgatacctatgatgtatcatggatatatcatgtgatacttcacggtatcaaacgacaacacataggtatcgactaattatccgttgatatcgtgcctaataacgatcagtatcaggccctgaccataccggttggtatcaagtatcaacccgattcttagataccatgatgtattgtaccatgcctctgcccctctctctctctcctccttcaatccacctgtacatcctacttctcttccgtctttaacaccaaacaaactcctccctaaatttactccctttctcctgtataaagaacaagaaagagataaaatagtttgtggttgaatatatgaatccgtggatggaaaatatcccacttttatctcacgcgggagaatcaactgcgctagcaacaacattttgttgcaaatcggctggcgtccttccgccgggccaggttaataatactccctccgtttcaaaatatttaacgccgttgactttttagcacatgtttgaccgttcgtcttattcaaaaaatttaagtaattattaattcttttcctatcatttgattcattgttaaatatatttttatgtaggcatataattttacatatttcataaaagtttttgaataagacgaacggtcaaatatgtgctaaaaaatcaacggtgtcaaacattttgaaacggagggagtattttgttgcgcgcgttgccgcttctctaatccaatttccacccatatcaagctcacctgagtcaacgatgacaagggagtactgcatcaccagatgcccaggcggccaggccgacgactctgcaggacagctcatgtttttgggaaaggctaactcgcgcgtacgcgttgcccgcgcgcacgccggcccattaagacccatgcacacacgcgtttccgtttctctctttttttttcttttttttacgccgcagtttcttctttttttcgatgtttgttattcctcccgtacggatagattagttccatatttttactagtgattagtttactagtaatttttaaatcttaacttcgaaattttcaaatctcgagttgaaagtttttaaatttctaagttgaaagttttcaaaattttcaaatctggacttgaaagtttttgaatcgagttgaaagttttcaaaattttcaaatctggacctgaaagttttcaaatctcgagttgaaagttttcaaatctgagttcaaagttttcaaatcttaagttgaaagttttctaaactttcaaatttggacttgaaagttttcgaatctgagttgaaagttttcaaatctcgagttaaaagtttttaaaatttgactttaaaatttaaatcttaaatcaaaagttttcaaatctgacttaaaatttttcaatctgttagtaaaaaaatctcccgaaaattttttccctaattactcgtcattagtgttaagtgggtgttaactaatattagttagggaggtaatactactctatagagtagttagggaggtgctcgctgctggcgcgcacgcgccagctagcagccccctatgttttttccaagggaacagcggacagctcgccatcgggtaggcccaagcatggcccaccagccatcgggccggcatggcccggtcggcactttgtgccaggccatgccggcccatgggctgcacctccgacccaggcacgacccaccagcagtcaggccgtgccgtaccggcccgaaggcacgggtggcctatagtacctcttttaaaataagtctattttccctccctcccttttgggctgtgacacacatatatagctaaaataagtctattttacgtccctattctttggaccatggcatataatatgtctatttttactccctattgtgtgtcgggcctggctggcgacccatccatcgtgccgtgccggcccaacgtgcccgggggggggggcaggcacagcccggcggtcgggcccggcccccgtcgggccgtgccgtgcttgggtggagccaaaatggcatgccatgggccaggtcgtcgggccttatggccatctatatcttcaggtccgtgcatatgggccagcctgcaggcccgtctatccttagaccatttactgcactcctatgtgacgtataaactcgtccagccatgtaaagacactgggctgtcatggaaggaaaaataggtgggcccatgtgttaacgaccaaattgcttctcatgtcttatgttggctacaagatcctcgcctgcaagcatctgacacagggcccaagtcggcggggaggggagaaggggaagtgacggcgctacacgtcggggttgtcgtcaccgagggccgtcgtggtcgtcgtcgccgagggttgtcagggtcactgtcgatgaagaccatcgggccgccaacagatcagtcgccaactccgccgtccaagaagatccaacggtgatgccgccactgcaatcaaatcggttggcgagaggaggatgaggcgaacgtcctcatggagcgccagcaccgcgagcagtcgtgccatccacgtcggcgcaggcgccatcagagctcgatccacggcctccgagctcggtttgcgccaccagaactcgatccgccgccactggagctcaactcgcggagagaaagagggctttgccaccttcgcctccgaccgccctttccgccttcgtttgctaggccgccggcggggtggggagagagaggaacgatggcaatggagaggagagaagccggcggaggggagaagaggtggcagtggagaggagaaacaccggtgaaggggagaagcagcgccagtggagggggaaagagatggcaccatttgagtttgagcgaagggggggggggggggggg

SEQ ID NO: 77648 - DNA, 1809 bp, Oryza sativa
agggagggaggagaaaaaggtatagggaggaactgacatatgggtccgtctcagggcttcacagatgcctcatgccatgttagatctagaaggagaaggagaggaagtaggagcggtttataggttttggagtcaccgccgagcagggggagcatggccgctggtgagtagaaccgccatggccaccgtcgagcaccgcgagctagctccttcacgccgctccgctgagatgcacgaggtgaggattgaggaggggccgcgagctcaccgctgtcaagatccagatccgacacctccactgagctccatccactatgagctagcttctcaccgtttgtcttgtcatgtgaggctgtcgtcaggatagacaagggagagcggagaggcggcaccattgagctcgtgggtgtgccgaccaggagcaggaggataggcaatggtctcggcatggattcctctacaaccacggaggccacctagagtcatcgaggtgcccaatgtctaacaatggtgaccttgtcgtgcggaagaggaggcagcgaagtcggtgatgcggatctggtgccatctctgagctccacacgccagtgcgtcactagggagagcaaaccttggcggcgttagaccttgctagcctcagagtccgccaaaccgcatggtggcgccgtcccttctactcgtcagctgattgaccagagtgtagtcagctgattccacctatactattagggtatagaatcggagagagaaggattagcacggacttaatatcggacatgatttaggtggtgtttggattcagagactaaacttaaactttagtccctgtcacatcggatgtttggacattaatttagagtattaaacatagactacttatataaaactaattacataaatgagtgctaattcgcgtgacaatttttttaagtctaattaatccataattagcatatgtttaccgtagcatcacataggctaatcatagattaattaggctcaatagattcgtctcgcaaattagtccagggttatggaataagttttgttaatagtctacgtttaatacttctaattagtgtcaaacatccaatatgtgagagactaaggtcctgtttctttcagtttgggattattataatctagattattgagtcagattactataagctagattgttataatctgtagtacaataagcggttagttgtttctttcctagattattagagcctagattattgggtttgcaagtctaaagagggagtggggtggcatggtgggtaatttttcacccaataatttagaaaaagctcacataaatgagcttatcagattataataagctgggctccagattataataagctactttaataagttgtctatttctttaaaccttacgacttttttttttgttctagtgttttaatcgtagacttatgaataagttctagagttacatttctctctttatccaaaatttatcttggttgcggcctagacgtttacatttggttgcatccttttgattttatgaaaaccgtagttttgttgttccgaacgatttattggtttctccgttaacgctttattcttcatccataagtttaaatattttatgaaaacatttctagttttctcccttgacgctctattttccaacctccgtttaaacattatgcttttattggatttatttattttcgaaagttttcttgtattaatgcttttgacatgctacatttttaatccataactttttgattttatgaaaaccgtagtttacttgttccgaacgatttattg

SEQ ID NO: 77649 - DNA, 1402 bp, Oryza sativa
attaagcaaaagttacaagaaaacatctgctgagcctttctaatttcttgtcctctctttttattttcagtcattcaagtatgtttcatttcatagatgtgtatattagcaacgtaatcacatcaaaatccacattggcgcgcactcatcatcccatccaactatgcacccatcacaacaattactatccctggactaaatagctactctaactgcaatagatcgagagactcctctcctaaactaaaactcataaatttcagattggattatccatacacctcatgtttgttcacgcttttcacctatagaattatcaacttttttttccaacacatctagcgataccttccgcacattgtgaaatcgtaatctcaaaaaacagcacctgattttagacttcaacaatcaatcaacacagagcagaactgcatccagcgtcctatcctcgatctacggcaccaaacaccttaatcgaagcaaatatcagcgaaccattgcgactatcgattccccacatatgccacagctacatttactaaaaagcgaagcaaagcggtcgcacctcgattccatcgatgggatcattcggatttcgtcgctaatcgaatccacgaccggggcatcaaaacgcagtatattaattagagagaatcggatccgacgtgacgtcttctcacctgaccgctgcggccgagggtgatggtgacctggtgcctggatgacgacgccgaggaggccatcgccgccacccgccggtgagagggacgacgacggcggcgctgctgggagggaggagcgggaggcggcgcggcgcgtggaggagaggcgccggttagggtttcggggggaatggattgcgaattggcgattggccgattggaggcgtggagtttaccggcgctcgagacgggagggggagggactcgctttggtggcggagagtttttttttttcccttttcttttgatctcttttggattttgggcctatttcactcgattttcaaatttttttcgttcattttatggtctctttttgcgatttttttctcgtcttcaaaatatacagtgctgttttttattttcaaaatcagggggtcttaagcaatgacaacgagattgggggttccatcgagtgaatatggttaagaatccaaatcctgaaattgatttatccagggaaactgtcgtgacaaatttcgtcttttttatgccctggtcttagcttacgtatgtttttacagtataatctctctgataaaaagttactcctatttgacattcagaaacaaaaatgggttaaactttttaaattctatcaatcagttttatatattaaaatagatttgtagtggttttttttatcaaaagcataaactatttatatggccaaagcaata

SEQ ID NO: 77650 - DNA, 1339 bp, Oryza sativa
cttgcggctaacttaatgtgacagttaaatactaaatgaccggtgttcggaaaagaaaatatttgagcccactgcaagagaaatgtactattcgatcatggcaaatgaagcttgaaggttacgttgctagtgaggaatatttctcgagaagatatcgctgggccgctccaaccacacttacaaactagcggcaggaactctggaggaccacatcaatgtgggtttctagcatcataggggtattgtagtaacttcctgtgcaccatcggggttaagattataactccacatttatgtttggggactatataagccagtcctaatctcatagtaaaataccataccatatattgggctttacaactcgaactcatctcgttcttagaataggcgggaaaaatgatacttttccgcctatcctctgttgatctgttacccaaggtcacgaaataatattttattatcaatgttttgctttgaatagttccttaaccaatatttttgttttggattgggtatttttattttcatggtgttttagaccatccttaattttaattatctacatctaacttgttacatgaaaaagaaataacttgtatatagctgtgagatttaagagtttattgatgagtaggaatcgacgtattctagattgttcaaacaatcgttcatatgtttgagacgagggtcggtagtcaaaagtgaaaaagaaaaaacaagactaccctgtccaaaataagaacgtcgattaaaagatgttttaaagtaaactatcagtaatgaaatatgatccgaaatgagaattactcaaaatgttatattatgatcatgccatcacacatgatcgtatcaatatccatcgacacgtgcacatgtgggcatgcgtgtgtgggcagcgtggcgccggcacacacaaagggagaggggagagcgagaaccacacgcacgcacgcacgcacgcagccacaacaggggagagattgcgagcgcgatggccgcctccacctccgccgccgccgccggggacgagccgtgccgctgccatgtcgtggcggtgccgtttccggggcgcgggcacgtgaacgccatgatgaacctgagccggctcctcgccgcgcggggcgccgccacggtcaccttcgtagtcaccgaggagtggctcggcctcctctcctcctcctccgcgccgcccggcgtgcggctgcgcgccatccccaacgtcatcccctccgagaacggccgcgccgccgaccacgcgggcttcctcgacgccgtcggcgccaggatggaggcgcccttcgagcgactgctcgaccggctccggctcgaggaggag

SEQ ID NO: 77651 - DNA, 1244 bp, Oryza sativa
ttctttccgtacaaatttcccagagcaccgtcaggaaagcagagcgtagtccttttttctgaattttctctgcattgcttgtttggctatgccaccagtcaagcagtgtactgtcctctgatgagtcttggaagcgccgtggcctgatctgacgcccaacctcagtccaaatctgctgcacaaagggacattctttgaagaggtgttgggcggtctcaaggtttctgaagcagagctgacaaggtgcggaaaaaatgtgagatcatcgaaatctatacactatacaaggtgcggaatgaactcgcgcagacacttagctttgtttgttacttatacgcacattccgaagtgttttgagtgctttgggtttaattcgttcaaaaaggtggttgaatataggcagttgtaggtgtgaatatagcgtggtaaatgaaacaccgtcaaataggagaacaatttgttagtgttctttcacataaatccattactgcgagtctggaacaaagctcacgtgattcagctaacaaaatcttttaagtcgtcaaaatggttgtctttctcattttggctctccaatcaacaaatcccctagtcggggtttaatcgcagaacacatcgccacttcaccccaatcttgagaggtatcgcttctttttaatttctctattaagatgaatccactttctgtaccaaacttgagtagtcttagtgtttttttgttttgtactaacatttgagagaggtaagtttctgtgcatctgaatcatctactgctaacagtttacaaaattattcactcttacgatcttatctacttttgatcagcagataaccctgatcagagacttgagcactatatctcaagcttggcttcaagttcaataatgttatctgatctcaagcctttaattcacagtgagagaacagtggagtatatcctagcatgtatctctagcatcagaaaagcacagtgcctcctattcaccaccatatatgagcttgaggccagtgtaatcgactctcttgaatcattagtcacctgcccagtgtacccaattgggccctgcattccgtatatgacccttgaaaacgagcataccaagtccaatggagaagctcctggacggatagattacttcgcgtggctggattgtcaacctgagaactcagtgctatatgtttctcttggcagttttgtctcggtgtcatcctctcagcttgatgagatcgccttgggccttgcc

SEQ ID NO: 77652 - DNA, 4607 bp, Oryza sativa
gggttggggaactagatggaggagagagttgcctgcaaagagaaagggaggaatgaacttttgtgctgctggtttcggctttaagtactgtacaatggagtgtttatactgtcagataggtagcgtgtacagttaatcagtgcttaatgtcagaagataactaaactaaactagcgattttaatgcaattgatatatttgaaagttctgatggtattctggcaatttcctgagaaatcttaaattcaaactctgccgtacttgttagctgctgtacgcagcttgttataatctgcaatgtctgatcctaaagcccacgcattcttatagttaaccatgtgctagagaattttgcttaagatgtggattccgattaagattaaaaaaaatcacttgtttacacatccagttttttagtgtaagaacgtgtatatatattcataattcagtgattagttctagatggttccatgttaggaaacctacacggctgaaagtttcttttcttcctccatgtactgtgatactgatattgtgatttccagtagtgccagatggactgtagattgtagtacattcttgcgacagaatcatgaaaacatcacaaaaactcaggaaactccactttttggagcgagcgcatgagcttaatttagtaaactcattatgaaatatatcatctaacataattatactacgaactaacgaaatcactgaatcaagaacgtttaactggacaactcaactttttaaacagttcagttacaattaatagccttgccacctaaagcaaaaccaaaatgctcctaaaacaagccaataacgttagattaaaggaactattgcaatgatattatccttttggaaaatgaactgtactttacatactagagtttttttccaaatgatcttagagaacaaaaacacaaactaagggcaatcaaatagccggtttctgtgctgtactgttgtatttagcaaatccatgttcttatgtatcaaaccatatttgttccaacctacaaatgatttcagtatcctaatatgttacatatttcaggttcatctttgggaattgaattcagctacaacagagttacaacaggaagatcccggattctgcagattagggctggaaaggctgctctgtgcatgaccaagagaaatagatctaggaagtcgcttgcccgtacacatggttttcgcagacggatgaggactactgccggaagaaaggtcctgaagcgcagacgcgccaaaggaagaagggttctctgcacaaagacgaactcccccactgggaagaaacgaatgttctgattgaatcgcattctaagtcgctctttgtcacaattgtaagtgtatttttttatcccacgttctcggttatactcaaccataacaatggtgcaaatccttcacccggtgtccggttaatgtgtgaagtacattatcaacacaaattcaagttagcctttttgcttgtgcagtatttagtagttgtttgctgtgggaatatgttctccttgatctgcattgccatggttttcctctgatctatcttgactgcattctgagcatagattttgccaaagggcctaaatgctaacttgagcagttgctcaaataaactcatcaatttttctattctgtagtagaacgtcccttttattttctgatacagtccagtgaattttaatattcagatcatctcatcatagtcactccatgctccactgtgtaacacaatttatccacctcctctgtgccaatctctttggtacacacttatttgtaaaacaacctgattgcccatccaatcctctgtcaccttataattttgctactatcaggcgaaaaaatggataatatccagaactcaacctggaataaatgaaaggcaacaagtagcaaagagaacatttacattctaacaaactgaatccctcctcttcttcactcgcatcggcaagccgccttccatcctcaaggtcaccgagaacacaagccctggccgtccctcgccgccgacgaacctgaagctgaacctctcgaacacgcacgccgcgatggacttcatctgtatgtatgccatctccttgccgaggcacatcctcggcccgccgtggaacaccgggtacttgaacgggctctccggccggaacacgccgtcctcgtcgagccaccgctccggcctgaactcctcgcagtccgcgccccataactcctccaagcgcgccatggcgtacgcgctgtaggtgacctgccatcctttgccgacgaacgtgccgtccggcaagacgtcgtcgttctggcagcagtgcgagtccatggccacgggcgggtacagccgcatcgcctccgtgatggccgcgtgcaggtagtgcatctcgcgcagctcgtcaaagctgaacgccgccgcgtccgtgctcccgctcgacgcgcgcaccgcgcggatctcgcgcgcgatcctgtcctccacgtccggccggccggacaccagccagaagaaccaggtcagcgccgacgacgtcgtgtcgcgcccggcgatgaggaagttggtcaccacgtcacggaggctctcgtcgctgtgctcgccgctcgcggcgaagcgcgacaggaagtcgtcactgcgcgccagcccggcctcccctctctccctgcgctcccggacgatccgctcggcgaagccgtggatcgtggcgagcgcctcccgcatctgcctctcgggctccatgttgaacagcctcttgaagcgccaccgcgacttgaccggcgacatgaaccggtccatcacggcattctgcgcgtcactgaacgcgcgcatgaacttcgcgctctggggcgaggccatgctgtcctcggcgaggcacgccgggtcctcgtcgaaggcgacgcagcagatgttgtcgaacgcgaagcgctcgagcacgtcctgctcgtccagcgtccggccgtcgcgctccgcccgcgtgagcagcggcagcagcctatcgacgacctcggacctgacggtgtcgaccacgaagttcctcagcgagcgcttgttgaactcgtagctggcggccttccgctgccacagccactggtcgccgtcggagttgaagatgccgtggccgaggaagtcctccatgactgacaccacgtactcccccttggagtagttctggaagttggtcttgacgatgtgttcgacgttggccgggttgccggtgatggcgccggcgatgaggccgaagcccttgaagttgaaggacatggtgtgcgtggggcagcgcgccacgacgccggccgaccactcgaggaggcggtgctggttcctgacgaagtgtggcagtatgccgacgatcgggtaggccttgaggccgtcggcgcgaggctgcttcctggtgctgccatggcgcaggcagaggaaacagagcaaaggaaacagcaagaggaggagcaggggaacggatgaagtcaacgagagctctgtgcccatgtcgaattggtgattttggattggacgatggagatgccagcctcgtgaagtccgcagaggcgcagattatggagtgatgttgcttatttgattaagttagtcgatttgttgagtgcgagaattttcagaatatgccatcgaattcgcactactttcagaatatgccatccaattcatgctactttcagaatacgccatcggagcacgaatttcctttgttccgtgccactctgtctcttccgttcgtagcaccgtcgtcttctccgcccggcaccgccgtcgtcagtccgccaccgcccgcgccgacacccgtccgtcgccggcatcgtccatcctcgttggcgtccatcgtcgtcgtccacggcatggcgtgggcgcggagggaggcgagcgcgacgcgagtactagcagcggggcgagcgcggccgcgagtgctagcagcggctgcggcggcgggcgaagctgactgtctgcgtctgcgtctactaccgcccgggactggacctcgtgtgcgcgccttgtgaattttgaggcaccgttcgttccagggtgtttggggagattgagtctcgttttccgcgcgcacgcttttcaaactactaaacggtgcgttttttgcaaaaaatttctataggaaagttgctttaaaaaaccatattaatccatttttgaaatttaaaatagttaatacttaattaatcatgagctaatggctcacctcgttttgcgtatcttctcaatctcctcaatccccttcccctcaaacacaccctgagagtagagggcggccggtaaaaactccttgtatgttgttgctgctgcacgtacttggtccagatgatgagtgtgaattggcaaggacggaagggaacggaatgggtaggtagtagttggatacttggattgttcagaggaggacgtcggacttggcggggagtcgcttgtagaagttgaaggggacggatggtgagcgcggccgcgagtgttagcagcggctgcggcggcgggcgaagcggcggctgcggctgcgggcgaagcggctgcggctgcagaatggggcggcggcggggaaggggtgggggagaagccccttgtggatggtggggcgaggcggaatgcggcag

SEQ ID NO: 77653 - DNA, 3885 bp, Oryza sativa
agagctgtgatgtgggaggcatcttatcgagattgctaaggggcgatcgatcgcccctagcgatcagggttcggtccctcctccctccacctggtttcttttttggtaccgcattactttcctattttagtaaatttgtgcaccaaaagtttgtacacctcaagtttacacatctaaagtttagagacccaaagtttataagtcaaaagtttatatatccgattcaaatttgaatttaaattgaaatatttttatatatagtatttctatacatctaaagtttatagacccaaagtttataagtcaaaagtttacatatctgttttaaatttgaatttaaatttaaatattttctatatatagtatttctatacacctaaagtttatagacccaaagtttataagtcaaaagtttacatacccgattcaaatttgaatttgaattcaaatattagtttatagacccaaagttctataagtccaaaagtgctgcataccctagtttcaaatctatgaatttacaattccaatttttgtatatatagtatttctatacataaatttttccaacttttattttttttaaaaaaaaatttatagtgtactgtaataggaagagaagaagggaaggaggaaggagtgtatagccgtataggggggaggggcgggcgccgcccattagctttacctgcatcttatccccttagagcaggtacaataaccggcggtactgcttccacataagattttgtgatgatctggaggagagaggggaagagagagagagagagagagtgagccgacgactaatttgtcgccggactgcacgtgccggtcgaggagttcgtggggctcgcctagatgcttgcgctgcctgccttcgtcgccaactcctgcggccactggaccaccgccctcagcctcgccggcgtcgacgcacggccgccgcggtctcccacatccgtcgcacggtccccgtcacccctcgcctgcacggctgacgccatctccgacgcccaccgctctcttccgcctccgccgcgcggcccggccaccgtcgtctccgacgcccaccgcacggccgccgccctcttccgcctccgccgctcggcccagccgccgccgtctccaacgcccgccgcacggccgccgccatctcctgcgtccgccgccgctattttccaccccgccgccatctctgttgctcaagaaccaaacaaagaagagaagacatgaactgatgggagaaagagagagaaagagaatgggaggtagccggtaggagaaggtggtgggtcccatgaaacaataaaatattcgtgttatagtatttttattatagacattagttatattgtttactatatatgacatggctggtttttaaagccaacaacgggctatattattgaccttgctcttagcagattctatcgaggccatagcgacaaacaaagacaaaaggtagtccgtgtgatggggcaaacttgacgccacagtggaatcaagaaaaaaaatcaagttcgctcatctttgtgtgttcgcaaaaaagacaagtccgctcacccttttgcgcattcggaaaaaaaagcaagtccgctcaccgattcggccaaccgagttggacacgttccagattcttgcccactcatcattgatcagcggggaaggcgagaggatgaaccgatgaacaccgagcaccaggggttgtatcagttgctcggccttgtctccagttccaacaccgctccgccacggcatacttttcggctgagacgaagtattcaaatttgctcgatgtgggcgcgccatgggcagcccatcaactcgtgcaaatagcttctcctgcaaatctgcaatcctatatccgacaactcgtgcccatctcatttcgctcggtgcgccaaacacagccgcagaactcacgtgaatcccgaaaagcgtggctgtgtgtgggccattcaccattcgggtaaaaaaccggagcacgacaccagttctattttatttctccaaacaagcgagagcaatgatacacacataaagtatggagtcgacaagtccagctagcctagcatcacgcttgtttgattactccctgattgtcactttcatcggcaagccaccctccatccgcagcgtaagcgcgaccacgagcccagggtgccccttggcgtcgccggcgtaccggaggctgaactgctcgagcacgcacgccacgatggacttcatctgtatgtaggccatctccttgcctaggcacatcctcggccccgcgtggaacaccgggtacttgaacgtgctctccggccggaacgcgcccgcctcgtccagccaccgctccggcctgaactcctcgcagtccgcgccccagatgtcctccacgcgccccatggcgtatgcgcagtacgtcaccagccaccctttccccgcgaacgtgccgtccggcaggaactcctcctccttgcagctgtgcgtgtcgaagggtaccggcggatacagacgcatggactcggtgatggccgcgtggaggtactgcatgtccctcagctcgtccaagctgaacgtcgcgccacgcgttccctcgctgccggccgacgactgtctcaccgcgcggatctcgcgcacgatcttgtcttccacgtcgggccggccggagagtagccagaagaaccaggtcagcgccgaagacgtcgtgtcgcggccggcgaggatgaagttggtgaccacgtcgcggaggctctcgtcgctgtgctcgccgctcgcggcgaagcgcgacaggaagtcgtcgcggcgctccagccgggcctcccttctctccctgcgctcccggacgatccgctccgcgtagccgtggatcgtggcgagcgcctccctcatccgcctctcgggctccatgttgaagagcttcttgacgcgccacagcgatttggccggcgagttgaaccgggccaagatggcgttctgcgcgtcgttgaacgcgcgcatgaactccgcgctctggggcgcggccatcctctccttggtgaggcacgccgggtcctcaccgaaggccacgaggcagatgttgtcgaacgcgaatcgctcgagcacatctcgcaagtccagagtccgtccatcgagccccgcctgctccagcaacggaagcagcctcttgacgatctcgaaccggacggtgtcgaccacgaagttcctcagcgagcgcttgttgaactcgtagctggcggccttccgctgccatagccactgctcgccgtcggaattgaagatgccgtggccaagaaagtcctcgagcatggacacggtgagcttgcccttggggtagttgtcaaagttagtcttgagaatgtgctcgacgttggccgggttggcggtgatgacgccaccggtgaggccgagcgccttgtacgacatggtgttcgtggggctgcacttcatgatgctggtcgaccacttaaggaaccggtgcttgttcttgatgatgtgcggcagcgtgccgaccacagggtaggacttgagtccatgaatgcgaggcttcttcttgggatcctggtgcatgtagaggaagtagaggaggggtagaaaagcgagcaggatcaggatgagcaagagagaagctgagattggggagagttccatggcaacagtgagatgatttggggcttttgtcttgcgacttgtgagctgtgattggcgcaagtgcttgcgagaagaggtcgatttttttttttttttgtggctggagattgcaagtgatgcatgatgtgtcgttatttataacggaggtgctaactactaatacctccgttttttttaaaaaaaatagataatgttgttaacttttagaataacatttgattattcatttataaaacaatagtgtaa

SEQ ID NO: 77654 - DNA, 682 bp, Oryza sativa
tttttgcctgtacttgggacgcacgaggagaaaaaagctgggttcgactagactatcacgcgtacaactgaactactccaataacatttgagctttcacaatgttgtcaaacatatgtaactacatgctttctcttcttataagatatatgctctcttgtatgatcctaattaagtgatttgccactctcacctaaggattggtatcctgtcccaaatccaaaagatctgcactttgggtattttggaactcaactgagtgactagcaaatcctggattgagtcctaattaaaatgcaaaccaagacataccttgaggcgaatcagatcgatgacaggccagggatatattacacgaatccgagaattgcaacatcggtcagatatggtgaggaccagacaggccgtgcaaatcccaaacagagaattaaaaacttcaaaccgatcatcatgttgcacaaacaaacaaacagagccaggcatcagagtgcgtcaccattgccgactgatcaaaaagctctctctctctctctttctcactctctctcgttagtcgtcacagctaagtagtagagtataaccgatggaggggtatggataggtgcgcacaacggaagtggcggatgacctgcgctccgattcagattataattagttaatttcaggcgaggagaaagatcgaa

SEQ ID NO: 77655 - DNA, 613 bp, Oryza sativa
atttacagattccgtctgtaaattacgagatgaatttattaagcctaattaatccgttattagcaaatgtttactgtagcatcacatcgttaaatcatggcgcaattatactcaaaagatttttctagcaatttacatgtaaactgtgcaattggtttttttcgtccatatttaatactccatgcatgtgtccaaacatttgatgtcacattttagaccaaaaatttttgggatctaaacacaccctaagcttagttgcagcagggttagtcatcaactactcctacatattttcggttagttccctcgtggtgctcaattaatagagttattatagatagataaatgtgcttacgacttcacataggtcagagaacaaaagtcaaacattcccttgatcagaagaactggaagtttcttaggcttgtctaattttaatggtagagtttaaattggtgacattattggttccaagagggcaagtggaactaaatgtttctaatttacttaagatgaatcggcttgcagctcaagattcaggagtggatcatcctatcaaggtgagaagtgattcagcgcaagcagatcgttacaatgactttgttgtgccgca

SEQ ID NO: 77656 - DNA, 6291 bp, Oryza sativa
ccatttcccacatagccgccacatcggtgtcccgcgcacccgccgcctcccatcccacgccgcagccgccgcctgccgtgctcgcagagagggggagagagagagtgagagaggggaaggagagagagagtatatgacaggtgggccccacaatcttttaaaaaagaaagtactgactaggatgccacgcgtacgccacgtaggataaaaccgctttagattgagtcgagggggaggggggtaattcgtccggtattgaaagtttaaggtgaataatgtctggtttcaggttcggggggaaattcagtcgaccgtgatagttcgaggggtaagtgtttctttagtccttcctaactttgatttctcatttttcatgcacatgttcccatagtactaagcggtaagttttttagaaagtttctttaaaaaagtatattaatccatctttaaagtctttttagtattgctccgttttgtgtcaaagagaagcttaacgtaaaaatacttctgtaccacagtaccagaagtatcgtacagtaaaatctgagatttacgggatgaatgttgtagattttactataggctgtgtttagttcgatccaaagtttgaaatttggttaaaattggagacgatgtgactgaaatattatgtgcgtatgaaagatttgatgtgatagaaagctagaagtttaaaaaaaactttaaaactaaacaaggccataataaaagatgagattttactatactagtactactaagcaccatggttttgacatgcgtcaggacgcttcaggcgagaaaatgagttatgctagacgataaaagatggcaaatcaatagtcactggcctcacgaccaagccaaagatactccggtaacaagtgagagtaatagagtaggagtaataggatgcgatgtctattcattgtacgggtattattagagaaacgttcatctggatttgaatagtcactctttctaattatatgatattagtttattacctaatattcatgtctttttattggtcagtattgaaggaaaaagaaatgcctttcaaacatgaatttcccgaatttcccaccaaagttcaaatttcccgaacgtcccaagtttgtatacccccaagtactactactcccgaaacggagtatacatacattgcgtttatacggtgctcggcagtggcacagcatctgtcatgtcctgcaggagtagcgcacaggccattggcataggttcgaatgattagagatccagctcatttaatacccgagatttggctgtactctctccaccggagggcatggcccagcaactactcctacgcctgtacaccctgccactttcacttccaagagagggctgtttgctgctccccaggcacttgcttcttccatcatcatttgcatggctacctgcgttttggaaggaatctcataaatgcaaaaggtaaaataaaatccgtcttgcaaaaggtgatcaaattcgagcttgactgtttgtgtttggtgatcaaattcgtgccggtcgttgtggaggcaaacttcatttactacatttctgtagctagagaggatgactcgaagtactccagttcaggtgctggcattcgctcctcttttggcaatgttttcccagtccaggagtatccgtttttttttttttgacattgacattatggagtatccgtttttcatcagctacggacgtgtttagttcacgaaaataaaagttttgggtgtcacgtcagatgtttgaccggaggtcgaaagggatttttggacacgaatgaaaaaactaatttcataactcgctggaaaccgcgggacaaatcttgagtctaattaagccgttattagcatatgtgggttactgtagcactttatggctaatcatggactaaggggctgtttggtttccagtgacttattccaagtccctgtcacatcggatgtttggacactaatttggagtattaaacatatactaattacaaaacccattccataagcttggactaagtcgcgagacgaatcttttgagtctaattacgccatgattttgacaatgtgatgctacagtaaacttttgataattatggattaattaggcttaaaaaaatcgtctcgcggattagctttcatttatgaaattagtttttttattagtccatgtttaatactctaaattagcgtccaaacatccgatgtgacatgggataaaaagttttagtcccatctaaacaccccctaattaagctcaaaagattcgtctcgcgattttcatgtaaattgtgcaatcagtttttatttttatctatatttagtccttcatgcatgtgttcaaagaatcggtgtgatgtttttatgaaaaaattggaaactaaaccaggcctaccagtagtaaagtaaactgacctgatgttgtatttgaaataaaaagtctgtaaagaatttttgtaggattaccatcgttttgaaaaaaaatagggaaaatgatttacattctcggtctcttctgacaagctagcacacaactaaatcctttggtatatttaactctttggaacaaatggttggagatttcaaaattccattcgtatattttggagtaaagttagcataaaatcgtatttccttctggtcgatctcttccatgcaagttttgcattttccccatacgttcagtattgtcaatacgaagaatcattcgtgtgtattgaatcgcaggcccaaattgaattgaatctccagacccatttaaatagcaggaaccaaaaaaaagggggaatagaaaaatatataaaattctaacaaaaatacaagtgtaaaatagatgattgcaaaacgcggaaaaaaacataaatgaccgtttgattggatacatgaaaaacgcgagaatcatataagaaagatatactcaaaagaaatttcttcatagattgaagctcttgttaagtttgaaacctataacattgtccattcataggaattttaaacaatatgatacgattcaatccttggtttcaaagttattcatataaaaaattcttataaaattaaaatcctttagggcccctttgaatcaaaggaattatggaggaatttcgtaggattaaaatcctacaggatattttcctatgtagctctttgattcaaaggattgaagttttccaaatcctacaaaattcctatggaatggcttgttgcatataggttttggaggaaacttagcaagaggtccaacctcctggtaaaaatcctttgggtctatctttctcatccgattcctatgtttttcctgtggtccaatcaaacgatcattcttatgttgttcgtgtgttttgcaatcctctgttttacacttgcattcctatcagaatcctatatttttcctattcctctgttttttcattcctatgattcaaaggggcccttaaagttttttttttatgattttcatataaatcaaatgggactttaattaatcataggtttgaaattgaaagggccaaacaaaccatactgctgctacaactagcactcctaacctgacacgatagttttgggttccaaatgatcccttttaggctatccaatggaccagctgtttgcttctactactactccttgcttgacacgatttggagggagtagtgaccgtgtgtagccacgtgacatgtgcatgcccacggggtgttcggcgaaaggccagggccaaagcactagtactcctcctcttgtatataatggctttctccctcaacaatcgatctcacctctccccatccgaacccccaatttttcttggctagatttggcgcgagatgtcttgcctctctcgcctcaacgcctcggcggcgccatgggagccgccggtggcacgcgccatggccgtcgagcagtactgcccgccgccacagtccttgctcccgccgccgccgctgccgccggtcgccgttcccaccacctgcggttgcgccgcctgcctccagggctgcttcgttccggtgggggttcaagctgccttcccgcacgccgctgctgggtgcgcgccgccgccgccggtgatgccggtgatgatagtgtaccgcgtcgtgcagcctccgccgccggcagctcacgccacgcgctgccagatcacggagatcgaggacggcggcggcgtggagaccgcgaaagctgtggacggcgacgagccgcagccgttcatccgcacggtgcgcagcactcgtcgcagaaaggcggcggcgatccgccttcccaaggcttttcgagcggcgcttttgccgccaccgccgccgccatgcgcgttggggttcacagctactactacctccttgatgataaggaacatccccaataagttcctgtaagtttcaaccaaaatcttcctcgattctagccacgacccttctttaatctacttgtttttactcttagattaagaaaagatctaatctaatctcttctttttttttttttgcatcgaccaggaaggcgaggctgatggctatcctggaccagcactgcgccgacgagaacggcaagtgtcaccgccgcggcggcggcggcggccgcagcgtcgtgaagtctgaatacgacttcttctacgtacccatcgacttcaagttcgtatactactccaatctagggtttctttcctttcatcttgttcttcctgacctgacacggtggttgtgcgcttcttctttctataggactgggttcaacaaggggtacgccttcgtcaacatgacgacggcgaccgcggcgcggcggctccgcgcgttcctccaggaccaccgctgggacgccgccatgtccggcaaggtctgcgacgtcgtgcccgccgccatccaggtacgtacgcgcgctcgcgctctcgctcgccgcgccgcgcgcttgcttgcttgccgataggtgtttgatcttggccccctttcttggaaacctaccttcaggggctcgacgcgttcgtggcgcacttctcggcgtcgtgcttcccctgccgcaccaaggagttcctgccggtgtggttcgagccgccgcgcgacggcgagcagcagacgaaggcgcacgtggtcggccgcctcgtcgtgcgcccacgctagctggtcgtcgtcgtcggcgtcgtctccggcgacggcgtgggttgcgcatggtatctatcttgcattctatccctaccgattgtccaaatcgatcaatggatgcatggaaggatagaacgggagatagattcatatagagaggctggcttggcttggttgttcgtagtctttccttgttcgtttctactgtagtagtagcagatagaactactagttctgccgttgttgtgttgtaatcatatgtgtagtggctgttatgtttgagccgatcgataatccttcgttgttgtgtgttgttaacttaactctactagtactaagtaccgcgtcctccgatcaataatccgagtatttgctatggcaatgcccggttgatgtcctactaaccacaacgaaagttgtgctaaatggaatgtgcggcttaaactatgaaggatttggttttagataatttttggttatgtatttattttattttatttgcttctgaagtgcacagtggtttactactccattatatgcataacagaattgccttcccattaaagagcatagaattgcttatacagacttctaaaaacaattttgtcgatagtgcaggtgccaggtactactaatccagagttactagtactgtgtagggtatcagtagtacatcacagaattagtaatccagattgtaattgcttcgaagtactccctcactctaaaagaaccttggcttacggctatggccgtgtttagattccaaatttaacaagaaccatttacacagtttgcacgcaaattatgagatgaatcttgtaagctaattaccctatgatttgacaatatagggcatatttagatccatttgttccaaatggtaaaaagttctggtggcaaaagttttgacattgcaaaagtactagctggtgtttagatgcatgttaaagttttgccattctagcactaaagagaaagagggagtggttccaaagcactttttggcacaatttgctactatggactagcaaatgctaaatgccaaattgtcaacatttgctacttgtgtttagatccaaaatggcaaaaagtgccattttataaatggtaaaacttttgccattggaggatctaaacagggccataatgctacagtgaatcttttatataatgctacggggtgcaggaat

SEQ ID NO: 77657 - DNA, 6048 bp, Oryza sativa
tcaaatttgaatcattacactagcataacttattcattttaactcggatttgagtgaaacttgaacctaaattcatctaaattcataagctttccaatgatatataattcactattcaataaaatatatttataattataaattaattaatatcaaatgattagataatagttaacctaaatagtgtaccaataaataaaaaaaatggatattgtacagtagcataattatctttaatatgtcttgtcactatagcaaccaaataaattagttataatcaatccttcaaattaatgggtgtaaaggaaaatattagtgccatttactagcctatgtccaaatataactaattccatgacttataaattatttacataaagtttagcctcatattttgtaactaaaatataaacacacatagatgaatctttaacttgtttaggagagtaatcacaaagctagttgtatttggaccacttaaaaaaaattagttgatacaatgtcatgtgaagtagaatatatatatatatagtcggttgatatccattagttaaccaaacagagccatcttaaaatcaacatgtattgtatagcttacagtaaacagaaactactcaaatatatgatccaataataagatattgttgcttacacatatactatacatcccattacagtggtacggtatagtattaatttgcatgttgcatatatgaaattaagagggagtgtatgacaaacatgtatattaaataaatactagttataaatcttgacctcatataattataattatagttcaactgtaaattaggattattcattataaaattatgtgatgggataatctgtaaccataatatgattaacctaaacaactctaacatacaaagcatggataattattaaccttttataatttgttgtgacaagtaaaatatgttcataattaaagtaaggctcccatcaataaaataaataatacaaatgattcactctaattatttgattgatcctaaatacatccgacaacaaaacctctagtatacgaccattttatttagatagatgcatgtgtagccataatccttccatagccattagctagactaaaccacaaattagccagatacgtatctcattcatactacattggctagctcctaaatagaccaccatgataacagaaagattaagagactttagcccttagcatgttggaacccattagcaagcgcgaataatatgagcaaccttaggttcaacctcaacaaatatattttgtttgtgcatatttgattgttgcttgaatattggtttttctcgcgtattatagactttgtgtatcggttagtcgtgaggcaacgtcagcaacttccagaaggtgaaggttgatcaagaattatatcaagaataaggactatcctgagcaaggcaagtcatcactattccttgaacatgttgatcccaattgcgaaattgttttgtttacaaataaaattgcatgcaatgatgaacatcccacttgcgattatgccatgccttgattattgtttaccccttattccttcgtaaccatgtttacgtatgagtccctaatcaactatgacaaatgcttagaaatgctattttagaatcatgcatactcatatttatcaaatgctatatgcttgggcaattacctttgggaaggtaattgagatgcggcatgtggagacatgagcaccacattgccatgatattgatgacatgatttgcgaaaggagaaataaaactaaacaactgttttcgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggaggcagtatctctgcatagatggttcacccctgagtgaggcaggtgcgctacggtgggacagtcgttgaggtagggccgagaggcgtgccctacatcggtgtcgctattggtaggactgccatgagtgtgtgagagagagaacttaacttgaaccataatttaatatgtgtgtgagacttttctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtgggggatgggatattgcatgataaattttatgctgatggagccacttcccgagaggagggaaggtggacatcctcagaaaaccatgacgattcaatggcgggaagctatccttgggatcacaatggatgatggacagaaccgtcgttgtttaaagtgaacactggtgctaaaatttgatcagtctatgctaggttttaggcttgtgaaaagaattgtaaaattagctttatgcaaaagaacctgaagccattccttgaaataccctctatcatatgcattgttgttgtggtggcttgctgagtacggttggtactcacccttgctattcatatatcttctaggagagtgttgaagagaagcccttgtcggtacgcttgcgtatccaacaagatgatcggagtgcggtcttgttctaggtctcgttccccagtcgactgcctgtggcatgttaactgggcccttatattattttgtcttctgctgttgttctctaatagttgttggcctacctggccctaatgtaagtatttaactcttttagcctgaattcattcgtgatatgttgtgatccaactatgtatgtgtgtaccaactactgatccagggattggtacggataaacacagaagatttccgatttccaaaattgggggtctacatgtacctaactatttatagaggtgagaggacgaccaagagggtccaaaggtcgtgctccatcagattggggcgcaccccacatgggccccacatgggccagggtcccaaacaaagttacaagcccattggcccaatacaggtgacgcagcaccttgcggccaaacgagatagaatttcgagatgaggctggatccgttggaaggaggacttcgagagctttccatcaagtactcacgggcccaaaacggagcacgtatgtagatttggcggccgtttgaagtcagcaatgtaacacgtggccgaatcagattgcagcacatggaggacttgatcttgatgtcttcttgttgattcataatgtgagcaatggtcgtatccatagtagccatggtcacatcatagtatatcgcttaagaactcagcctagctgcagtacaccatacatcagcggtgtaataaacatagtactccatccgttcgaaaatatacaacatatgactagatagtgcatcgtaacaggtgatgtctcattagtcctagatgctatattatctgaggagggagtagaaagaaagaaaacaagctccaatcgtttggtcattaaccgttggctctgtcaccgattaggatccatctaataaacatgtcgtgcttttagcttcttcaggcggtcgttcgatcgaactggaccgatcggcacgagggattcacaacacacgatcgtcgatcggtcggacgatcgtcagggagaagagaagaaacagcgggcggtgtggctcccgaggcatacgcactgcatctttcctttttgtccccctagctagaacgcgtttgcatgtgttggagcaagagtaaggataataatatagctcacttattactattagctaattttaaagtcaacatatataatagattagctataaggttggctataattttcttctcatctctctatctctcacttatatattaattgaatttgtcttggagtttgtgttaagctagctcttgcataagagctaacactcttaactttttactttttgttacatctctcctcctggtaagtttacagaacgacccgccggggagacggccggcgcggaagccgcctagctggccaaagcgacgcgcgcgatcgacagctaccgtatttgctgtctgccggtcgtctgccctgaattctgatcgatctgcaaggggaggaagtcgccgtcacatccgacatgtacacgacttttttttttgttattacggagtcctccctctctaaaaaaaactaatcctgaatttgaatttggtcatacactatatctaaatttaaactcataattagattttttttaccgaggaagtatcatcgtgtgaacgtttaaaatgagaaatttaagttaggaaggagtaaagaaacactccccaactcatcccctatgaggctgtgtgaccgttccataggaaaagtgatggagtttacgctgcccagtgtatggcggctgcaatgcaagatactagtactactacggtagtgtctgaatctccttaagataaatatgaggatggagattaagtattttatataaaatgatgtggtaataacgtgtaattaattgatttttaattattacaaacttaaaaaatggattaatctggtattttagaacaaccttgatatagaaaattttcacatgaaacgtagcgtttagctatttaaaaagcgtgccattttgatccaaaatttaatccaccatttcatgacattcgaatgaggcctacgagtatcatgacggtagattttccggagagctatgcacaggcacagcgcgatactccatctaccatgcgacagtgcaggtgttcaaaacggtgtagtactagttgtacgagaggcttggaagggaaaggaaacaagcgtcgcactcgatccgacgcccgagatcgatccctccctgtacaacccgatccgacgcccgagattgatccctgtaccaaaggctgatcgatgatcgatctgtcgtctccatccacaaaaaggcttcagtatttggtacagggatccacccacaaaagcgggcgacgtccgatgcatatgcatgtcaatccagccggagagaaagactactccgatgcctgactcgccagcggtgatgcacggaaacaacttgtttcaacggctcccatcggttggcctaatcagaaaaaaaaaagggctaaattttgaattttcaagcttaattttgatattgattttgagatatttttgatgtagtttctttttcaacattagcttttaagtcacaaagaacacatttataaaagttttacgtacaaaatcatttttatttcctaataaaccgttttggtttattaggaaataagccaaacgatgagaccaaacgttgctgctataatgctatgcactccagtttatcccagagctacgaacttgtatccaccccaaacggagcaccgcgccaccgccacaataccacgagaaatttggggttatactatcgcaaaagagtggtttagctggaatgctatcccttcaaactgattcactaaaatgcaatcctaaactgaaggtgttcaccaaaatgttattttcgctcttttgggtgaatataaatgtttttcattaattttaactttcccggaccaaaatacccctgatgtgggcccacctgtcatactctctccactctctctttctcctcttcctctctcgagggagcgccggtggtcgggaggcgagcagtggcccggcgtcgcgtcgctgtccctgtccccctccctgctcaccgccctccgctcgccctgcctggccacctccttcgctccgccgcgacacgccgctgccaccgtagacgtgcgatggcggccgtgaggaggacggcgagggcattgcggaggatcgatggtggcggcgacgctagcgcgatcgaggatggcgatggcgttggagag

SEQ ID NO: 77658 - DNA, 1201 bp, Oryza sativa
ttcctgcagccctcaaatgtaaaagtccaaactcaaaattaaaattatacaaaaatggaatgctgaatttatactggttccgtttttccaaacggatctcgaaaccgacaccaaacaaaaattcaccaaggtgtttaacacaactcggaacaggcgaaactgacgtgagagggggactcggactcaagataaagttggcgacaaaaggagatggcgccaaccggtcttcacgcgtggggagagtttggaaagtttggccttagatggaaactaaccaacctgattgatctagtctgcaaaacttcctccaaaaacagatctgttatcttttctctctcctcttcctcgcgcaagagaaacaagcacggccgaatacagacgacaaacccttgatgtaactcagcaactccaaaaccgaccgacaaaaacttctgaaaactagaaaaacgaaaccccgacaacaagatgattccgttttcctaggtcccgacgacaacaaaaacacggcgggggcgatgacagtggtatgaaacgtgaccagaactcgaaactctaaacgaactaaacgctaagaccagcaacacgactcgacaatgcaacacaaaactcaacaaagcaaaaactgataaaaacaatgcaatggcacaaaatggctaggtacaggatacaattttttttgtatggcaattttctggttatgggtagataaaactcaccgagcaacgaaagctctgataccacctgatgaaccctgagttcctctccccccttatctcttcccctcccctatataagccccactattcccactctttccctccatccccacctcctctcctcaactccacgccgccgcgccgtcgcatagagccgccgcgccgccgccacgaagccaccgcgccacgccgcgccttgcgccgacgtcgccaccgtcgccgtcgccaccgtcggtaagccgccgcccccccccccccctgcgtccatcgtcgtcgccgcccgggagagcaagaagccgagagagagagagggagaaaggagccgggagggagagaagagagggaaaaagaaagagaggagaagaaaaagggagagagagaggaaaaagagagagagagagaaaaagaaaagagagagagaaaggagaagaaaagaaaagagagagaaaggaaaagaaaagaaaagagagagagagaaaggagat

SEQ ID NO: 77659 - DNA, 4383 bp, Oryza sativa
ctacgagatggaaaccaacctcaagcccctggcaatatggcaacaacgtcttgccctccttctcgccgcttcggccgtctttgttatccaccacaaacatggagtaaccagcgcaggcgtacttgaactgcctcaaatcatgcccctgcgccgccgcctcttctctgggctcgtccaccacgtagcttgggactggagcaccgaaccaaacaacaacagtttcgtgagattctccgatcaatctgaacccgaaccaccagaaatcgatagagacaatttttgccgatggattgaaaacccgcacgccgatcgatcgcgcgctgcgattttttttttttggggggggggggggggagattagggttcgtttcgttttaccttgggggatggagcgcgggatccccacgcagacggggttgaatccgcgggatctgagcatggacgagtagtagaggcagcccttgcaggatttccccctcctcggaagcgccgtgcccgatggttttccggccgccgccgccgccgcgccaccgccggccgccggcgattcctcccccatatcgcgctctcttttcctctctcctctcctctcctctcgactccccgtgacgaagagatttcgtcgtcaaattttgtcctcccctgcgctggctgacatgtgggcccgccaacctcggcgattgggttcccgaatcgtacccgccgactagagggcccaccagtcaggtcagaggatcaagacaattcacgagtagttacgttacttctttggatttttaaaattttgatttgtactgtaggattaatttcaggttgccgtgatacttgtcacaattgggctgtgtttagttcacaccaaaattagaagtttggttaaaattgaaacgatgtaacgaaaaagttagaaatttatgtgtatagaaaagttttgatgtgataaaaaagttgaaagcttttagaattattttagtactaaacacggcgttggtttcaattgatcgaatcggtacgaataattcataaaaaaaaatcaaatggttgttaccaattctcaattctggcaaaagtcgaattatggttccatttatactccttaacaagaccatgtacatacacagaagtgaaaattatatcagaatcaagacctgataaacagcaccaaaaaaaaatctgaaacgccaggttgcaagcagaacaaacagaagatttgaaatggcctacaatcccagaactgatacaagaatctcaatacagaaaagaagcaggacaatcaacaggctacatgagacagaattactgtgtacaacaagcatacatccagcacagtaaaaggttggagcatatcaccagggggggtgctttagtacccatttcctacctgacaccaggatttattcagaatgtattactgcttgttccgaagcaagaaacagaagggtaggatgcacatgatttataactacaactgttctacatgacaattctgaggagatgcaactcgctacaatgcaccaagttcagaaacatgcatatgtgatatggatgtctactgaggaactacaacaaaagggaggatacaacagatgaaactgagaacggatctactgcctctctcttgattgtgacctagtatcagtcagcctgtcatcatgcctgtcactatccctgccgttgtgcctgtcatcacgcctctcgttgcctgacgattgccgatcaaactgccgatcagtcctctcgttttgcctgtcgtaccgtctctcgttacctgaattttgcctatcgaagtgccgactgtttcttgatggatatccatcattcggtattgaatgggaaaagttgcagtgctcaccattcttgcagtatcccttgtcgagtatagaatagcagactccccttttaggcctccacgaccctccatcaccacctgactgcgacctccaagacctcccaccagagtcaccgccattaaaatcaccaccatgcccagaatgcctgcctccattgtctcgctgctggttattccaatttgggttcccgcttggtgaattccagttcatattgttattatcttggcctgtcccatttccagtactgggacctggattaacctgcatgggagcaccccatccaacattttggttcatgtttccaacttggcccccccaaccaggataagaatttgtatttccttgtgcaatggccccccatggagccattgcaactccttgcatctgagttcccaccattgctgctgcatttggagtgccttggccttgagttgcccacatcatattcatattggtgtttccaggatttggtgtaacccagcccatgtttggaactgcatttggctgtgcttgcatagccaaacccatgttgtagcctgtggcactttgtgctgttcctccccaagacatgttcatgttgttctgtccaaccattccccagcccatgtttgcattaccctggagagtagctccccaggtcatatttccagccgcctgaggctgagattggccagatgtgcttgccaattgtgcccaagcagtgttttgattatcaccaccagccatggctgtggacgagggctgcactgcttcagcagatggtgttgatatcagctgagatggctttaccgagttggaagcatcagtttgtaactggttccttgcatctgcaggtaatgccatcagtttcattaggtatttaaaccataattttcattgaacaaaagttgcttcgggattaaaagcttcctttgtgaaacaacagatgctaatacagtaaaagagaagacaatggcataaacaatgaacaagcattgagcaataccttcaagttgttgagtatttgattgcacccctccaggttgtgcaccagatagtccaagatctgtgaagaaccaaaaaagaatgtttaggccatattgaaatacttcttcgcggcgattttataattctcagcctattaccattcattaaagaaacggtgtacattttttttatatattaagtatttgtttcctcaatacattgaacgatataaaccttcgcaaagagcctaccttcacccgatgacctcatcctttcacgcgaagcatcttcccccaactttgaatcgtttccatcagctaatctgccatcactttgtgataaaaaagatgctatctggttctgggactgcaactgtgaattaactacttctgcactcactgtcgcaggacctggtacaggagttagctgacctgcacttcctaaagctgcattttgtccaactacaaagctacccatggcaggctgagaaagtgtcacaggatttattgcagttccaaactgacttgaggcgttccaacttccactaagagattgttggactgcatacgctgcttgagagttttgcattccataataaccttgtgtactagattggatagtggctggtccaagatttgccgcatcgtttccctgaccagcccttcctgagaaagactgtgtgctacttagaactgctgattttgaaggttgttctccagctcttgttccttcctcaagaagggaatcattacggggcctaccatcaacatctgaactgcttccaactggcggttcccacggcggtaggtctttctcaaacctcccgagcaaagcatctgtcaataatattgaatcatcttgcttctcagtagacttccatatttttaaattcggagggaagtacccactgccattccatttccgcaactgcactattgagaaaggaccctggattttaccggtaggatccatgtactgccagattttttcagactcattaataactgactgtgatgcatgtgttccccctgaccctatattggctcctaaagtttcagatgaaacaccagatagaccatgtggagcattacctgcagtagctcccactttaactgcgtgtgtaccgatgtttgggctatctgatttacttgtgtaaccagcactttcaccgtgagacgaaaatgcaggtctgcgtccaaggggtgactcgatatgtgtactggattcgccccatgtgtttcgattagactcccagttggtttttaaatctctttgtgcaggactcctaccctctcctttacctggagatacaggattattatctttcttagagaaagatcctcttgacttattgaagctgcctgtacaatagaaaaaagggagtgatgtcagatgagcacgcatggatcgaaaatgaatattatggggcggaagcaaaataaaatcaagtacttcttccagtatcctgctcttgttcctctggagattcataatctggatccatggtatggtcagcatgaacttcaggttcttcattcagcctacgaacacgctcttcaggggtacttag

SEQ ID NO: 77660 - DNA, 2913 bp, Oryza sativa
atcgtgcgcgcgggctgtgtttcgcacatgtgtgttgaacccgtgtcacaaaataggaatgtcggtctttgaacacttcgcacgttcgaatcgatcgtccacgatatatttgcccggattttaaccaaatttcatgtgaaattcgacatgcgaattaaaattaaaatatccctctcctgtcccgtagctggcgtcttgtcgacgggtctctgtagctgacatgtggggccatggcgcgacaattcacgctcggtcatcatgccccttgccattaatgggatgtgaggccttggagaagaaaaggtgcgattattcaatctttctttctgcatgtccctccttctccttctccatcccctcccccggtggtgcagcgtgccatatcgtcagagagagacagtagccgcagtaggagggagttgttgccggagaagtgactgtgcattctgcagatcgtttctgcgaatcctcctatggttgggacgcgagagagacagagagatgctacaggatgaaggcatcagatcggttgggacgagagagagagcaaggacgatggacgagaccggcattaggaatgcatcgggaagtggagatgatccgcgcgcggttgcgccggggggattgatcgggtggtttgccaacacatctctctgtacgagctctgaccgcgtctactactagcctgtagtgctactagtagtaggagtatgcttggattgtgctgaatcctgtttgtcctcaaggctcaatcaaattaatgaccgtccttggcaatattttttaaaattattactcctacagtggtagtactacatgctgtggagtggtcaggtgaggggtgccgtccaggcgtaagcgtacgagcaacagttctcaacaggtgagagttgtggttcggaggcgagacgagctttgctctgtcaacaacatttgagttgttttgggattaaaatttgacctcttgctgtatacacagtctccctctcgatgggctgacgattgaaatttcaccaaatgcgtctaagatcctgtttagattagatgggactaaaactattactatctccttccttaaatatttgatgccattgacttttttaaatatgtttgaccgttcattttatttaaaaatttttgtgaaatgtgtaaaactatatgtatacataaaagtatatttaacaataaatcaaatgataggaaaagaattaataattacttaaattttttgaataagacgaatggtcaaatatttttaaaaaagtcaacggcgtcaaacattttgggatggagggagtacatcggatgtttgatactaattataaatattaaacatagactattaataaaacgcattttataaccctggactaattcacgagataaatctattgaacctaattaattcataattagtctatgtgatgctacaataaatatgcgctaattatggattaattagacttaaaaaatttgtcacgcgaattagctctcatttatgtaattagttttataagtagtatgtcgatgtttgatgtcgtgattccggtatttgcatagtatggggattgttggtactaaggtatatgcgagactaaggtaaaagagacggaggcgaggaattttatacaggttcgggcccctgaattgtcaggtaataaccctacatcctgttggccgaagccgatattgctcttattcaccataatcacaccagtacaatatttggggtagcctatctaactgttgtcgacatggcggtctgaagctctgactcgtagtcgacaacatggtagtcttcctcctcgagttcgtgcccggcgtcttgtcttgacgtatgttttcttgtatgttgatcttatgtcttgatctattgttccgtgtatgttgattgtagtgggtgtctcccctctcctcctagggggtcttgtatttatacccataggtgtccccttgtccaagtagaactagggaaaccaatatggatacaatccgagtagttcttgtcgtttccatgtagaactctggttatttttccttatccggaactcctcctatatccgcaggttgtttccgtataggacatggtatgtggtgggtcctgccgagatttagtcgactactattaggtatgtggtatccataaccctaacagtagtctccgacttcaatgcaaatgaacgaattcatattctcagccgcgcacagactttggagtaactgttatcgagctcatgtgactattctcggtgagttcagagataacgttaggcttcctttatcagcctcgtgcgggcacctaaagggtttgtctgagtcaatctccgacgtcaactaagaaagtacagagcatacgactaagtctcccatcttgttgtaatcgagaatttggattgaaatcgagaatttggattgaagtcaagaaattttatctcagcgggtacaccatctcttcattccgtattccttgtcgagatccatcgaccgtgagcctgcgacgaagccttgtcaatatttgtcgtactcgccttagtcgatcttggtgtgtagaaccatagagacatggagtcttcgttaatgtcgaatagaattttcctgaaatcaatactcagaaaataatattagatagaaatagcccccaagcgaacgctcaaagggtgacatgttataatatgtatggaaaactgaaaatgaattaaatttacagaccaatgttttgtatatgagcgtctactcttttaccgacttcgatcagtcagtttgttgaattatacactctccctagcccccagccttgtcatcggagaatcgttctcgggagataaggctcttggacctttgacctgcctcggttgaacaagcactgatcctagaccccagccgtgaagttggaaaacccaatttccgattaca

SEQ ID NO: 77661 - DNA, 1351 bp, Oryza sativa
tattcacccaaaagagcgaaaatagcattttggtgaacactttccagtttagaatagcattttagtaaatcactttgaagcgatagcattatagcgaaaccacttttgcgattgtataatcctaattttctccaacaccactgacgagtacgtgtgcgattctacagtagtcagtatgtgccgctgcagtagcaacctgctacatgaccatagctgccgcagcatttttaagattgaaggggaattgttgcggagctagatgcgggacctgtgtcagcccaccactgcacatttgttcgtttgttcatcattccacctgcttcttccgtctcaaattacttatcttttaaggttatttggtatattctggttttaaacaaaagactacaatacccttataaagtgatttatgaatgaggatagatgggtggttgaggagtagaattgggagaaatttaaataagatatgattgacgggataagtagtagtacttggtagtgataagtacggagtagcattgaagaacaaaatttaaatgatagaaagataactaatttgggaaggagggagtagtaaaataaaatgggaaaattacgaattacccccctcccgccgaacccgaaaaccagacatgattcaccctaaactttcaataccggacggattacccccctcgacccaatccatagcagttttgtcctacgtgatgtacgcgtggcatcccagtcaacattttctttttttaaaagatggtggggcccacccatatactctctctctccttcccctctctcactctttctctctctctctcggagagcacggcacgcgtcggcgtgggatgggaagcagcgcagcggcatcgtgggatgcagaggcagcggtggctgcggcgtgggatgcggcggcggtgacggcggcgcgggacatcgaggcggcgtggcggtagcgtgggacgcgagttgccccacgcgagcaccgtcacgcccagcatgccagccgccacgccggccgccacgccgatggagaccagcagggagacgagctcgcgcgtgagcacgtacgaccagagcaccgggaggcaggacgagcggctcatgggtggggagtcggcgtccgtggtggccgcggcggcggcggcggtgaggaggactggagggtggttgctgtggtgaggcgcggtgatggcggcgaggaggagtggggagaggagcgcggaggccaccgcggtgcgcttcgaccaccggtgcgccgtgatgtccgagatggtgaggcggcgcgggaggtagagcagcgagtggagaggtcgacgaggcggtgcgcgaacattcttggcacggaggtgggctt

SEQ ID NO: 77662 - DNA, 2225 bp, Oryza sativa
cgagcgtgtcggctagaccatccgtctgcttgttcttcggaaccccaacttatcatttgtattaagttcctatttgcaatatcagattgcttttatcttgttcttgcttgtttcttcgatttgcttgcaggaatagggttgatctgcaccggccagatcaacaacccacgcagaggtgtattgatcgctaaggcgcaacacaacgtctcgtacggttgtagtcggatcgtcaacgtttttcccaaatcgtagttatcacaactcaccgaaagatcgggccaacaacagccttgagtgctgagaggaacttagggttcatcatactactaccattttatctctgttcccaacacatctctctcgcattccatacgcacgttttttaaattactaaacggtgcggtttttttaaaaaaattatatacaaaagttgtttaaaaaaattatattgatccatttttgaaaaaaaaggtaatacttaattaaaaaaaggtaatacttaattaatcatgcgctaatgaaccactccgtttttcgtgcgtagcagctatgttcccaactcttacaaacgaacacagccttgatacaacctctgcagccgaacaggcccaatgttttcgtgacaaacataagcaatcgctttgttgtaattgaaggagtgatttgaacagccgatggatctattccagatttccaggcataaccggttgaattcatgcccgacgattattggagtcggtagagaggaaggtcaagaaacctgatgtgctatgcttgtatcctggggcgcgcagccttcacccggccggtaaaagaaaaaatgttgcctagatcttcttgggtacaatatgcatgtcaataaattttgttagcttattcccatgaatgaactatcttgcttttctaccaagtactctatttccatttgttttaaatgcaatttctctctaccttgccaatccatccgtgctaaattaatggatcttgaatcaaatgcatcttaaatcgaaaagagtctagccagctctgttagtatcttttgtaccctttgaaaaagccacaaaatgttgtttccagcaaaacgtcaggaataaaaaattcacaaagccaatctttcctgggtgtagacttgggcctgcctataattctgaacccaacaagttgaaattgtgtgctccagtaatgggccggaatatgcagtccaataacgtccatccaaccacaagtctaagacaaatggcctttgtaaaatcagatgggccgtcaagcccatcttgtttgcaattcataccggaccatgtctttcttctctgcagcctcagcctctgctttctctcatgtcgttacacaccccaaccaactgaagctttgtccatatgagaaagccacctttcttagcttgatcactagcatgatcatgatcaatgtggtcatgatcgaactgtgaaagtcactacactacactaccaggatcctttgctattgctgatactactactgttcattttttttcccctcgattgcatgcacatgcttgcaactgaaggagaggtgagagagctacagggcataagcaagcttgggttaggtcagtgtctcagtgagtcagtcagatgatgcaatcatatgcaaggggagggagaggcaaaagcttggaataatcgatcatagggcgacaccatgagtagtatatttatccccttctcttcgctttcctttagctccaagcttttgtaccaaggctgtttggcacttactctccaggcgtatctgctccacatcatgatcatccctgatgtcacaactcaggccatcagaacatggtgccatgattctttcctatctagcttggagaacatggtcaatgtgtggatcatttcgtaatcctgtaattatccaagagctgaattaacccacaaattaagtacaacagcctgaactctgaagataggaagaaagaaagaacatgctattgctatcagatataggtttgattcagatggaagaagtggcaacgtagaaagagtagttgcatgggattaaagggtaaggaggattatattccagctatatgtacagagcaaaaggcccatcgaataaattcttcttgtacgatttggcctgaggaaagggatcgatgtgatcgaaagttaactcaatgcaggagcttgccggctccatcctagctaacaactgacagaaacaatagccaggacaggtccatc

SEQ ID NO: 77663 - DNA, 1901 bp, Oryza sativa
ttgcagctgtacagcaagtgtttgccaaggcatcgatacatccaacctccattggggtgcttggttaagtcggtgtacatcaccattccgcttgctttggtaagaacttgtaagagcttggttaaaagcttgagtgtgtgtgatatttgagctgccactacctagtagttgataggagcgtgcatatttttgtgtgtttcttgtttgctactaaccatagcaggattgcgtaagggaatacgagaacatcgactactacacctttgacgagatatgacgacttctccacgtgatgcatatgaggtacatgactataatttttaacaagttgcatctaagttacccttctatgatgagaagtatgattctgttgcatacattgattgggagctagcagtagacaatgaatttgatatatatgatttttctgatgctcaaatgattaaggctgctagtaataagtttacctcttctgctttattttggtggacttatgttagtaataaacctgaaacttgggatgaattgaaaaccatgatgagaaaacgctttgtgacatcttattacaaatgtactcttcgggagaaattagaacatctgaaacaagctgacagaactgttagggattacattcatgaatttaaggtctgtatcatctacagtggtctcaaagagtgcaatgaaaatacaacgcgtagatttttcaatgggcttaattctgaaattcaggttttgcttgataatgtgacatataatcatattgggcacctattcatgcttgctcgtagcattgagagtcagatcatatcaaaggcgaggatgcatgaccaatgtgatttatctcctctttctgaatccccaatatacttatgtaatgatgatgtgcaaacattggaggagcaatcttttgtctcccctgttactaacgttttgcaggtagatcagcacatcaaagaaaaggagaatggtatacttgagaagaaagaggatgaagcacctgcgatgtctgaagaaagttcgcaaggtaaattaaatggtgctgagagaaatgaaggtgagtattctcaaggtgagctacacttgtctacttttcatgctatagtagagcaaccattagtggaatcaattgctgagttgcctttgtcacaagttgatttacttgctgttccttgtgataaagaagagttgtgtgataatgtttcacttatatccatgccacaactagtgaatgaacatgttagttctactatttctttgtgtgctgattctaagcatgttgttcacattgctaatgaagtagaggaacgcgaattgctatcttctttaaataccttgggctatgttcagtttgatgatttttgtgagctcgataatttgaaggagaaattatttgctaaatctgatttgccatgtccaactaatgctatttttcatatctttggcgaatataatgatagaggaatatttttggtgcatagagtttacatttgttcggatttagaacatcttgtagttccggataaaatatgcaagctagagagacatgttactgccaatcatattgtctcgagtttgtcttgttttgattgcaagaaacatgttgttttcaatggactgcgcgaagagcacaatatggaaaaactgaggacggttttccgtgaagaaggggaggatgatgtgaccatggctactatggatacgaccattgctcacatcatgaatcaacaagaagacatcaagatcaagtcctccatgtgctgcaatctgattcggccacgtgttacattgctgacttcaaacggccgccaaatctacatacgtgctccgttttgggcccgtgagtacttgatggaaagctctcgaagttctccttccaacggatccagcctcatctcggaatt

SEQ ID NO: 77664 - DNA, 812 bp, Oryza sativa
acataataaatcatagatctgacaatattgtatagattggaaaaatagatatgataaattgtatataaaatattgcgtactttgtagatacatgccggatgtatgtacgaaattattagactaatttaaaaaattaatcttaaatacctcgttttgggtgtttgatgattattgcttgtggacagctacctggtaactttccatatgcatgtattggtcctattccgcgagacgtgcgtacagcgtacgcgtcatgcatgtcggagtactgtacgaaatccgatgcatgtcctcagctctacgtggcagagtccaaatcaagttgagcttgaggcttctcatgcatgtcggttgttgtctctccatggcaacgcacggtgtgcccggacagaggacctcggccatggcacaaagaaaaatggaccaatcaggaagctgattagtgtaattaattaggatgagattaaatcaaatacaaagagttggaacgacaaacccgatatcgtgttataggacgacgttctggctggtgagagtctccgtagttgaccggaccaggcgaagttttcgtgatcaacaatagcgaacagatatctcccgcaacgacgtctcgaggcttgagcgatcttgatggatcaaattgctgatgatgatggttccgatctcgtcgggagacgtactctggtcgggttggatctccccggtccgaagtcgtcgagtagctcgttggcggagaatccatctcttaaactcatctcgtcgaaatcctgaagcactaaaattcccctacctggcgtgccactgtcgacgtt

SEQ ID NO: 77665 - DNA, 15099 bp, Oryza sativa
tcctgcaccccatacaaccaaaatcccttatatttagggatagagggagtacatcgtactattgatagcattgtacgaaaaaactgtagcacggagtactatgcacaattttacattagcgtatactttctccgtaaaaaaacgtatatagaactggatgtgacacattttaatataacgaatctgcagagagatagtttgaatgggacggagggagtagtttgaaccattcatcgtaaaaatgaacaatcaaaattatacgcagtcgtttaacttaacgttacaagtataactgaacttgatctgaatccttaatcgtagtgttgcgaacgctgtgcaatttttgtgattacgtgtgctctccagttcatccaagtaaactgccaagccagcccatgtccccaacgccacaatcttacagggccggccccactggtgcttcgtttcgcatgggccaaatgcagcaccgcttgccagctcgtaattgcggcccattaacctaaatgggccgatcgagtggtggtgcagcccaaccacaaggccacgacaaaaaaaacgtcctcctcttcgagtcgtccgcttccactcacgccggctcatcctctctctctccaaatctgtggacatttcacgcgcgctctccgctccagcctccagccaccgcccaccggccggcgatgtcgacggcggcggcggccgcggcgtccacctcgctccggccggcctcccagtccgcgctccgtctcgcggtttcgctccctcaccaccttcgtcgtctctgattctgtgtaatttatcatgcgccttcgtctaaccgagtagtcttccccggttaaatcgcgcagggttcgccgcggcggtggtgctggggagccccggcgctctcccctgcgaggagagcattccacgcggacacgcggaggcggttcgtgttctctccttgggcgtttgcttctagtatggaatggagttgatggccttttgtccgaattagttttgcttcctgtggtgtatttgggggaagtcatcgcagacctgtggattacccttcatgttgcattgttgtctcctgtgggattaagtgtttcatgagattggggtatttcgttgtagattactgttctatgcttttaaattgcaatgccggtaattttgttgctacgagttattgttcagagtagattacttctataactctcgctgttccattggagttgcttatacagtgcgctctctaactgccaccagcacagttcagatgttcttcagggtgttttagtaacatgagtttctacggtcctgatgcacatttctgattcatgtgcaaatctacatctaccattcattcctaggatttcatactatttggtagctgcaatgcggcaggatctgtgatttgcctttccgaattcattgtgatggtgcaaatagacagatgaacagtctattattattcttaatttaagaacctatgtttgtattaaacaggaagactttgttatatgcaactgataaaggcccagaagaatccttgaagaagacaattgaagttgacaggttgatcgagatgctgagggatgcaaatcctagagaggtaactcttcatatcttcaatctgactgtttattctactactctccatcccataatatagcaacgtagtgctggatgcccgtatccagatccatagtactagggtacgtcccatccggtcctaggttgctatattatgggacagaggaagtattagataaggttacagtctcaggttttacaccacactaaaagatctctccattcaattgtaccaatttaaatctgttaccaaacctctatagtatataattctccttgctttgagcatgcttccattagttcttggttcaaaatctgtagaaccaatctaagcagtacttgatgacttggtcgtgggagcattaagcctcaagttctgtgaacaacatgaactgttcaattttatttacttcggagttttcatatttacctttagtttcttatcaggtttattttacgcatttagaaatatttgaagtatgcttatccttgtcagtttatcactagattttattattatgtctatggtaattctaaatactggagcattgctgaacagaatatatgcagtttgttttattttcatttaattgaattaagccttgctttgttttgaaattacttttgacatgaaaattacttgatcaacttactaatttacccttccttgcatgtgacagcttgatcaaatagtggttgaaaatgttctggcgttcgatgagggtttctgggttcggctggcagcaagaattgatctatgcaaatcggatgatgataaagcatggttttcacaattggatttcttttttgttactatggaatgtcgatcccgttctcttagctcgattaatctaactttgtgaatggtgtctctcttctgccttttcagaaagactatgaagaattggctgaaaatgtcatgaacatagttgaccgtcttgtccataagactgatgtaagaacaatattgggtcacattatttgtattaatggcaacacttttggcatttttatcgtgatcagaaaagttccttgaatgctgctaatatttacccttatctattcaggaaaagattgaacagtcaactgatgtgctgaaggcaattattagtcctgtgatgcacgaaggtgaaaacgccacgtggccaccgagagatccggaggctctcaaattgatggagaaagtaagaacgaacatagctattttttcactgttattctttactgggatatttcatcggtgccttcctatgaatttggtttatttcacattacctcacacatagcatttagtcgctttaggcaagttactgttttggttggctctacttcacatgaaacagatttatattccaatctgtagtgtaactagaaagtgccagttttatactccaatcttgtatttgttttttatggtgtcctggtatcgccaggaaatttcaaatagagaaaaagaaggacagctagacgaaggatttctgtcagaggttaatgctcagttgaggcaggtatgtgtcattttctacattgtggattaactttgttgatatattactcagcatagagtagttttgctactcattttactattacacccttacatgtgtttaggctaaacaagatggagataaaccaggacttcaagctatgctgcagaaggtgttgcagctgtatgcgtccaattttctccaaaagcgtagttacgcttacaaaggtaaatcctgttcattcgttttggactgttgaaccacaaccactgagaatgattaccctttaaattgatttgtctatctttcattttcagggggagaagtaatagtgcctgaaagttttcttgaatctgtaataaagggtatgtatcattgtgcggagagattgtttgtcttcaatcaactgatctcaacctttaatatatccagattgtgccttgcagctccggaaaacgagtggaacaagctgttgcttgatgggttaacagtggggaaaggaaatgtttcaccagaagaattttatgctgttataaagaagagaattgagagagtcttaattcgcacagtaatatcccaacctttggagttatacagagaacgcaatctcttttagtttgtcaggaccttgtctttagtttagcatcccctcagcacatttttcatttttcctcttgttatctttttgtttgacaggaaggaggttcttatcagcagcgcatactcgttgaatatctaaaagagatacaggctagagcggaggaagttgtgaaggtgcttcaaggaccaaccatatgatgatgtctggtggtcgattttaaacagtgcaggttatccagttcgatcatggttttgacgcatcacctagcaaaagcttagaaggcgacaacagacaacctaactaggtatgttgttcttcgtttggtatgccgttgagaacactagattctattacttgtctgcacatttttacagcctctgcctctcagttgtctgattcaggaacccgagataagcatagcgagaagagaaacagatccaaatgtcctaaaggagtgcgtgattttcattccccactttggtcttcatctcgaatggccgattttgctgttggaatgtttgatttctgttctgtctgattgacacttgacacgagtgagcttgactaagctgtagtaacatgtgaatcggtttttgttgtgtaagggagaaggttcaatgctgagcttgacttgttactgaggtgcttgttgaactcattttaagttactgatccctgcaactgttgattatcctgatcctgatagatcattgacgattcctcgtattccctcgttacaacttacaagtcattccgctcgtgactcgctcgcaactctgcagtaaaatgtttcagaagccgagcctcgcactatatatttaatgatatatagtgaaaataaaaaaaactattgttggatctaaaaatgaaagtacaagatttatccacgcaaaaactatactcctaaaatagtttcttaccctatatcgtagacaagtcttatacgtctatttttttaatcaacgatcatataatttgcgatgctacaggcctcatctttttaacttacgcttatgtttatcagccaaaaattgaattttcaatcttaataaggttttttcatcgaagtttattttccagcctttgcttttagatcactaaaaatacgtatataaaaattttatttataaattacttttcgtttacaaatatgccgattcgctgggctccggtagtgttttcataagatacaaagagatgaggcgacgtgccgtgtattaattggttggcttcaccttgtggcagttggactctgccttccaaaatactctaccaaaaaacagcccaacaagtgggagaatcggcttttctcttcccttctcttccgcatgctggtcgccgccctccgcgtcccggcgccgatcccctcgtcgctcccctcgccggcgcgccctctcctccgccgccgcagcagccaccgcctgccccctccggccgacctcgtcgatgcaatggccgacgccggcggagccaccacgaacaggccctgctaggactccttcccgtagctcgcatagaagccgctccccggcgactgctgcggcagcggctgcgtccgctgcgtctgggacgtctactacgacgagctcgacgcctacaataaggctctcgccgcccactcctcgtggcatcctccggcagcaagcccgctaccagcgacggcgccaaatcatgaggcgaatcaggattcaggagttctgaggacgacttgcagtatgcgtcccttcctctcttttcattttttttccccttccccaaatcggggtcttggtgtggtactcctaccagctagtagtattaaaattactcgtttgattatagtgaaacatttgtgttatctcattgtgtatgctgcaatttgtactagagtggaatggttgttgttccaacgaaaaattccctgattacatacagagaattgttcatggatagttcttgtgtaacaaacattagcattttggcagaattcttgtaaacaaacccccaacaaatcacctatgccattagaatcaggagaattagcgagtttaacttacatcttgtcccaatatcgatggggactacaaggagtcacaagacttgttcaagcattgacgtagaacttactgattattatcctaaccaccaaagggatcctcaccgtgtgagtgccatcctcccatgtcaggctcccgaaggtgtacctccctttcaccttcaatttggcctggaatgtcaccttgaatggcaactttctgacggttgagttgaaggttaggagcgaggggctaacggtgacgtccacgcctggaggagcttctacacgagctctgtacttcgacaaagcagggccgacgttggtgaccgttcttgacaccgtcaattttcccctcagttcagggatggtgatggatggaacattcaggtttaactgcgattttggcgtatgttgacatgttgtttgctgttgagtcatggagctgatggctgaggtgttgtaacccatggagcaaaggaagcgcatgtagtcagatactcccatgtcatacacaagaccggggtgcgcagctctgtttggattgacatggccacctccataatcaaatggatttgcgtcattgtagggtgctgcctctgataccatttcaaacccatatgcatcatgaacattggctgcaaagatgtagagttgtcaggtgaaggcaatctttggtgtggtgaagcagataagcattatggtattacctgtcgtgaccaatgctgatttcactgcagcagggctccaattaggatgcattgatttcagaagagcaactacacctgaaatgtgtgggcacgacattgaagtcccggagtcaatcttgaagttaacagatccaatggccgatgatatggcagcagcaggtgaccatgcagccagaatgtttacacctggggcggcaatgtctggctgcaaaagaattgatggcacgggaagatttgattttcctgtcacatatttgatcaaatcaaaggataaacttagttcatcaactaaaggagatgccttaccttcaggatagagggggacaaagaacttgggcccctagatgagaagtatgcaacttctggggctaccagctctccaacaattgtttttggaaagctaaattgggccactgggtttctgtatttgcaaaacaacagttaattgcatgaacccataattttcacacctggtggatcatatccaagaaagttttgtgtacctcatgcttgtcgtgtatgcaagtatagctgttccaacttggtaatccacttgaacacaaggaatatcaagtgaagatgctatatccttggtcaagaattgcgcaaagatgactccaacacctcgagccttttttacagtctctacggccactgaggctgacctctgtgctcttgtttggaagcaaagcactacatttccttttactagagtagcattcagagatcctgcagtgcagcttctgcaaagacatcagcccaaatggaagttgaaattgtaggatggatccaaagtgaagagaatgacaaaggttaccttgcatcagtatcgtcggcattatcagatgaaatgtcttcagcatagactatacgcacactttttgaaggatgctttccagaatacagtgtttggccctgcattatcatgccatcagaataaagaacaatgtgccaaccatctgcaaccattagtgtttgaagctataattcagattacaccataccacgtaagtactattgttgccaagaatgatctttgcaaggaatatccgatcaatggtgcccgcagcaacagtgacaatccatggggccgagttgatcaccgtctctgaataaggaccggagttccctgcagaacaaacgacgacgactccttttgcgacagcatggaaggatccaattgacaagacatcatcaacataagcagggagaggtggtgcttgtcctagggacaccgagatcacatcgacgccatcgtgtatggcatcgtcgaaagcagcaagaatgtctgcagcggtacaatctccagtagcccagcatactttgtaaactgccagccttgccctctgtgcccctccccttgctacacctttggcaaggcccctgaagctggcattggctaccagagctccagccgctgtggatgccgtgtgtgtgccatgcccaacggcgtctcttgccgacatgaactcatagatatcactggtgttcatcttgccgtactcagcttcataccctttgacgtaccatttcgcgcctattattttcctatcctatcatgaatctgaagtcaccaacagaataactagtagcaaaattctctgttctcctattgcagtgataaaatttcacaagcaaaatagcaatgtgaaactgaaggctcaagagcaggccaacctgttgcagttagaggcattgaacttctctccggcgacacattgccccttccagcgccgcgggacctcgccgatgccgtcgtctctgaaactggccgactccggccagattcctgcaaaccaagagcatctcaatcctcacattgtaatgtcagcatcaattgcaaactggcaattgccagttctacacatgatgaagaacaggtgagttcacctgtatctagcacaccgatgatggaatcctccccaaatctgctctccaagaggattccaccacctgaaggcgacggattcacccccatgaaatcccagctcctggtggtgtgcaggtcaagaacacgattccgaacaacccgcacaactccaggccaatcttggtgacaaaaaaaattcaatccagcagaagagtacaagaaaaacagagtgagagagatagagaaacataaaatcaaattttggtttgccaagaacagcagcaagatggccggcggggaatgcggcgagctcaccggagagccgcgccgcctggccgccggtgagcacggcggcgaagccggagaagccatgcctgtagctgtagaggatggcatccatggccgcctgctcgctgcaaagcgcaaggcaacagtaaaccacgccacatctaagcaaccaatgctccagccatggagaaggaggagaagaagaagaagaagaagaagattgcaacctgccaagaacggcggcgagcatgccgtggtgcgcctcctggaccagctccggccgcagcccgtggtgcctctcccccatgtacacaatgtacacctgcagagagagacgccatgggaccaaaacagcgtaagattgacgctgccagaagctttcttggggggcagaaatcatcaaagcaaagctaagaatgtcccggttaatggctcacattgctgcgagaagatgagcagggctcgagcagcatgaggaggaagacgatgaagagcaggggagacatggccatggcgtgtgatgagtgagcgtgagctcaaagagggaagctgacgctgataaatttttctctctggagtactcgtagaggtgaagtggagtggtttgaaagggaggagctgagctgaggctgaggggggttggtcggtgtgcaggaggcggcctctcttctctgtctgcttggactggattcaaatctcccactaaatactcctattggagcattagagcaagtttaataggataggccactactaactccgaatcatctatagccattgtaatagtctatttatacaatagttgcttactataatattaatatctggtcgcacgtgtcatacacacattacgttttggagtccgtgctgctcttctctcttttcctttatctctttaaaatatatttatagctggcttatagcttgctattgtaccaacactagtatagggcaacaacaatatatacagtaaaagtagtccatatagatgggacccacacatatggactataactattgttatcttcacaatgtatatagatagcaactagtattaagaggagagaggaaatagagagaaataacatattttattctatatgggcaactcatatgcttatgggtggcttttgctattttcttgctatggactagttccataatgttgttagatggctaaatagaatattttattgcttatgaactagttttagactacattgtggatgccctaattacgactctgcaactgcactgtatgcactgtgcggccgtgccccagtggattggtttgttttctgtttgttcttcgtcctgacctgacgcagcacaaacgctcactggtttgtttttttttttttaaaaaaaaatggggctgtgaggtgctcactggtggagtggcgatcggtgtcgtgctccctcaccgcgccgtattgctgggtctgcgtgcgatgcgtgtgtgagccgacgatgttgccgttcggccgaacgcgtcttgcccgttcttttgcttgctttactcgatactctcgtactagaactacaaatctatctaaacataaattttatctgattctaagttcttatattttaggatgaaatgagtatttgcttggtgctcagcttgcttggccatgctctttctaatttattcacaaaatggttatttgctcaaagttttctaaatacattttctaaaaggaaattcctacgatagtttgtttttaaggtatttattaggcgtgtttcttaaaaaaatgatgataattaagtagataattcgtgatataatccgtcagaggcatatggttgtttcgtagctagcgtagtggttcttcggatggaaagagatggccagtttgttctgtgcggtgttaggtttgccaccgacgcgtacagtgaccattagtcacagggatatactgatatgtcctcatttggcttcacaacttcacacggattttgttaatttgatttcaccagtgagcattatggcgtgtgccgagcagtatcttgcttgtaacttgtttcaaactcaggtgttccttaaaaatgaattgttggatcgtcctccaatgggtatgtgctcgacatctgtctcgaatctccctggctcaggcacatgggtatggttattttttatgcagaagcagactatcatttcttatgcagaatgcagataatgttattgtcctaatcacttctcattattttttttctatcctggattaactattagtacaagtggaagtgggaacctcgtttgttctcatttgtggaccagaagaaagtggcacaaatggaactgtataaaaccgggaagttccatataaaggctgtgtttagttcacactgaagtttgaaagtttggttgaaattggtacgatgttatagaaaagttgtgtgaatgaaaggtttgatgtaatggaaagttggaagttaaaaaaaaaactttgaaactaaacagggccaaaccctactcgattcagaatattcttggtagctatacatagagcaaaaatattatatcttcatgcactcatcatcttttactttgcgctgcaatatgaagtagtagtgacatcaaaatacctttatggcaatcaaaaagattattgatatcatatcattttattaagctactgatagtggcactatggacagatgacaggcaacttgcgttgacccggagagtagacttactccctccgtgtcaaaataaaccaatctcgtattaagatgtgacacatctcagtacatcgaatctggatatagaccgagtttagttctaaaatttttcttcaaacttctaacttttccatcacatcaaaacttttctacacgcacaaactttcaacttttcggtcacatagttccaatttcaaccaaaatttctattttgacatgaactaaacacacccatactctatttttatgaggttgacttattttaggatggagtatgattagtgggctgttttgttttcaagttccaacagggacgctgctttctccttcagtgcttgcactttaaactttttatgtgagaagctcaggtcactttaatggcgtctggtgttgagaggtagcagtagcatagcaatagcaccgttgtttgcagcttgcgtgggtccagcagagcagctgccatgaaccggaggacgagatcaccacctcacaatttggaaggcctgcagctttgcatgggggccgggaaaaaggcaaataattccaacttttcggcaaatcattcggaaaaggcagcgaccaaatttgaaaacagcacagcaaactgcttaggttaagtcagaaatgttcttttagcagtagtcaatgcctagtagctggtcagactttaaatctacccttaaatattacacatgcgaatgcgcttttaatactatcaatattactacatccgtcctaaaatataagtatttttagctataaatctagacacgggtagtacacatgtggatgtgcctttaatactatactcacctctttactccgtctcaaacaagtgcttgtccatttaaaagttgatttttttcaagaacagatgaagtactacactaataagttctattgatatttgtccgtttaagcatatatgcatgtgatgtgtgtattttatgtaattttgaaaaaaaaattatatgtttattgatgtgttcaatactcatttgaaatgcaggaattaatttaactccaatgaaattctagcaaaaaattctttgttccgaaggagctctcaaggttgggtagggggcactactgccgctgagtattcctcgaatgcttcgtgaaatctctctcgcatcatattagtgctccacttggagcacatgattttttacaagaatttcaccggaatctatacggaatttaagaaaaaaaaaactataaaaacttggcgttttgagtactccaggctagctagagtgccgtttgatcggcagggagaagtgggggaggtgcgacagtgtgctgcagtaggtacgacatttactcggtacatttgctttacatgcgattgacgtgacgtcgacttcaccattcaatcatcgtcaccgtaaagtttgaactcggctcggcgaccatacggatcacaacacaacgccatcacgtgtgctccaatcaaatctttcctcctcatgcctctgcacaagtgcagactgctgttcaatgttcatctctgaaagcattcgaggagtaactcaagagtcagaagtgcagaacaacggcaagtatacagtgtcaggactacaagtacctgctactccattcgtccttaaaaaaataataaataataggttttcgtatctaacgtttgactgttcatcttaatataaattttttttataattattattttcattgttgttagatgataaaacatgactaatattttatacgtgacttatctttttaattttttcaaataagacggatggtcaaacgttggacacggaaacccagtgtctgtcttttttttttttttgggacggaaggagtagtaaaggagtagtatttagtacgagagagcaaaagaacagattaacatactcctaatactattatggcttttcctgcatggtgaaaacgataaccatatgctactctgtacgataataagcgcactattggatagcactcttctacttatatctatcaaccttttgccctcaaggagttaacagttgacatcattcaacatttcaccgaccagatcccatttttgcttcaatgaagcaggaaggctgtcgcatgtacaacattagtttgtatctggccataacattacaaaaacgatgcaagtccaatggaaagaattaagagcatccaagaaaccgtccatttttgctcaatgtggctcggcccactcctcaatagggatgtggttattgtaatttgtaaggatatggcgtcaggtagtcttctgtatctcatgtcggtagcaattttcttcagatctccaactgaacaacgacgggcaagcagcatagttcctatttaggtggtcgacggtccgggtaaagtatgtctgcgacgttttccttgatgtaaatagctgtcttgtttagattctttgcaacgcctgaagcgaccaatcccgcgcttttcctaaacctgcagcagcctcgtactacatcagtaagacaatcacaagaaagggacaggaaggggaaatctgaaagctagctttcctcgcatagaaatcctgtcctgtaagttgcccgggtctttgtccttgttgccgagagctggtggccgctgtaataagaaacgcaaatgtattaaacatcaatctaaacaatgaagaaatggtacacccaaagagatgggtcttattgttgtagaagaacattggccaacaaaactgaaccaaactctcaacatgactgataatttgacttaacactccatttttcccagctaataccatactattagcaaatatttctatagctgtctgtgaacaaaagaacaagtttgtacatgactgaaacatatggttaaatggaaatacccaagctaaagtttacagaaatgtgtaattgccaccgtcaaatgcacatgacctacctatggacttaatactgagaaaatggagcttcaacccaccttttggtacttactacgtccatcccaaaatataacaacctttggctatgaatctggacacacatagccaaagttacttatattttgggacggagggagtattaagttgtaacatattgacagagttttaaaaagtttgatcattcataaatcatttgaaaacaaaactccacaattacctgtaccaagtcatcatagagttttattcaactgtagaccaaatatgaagaagttgtggcatcaagagaaatactttagcataccttcctttctataagaggcagtagcaggctcattatttggtgatttcttctcaaccaatctgctgtccaccaatagctgtagtgacatttttcattgtcattagacagaagcaaagcacaaaggctagcacaaaaaagatttataatgactataaaatatacacttatacatgtatgtgttttcaataaaaaacagaaactattaagaggcataagtttcattcatgttgttctcagagagcagtgtcaataagtgaacagagtccaaccaccaagcagtcagaaaaagaacaaaattaccaaccattcttcaggttgcacaaatgtggtcccacctcaaccttataggttgatgatgccaaccaatatcctacacatggaaatgcaagaaaagaaaatccttctggatgcttatgaatgaaactagtgctcaattgcaggatcatattgtagtttacataaagaatctttgatacatgtagataccaaaatatgcctagcatgattacttccagtattacgcaatcagatgttttacgtgtgaaatgtcgtattataggtttatgtaaagaagctttgatacacgaaaatcgtaagataggtctatcacatttagttacagtgcttaggcaaacatagatttttgtctgaaataaaaaaaat

SEQ ID NO: 77666 - DNA, 535 bp, Oryza sativa
  unsure (1)..(535): unsure at all n locations
attcctgcagccctggcgttggaagggaggcatggaataactgaattctggagcacgccaacatatgctctctcgctgcatgcatacggcgcgggcaattaactccaccccggggtcgcatgctgcatgcagngctagtanngcagtggcnacnaangnatacagtacagtacagtacattccaaccagctaactgtattcagaacgagagagagagagagagagaggggtgaggcagccggcaactgtaccctgccttttcccctcgactctctttctctctctcgcagcagcagcagcagccgcgttgccgtgtgcgcgtgttggtggctggctacctctccaactcacgcgcacacacacacatctcttttcctctcggtgcgatacgaagcgagagcgagagagagagagagaggaggcaaaggcaataaatggaagcttaggtgagcgcaggctccatggcggcgtggcagggcctctctgtcgcctcaccgtcttaactcgcggcagcgcagcgagctgagctgagctg

SEQ ID NO: 77667 - DNA, 1012 bp, Oryza sativa
atttaaaaatgagcaatcgatagaacacgaagcaatgaaacaacttaaccgatgaggattacttcgagaatgataaatattttggtgtccttgatcttaatgtcatttgcttagggtatatatgttcaaacttggatgaggagagtaatttagtaggatcatttttataaattctaaacaagtaaaaaaccaaaagctacaatgatgtttgtgaaaaaagctagaggggttaaagggattccacagcctctcgtacatagctccgccactgccctcgagggtgtggagagactccgttgttgggatgcatgaaataacgtcgtactcctcctactggtactcgatcaattcaagctgcatgcacgcctgctcgacgaaaattactctacgtgcggaatcaatgggcaaaattttagtcttggaacgaccataaatatcttcattgattttcaggttatattcggtgcagctgtattaaccccttctcacagtgcaccaatttttttaaaaaaaataaaatgtgaaatttaccattatttgtttggaaaatgcaacgctttatctatctgaaatgatgatgcatcgatatgctggagaccgaacatgcatttactacaactaagcagtgcatttactcaagccgccacggcgccggcgctgctgcttccccagtatatttcgcttcccaactgcagatacacctacgatttggttctgctaagattgtgtttagattcaaagtttggatacaaattacgaagtgaccaccagttctactcctatagtagcagcagtgcagcactcctgctactgttggatgcttgaaactgcaatccacggatgatcctggtcgacgtcagcgtagtaaatgcaccatctccttgattcgaacttttcaagttcgcagaacggtaaacgtacaaggcatgtgcatactagtatatacaccgtactcctccgtatgtactgtacgtcttgcacaccataaattaaattggaaaaaaaaggttta

SEQ ID NO: 77668 - DNA, 3650 bp, Oryza sativa
agtacctcttgcccattattacattttgttattctttatttggtggccatctcaaaaatgcttaagcagagttcccatcagtgaggccataaacaaattaaagctctgattaggattacccaaccaacccaccttatctaagcacaagctttctttcaccagggccttgtctttgagtctcaccaaacctgacagtgacacaagcaattaatcctggcctctgaaatatgtcaagttgcagatgacaccaattccttttgacaagttactccttatcatcccttcttccttcctgccccctaatgataggctaaggtcctatgctcagtagattatgtattatggattaccacaccacgcttcccgaacccctaatgaacggtactatatgttttacaaaaactttcttcatcaacagttttaagaaaaccttttcaaatcgacttatcaaccaatatttacttcattcatttgcatcctcaaataatatgatcataaactcaatttcagtttatcatccatcttatgctaagaacgcccttcaagagatcgtttacacaagaggagtgaaagaacatgtagttagtgattgcagtgagtagcaatctaagaccctagcttcgaatcttcgtaggagcaaatatcatattggattgtttgaggggctaaattttcaatttaaataactgtgtatattcggttggattagaggccgaataaaaattaaccatctctaaaaaaaatatttacaaaagaggtaaaaagcaagctactaattacttgttgctatcaaatggccaccactaggagtagtactagtgtactactagccctgttgcttgctctctctgcaatcctcctcggatttgttaatgattctgttcttttttttcatttcgcccttgtcatgccgtctgatcacgtgctgtgatggatgttaacaagctattgctcctgggccaccagctcgattttggctctgctatctgctgcattctcgctgtctccttcgtgacgcactcgatccccctctcgccggctagatttcttgggcagttgctacgctaccgcctcgctcgccgacgtgtgtgccgggcaaatcgaaaggcaaggatcccggcgagcgcactcccggatcggatggtgagatctctctggggcctttttgcagggcacacttggcatctgcttcttctgatgcggatgtttctcatgatattgcggtagctagatatgcaattgatagtgcagcgataaggggtgtatagtttcaacatcaaggtcctatatttaattccaacgcgctcacaatttcttctttaaaaaaatgtttggagggacatctcttcaaatctagtttttttgacgcatacatttctcagggtaaatatcggtacctcttctactctatcttccataaactagctacttgcctgtaaattctaacaggtcaggcatatataatgtatgtttggcagagctccaacttttaaatttagcttcgggagaccagctccactttcattttgtgaaagtgctccaactagctctactcccattttaggtagagttgaaactgttttactgtgagctggagctgtgccgaacagacccataaccagagagaaaaagttgttacttttcatgtacggacgcttaagcaccttgagatagtagagaatgactttgttttcaagaagtagaggtataaacatttctaacgtttaaaatttacaattcaccaccaacgccaacaaaatggatggaatcacttgaaagctcacgagttacggagagtactggaccgatccacctataaagcgcagttcctcggcttcattaacacgatcatttagaaaccttgctacccgctttgccgatacaccctggaaagtagaaacattcttttcacctcgtcatatacacaaggagaaactcatgtgagcaactcaagctgacaacgtgaaaacacaacaatgatggtccactagtggtgctactggccaaggtatattaaaaaaagggtccgcgctctcatcctactaacagtataggaaatatggaaggagaaaaaacatagagtgttttaacgcaaggggctcttggcaatagctaataggttgccaaaatcaaggagactaacatcctcatctttttgctaaggcttatacttatcaactaaaatttaaaatttaaatcttaaatttgaagttgattttgggtttttttatcgaaatttatttttcagcctttgctttttagatagttaagaacacgtatataaaggttttattcacaacttattttttatttgcaaatatgccgtttggcttattcaccgaataagcgaaacgattggactgtataacctaggacctagcatgagcaaaacgacttcggagctttttttttttgaaaggtttcggagcttattctttagctttgttctactttttttatagttctctttcacacgtatacaactcttctttttctcttattatatttaaaagtaaatttcataaaacttgaagtagtttaatcaatctatcacaaaactacaaatttttaataacatgtatcacaaaactacagatttaacatcataatttttttatataaaattacagatttaaggtatgatataaaaaaactacagatttaacgtcacttttatcacaaaaactacaacttctataacaccaatagtgctaagatataaactctaaactaaatctatagttttgtgatatgatgttttaaatctatagtttgtgataagtttggtgctaaatctgtagttttgtgatacatatctttaaatatgtagttctacgacagtttgatcaaagtatatgtagttttgtaaaatttactctatatttaattaatgaaattgtcacgatctagtacggttcgttcatttgtttttatttctagcatactacttcccaatccaaccggccactgttcatgattatctatatttacagatgtattgctaggcacgattttttttaatcaagtaaatttctagtgaatatcaccttaagtttaattttaaactcctaaaagtgtatatatccgtggatggaggaagtagatgccttctccttgaacaaattggaagtggtcgtattactgcattcaaagacatgtgttgaatgttctaaaaaaagacatgtgttgaaatgtcatagggcaattgttggatgagttagaatatatttatttagctcgagtctgatttgctgaacataataaattaataattaatagacttctaagagtgactttaaaaaataaggacagttgctccaaactagccctagttaagtcagaagggaagatggataagatgcaggtaaatgttcatttttggtatatccttttggcttgttctgcagaagatacaagcaagtacatgtcacagtattagttggaaatcaacaggctggctgttggatttgcagattaacttaaaagagactgtcacttgcgaagttggtatgactgcaattgccgctcttcgaccctctaaacggatgatgaggcaaatgaatgatcccgcgaatatatcctctaacataaagaaaaaaaaaacagataaaggccataaacaaactctgaaagaaaagtgttacaacatt

SEQ ID NO: 77669 - DNA, 601 bp, Oryza sativa
  unsure (1)..(601): unsure at all n locations
atgaccactttcagtgtagaagaatgatatggaaataacagagaaaagaatgaaggatgttttattaccatgaattttagtccctccatttttctcggtgttcttgtggtcaggcttggagaaatgccttcccattggctgcttatattccagtaaattgttggtttgcctactgtcagcctccagttctgaccttgtacatgaactctgcaagaggggatccaaaattcagtccacgaacaacagcgaacagatctgaactcagcataataacgacagtccctactgctaaggatataaagactatgcagtatgatgtcttgaagacaataacatgctacagattcagttcaagtgtgtaacatcaaatatccagtacttgaaacaaacaagtattccgtaataggctttatcaaactgttcgtgnnnnnnnnnnnnnnnnnnnnnnagcagccaaaaaaacttaccttactggagccatatgtactccattttgcaatacccaagaggaccgaactgtgacatttcgctgacaagaaaatactattttcactcaaaacacagtttcattacccacctgacttgaaaaaatgataaatta

SEQ ID NO: 77670 - DNA, 2870 bp, Oryza sativa
ataactagacagctaaataatttaaaatcaatattaccaatatttcactataaaaaataaaatatgttatttgaactgccacctattctttacctgacaacccaaataacatcctatttttaatttatttgaactgtttatttatgttactcatattttactatgtaaaatttaaaatacgtaatttgaacatacaccaacaagcaaacaacactgaaacattgaaaatttgacaatatgtattatgtcatcttaatcattctacataataaaaaatagaaaaatacaaagtcaccatgtatgaccttttagatacatgctaaattaccaagtgtcacattttaaaaattagtaaaatcttatatattaaaagaaaaaaaataaaacatctagctaacggttttcacctagatcgatgacctattaacattattttcaactatctaatctacttttgaaaaatatatcttaataagtggcatgtcacatattttaaaaaaatcttgcaaatcttaggaaaattacatctaataattggctttcacttaatcacttagaaaaattaaaaaaaaaatcccctccacacgcgcccatcactacacagccgctccttcccctctctggctcaagctctaaactttcattcctcttacgttccttttaactaaaatataaataatctataattataagtttcacgtctgatttctaatctaactattgctctgtttataatcaaaccaacgatataagatccatatgcctatagtttactatacaacaaatacgacattttaacacaatcagcctattacttacgagtatctcaaatgcagcttacgatacatgcccgcgcgaatgcgcgggctacctttctagttaaatataacaaagatattgtggagattatgggtaccccatacctacatggcatattatccgactggctataggggataacttatatctatggaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagcccctctaggggcatgatgagacaacctgatcgtcagatcaatacatactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtagggggtgcgtcgaattacctgtcgaaaagtgcgatggaatcaacttcagaagaaaccccgagatcaatctcatcaatttcgatggctcaaatcttcaatcgggtctaccgttccaatttaatctctattagattaatttttaatcattgtttgatttcctgatattttgacgaatttcatatactggatgagatcgaaacacgaccatcatcgtcgcctacttgggtgcccttgccgtgtccgagtgctcctctcttcctttccttgcagatggacgtgttgcaggagtggcacaggccgccaggattcgattcctgtttgcatgtatgatggttgatgggctccgccggctacctccgatgatggcatcatgccgaaagaacatcgagttagctgttagttgccggggcttatacatgttgcatggcacgtcgccggctatcactcatgatccagcctcactgctcgacttgagtttttcgtttcaatttgttatcaatatatattagattgatttctaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccaccggcctgcctccgtcgccgccgactggtgtccccgcctatacggttggttggtcacaccaccgttcatgggcgtctacgacttcaccgccggcctgcctccgtcgccgccgactggtgcttctgcctacacggctggcctattatgccactgctgttgggcgtctacgacttcaccgccggcctgcctccgtcgccgccgactggtgtttctgcctacacagctggcccattatgccaccgctgttgggcgtctacgacttcaccgccggcctgcctccgtcgccgccgactggtgtcctcgcctatacggttggttggtcacaccaccgttcatgggcgtctacgacttcaccgacggcctgcctccatcgccgccgactgatgcttccgcctgcacggctggcctattatgccgccgttgttgggcgtctacgtcgtcaccgaccggccacctcgaccgccgccgactggtgtttccgcctgcacggctggcctattatgctgccgttgttgggcgtctacgtcttcaccggccggccgccgcatccgccactgactgatgtcaccgctagcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggcctattatgccgctgttgttgggcatctacatcttcatcgccggtcgtctcgtctgctgctgactagtg

SEQ ID NO: 77671 - DNA, 971 bp, Oryza sativa
cgttggatggaccgagtaacgcaaggtgctaagtattattcggaataaatcaaaagcatagagatgagataaatttattttctgctcttaataattgcaaaagtacccgagtagtaaattctgatccgtgaaactttgttccattaatgacgaactcatgtcactcatatgcatgtttgggaagtgcctaggccgactcccggtgcttgatggtcatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaagatccagatccagatatgcataaaagggattcatggctttaagcttatctcttacgctccaggaatggatcagtcagaacatcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcttcaccgaccggcttgccttcgccaccgccgactggtgtttccgcctgcacggctggcctttatgccgccgttgttgggcgtctacgtcttcaccgactggcttgcctttgccgctgccgactggtgtttccgcctgcacggctggcctttatgccgccattgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttcgcctgcacggctggcctattatgcc

SEQ ID NO: 77672 - DNA, 693 bp, Oryza sativa
accaccgactgttctttcgttgttgttgggcgcctacatcttcactgctagctgacctgactgttgccgactggtttcttcacctccatggttatgcaacttcattacatttgattggtggcatctttactaccactgacatcttccgttacttctgatgagcaatttcgtcttcatgttggtcatttcatctccatgccgactgcgtcagttattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattcttgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtg

SEQ ID NO: 77673 - DNA, 752 bp, Oryza sativa
ttcatgcccgttagctgtatctcttcatagtatcaagatgcatgtgtagtcgaaattctgcagcttaaatagcctaatagtacccatattagccattcatgattcatgtaccaattttactctgaaaaattgcagctgaattgaaatggagctacacaaaagggaaaaatatagcctaatagtacccatattagccattatgctaaacttttggagtctcttgtactcatttccagttattctttctttctcgctgaaggatttcagcaggtttgctgtagcttggacggccgatccttttcccatggccattagcgtatgattgtttttctatcgagatgacatcatctccggtcatgattctgacttctgttacatttaatcaccaacaaagagtatactatttcaaattgaatcatgatcctataaaaaaaatagaaaaatgatgtcatccggaagcaaacaagcgaagtcacgagcagaacacggacaaaacaaaaggcacagcacacccaaacttccaaactgagttgccatgtcgcgttcaatccacacaccacaactacgggagacatgacgtaaacacaatatatactggagataatctagtgatttttatattaaaatccattacaatcaatatttcttttagcttgcataggcatgctagtgtaatctaccatagaatgaactgtagtgtagcaatcgaagttcacgtgatactgtaagggcattgacagggctgcaggaat

SEQ ID NO: 77674 - DNA, 960 bp, Oryza sativa
tttcaactactcaactaccaggagaatcagcatattctcactagggcactacaaacagaggatcagatccaggaaggacatgatcagagcttcagactatgttaggaatattactcagaacaaatcaagggagaaagaagaataaatcaagaaaccttgtgaggaacaaagaacagatccatgccctcctgcttctccttgccgccgcaatagcacgaggtcacgagcgcaagaaaccctaacactggaagaggaggctaggggagatgggaagggaatgaactcaccggggagaaggtggccaccggaggagagagcgtgccgttgccgtcacgtcgtagtcgcgccgcgccgtgcagccgtccccgccgcagcgccccctctcattgcgtcgctgcgtcgagaggattttttcctcgccaccagagaagctgaatatttcccggccgatgacgaggggaaaacactggggtgggccgggataaaatctcgcctggacttaaccgaacgcctatacttgcatgggctggtatcctttccacgccgggattttccacggggattagaccccgatcccagccgggaacggcccaaccgaacaagccctaacggggaaacttaggctggctggccacagcatggacctcactcatctacagtaaaaatggtcggagacaaaaggaaatcaaccgaagctggccaatacaaacaatctattctcagggatgcatgcatggttgtgaagataactgagaatagaaggcaaaatatagaatctaacaactagcttgagttcatacggtgtgcttgaggtgaagtaaatacatgtttaaatgtcacaaataatttaagaagaatattaatggaaagaaacggcaacgtaatggagagaatacaaatcacggatagactttacaattgctcttacatgcatgaaggatatttaaagttgaatgtgcc

SEQ ID NO: 77675 - DNA, 569 bp, Oryza sativa
agccatacgactgtaggaaaagacgaaaaggcgccccaccccttttctaatttggccaaggagaaattcccatttagtaatactttcaaaaataaaaacgctatgtttacaaaactcggtacgattttcatcttactcttaactattttctttacaaaacaagttttactctcaactgactttgggtttttcttaaaattagatggcagatccggattcacccgctacctgggagttgagcttacctcaatcagaggggtatgtcattgagctgcatcggatgttgaggcgtctgcgatactctgggttcccgtcataccgagtgagacagtgtggctcagtttgggaggctcgggtcgaggttcacccctgagtcccttccgagttggactacagctttcagacacgtcaccaccgagacctgccagagaccgcgatgcaggatgcagcccgggaggccttcctccgactcagctctatccaccgagctgagttagcgagtaccgagtttgctcatcacccgttccgggaggagagcaactcagtttgcacagttcaggacacgccct

SEQ ID NO: 77676 - DNA, 7809 bp, Oryza sativa
  unsure (1)..(7809): unsure at all n locations
agcatatcgtgtatagggctacgaggatattgacaccatctgtctcagcaacgaccaaccagttcaaccaacatattaatcacattgcacacagaagcagcacatctgcgctgcacatggtgggaaggcagaatcttcactggtagatctgtgaagccaaaagacgtcaatggtgtcctgcctcaggtccaagatatggtcttcaaaaactaactattatccatagcttatttctgaagcaattgaataaagtcaggccagtccaaagaatattatgagctgttcaatacccggactgccgctgaaaaagaagaagatatgccaagacagtgtttgtcaaattataggatcacaaatccagcaacagcagctgctgcagactgcagtatccaatatccctcgacccaaattaaagcctaactggaaagaagcagaactgcgacagggtagtaatgccggtacaacaagtataagattagctttgttctaccatattgacacataaatctaacaagtagaacgagtgctctaaggaatgatatcataaatcagtacaaggactacaaactccgaggaaactcttgttctagaacaacatggccttgtataacatgctaatcgtgctaattaaatctgtaatgagctaatgttttacatattctacatcttctaatgtggcaatccatgacttcatggcacaaaactgaatctaactagtcagttacttcttatcagttcattgttctaacctgctttgatgaagcaggcatgaataataccaaaggaaagctctgaactacacaaattcaaggtctccacaagctgcttcgtccaatacattcctgtccaggcctgcacttgccgcttcttccaattcactatctacatccatgttttcttcctcttccacttcatctgtgccagcttttctcattggttcttcaatttcgtcttttgggtagacttttactctgatgcgtttgcctttgatgcgtcgatattcccattttggtggtggatatttcttctttaattttacatatttgtccaacatccctaacttctggaatacctcaccaagcattctgataatcgaaccgtcaggtctaacacccagctcctccatatcagcaaagatctggcaaatttacaagaaagacaacaatgattagatctttagaatcttggcaataaataagcaattctaccaatgtttccttgagtataacttctcaacaacaaaaaaggttgggttcagaacatgagcgggagaccaaaaccacatatttagtccaaagttggtgaactaacagttgttttgtcaagtaacacaaatgtgtctctttgtacaaagaatgcaactttgccctcttctgggagtaagttaaagtcatagtaataatggattatgttttctcatccaacatgactacgaaaaggaacaaaaattcctaaaacagttaatacaatagctgcaacaggaactgtgccatccgctgtactgaaatgactattgcttataagcaaggtcctttgggagcaattcaggcttattgcataggctggttgagataggcttcagcctcttggcagaaagtggccttgagcttcatgagaggaccaataacccacgccctgtttggggtagcttaatcttctgggaactttaagctaaagcttatcctccacaaaaaaagggcccaagctaccaagtcaggtcgatatatgaaacacgaaactttcaaaaggatagaatcttcgcacttgacttgataatctatcacaggtgggccatgggcttgtttcaacattatttggaatcagaaattccatacctaccaaattttctttttcttttcataaaatatgcctaccaaattttcatcagtggatatgtgtagcatctgcttctcaataacattcaatagagctattcaattaagatgccatttcgcagtggacctttcgaggaggacctaagatattaaaacacttgcaaaatgataacagtctgaaacatcatcatgttcaagcaaattgtagcatagaaaatgtagtttgtcagtgcagtaagcagcaatgaagactttccattaagcatacaagcaaaggcagcactaaaaaacatggagccaaatgatagtcacatggaagaaataaatccaacccatgaatattatttctaacattgtggctgctgatacataccacaggctaatatcatgagaaacttactaaacgatatccaaatacctagctctctaagattagcacactgttaggttttcctagtccaaatatctctgatcagtacactgttaggtggaaataaaaccagtagaaaaacaaagaaaaaatttaaacaaaattacaacttactatcttaacaatacttatgtgttaggctgttagcagaaaatttttacaagttcacttctgttcctccatgcaagggaaaccatggtccagaattaacataagaagggtgtacattagaacaaaagtataatatatttggattcctacctcaaacatcttctgatatgattctagtctgtaatataaagatatcattctcatgaaaaaggtatgaggcaaaccctccaaatatcgtgagaatatttttccatacagctcttctgcttcctccactcgtccatcctcaatcaaagcattcaacaaagtgtaataacttcccattgtctttccttgacctttgttaaacatccatttaataacctgagtcacaaattctgtagttactacagtgtttcagaaaaaaaaaaggtatattataagggagcagctaattcttgacagtcaacacgacactagaaatatgtagttttcatgcaggagatatttacagtgtatatgcacaagtccagtctgagatttttactgcaattacatgagaggaacacattggacacaataatgaaaccaatgcaacaagacctgaattatccgtttccattccttttcatcttcaagggtcttaagtgccttctttactgctatcaagggaaactccaattcccatgcaacaaatgaatcaagagcaccatatacttcctcctttacattagacaagcctttaacctacaggaaaggacaaaagaacaataatttcaggtactcgaggcatgaataacaccaggtagtctgaatctgttgcagcaaaatccgtcatgcaaaaatgtgaaatgaaacacttgcagtcttttgatgtttggcgcctgctttatcagagagaatacataagctgcttaatgaaaaagaggacaaccacaactatcgcaaactgaagagctgcagcagcgggtgaattctagagtagctattggtaagcaggtgtacgataaaccatataatttagcacctcaccaggaagatgttggatgcaaaagcggatacaaactgcaactgaaattacagcacaggaaagcagaagaacctcacacattcgacaagcttttgagacttggaaacggttccgattctcttgcgagttttccacacacgaggatatcttggcctcgggcccctggcaccacatacctacatcacaatcgtaatcaaaaccatcagtttaactgcagctccagcactatcgcaagaaccacatgcagtacagctgaactgaacttaccactaaagtactgaactttgaaggatgcgtaatggcagccctttccaatccaaaggcgaatgcaggcggcccgcacctcacagaaaacatcgtgtaacctgccgtgacaaacaatcggataaaccttccgcagcagacagtgctggtccgtatacgaaacaggaaaagggatagcgagcaagaactgcgcaaagaattgggaagaaaaagttctagctgtcctctcctcttccccttctcgctcgccccacctgaataggggaatcgaagggacgggagcacatctcaccttgtaagaggggaggagcagttgccgccgtcgctggcctcggtgaatccgtgcgccgcggcggcttcgttctccgcggggcgtagagtccgggaacgggaggagggacgcagccgcacgaccgcaacgcaatctctccgccccactgggcaagataatttcagcgttggatgaaaggtgaggcccactgtcagtggctcaggcctgtaagagtaagatatcagtatcgttttctgtcaaataaagaggaaaagaaaaaaaaaaggaaaaagggaatagggaagcgagggcggagtactgcgctcttctcctttgcctgaggcggctggggtgagggcagctagcgatgcctgtggctaggcctgagcctcangagctccgggtgatcgcccatgtcgacatggattgcttctacgtccaaggtcacctacctacctcctcctctctctcttcccccctcgccgccgtcgccacgactcgacccccaaactcgcggaatgatgcctctgacgtgagggagtgagcgtttattttattttgccgcagttgagcagcggaggaacccggagctcagggggcagccgaccgccgtggtgcagtacaacgactggaaaggcggcgggctgattgccgtcagctacgaggcccggaagttcggcgtgaagaggtgcgatgagagcccgctctctccttctccgcggaggcgatttgatcggctgggttttctgacggatcgattgtatgctcattgttgtggttattcaggtccatgcgtggtgatgaggccaagatggtctgtccaagtatcaatttggttcaggttccggtggcccgtgacaaggccgatcttaatgtttaccgtagtgctggctctgaggttggtctgtgcatcttaattggtacaattgacaatggaaaatgaaggtgcttccatggcattgacagttttgcgtctaaactctcaggttgtcacaatcctctcgaccaaggggaagtgtgagcgagcatccatcgacgaagtttatcttgaccttactgatgcagccaaggaaatgcttttagaatctccaccggagttattggagttgatttttgaggaggccacaaagtcaaatatcctgggccttccttctgtaatatttgttctccacgatttaattgttgtttctctgcaatttgatatgaatgtgaccaatagggcttcatatgtgcaggatgtcagcaacagagaagatagcgtgagggcatggctttgtcgagccgatgctgattaccaggataagttactatcttgtggggctataattgttgcgcaattacgggtcaaggttttggaggaaacccaattcacatgttctgctggtattgctcacaataaggtttatatgcattcctttctttcgattgaagtttggtctcttttactctgtaaacctctcttcctattgcaatcctcacccaagatgttgctgtgttttgtagatgttagcaaaacttgtcagtgggatgcacaaacctgctcagcagacagttgttccatcatcagcagttcaagattttctagtatcactgcccataaagaagatgtaatgagctaatgtgacacctccatctttgctagtttcttggtttctgttggacaaagtttttcaaacatcctatttatctggtctcatggttgtgttgtttgcttaaattatgcaggaagcaacttggtggtaagcttgggagttccttgcaggatgaccttggggtcaatactgttggtgatcttctaagttttacagaggacaaattacaagagtactatggagtaaatacagggtaacctggtgcttgcatttatttttttgctctactgttgtttggttgccctactgattttatctttagtacatgacttaactttagagctgatagaaggctagttttatgcattacaaggaagcatacttcatgcagattttacaactttcggatgtcatgtctagttaataataactcagcttataaccgtttaatctcacgcaggacgtggttatggaagattgcaagaggtattagtggagaagaagttgaggatcgtcttctaccaaagagccatgggtgtggaaagacatttcctggcccaaaagcattaaagaataatgcttctgtaagtacttacactctgtcatttttgtttagggatgcttatagcaaagcatatccaggaagtcttttgatgactatgttcatttggtataagccttgactacttgctttggtccatcaaagtcataagtagtgatataagctcatcactccaatcaacaattgtcatgggcattgggtcgggagtccggcccaatgggaacgatatcctcacccctcacgataagtacgtaactcacttgcatagagtcagggtctgttgggattaggttaaggagttctccatctatataaggaaggatcctattccaggtcagttaggcattagattgagttatctcttagtgccaaccggccctgccttcccggcgcgacgtcgataggactccgtcgcgctgtttaggttcagggacagtgctgttacttcctcttttcatcccaaataatcctagcacgtgacaacaattgatattggaagaatcagatcctcatttagctgtcatttagtgacagtttactgatatatccagtgtctgtgcgccttgattgatcatgtaataatctaatcagataccttctacacctcatttctagagcactaggctggagcctaccctcctacttgagtaccagatgctcctatcaaatactccctccgtcccataatataaggattttgacattttggttgcactgtttgaccactcgtcttattcaaaaaaattcgtgcaaatataaaaaacgaaaatttgtgcttaaagtactttggataataaagtaagtcacaaaaaaaaaataattccaattttttttaataagacgaatggtcaaacaattcaagcaaaatgtcaaaatcccttatattaggggacggagggagtactagtttggctagtggcatgttgttgtgtccattcaattacattaagatatgttgcgagcctaattaaataggtcctttgtattgcctgattcaaatcccacatgtgtttgcacagctccatatatgtatttcctgtgtagtttagagaagtttatgttctaaatattttacaaatgggaatttcatggtcctttaataatatcaggttcatgtttaggttaagacatggctggatcgactttgtgaagaactgagcgaacggattcagtctgatttgaaccagaataagagaattgctcaaacactaactctctatgccagggcatgtaaggtacttggtgcaaattatctttttcccccctaggattgcataaattagctcttagtttctgtaacttaaaatgaatatatagtttatttactgattgctttgctacagaaaaacaagtctgattcaatcaagaaatttccttccaaatcttgtccgttgcgttatgggactgtcaaaattcaagaagatgcaatgaagctatttgaatctgggcttcatgatttcttgggttctcagaacacaaaatggagcataacatctctttctgtttcagcaagcaaaatattcgacataccaattgtatgcatactttaactttatcagtaataagtatatcgatttgctctcatgtttaaataaccaacatccctggagaaataaggatcagagcaaaatgattatcttgtttctttgattgcaatacaccatgcatttattgatattgcattagcttctgctctcaaaagttgagggttatttctgaaattgttatctgatgt

SEQ ID NO: 77677 - DNA, 1047 bp, Oryza sativa
tgtatgtcaaggaaaacccgagatcctagtcggttacgattatattttatctgtaattccatgttcttttaggatatggactgtattttgtaaagcggaccccttcccctatataaggaggggtccggatgcttatcggggcacggttttttgacctagattatacaatcaataatacactcggcggaatcatccccggacaggagtagggtatacttcttgaataagaaggcctgaacctgtataaaattcttcgtctccaaacccatccactttcctagcttgatagccacccccttttagtattgccgaaatcttgtttcgacagttggcgcgccaggtaggggtagcgtcaagtttttaccggctaagtgcgatgggttccgtttctggcatcgacgacttcgccttccctcccggacaggcgttccggttcggcagcctcaacttcatcaccaacgacttcggcaagatctctctcctaactcggattcgaactagtcggggagagatcaggtccccgcgccgttcggtattccgaactcggccgaggcctactccaagatcatctctcccgagtcggcttcaaaccactcggacgagatctaatctactcctccgcgaccagatcaagatgacgggtcctatccctcaatcctgataaaacttcctgatgatttggccgctgtcttcacagccaagacatctcctgctcgaagatctaggcgagctccggcttcggccccgatccgatctagatccagggaggttggcgttatactccaaccccttgggacagtctcgacggaagagttggatggctaccttagctcccccggtgtcagttctcgaccaaccgagatcctcgactacgacgacttcggctaccactacgaccacgacgacttcgacaacttcgacgacagctatgaggataactacacgcctctcttcttcggcgtattcgtggctgacaacgaaacggaggaacaacgccgagcccgagaagtggaccaagagcgcgcatggcaagaaactgaacgtcgc

SEQ ID NO: 77678 - DNA, 1283 bp, Oryza sativa
atatatttcttgatatttctatatatattataatagaaaatagttgtcaaagctacgttttgaagaccgtgcccttatccaaaacgataagtattatcaaccgggagggagtaattaaagatgattcttctagtatgtactgtatataacctgataaagctaagctagctagtgccacttgttagatagagaattctctctagggactatgccatatctctacccctatccatctctgtaccatctcaatagtttaattaaccccaaatcaaagcaacactatccaattaacttttcccttctctctgatgagttcaaacttgcattgtgggcacacatcacatgcccttgcacccctcaagagaagcatgcaaacagaacaaaaaaaatggattcataagcattggtaaaaacaaacaagcaaggactcaaacaaaacaaaataaaacaaaacaaacaaccgtgtgcacacacacatgccaacacacccggaatgtatttcagattttcagtactttcagtttattactccgtatcaccttctctctctctctctgagttttgttttttgtgcattgtgatgtgtttgtcctagagggtagtagagagttgctgccatggggaggagcaagctcctagatcgagtagttggaatccttatttgaaaagaggatttcaaaaagggagtagtaaattttaatcagattccgtgtgtacgcagggacgcatgcaggggttgtgaagctcaaggtctaggcacggttttatatatatttgaatgacattgtaaaagggtatttgcgcacacgcattcgtgtacgtacgtatgtgtgacgctgttgttggactgtgagcaagggagtacattcaacgcagcattgctattggtgatggctggctatcaaatcaaaaaaaaattaaccattatatatcaatatatgcttgccgcttattggcgcatatatcttcatgttgttcttttgtgctggatggctgaatctcagaatgatttgtaataatgatggccaaataaatgagtgaactattatcactggtggagaaatgttttttagtcccggttcgtaaccccctgtagtcccggttttccaactgggactacgaatccgggactaaagatcgctatctttagtcccggttcaaataaccgggactaaaaattaatctttagtcccggttggtaacattttttctttttttttctgcttttaatattgaatattgatttcacaccatcccctcccatatccaaatcatcacatatt

SEQ ID NO: 77679 - DNA, 644 bp, Oryza sativa
gtctcggagtgattactgtggcggcgtccagcgtggcaacggcgtccggcggtgtcctggacctggagtcggagatcgggcggcacgcggcaggagacgagtcaactgtcgacgagaggaggcgaacagccgatgcgatgaggcgatcagccggtgggcaggtatggcggccgccatacctcgccatactggtggcttcgctactgagcgcaagatccccaaacaaccgggccgatcgatgccaaagctaggagtggccttggttttttttcccttcttgtataaataagcaatccaaatcaataccgaatcggaaccagagaggacggaggggtgaaaaaaaggcgataactttgagacggactcttaccacgaaactgatttcaccgcatgggcatgacgagaaggagttggcgccagatgttctacgtggggggtggagcggagtgatgatacagagggaggcgaaatgatatgcgacgccggccgcggccggaaggcgagtacacggcggcgccggaacggacgagagagaggaagggggggaggggtttgtagatttgggttaacgagagagagagggggtccgtcttttttttttgccgaatccttttttctgttttttttttgcttccggttttatt

SEQ ID NO: 77680 - DNA, 686 bp, Oryza sativa
ttggtccaacaaattatatcgtggtcgacttcaaggatcttttcgacctctacaggctctgagtggtggacacaagcctccttaagtgctactccttgtaagtattgtcgcccaactcattctggtaataacaatcggtttaacttgcttacaagatcgttgatcctgtgtgtaggttaagttggcaatggtgtcagaagcatgcaccggaagttgccttccttgatccacaagtggtcactatcacaaatctccagaataaccgtcaaggaatggtcaactacatctacgacaccttgtggtcccgccgagacaagaagtacattatgtgtgcctataatcaatagtaagtgtgttaactaaatatacacaacagcatgacacattccttgagtaccgaattaactttcactatattaatgccgcagtgcccattggatcattctggtcataacacctaaatggagtacatgtcattacctgaactccagaattgataagaacgcatatgattggaccccaattcaactagcgatagatgaagcgtgggcccaatacgtgcaaagaggaggcctcaggaagacaggacatgacaccctcatccacaaaaaagacttctcggtgaagcaacaaataggtgaccagtgcggatgccatgtgtgccacaatatgcgacttctgtatag

SEQ ID NO: 77681 - DNA, 649 bp, Oryza sativa
ctcacgaggttgttcccgaagttcgaatccttgaggggattctactctccgttgaggagctcactaagagtcgggtcttagctaaccctttcctcaagaggttgcactaagcactcctccttccactaagggtatctcttcccttttggaggtgagatccgaccttcacaaacttctcccggccaaccataagtagatcggtggctcgggagcgacacctagccgcctaggagtcctcaacctccaagagtaacaaatgaagcaaagaactcccggagatgatgaaagtgctcacaaatcttcacgaagtcaacaacaagcactcccacaaactcgaatccacaactctcacacacacaccaaatccaaatcgaacacgggtgagagggaaaacaagaaaacaaggctcaaaagtgctagagaaagagcaagccaagggcacaaatgattggaatggaaccagcagccctcacaagtgaggggagggggctatttatagccacagcccagattctgtccgttatgcacaataattcagattttcggatattccgaaagattttcggacatgtccgaaaattccagctcagcaccaacaacaaagttaacgaaggatttttcggacattccgaaaacttttcggacaagt

SEQ ID NO: 77682 - DNA, 535 bp, Oryza sativa
ctagtaaaaaaaccggaccggcccagcggttgaatcgtaaaaccagaaccatgcctctcaccggttcggtttagtagaacggacggctcatgcatttgacccggtaagaaccgagtgaaccggatggtttttagtgaaaaccggcgaaccgggctaataagaaccggcggttcattgtaagttgggctaacgcttgggctagccttgtaaggcccatcatcctacaccacgggccatttatattttatgcaaaatataagagaaagcatgtgtgggaagtgatttgaacccgtgacttgcggattgagacattgggcctgttcactttgatgccattttcaaccttaccaaattttggtaaagttgcaaaaaaagtggctacgggcctgttcactttgatgccatttttaaccttaccaaatttttggtgaagttatcaaaaaagtggctacatttagtttgctgccaaattttggtaactatataagaaattctgccaaaattttggcaagttgtcaaaattttggtaactatg

SEQ ID NO: 77683 - DNA, 17581 bp, Oryza sativa
ctcattttgactaaataacatgttataaaaataataagggatagagaaataccatacactaaatgtcatatatgattattattgaaaaaatttatttggtaaacaatgcaatatacatattatacatattgtctaccaacataatcttctctcgctgtagtaagcattcatttggtcaagattaggtataccctctacccttcgatgtacgttatatactgatactgtcgacgtttgatgtcgcgattctggtatttgcatagtatggggatcgttggtaccaggatatatgcgagattgaggtaaaagagacatagacgaggatttttatacaggttcgggctcctgaattgtcaggtaataaccctacatcctgttggccgaagccgttattgctcttattcaccataatcacaccagtacaatatttggggtagcctatctaagtgttgtcgacatggcggtctgaaggtctgactcgtagtcgacaacagggtagccttcctcctcgaatccgcattcggcgagatcagagacagcgctatatctctcctgacggtatccgtaggcactgtaggggactagccatacctatctctgaactcgatatccggtgtcttgtcttggcgtatgttggcttgtatgttgtggcttctgttgttccgtgtcccctctcttcctagggggccttgtatttatacccataggtgtccccttgtccaagtagaactagggaaaccaatatggatacaatccgagtagtccttgtcgtttccatgtagaactctggttgtcttcccttatccggaactctatccatatctgagtcagtttccatataagacatggtatgtggtgggtcctgccgagatttagtcaactactattaggtatgtggtatccataaccctgacagatacggtatacccgcacgtatacgggtagtttccttatacattaaggacatctaacccgtgatagaaacataatctatggacggaaagagttctactcggataatactgggtctttaccatatcgtgaggggtccaatatctccgagtcctacttggagatcaactgacccacgatatataagggaccccctaggcaggacctaaggcatcgaatattactgccaacacatccccacagcctacaaagccgaagcctacaggagccaagtcgccgggagatctagtcgggccaactcaactgcggtctcgtcggtatcaccgagttctgttattccctttgtaatctgtggattccatcatataatcccataccaactggattagggctattacctactaaggggcctaaaccagtataatccttgtcttttgtttgcctgatgtcgtactacgtagatcctcgtaccaacggaccccaataccctctatatctggtctacgggtatcccccatcgacagtgccgcgccagataggagaacttggtgctcaaggttctactactatgacttcaagcctcctcgacggtaacatcaaccccagcatcaaccaaggagcttcaacttcaacgatgctggtgtggactcaagtcggcgaaatcgtcttcccggtctacaccacgatgccgatctcgactggcctagcaattaccgggagcgagaacggcgtggttacgaccctggtcgactctatgtcgaaagatcctcccgcagaagcggagaacggaacatcgataacatctgagcctgagaaggatcctagtgcggtcaaatcttgtccttccgacaaaaagcacgagccgacaaggacaacttccgaggacgacacagaagctgagaagataacccgacaagccaagatctattgtatgatcggcaatgatctgtacaaaaaggcgccaaacggagtacttctcaaatgcatctcgtccaatgacggcaaacatctcctcctgaacatacacgaagagatctgtgggtcacacgccggcggatggacgctggtaggaaaagcttttcgacaagggtttttctggccgacaacactcaaagatgcctgcgatatggtgcagcggtgtgaagcctatcaatttcacagcaaacacacaaaattccagcgcaagcgctccagactatccctctcacttggccgttctcgtgctgagggctcgatatactcggaccattcccacgaggacagggtggctacaagttcctattcgtggcgatcgacaagttcactaagtggattgaagcgacgcccacaggggaaattaaggccgacaatgccatcaagtttatcaaagggatgttctgcagatatagattgcctcacctcatcataacaaacaacagctcccagttcatcagtgccgaattccaggattactgcattggattgggagtcaagatttgctttgcctcggtttctcaccctcagagcaatggataggtcgaaagggcaaacggaagagtactacacaggatcaagacccgtgtctacgacagactcatgtcacacgacaagaagtgggtcgaagaactcccctctgttctatgggccgtgcgtaccacaccgacaacatccaataaggagacacccttcttcctcgtgtatggcttagaggccatgctccccacggagctacaacatcagagcacacgagtacataagtactccgacgaggaacaggagcagcgaagcgacgatgtgaatctactcgaggaacatcgagaaagagttgccgttagagcagccagctaccatcaggcccttcgccgataccacgagaagcacatcagagcacgcacactttcgatctgcgattacgtcctccgacgggttcaaagtcaagtagggcgcaacaagctctcacccaagtgggaaggaccatacacaatcacgcaagtcttgcagccaggtgcattcaagattgcagacggcgatggtcgcgagttagtaaattcctggaacattgatcaattacgtaaattttatttacaaatcaatagtctcaaaatttgtaagtcatattacgatttcaataaagttgatttcaggttaagaatattgtcagagtgttccttcccgacgatcccttaccacgacgacacctagagttgaaacctatcctcatgtccctttacgccgtcctggcaaggcctctgaggaacctaagggaacttcagctagggacgcccagagcggataaggccttgtcggatcatgtagagacaaacgaccatgtatgacctggtcatgtaagagttctcgccatgcgtattaaccaagccgtgtaatcggaaattgagttttccaacttcacggctgggggctagggtcagtgcttttttcaaccaaggcaggtcaagggtctaaaagccttgtcctccgagaacgattctccgacaaggctaggggctagggagagtgtatagctcaagtgactgatcgaaatcacaaagtgagaaaacactcatacacaacatgcccagagtaagaaaacttagatagattccttttctattttacaagtatttcttacaagtcataaatacttcaaagtatattacatgcttccttgagatatttttctacataatacaaaaactaccagacggccaacgccaatccatggagcggatctccgcaggaccgtcgatctccgcaggtgtcctccgagaacgcgagaacccttcgcgaaggaactcgagatgcagctgcgaacgatgatctcggatgcaggctagcacatgtcctctggcatagcggctcgctcgacgacactcctgcttcagggcatcgtcgatgcgctggccaatcccttcgagctgtgcgcaagcctcattcaaccacgagatataaccagccgccgactcctcgggatcttcgcggggaactcagagctccatgcaaaccctcgccatcgacgtgcaacagctcctgaggtacgagttgaaccacacctcgtgacccccggagagcttccatggcctggtccttcttcacctgcaccatgatttttttgagttccaccacctcgagtttcgtcttccaatatcggattcgacgagctcggtcagccaacatgttcttgaaatctgcccgacacggaaaagactaagtcaagctattcttctcttccgagaacacagctaattaagtcaatccgaacacaaggagtgaaggagagcaagatacaaacctagcaacgtcatcgccatgtttgcctccgcggacgggccctgactaatttcctcccacagcacgaacggctcgagtgtgagcgccggaacgatcaccggcatatcgggctgcccgtgctgctggacatcctcgacatcaatatatctacaacgacaacaaagtactcagaatcacatgctaaggaaacaagggagacagtgttgacggtcgttatcaaacagtttcgaccgtcaatattatcaaaataggagagaactagtgatgcttgcaatgcatatgtttgttagaataataatattccactagtattaggtatactaacctttttgtagagaatgacactaaagtggaggagaatcgacatcaacatagacgataaatcaatcggacgatgtcgagaaccagacttatgtatgaatgggccaagaactcagaattgacacgatgaattgggccaaaattcacaagtctacaaagtgaagcaatagaggaagtcgccaaccgaagatgggctggtttgggccagcccatggttcagccaaaccagggggttcggtgtcacgtcctgataaattcatcccgaaataaaaattattttctaaaaggaataatagaattaattaaaattcgaaaagaatttggcaaacactaaaatacgtacaagaaaaattcaaatgtggcccggagaatttttgttaaattctccttggtctaaaaagagccctcaaattttagtggaattttcagagcaccaaatataattattaagaaataaacaaagtttaaatgattttataaaaagaaaagccctaaaaaagttccctttccctccccctctccctcttgggccggtccggcccagctccctccctctccctctcctctccccgcggcccattcggcctcctctccgcgcgcgcgccgctgacgggcgggcccgcccgccaccctcgctgacgggtggggcccacctgtcatccctgtcctcccgccgctcccgccgcctcgtccgcgccctagcgccgccgccgccgccgaatccgccgcatcccgtcgtccccgcgtgcaatcaataggggggaattattccccgtgatttcctctctctttccccccattttttccctccctctctccctcggattcgtttggaaacctctcccctaacctcgccggcgccatcaatggcggccggatcttccgcgcccgtttccccctcatccggccgccctctctcactcccaaccctatataaaccctccccgtgcctccctccaccgtttccgccactcgccgctctctatccccgccggagtcgagctcgcgccgtcgccctctctctccgtcgtcgccgccgagctccggtccgccgccgttgtcgtcccagaccacctctcccctcggcgccgcctccttcggcttcgccgcatccccggcgacctcgtccacccctccgtttcgctcgccgaccgccggagcaccgtcgaccccgtccacccgagccgcgccgccgccttcctccgctccggtcgccgtttccgtcgtcgccgtcgacccggggtgagccgtggaccgccgcttcgtttcccccttccctcccctctctcggccgccgctccgccgtacctatggccgccgccggcgaccatagggacgcgggcgcgccgcctcccgtcggctgtgccggcgtggccgccttcgggcgcgccgtgcggctgccgcgtggggcccggctgtcagccgctcgcgccctcgggtgcggctgacgcgtgggacccacggcgccggccggtgtgagcccgggtgcgcccggtccaccgtggaccgtggggctgccgcgtgggccccacccccgtggacccggtccgcgcgctcctcccctcggctgacgcaataaatccattttaaattaaaatttaaatgaacaaattcgcaaatattcatttaaagagcatataaacttcaaatggccataacttggccatttgaactcggaattggaccgttcaagtctctaatttttccctaagaagtcaagaacccatttttgtgctttgttcctgcttgttatatggagtttattagagtaaaagccttttcttttccgttggtcgtgtagacgctgcagcttcggaggatccgctcttcgtggaagttgaagccggcgtttgggaaagcgagcaaggcaagtcacatcatccttgaacatattgaatcccagtttataaaattatgttgctttaaattattgcattatcactttatttaaattcccgcgttatcactgttttatctagccatgcctatctacctttgttatgaccttattattattgttattgttattattaccttgttcaccctagattaaacaaaaccccaactagtggacactctactcatagtaccactagtataattttaggtagatgcttcgctgattaattaggtaacattaggcggttttacaactctagactttgggatattcatatcacctggacactttggaattgttggtttattgtggaattggattcacaccgccccctctattcaaaatccccaaaatggttttaggctgagctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctgcctacctgtcccggaggttccggccgtaggtgggattgggtcggtactcttgtctatggctaggatgggttgggaactatgtcacgtcttccgtccgtataccgtggtggtatgtggcacgtggttacacatgaggaagatgtgtcttgtgggtaaagatgtacacctctgatcagagtataatctattcgaatagccgcgccctcggttatgggcaagccaagcaatgtacccaagttagtgttttaattcttaaaatttgctcaacaactaaaatgtggaatggttggcctgggttggcttgggacgagctgggatccagggtcgggttgccagttcggtctgaatcatcgtaggccttgggttaaggcaggttcgtgcgggttcacgaccttgattaataatactgtgtagctctaggatcgtctttttaaaatggctttgggcaactaagtgacttttaaatgctgttttctgcaaaacttaacccctatatcattaccccttgtacccccttgcattaatcgtgcatccgccggtgtggcttgctgagtactgtggttgtactcattcttgctctatctttctccccccttcagtaagagaagctttggagaagatgtcttaggtggagtcttggcttacaccccagttgagcgcctgtgaagatggagccgtaggcccgctagtccgctgctgtttattttttattgtcaggccttaagtgcctttgtaataatgtaaatattatcgatataataaagatgtgtcttttatatcatgtttgtatggtgtaccccggcttttcctgggacggggattaatacactagcgttcgggaaaatgcaattttctcggtcgcgacattcggccaaacccccatctccaccgttgaggccacagtttggcatggatgtccaagattgcaccccaatgacgtttggagggtacttcggacaatccccctttcacaactgtcataaccacctctatataaaggcttcactctcttcacttcaacacacaccttaagcaatggctctagtagcttttctcttctcttttgtaagatttgtacttttattagaatactcttctatatacatttatggtattaaaatactctccgagtatataagtacctactttacattatgttcttgttatactgaatatacggctagcttatctgggagatgctttggtacgggtacagtgtttgcttatgcaattactctatgtcatgacgatgatattatagtagtatctggtagtttagacgtggtgtctagattacgggatatcattatttggggttatatattgcggatgagaggtgggccgctgatggtgacagctcagtacaggtattcctccgcgcctatatataatcctaagttaatttcctggggagggtattcctctgtatttagccctagttgtatggtcatgacgggctgtcgtaaggaactcggcagtcaggggtggcttcttaaagtaccaggagagcatcggatagagggtattagctagtatatcagttaactagaatgtatgtatactatgtatattagaagtataggagtagatttcctttctcttttctttccacacagcttagatgatatattatgagaatgagtagttaatgcttgtgtgtcactctacccttggattatcttaacccctatttagaatatgattatcacaagtaatatataaattattagttgagttctctctacatgatcttcccacgggataaaataaatacgatacccttggaatactctagagtgaaatgctacaatggtatatccgtgcgcttgcggatgaactctgtaaccataatataccagaagtatttctacgccattgctgggaattatatttctagtaatgtcgttaagaaataccatcagacagttgttcagataagaatagttcggatccatagacaagttttacagcatgaaggttaaggggtacaagggaaaacaaatgtcctactcttcaaaaagggggaggacggactcccccaagtcaccgacttcttccatcgtatccttgcgtgcgtcatcagcggcccccagatccaaagccttcttaaggtccagatcgggatatgccagcctcatgcacgcaaggacatggcacgccccggtgtagatgccgttggacgtctcctccccgatcctagccgcgtgcttggatgtgatctcctccatcgccgtagccagctccacaagcgatgacgtcagcgagaactcatcgggatgcgccgggatggtagtcgtgacactacactccccggcgagttggtgcaggctggtgaatgacgttcgcagcgaaccgcagatgtcgatcatgtggccctcgagctcggacatccggtgctcgagtccgcgccgctgcatctcgttgccggccactagctccctcatctttaggaggtcctcgtgggcctccggccaggtcgctcgctagctagtcggcacgttggtttgccgatgacgccgccgccctggcctcctcgatctcgtgacctacgccgcgagcaccggcctagaggatgcgctccatctccgcttggagctcctcccaggtgagggcatcggtggacgggcctcgggtaggcatgaggctgacagcagggccactccgtgccgcctcctggtccttagtagcgaggtcgccgcaggggacacgctgaaagcggcatcagtcccaccttgtgccgtctttgcccgcgccgccctgtgaagatttttctcttccccatgaggcgaggtgatcggatttttgaagatgacaagacctcaaaaatgtttacttacttctcaccgatcgtcaccaacctttgccttcgctaaggtggaggagacgcgtccgagtcctgagtaagatgaaatggtatgagatcaagttgttccgactacgtgttagggaaccacaaagaagcttaccgtagagtttttcgctttccgacgggtccctcgtacggaggagaatttccttcccctctttgggacgttgctaccactcgtggtggcagcaacagcgtcagaggcctccttggcgatgctctccttcaacgacgctgccgcctggtggtccatgagtggcccgattacgtccgtcagagggagagcctgcacaacgtgaagtcacgacacgatctcgaggagaaagatgtaaaggaatcatcgagtacactgacattgatcgcagcggcgcgttcggccgttcccttctcgcaaagggggatcgagatctcgcccgtcgctgagggggcgctgatgatcacctgactgacgcggcgccccccggtgtcactgtctagacctgtgaatcgaaaacgagaactcgataagttaggagaaacagatggactcggaacaagattagaaatgcgagcaaaaatacaccgaggagagatccgggtcgtgtcctctggcccagagtaatcaaaggccggatgggcacgggcctgcagcggttgaatccgcctacctacgaagtcggcagcgacttcgtaccccgacaacccccaatttcggagatcatcgatgatctcgataaaagattggagggagggagtcagggcgggtttggcggtccactcagggattttgtttggttgttctttagggacaacaaggacgggatccgagttttctatctgaagatagaaccatctcgcccgccacttgctgtgagaagaggggcattggaaggggatgtaacgcgacttcagccgatcccgaagttggaatgcaacgcatccagataccctgttgggttccatccatcgcagctcatagtaaaagcggaatagatcaaggaagggctctaccccaatgtaggcctcgcaaagatgagaaaagatgctaaggaatgcgatggagttggggttcaagtgaagcaaagaaaggccatagaaattcaagacaagaagaagaaattgagaaggcggaggaagaaaaccgcaagaaatgtaatcttcaacgacaaccatgcggcctaagatgggtttaggttatataccacctgcctccctttgcatggtcccgcgacaagggagggcaccgtcgtcttgcagcttcctcaaggacgcggtggttgaggtagacttctcaagatccatcgccgtcggaggatcgccggagaacaagagggaagaagcaagctagggttttctttgcggagagcggagaagacgaagggcgctagaaggcaggagagttttctggcaaatggacttcaaatggactcccaaaatccctttaaataagcgcactaccgacgacgcgtattccaaggaaaggagagagattgctgccggaaaattctgggtccgttgcgcgcggtagttttcagacttcaatttaaattcactcatgaccgttgaacttcatgcggtttttgtcgatagctctttgtctctatggtttttgcactgagatcgactagatgagaacgacaattccgacatcagaagtcgcgatcaatgacatgagttcatttaagcagaagtcaggggctactgtcagggttacggataaggtataccatctacccttggatgtacgttgtatactgatacggtatacccgcgcgtgtacggatagtttccgtatacataaaggaaatctaacccgtgatagaaatagaatctatggacggaaagagttctactcggacaatactgggtctttactatatcgtgaggggtccgatatctccgagtcctacttggagatcaactgacccgcggtatataagggaccccctaggcaggacctaaggcatcgaatattactgccaacacatccccacagcctacggagctggagcctacaggagccaagtcgccaggccgggagatctagtcgtgccaactcgactgcgttctcgtcggtatcaccgagttctgttattccctttgtaatctgtggtttccatcatataatcccataccaactggattagggctattacctgctaagggacctgaaccagtataatccttatcttttgtttgcttgatgtcgtactacatagatcctcgtaccaacggatcccaatactctctatatccggtctatgggtatcccccgtcgacacttctaagctttattcctaactttcagtcatatcagataatatcttgagatatgactggtttttctccaactattttttatgattgcccaaaaatattaatgagcactccttttcctgtatttctcattttctttcttctcttaatgattgagaatattttctaccttccatgtcctttctttctttctttttttagccatattttattgcaagctactaatatgagagacattttaaggacatgatggaatatttatttggtggatggaaatgttgctcacacctagggtagaggtaaaacaaccatgataggtggaaggcatattttgttaatctccagtatatggtgggtgcacgtaagtgggtatcttggtcaagacagcataaaaagaagcaacatatgattatagggttattcaattaagatcatcatattattgaggaacttataaattttattcttttttaaaaaaacatatgctccggaattccagtatcacttagagaaagaccatagcaactctatttcacaaattcatatccaacaacaatctagatttagatcatgctttatgcaatccacaagtttcaaattcaaggcaaagattttttttgccaacaaactcaaaaactatagtgaaggttaggcagtaaagcactagatagaaataagaatagagcatctattcatcatttcaactgggaaaaattaaaacattcattgatgatggcagcagtgcacgttgccaagaaaccgttgctactgccaagtgattcaaggggcagtggctttggaggaggttactgcaaccagcagcgtgcagagactgcgactggttttcagttttaggattcctctgaaccagtagcagctgctgaacaatcatctgcagatgcagtagtaggtgtctagatcagtttaccgatcgatctgaagagaggtgaattaattacaacgaatgaaactacagattcagagaggaagatgagggaggaagatactgattgttccatttggatttattttgaggagttgcattgcagatagacaaacagaattcttgatgtaaccggtgcaaggaaagattcagatttcttcctatgtcattaatttataagtttttttgttttgattttcatgtacaagaatgtaaattatagtaaatggtaacatcgtgcaagctagtactcaagcatatttatatgataactaggaaggtggcccgcgcgcatgtacggacacttatattattgaaatgtaagattattgtttgttaaaaaattttgtcccatagattaagggtaaactaaagttcagataatgttattttataataatttaaggtttctatttttcttaaggtatcttaaaaaaccattcataaacttttgagtagaagatggattaagtaattacgacttttgaatcatgtttttttctcaagtaaataagaaattattgctagttaattatcatacagtccaactatatatataccatgtagtatggtcacaaatgaaaaatgcgagagcaatatactcaaatttcttgtgattaaatcatctcatgaagacgtatgatatagtaagaaaagaagggaagcgtatgcatgcaaaaaaagaagaaagagatcaaaataaaaaaagggaggggaagcttacataccgacatatgtaggtgcatacctatgccgcgggaggagaggtgggacctcgtagtatttagtttgttctgagatcaatttaatctaacggtttataatattagacttaccgttttaagtgaaaatcaagaaatagatactttgcttttttcttaaaatttctaatacttgctctaatttattatagaactatgtgacaccttgagagcattttaaggaattttaaaggacttaacacatgtaattagaatattgaccgcgtaatatatatgagaatatggtaatatttgttcctgcttcgtccttgtttatatacatgtagagagaaattaattatgtggctggcaagccactagatatctaattaatagcaattaattttgacacctatttacaattgttcatagtagctcttacatatacatcttacgattttgattatttgttgatcaccatgactcgcatgaaaaaaatatgtgtactacatcttacggtttaggatatgaaattgatgaattatctgatttatgtgatagctatttgagggtataaacgaatgatttgacttctaagaagttaaaacattgtttaaaaaagacaccatttagaaacttggaaagcgtacaaacgtaagtccaaaatatggaattggaaaaaaaagagggccttaaactactttataacacccttgtcttagtaagagttctattgacatttataatataatgatttgtttcacatgtacgaacaactagtacaaaatccaaatatgacataacacaatacattataattattatgtaatcaactcttagtccaaaatattcttttttttgccaacagggccaaaatgttatatagtttgtatgcatggttcatagttgagacaacaatacttttgaacatcccaaaagaaaactcaaaaaaaattagaacctttttagaaattgccacattttcatatggaaataatcgcttggaaaacagttttcacgaagcttttgtaaagctttcataataatttccttttcaagcaaaactttaggcaatagttccagaagtttagctttgaaaaccttttgaaaagatgattttgaagtcatgcactcaaaatttggttttgcatgattttgcaataaattatttggaaccaaaattcacagatgtttttcaagaaaattttcttttgcaactaattttgaccattcctataattttaatataatttcaaagcggttttgggagacaatttttcaattacattgtttgaaacaaacacttcctttcttttttggagcaattttctttataaaactatatttcagaatgcaaaagttaatttgttttgcaatattttctatagacaattcacaaaacaaagttttcgggggaattatgccatatgagttggacttgtccttggaattttaaagcaaccggaaggtgaaattcatatttattttatccttcatccctaaattcttgtccacattgtagtttacaacgttccttttagtaaaatttcctgatctgcataccatcttatgtttctcctgatccataagcttcaaatctttgtatgtttatggaaataactagcaatcttgcatggctttcttatagatacgcagtccgtttctcttccttttattgttctccacgatattcccatgccaaggtagtacatttgttgtcagtggtcactaacggcttattcgagacttcacttctactgcacgagggtgtaaccaaaggaaactagtactaacaatgataagttgtcatgatcgataagttagtttctgctcttttctttttcttcacattattttcatataatatgatgcaatcgtctactttcgaggatgaggtttcggcaacaatcaataatattcctatagcgtcttaattgctttcggttcttattctataattttgaaatgtagatgagaatatagaaccaatattttttaatcacaaatcgagtagtaagattgccttttcaaaggaagggttgagatgtaaggtatcaaaataatttttcttttcggtgcatcggaatcagacattttccaagaaaggtaagatgacgtcaaaaattgtttgaatgttttcacagatctttttttagcatttaaaaatagctttgaaaaatatagagtccttaaactaacgaccattctatctaggttctcgaactacagtcgatatgctctgataccagctctgtcgacccccgattttggaactcggaaatcttctgtgtttatcagtaccaatccctggatcagtagttggtacacacatacatagccaaatcacaacatatcacgaatgaattcaggctaagagagttaaatgcttacattagggccaggcaggccaacaactaacagagaacaacagcggaagacaaaataatacaagggcccggttgacatgccacaagcagtcgactgggaacgagacctagaatggaaccacactccgatcatcttgttaggtacgcaagcatactaacaagggcttctcttcaacactctgctaaaagatatatagagcaacaatgagtacaaaagtactcagcaagccaccacacaaaatgcagtaatgtacaggataatacaaggagtggctatggttactttgcgtaaagctgagttttcaaatatcatttcacaaacctaagacctagcataaactgttcaagttttagttccattgttcattaaacagcgacggttctgtccaccatccattgtgttcccaaggatagcttcccgccactggtcgtcatggttttctggggtctaccccttctcgcctctcgagaagttgttccaccagtacaaaatcatcatgcaacatcccacccaaccagtttaagaatttagagtctagccaagtgtaatacatgtcccggtgctcaatatccgcgagcacggctattcgaatagatttggtttactcacattgcagtggatgtacactttacccgtactccgcgacttgcccaacacatgagcctacgtcccaacgaatgagacttgccacagcaaagcctttcgataacctcacattggtagtacccgctccatgaacttgcatcctcctgtactctaggcgtcataagtttctagcagtgagaggagttctggcgctcccgggaagggaagactcacacatgcattaagttttagttaagttaagtttacacatggcagtcctaccgatggcgacaccactgtaagcactcgcccctcgcggtcccaccaatggctgccccaccgtaggccctgcctcacacacatcaagaataaccactatgcagggatactgccttcgctcggctatgtactccgctaggtctatacccatacgagaaatacggttgtacgagagtcgtttcatgcttaacttcatggctcggtccttaactgaacagggatggtactagccttttccggactccacccaagtaccccagccgccccagtcgaaaacagtgtttaattttatttctcctttcacagttcgtgtcatccttgtcatggcaatgtggcgctcatgtctccacatgccgcatctcaactaccttccctaaggtagttgcccaagcatatagcacttgataaatatgagaatgcatgattctaattagcatgactaagcatttgttcaatattgactaagtacacacgatagcagggtttacaatggtcatacagataatcaatatcaaggcatg

SEQ ID NO: 77684 - DNA, 1341 bp, Oryza sativa
taaacatgaatctatctaggactcagattgagaaattccatcaattctattggtcatacttttccttaaaaacttacctcttttttctgaaacgtttaaaactttttcttcggccatactttatgtggttctctctgtcctagtgtgggctcttgttgtgtgcaaacttttgtgggccggtttgagcctccaaatttcttttttttaaaaaaaaaatcaatttacgggatgcgattagatgatgtgtatctcactatagtattcattcataggattactgaattcttccaccaacagtaaaaaccagaattcatattttcagagagcatgctaaaagagttgcacagaaatcacagcatgtgtttgcttaagctgatcccacatagtatgtgaaatcagggcaatatcctaggaatcgtattacatatttttgtaggccatctaagataaacaaaacatgatgtatgatgtatgtagcacaattgtccatgatcatgatcttgatctctttttttttcccattcatgtcttaattctgaatattttgttcatgtgctccagagcattgtgcataaatccccacttccggtgttcaggggaactgtgattagcatgaagattttggttgatttcagtgttggattgggttttatctacgggccagtagatatctgttcataatatgctattacaatggttaaatgtgtttcaaccgctccaatttcctaaaaaaaaaaagaggaaagaacttgtgttttcggcagatgttgttttactggatgcctctcacattcacaactcacgcaaaggatcaaatatgtgcagggactgtggaaaagaagaaaaatgggacatcgaaaagcaaaaactagcatatgatgattacggactagcaggatagaacctcttgtgttgtcacaaccagttcaagatcctcactttcatgctttggtacgttcccaaacgcctcctgttcctaaccttgcaatgctcgtcggctcgtcgatcgctccatcactataccgtatgatgatttcaaagttttgggaggcatatagccatagaggcgcaacactataatgtttaaatattaggggttcatgtcattctccttaaaatcagctgctacggaataacttatttacgcagatactataataaaactattggtatatattttcgtcttccgtctacctaccctccaatgagttcagtccttggagatctctcaaagaatacctcctctgtttcatattacaagtcgtttgacttttttctaatcaagtttgactaattttatggaaaaatttagcaccatctaaaatatcaaactagtttcat

SEQ ID NO: 77685 - DNA, 683 bp, Oryza sativa
ccgtggctggattgcaggattggtggcgccgtaaaacacggacaaatcgaaggccccggcgtcgacgacgagagtggcttggacgacaaagcggatggatcaaagtcgtagagagggtgaactcgtatatgagttacgacgatgtgtggccggctgccggcatgcgcgatcgagcgctcatcgctagagttagggttttcttttgattgtcaaggttttcttttgattgttctcactctattcgtggcttggctgcaccagggaggtggacgttggttccaacagcgtccaagtatggacgttgtttacaacggcgtccaattctggatgctttctgtattagcgtccatcctactcctgtaaatccccccaacgatttactaattatttaatttaagggtaattgtttattataaataaaaaattcggaactcaggatggtggtgatcatgcgggtaagcattcgcaatctaagaagcaagcaagagaagttaggagcttatggttcttccacacttagaattgaactatcatcattactttcacccttattttgttgggattctcctgatctatttttagatgttctcattgccgcctcctttgtttgcacacaccccaacaacaaccacaacgcgctatggcgcctcctatggatagcgcaatgtctctcacgagctccc

SEQ ID NO: 77686 - DNA, 2382 bp, Oryza sativa
cacaccatgaatatatacgtcatccctgtttttccgtgcaccaagcaagttaataaaatgtgttgagctagctctgatgtattgtattgtgtctaattagttatgtagtaactagttgctggtccatatctatttgtttttttcccattgcttactagccccaacatttggtgcttgatggacattcaagatagctcttgaattaggattcctggctccttggtttatatttttctccaaatcctctgaataatgtgctgaaatctatcacttgatcctcccagaaagtggcctgctaggtacttgatacttctcaccatccttggattcctacttgaagagtactattgatttgctgcctttaactacttagatagtgccttgaacgaatcatttatcattgtgacattgtagccctggcataactctgtggcactctgctcagtttacatgcattacatgttcattgattgcatacaatgccattctgtagtaacagtgtgtttaattctcctagattatgagagctaactgaatttaatttgatctgcagattgtgtgcgccaatggcgcctcaccacattaatggccttgctgacgttcgtgcagttgcggaaatgtcacctacacttcctaccatgattattagagtaccttgtgagcagtcagccaatattcacaggctactggaatttgttgaggatcgtctggatcacggtgctcacgacttgattaaggcagaggacattccccgacttcgagctatcgcccagggaaaccttacaagtgctgatgctccccagttttgtttgtcattgctcaacgagtcccagatctacctgcgggttcaactgttctcgtcgaagtcggatgattgggtgcggccacccatcgactcacgggtagtatcggcagtggctagtgcgtttcatcttccccaggatggggtgctgccttttgatctcaactcaacgacagtggccccagatggtccaggtgcaggtcgtattcatgctgaacttctgatgccaccaggcagcttgcctttaccgcctcctgttgttgtcacagtgtcagggtgtgaaccactgaatgatgcgcgggaactttatcagtacctggaggagtacgtgaatcaagagggctggatagttgatgacacacagcttgcggggcttgcagagctggctgaagctagggacgagttggtaggagctcgcgataagctcactacacttgcatcagatattggagatgatcttttattgggaggagcggtcactgatgatgtaccgttgttatctggggacttcaaagcagctttggccagggtattgaagcttcctgaaggtatggagcttcccaaggactttgaatcacctcttcttgtccctgccattgctgggagggagagaattcatggtgaactcatcaatctccgagctgacctggctgctttgaagcagcatgttgaggagcagtggctcccatgggctaatgatcgtctatcatccgctggagtcatcggagaccagattctactagacatggagtgacacgggctaataatgttcgtctcacatctctgatacattctacaagacatggactgagtcagattctacaagacatggagtgacacgggctaataatgctcgtctcacctctctgatacattctacaagacttggactgagtcgttccgtataggccacacaagaagtgagaaagacgatgtacatttcctgctgatttctaaggatcaaaccatagctgttataggagatctcccagaactgaaacctcaattgctattacatagttctatacttgcagaatgattacgatggatgcccttccaaaatttatgtggcaatagaagatgctttttagtggttagaccgaaaattaataatgttcagtgcgcagaacattctcaccagtcctcatacagacaatgcatggtcatacgcaggtggcactatttctcattacttgtacaacaattgacaatgaggttgatatcaatcatcacgttacatgtataagtgaccctaagggcttcttttgttgcttaccatccatctgagaacaacactgtgcaaacacttgcctaattgccaaagctgaatgaagggatattagcagaatttatttacacactgaaaaagaagtagcattttacatagccttcgctcctaatgaatcggctggggaatgaaatgatacaccccattagttaattctagacaatcagccgccttttacactgctacagcctattacaacactagcacaacatttacagtcgagaagcactttgcttcacccacttattcagaagaaccaaagaacaatctgtgggattatgagctctataca

SEQ ID NO: 77687 - DNA, 3299 bp, Oryza sativa
ggacattcatattcatatatatagcatgcaattttatttaaatcaacataattttcgcaataggttcaacatgctcaaagattagtgatgacttgcctgctcaggatagttcttattcttggtataatcttgatcaaccttcacctcctggaagctgcatacgttgcctcaccactaatcgatacacaatttctataatatgcgagaaaaccaatattcaagcaacaatcaaatatgcacaaacaaaatataattgttcggaatatacctagggctattcatatcactcgtgcttgctaatggattgtaaggtgctacgaagtccaaactatggctgctcacatacagaactcaatactcaggactatggaattatctatgaactattgctatgtggagttcatggctaaactagctttgattgtaatttaaatggtgacaccctacaggagatttaccaaggctcagtggataatttaatcataacaagagttctaacaggatggattatctaagcatggctctacaaatattactgtattagggttccaacgaattacatgctatgtaggttagattagtgtggtccataatattatagttaaagtttatctcaatgcataattttaccataaataatcctaagtcacggtcaaactataattgtgtgtgaggtcaagatttataattagtgttttatctactatacacgcttatcatagactcctcagtttaatatatgaaaaaggtaggttattgttcttgtgtatgatttaaatggactgtacagtagttgtgagtgcaataacatactagtattagatcatttactaagcatgagctatttactgtaagctatacagtatatgtgatgcaggtggatttggcgagttggtactgtttatcaacttaagattaccaacttaaaagatactattccaaagaacatgacattaagtaattaatttcgtataggtgatttaatcacactagctctgttattatttctcataaacaagttaaagattcatctatgagtattaatattttagttacaaaatatgaagctaaactttatgtaactaatttttaagtcatgaatttaattatatggccatcgaatattaaataagcactagtattttcctatacatccattcatttgagacattacttatacttagtttatgtggttgctacagtgacaaaacatgttaaatatatttatttgacatctactctactgtacaatatcaattttatttattagcacatttttaagttgaccataatctaatcatttgatattaatatattttattaaatagtgagttatataccattggaaagcttatgaatttagatgaatttaggttcaagtttcactcgaatcggagctaaaatgaataatttatactaatttaaagattcaaatttgagttaatccgagaaattgtaaaaatgcactgttcataaatgatttatttttaatcggaaacattatccaaaacccaccgtggttgacatgtgggaccggccctggttgacttatggtcaaacctgcttgtttaattaccattgggtcccgcctgtcataggaacaaaatatataattgtgttttcttagattttaactatagggaccccacctgccattgagtgggataatcaccgttagggataggattactgtgcgctaatcacatgtgggtcccacacggtttctctctctcctcatcttcttcttcctctcgcccgttaccgagcgaggcagaggcgcggctcggcgcagccggcgttgccggcccgagccgggacggcggcgggcggctcggcgacggccagggtgaggcgcggaggagctccggtgatctcccgccgatggcagccggcgcgcgaggagacgggggcgcgcggcgccatcaggcgacgccatgcccgagctcggctacaaggggcttcggtgctagggacatccttcggccgaattgaagggtgcgggagcatctacgaggtatggggattcgatttcacgaactatatggagaggggagctcccgggatagcctacccacggagagctcgccggcgatgaaacggcggctggggcggcacggccatgggcgctaatcgtcgattttgaagccggcgctagcaattagatgtatggaggacgctacgggcgcgagggtgtaccgcgagatggcgagatggcgaaacgcagcgaagtggagctcgacgcggtgcaggacaggggcaaacggcagcgacgtaaggtgctcgacggcgtttcttgatgtccagcggctaccccgcttcccccatggcgacgcggcaagcacggttctttcctccacttcctctaaccttctgctccggccggggagcctcacaatggtgatctctagcggtggtgagagggtgatcgcaaggtgttcgatgaaatgcatacgagaagaaggctgagagggatggggattttgttgagggcttcgcttaggatgcaagcaaactatggggataagatcaccagcacatgcctaggcgagctagagtactaatggtgatcggataagagcaatgaggtggatgacgcggctgagattcatctccttctccattaaggttctgtggcttaatcatcacacctataacctatagactgcaggtctgggcgctagctggaggagagggctccgttttatccattgggcgtggatgggggcgatgggacgcgcgtgtctgggtgatgaaggcaggcgtggcgacggcgacgcgcgcacatgggcgatggtgcagctccgtgttttctggagagaatctaggagagcggttagaggtgcggcttggcgtggtgcgggccctggcacgacgcggcacggaagggatgacgcgggcgcgggcgtgggtccggcgcgatgcgacgcacggcgcgatacaacgcgatacggttgcggagcggcaagtgcggtgcggctagggttggggtcggacgcagctgaggggaaggaggcgcggttgcggtgcggcacgggcgtgactggcgcggccagaagcgatgtggtgcacgcagtagacgggatcgaacggttggcggacattgaatagtggcggctgagaaaagagagaaaaggaagaaaaagggaaaggaaggaaagggaggggctaatctgcaaaagtgaatgggattgaatttgaattgaaatgtaatcaatatattttggttttgagaattcaaatgtttgatttgaatatttatttggttatttattagttcccaaatgaatttgctttccatt

SEQ ID NO: 77688 - DNA, 1668 bp, Oryza sativa
caacactaatataagagtcaagtatttcctattgtgatcagcaaaagcaaaaatcctaatctgatgatttttaatgaattcatataacataggcatgttcaactagaaattagaacgattaatactagtactatcttaaggttggtaattatttataaaagtaacacaacaagaagtgtgccagtaagtgccgaacatgcaagagtattatggatttcattaacaaaaaatatgaacctaacacatgtaagggaatatatcaaacaaaagcagaaataaaatgaagagacaactgaaacagaggaaacagatttatgcagaagatatttagatataaactgcaaaaaaaaagaacaggaaatgaagggcataaaaatgaaagcttcaatttatataaaattgaagatgctgacagaaaaaagtttactcaactccaaaaactagaacaaaatatgaagtccaacgattttctgatttattctttacagtgtacaatgtaccaattttttgtcctgttttattttcatgttctgttcccttctcatatttttgttaccatctgctacatggcttgtgatgctgggatatttaaccaattaacccaaacgaatcaagaaaaccagtagagatttggaaaactcatcgaactatgtaagaagaaaaataaaagccaataaggaaaactgagaaacaaatcttggtgggtggtaaaatttactgaaccacatatatagctcgacaaccaaattaattagcatcagatattgagtggaacagaagtaaaccactacggaattctgatgaacatccaagaaacaggaaatcctcccaatttgaccaccaacaaccaaacctcaactcctcaactacctgtctacctcaggaacagtgttaactattattgaccaaagtaagtaaaataaatgcaaatctttcctgatcaattcttgaccagaacacatgtacaatcgacaaaatgatgcagaatttgcgaacaaatcaactacaaaaaagaaatcaccattcatcctcattctcaaattgcaatttcatgatttggagaagcagagcagtatgagagaggttaattacctcgagcacggcaatggcgcgggcgacgccggcgcgggagaggcgcctcatcgcggcggcctcgtcggcgtcctccagcatcatctccaccgcctccctgatcgcctcaccttcacctttccttccaccggcacctctcctccgccgcctccaagaatctcccgaccaccctgcactcccttcgcaccctctacaccttcgacacctacaggatcacgcccttggacaccagcctgatccgcagcgcctccaccgacggaggcggaggtcgtggacgcggcatcagaggcagaggcggcggctggcactcggagacggacgacagacgcgcggaggaacacgccgacgccgacgcggcggcgccggcatacgcagtcgcgtcgtcgacaggggagacgcgggcgggcgagcgcatgcggcgtgacagcggcggcgccgcggtggcggcgtgcttgcttcgccgacggcgatgaagaggacgagcaggcagcgtcgtaccagcagctctgcagtggacggcggagaacgggtcgagggccaaagagcagcaccagggctggcgcggcgctgggccct

SEQ ID NO: 77689 - DNA, 9599 bp, Oryza sativa
agacgcggccgggcgagcgcatgcggcgtgacaccggcggccccgtggtgtcggcgtgcttgcttcgccgccggtgatgaggaggaggagcagccgtcgtcgtcccggcggggctgcggtggacggcggagagcgggtcgagggcgaaggagcagcaccagggctggcgcggcggggggccctgagggtggcggcgtcggctacggcggtggcggtgcgccgccgccgtcgccaccggcgacgagccgggcgtcggcatttgcgagttggcgtgtgggaggagagtgcgaaagggagggagggaagggaatgaagaacatgtgtcatgtagttgttgtttgcatgggtggtttgtgtggggatttttttttttggttatgtagcaccgccaaatgcacacatgtttctgtactccagagttatggattttgaattgtgttaagagggtttttttcatacagaagggtattttttaaccaatcctcaacatccaacaaaatatatgccacctttttcaattagatctttagcctaccaatagggaccttagccatcacataccccgaattgaatttcattcctatgaagatttgaagttaagccctcggggtgcttctaaccattaggctacatgccatttcgcaattgtgttcatagttaggaatcattttcttttgttttaacctatgtaggtgcaattaagctacgtgaagtgtcaaaatatgtgttaaaaaggatagctactccatctatcgcaaaataagtttatttttcatttatcctacacgtatcaatatagaaaataaaaagccaagaaaaccctcactttatcaaatcccacaaaaaatattcttctctttatatactctcaattcatttatcctctattttaaaaaactttgatacaataattacttaaaaataaatttattttagggcaaatgggaggggctaaaaataaacttattctaggacagaggaagtagctcagttttcccatcaggttgtaaatatttgatgccgaggataaaatttagtcaaactttgaccattgattttatgtaatgataagtttgtaaaatctgataaatctgtgatagtatgacaatgggcctgttcactttgttgcaaaaaaaaccttaccaaattttggcattgccaaaattttagcagctatgccaaaattttggtaacttgctaaaattttggcaggatttcttatatagttactaaaatttggcagcaaactaaatgtagccactttttttttgtaactttaccaaaatttggtaaggttgaaaatgacaccaaagtgaacaggcccaatatttttcaagacatatatgcaaaccattctctctttttttatataaaaaatatgaaaatggataagttattgattattaaagttgcaaattttgaccaaatctcattctaaatgacaagtatttatgcgttgtttgtacttgttgatctcgaacaaagtaactttcttatgtgtaacagtgtaagttagttaaattaattaggcaaatttatatgctgttaatgtctgtcttccttgttagatggatactatcaagtgttgtatatgaagtgatatttttaaggattggcatagttaccatcaaagtaagtgaatatactaattaagtcttaagagtacaagatctatgttgactgaatctcatgttttgtacattctccatcggtaaattctaagaagaggtataccatgatgtaaatatgacattattttagtagataattgccatgaaaaattctcaattactcatctaaaaagtgccctttttaaaaagctaacttggatgcataagtttcattttcagtggcatatgcttcaagatatatatatatacacacacacatagccctttcatttttgcctatactgtcactcttaaggccggcttaattagcaacctagatatcaccggatatagtacagtccgctgtaaattgcctatcacataactagtagtagtattgtcattaatcaattttaactctagatatgacccaagaggcatagataaatgcatcatgtgcccaccattttattatagcatcttttatgaaaaccaatattttgatgtaaccaactcaaatgcttgttctataagaatatcaatagtgcaacttctctaaacaaggatcaacagtgcaacatattgcatgtgattgttgtatggtctacatgcacatggatatacaactatatctctactattataaaaattaaagatatttttaccggtattttagtatgtcatccgtgtttgagtcggtttttaagttcatttgcttttggaattatagatttgtatttgagtagactttttaagtccgtttgctttcgaaaacataggagtcgtataagaaatcttaaaaaaaactcgcatgctaatcctacttgtagctcatgatcttgtaaaaacaatatccaagcaaattcctacaatgaatttcactttagctaaactgtataacaataataacattaagatagccttcaccaatttcaacacatgtgtattttttttctagtatactgcaaaatatgaatgaaacaaagataagatacggatagcggaccttacgagaaattcaaacgaattttaggctaagttcgtttgctggagttggaaactatctctcatgcacgcaaaatagagcgacccgttagcctatgaattattaagtattagttattttttaaaaaaatagattaatatgattttttaaaaaaaacaatttttctatagaatttttttaaaagaacaatatttagtaatttaaaaagtgtgcgcgcgaagttggtaaccttaagcaacgaactcagctttagtgaaatggcaataacctagttgttgtagtgacctgagtagcactctaaggtcttaagttcaaatctaatttcagattgggttatttgagagctaagttccttgtttaataggctaagttcctaatataaaatggctgcatatatccggttggatgtaaaggccgggtaaaaaaaacccttctctaaacaaaattagaactcatataatgatgatacacaaatactaaccaatagtggagaagatggtgggggtgagcagagcaaatttgtgttgggtggcaccctacgctaataaataaagctacaggaaaagcgggaagcaaaggatgccgttgcagcttttgggggcaacggcataatttcctctcctctcgtctctccatccatacttttccttcgttttaagcggcaaaagctcttcctttcttgcctactaatccatctgctaattggacctccttcactctaatcatatgcctcgtcaatgcacttacgctggtatcacggaagttcatcctaattaaactccataccactaaaatataaaaatagatcaactatatagtgtgttaaagattgccgccgccgtctttactactcaactatccaataaaaataaccttaatttctttgagaacatttagtaatgaaagaaaacaaataaagtaactttcgctaataagaaagtagtattgtcaatgtcaggtgaaaaaatgtaagattattgagatacaacacctcggtttgtagaaataagagggtaaaaaacattaagataaactttaacagctagaaattaagggctttttttgcatagatagatatttacgtgtttttttttgcggggagatatttacgtgttatagctgcatgttgttgtccagagttcaattgatttcttcatgtgaaagttagttacctcacatgacatctaaaactagtaacctaggtgattaactaaacatatccatcttaaacaaacagggctaaaataccacaagtgccaagccttgatgcaatccaaagctccagtcaataggaccccgtgacacatagccaccgcaatcgccggcgagtagtggccttatccggcgtggttaatactataattatcaccaaaatttggttaataattaccacctaaactaatcacacatgatgatgattattaatcagctagtagtagtaatatagtactagtagctagctaaccatcacatcataatcatgctgctcccctatgctttttgtgtaccaaacgtttcattccaaaataataatgacacgcgcatgcatgcaatgcaatactccagctaataacccaacctccatcctctgatttggttaacaaacccttgtggccatcaggggtaatgaggattaattaagcctaatcacacgttcagccgaccaaacagtggttagccaacctgcaattaagcatttttaatttggttggtcatgggggaactgttgttaattatggaggattaattagagggagagagattggctggctagctggttttggcagtggcaatcactctgatgtttgttgtgtgaccaactcttgctgctttgtttagtattatccagtagataggttattcctaatgactcaaagtggatgtatgtaatactaggtataatcttatcttttggttgttgagaacattaattatatatttttgatggtatgtggagagggtgagtgattgaatgaagcacactgctccactagtactgaccatgttattactatacacgatgcagttcaactacgaagctcttttggtacgaagaaattttaaagaaattccaacagaattaaaagtttactaggttgtttgttttatcacctataggggggttaaaaaatggcggtggaaatttctgacagtaccaagaccgttttcgtaaaactaaaagtgacgccgtttttccgattctagctatatataaaatttaattaattaattaattccatcagcattgtattgaagttgtcactaaattgttaagagtaaatttgacagaactaaagatttcaggtaatatatcataaaactacatgtttaaggctaattatcacaaaactatagattttgggtttaaatccttagcactaatattatgtttgaattataaacatccaaattttgtgattaaattgatactaaacttgttgttttttttggtaactttgttattaaatctgtagttttatgatactccaccttaaatctgtagtccggaatgaatttcatgttaaacctataattttgtgatacatgcatcatcttaaatatatagttttttgataatttaatcaaagtatctatagttttgtgaaatttaatcaaatagttaatttggccaatatgaaatttttttgaccgtaccaaaaccattcctctagctagaaatgataacgttttgaacgttttcatccttagttcacctatgtatattgctctttcatgtgtaatactgaaatgcataattttttcaaattactacatgagattaaaaaaaagaaagaaaattcagaccaaacaaacctaatttgttccaaggacctagtttctgcaaggaccaaacaataattcatggttaattagatctgcaaagttagaacagagatccgtaaaaggtcgacacgaactgtatgtattaattgtattgcatatgtaactatgcatacttgtagtggctcccctattgttaatattgctacaagcctaaaacacctcaaaattaaactctctttcattggcaatgtctagctgcatcaagaaacgacactgtttgagtattaagagttaggtggatttcgggtgatatatagtaaaccttgtggtcgaaggagctagctgttcttggcctggacgatattaaaagcttggaattccaaacagtgatgtatagatgcatcttgttgtcaataaaagcaggtgagagatgagatccccttgtccataacgaagcttttactggaaaaacattccactttcggaaattctctagtgtgtaatccgcttcccttttctggttcccgccttccttgctgtagtcgcgtcttatccttggccttgtaatgctgtaagcgtggcagcgaaggcgtattagcagaagcacgtgttattattccaaggaccagcagcaatcgaccagagtaaacgtaaaggcatccacggtttagtgaaaaagtagtccataagcaatacaatattccattcagccacatagcaacattgtggaactagtcatagcaaagaaataacaaaagttacccataaacatatgaactgtccatagagaattaaatatgttacttgtctctacttcctctctcctcctaatactatttgctatctatatacattgtggatgtttacaatagttaaaactcatatacgtgggtcccatctatatggactacttttgttatatacattgttgtttccctaagaatcaaacaagcattaggttattattcttgagatgacaccaagagagatactactacaagttagtgcacctaaaacgagaaagccactagcgcatgattaattaagttttaattattacaaactcaacaaatagatatatttgatattttaaagtaacttttatatagaaaattttcgcacgaaacataccgtttagtactagtttgaaagcatactaatggaaatcgagataaaatctaaatcttatgcagaaaagaagagggatggacctgtatgataatttggtcaataatccatctcaaatggggcggcctatatgaactggttttctggccgaatacgcttttgatgcaatctggtagagaactcttgattgatcaattccattatgaggaaaaaaaaagagcagctttgatttgactaaattccggtaataactcactctatgctccattcaaaactggaaccagggcggccacaagaggaatgaataccttctccattgcatgctgacaaatgacagtgcatgtttgctttttaaatttttttgcaggaactgacgaactgtgaaacactggagatcttcagggcaaaaggaaaagtctattctcagttgcccagcatatccatgccaaagaggcaaagaacacaccattctggcgcacgcaaatttgtttcaacactcgttgcactgtacatattacattctaaagtgatgaggtatatattgtcgacgtttgatgtctcgactacggtatttggatagtatggggatcgctggtgttaggatatacgtgagactgaggtaaaagagatggagacagggatttttatacaggttcgggcccctgagttgtcaggtaataaccctacatcctgttggccgaagccggtattgctcttattcaccataatcacaccagtactatatgtgggtagcctatctaactgttgtcgacatgtcggtctaaaggtctgactcgtagtcgacaacagggtagtcttcctcctcgaatccgtgcccggcgagatcagagatagtgctttcgtatctcctgacggtatccggagacaccgtaggggaatagccatgcctatccctgaagtcgatatccggtggcgtgttggcattatgtaggcttgtatgttgtggcttctggtgggtgtgtgttgattgtcatgggtgtcttccatcctccttctcctcctagggggtcttgtatttatacccataagtgtccccttgtccaagtagaactagggaaaccaatatggatacaatccgagtagacctggtcgtttccatgtagaactctggctgtctttccttatccggaactccctccatatccgaagtcagtttccgtatgagacatggtatgtggtgggtcctgccgagatgtagtcaactatcattaggtatgtggtatccataaccctgacatatatataatggataaaagtgaatttatgacaagtactcctatttgataaggatgaatgatgaatcgaaagaggtaaacacgttcaaatgttgatttaaaaagtttctaaaagtaacctttttttttttacaaaaatcgtgacgtttagaaattaaggaagcagcccacaataatccgtcatcggttaggtcaaaagaacgaccccttaattaaaagaactaaagaagagagtgatatgaatttcagaatttgatgcactgatgcttgtaagttgcaactgtagtgatgaccaccttgtacttacgtgggctactgcagatttgtgggccttctaatgggctttagtttgggctgcagacaaattaatgaactttctgccctttgtgaattgatgcaagtcgtgatcctttcagtttaaagtatttttatagaattattatatagcaattaaaaccttaagatttttttctactaaaaatgtccgtgcgttacaatgggcgaagacaaaaatccaatgataatatatgctttcttcctttccctgtataactatgtcgcgatgacaataagtgttaattcgcttatacgagagcctacgctctatttcacggtatcaacatagggtgtgtttgagggccaggataggagattgagaagattggaaagatatgcaaaacgaggtaagccattagcgcatgattgattgagtataaactattataaacttcaaaaatggattaatatgattttttaaaacaactttcctatagaaaaattttacaaaaaatacaccgttgagtagtttgggaagcgtgcgtgtgaaaaacgatgtactttctaactcaatgtatctggaacgaacgcagccatagtcttcatgacctaattttgttagagcgagagataagggaaagatgctacatttctagtataataactcgattatgcacataataaacaacgcattaatccttctgttattttctcgtgttacatacatcaattagtcgcatgccgttaaaacataacactattcaaatcatgttcaccttttggatcctctccggacaaaggtcacacagagaactttttcttataaatactgatcagaaaaaaaaaaacaataaccggtggcggtgacctttagttctcgaactaatgtttgaattaaaaagcaaatgtagcaatgatactgctagttttaattactatgaaatattttttacactctcctatgtcggtgattacatgcaacgaattttgccatgaaaaaataatattttttatagacccacaaacagataataaaaataaaaaaaatacaaccaactgtagaaacatttctttgaacctagaaacgataagaacttagttttgttttaatatggtttcagtccttttgcctatcataggattattcatttcgtattttttacggagacattttttgttgcaaatatggcaagttctccccgatatatctctataagtgaaaggttaatcttgaaaagccacctcattaatccacgtaggaaagaaaacatgggccatccgatgaagataaaaaagaaagagagtgcacgatctgatcggtaaaaaaaaaaaggttccggagaactcacgtccgccatctctggacgagatgagatgagtgagatataattttttctaattttttggttttttaaaattcttttatggtttactgtagtatgaaaagaaggggggagaggagggaggagtgtatgcagtagtataaagaagggggcagacgggtgatcgctgagcggacgggggagcgatcacccgtcc

SEQ ID NO: 77690 - DNA, 18530 bp, Oryza sativa
  unsure (1)..(18530): unsure at all n locations
cccaaatctactttacaatcttatcaaaccacgactttaggccgttccgtgatatacaaggaaacgtaatacccaagtcatgatctgttacatattccatatatataagttatcccctataactagtcggataaccatgccgtgtgggtatggggtacccataatctccacagtagcccctgagaccttcacagtcgaaaagataatcttctctcgaaccagattactccaaagccgagtacttcaatcatctttgacatggtctcccgagtacttttaccaaatctgaagactgtggagggctgaaaaataaagtcaggtgcatcgactagatgcacctaataggtgtagccctcgactatgcagttaagtgaacaaaccaagcatatagtcaataaataaataatccaaccaaccgagtggcttcgataattatagttaaccaagcgacttgatattaatatgtagcatatgcggtgtaaatccctgaataacatgatccgagtgatataccgactgctttgtaaaatatgatgagtgtaacctaaagttggctacatcattgaaaattcacatagcaaaacagctataaaaaagcttgtatgttgtgaataaagaaattttcaaagtattgggcgtacgccatgcgcacactgttttaacagatgtgcttaagtctctaaaagacacatggtttcgccgcacccggaaatatacggcatatgtggtgtaaaatccgagtaaataaactcataaaagatttaccaaccgcctgaaaaatgaccaagatatataatcagcctaagccataatattggtcaataaaaatgcacacttacgtggcaaaaagcaacgatattgtacccaatcaattgcttaaaaacccaaacaacaccttgacttatataaaaaagtcagcagggcagctatataaagctttattgtttgacacattttaagatgcattgtaccaactcctaaaaagttgagtaactgtggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaatagatcttccgggtgatatagaccaagtgtagctcatatgaatagcttctgatctgagtgattatcccttatgggatactccaaaatagatataaaaattgaatcccgactggcgccagtattcggttgataacccttacggggaataataaatagtccagtctttgagcatagaaaatagacccatgatcatgaattcatgttgcatgtatccggaacaagtccaaattgaaggtatgatacttgtgtttgaactagtaagcccctgagcatatagctcgtccttctgtcgtagtcacaattgtccattgatggtagctgacgcagttagcatagagacaagacaaccgatatagagataatattgcccaccagaggtggcaaaaatattggtggtagtgaagatagtgataccaatcaaaagtgatgaaattgcacagccgtggaggcgaagaaaccagtcggcaacagtcaggtcagccagcaatgaatatgaaggcgcccagcgataaagttgtctagccatggcagcgaaataatcagtcggtgacagacgagacagctggtgaagaagatgaaaacaagccaatgatgaagacgtagacgcgaatcaacgacgatggcgaaatcctccaatcatgaaaatgcaggaaatagtcgacgacgacaaacgcaactgtcatgatgaagatgacgatgtcggtgattcagtcaatagcggtgtagcagccgatgataatgacaaagacgctcatcaacgtttgcgtagtaggtcaaccgtgaaggtgaaataataagtcggcgaagacatagtcatccattagcaacagcggagatgtcagggccgatgaaacagaggtgctggtgatgatgtcagtgacaataatccatcaaattaatattatagctgttgtagatgcttcacttggaggagagttgatgctgttgtccaactcgtccaaaccgaaatatttgaagttgttgaagtagaatgtctgcttcgaagcaaagatgaagataatgactcctggagttgactcattagttgattaattggtttcttcagcttgacataaaatttgtcaaattttgagccttgtatttgtgtagcccccgactctttgattagttgggaaacaactaaacatagagtcaagaactgtagtttcttgtcgttgaatagtcattgcttgattgaagatatgtgttgaagatgtccaagtagaaatcctgaatattggagagccacttgttgtagtaaaataacacggcatcgcatgccgagatgtcgaggttcacaaagacgtcgtggttggtgaagtagcagcaatagagtttgccggtgccgaagataataaagatgaagtcgctctaccatgatgataaagttgcatcgctgtgatgaagtgaaacgagtcggcggcaacagaagcaaactggtagtgaagacgcgcagttgtgaagatgaaagcaccggtcggcggcggcataaccagtcggcgacggaagacgatgatgtccatcagtagtgatagcggtataaaccagacgtagaggcgagggcgctagtcaacagcagacgagatgaccggcggtgaagaagataaggccaatcaacactggcagaatcatgcagccatggaagtgaagaaaccagtcggcagcagacgtaggcaactggtgttgacgatgctgatgcctattagcggtgacggcgatgtagccagccgtgaagaagatagcatcagttggcgtcataacaggccagccgtgcaggcggtgacaccagacggcggcggatgaggcggccggtcggtgaagcggccggtcggtgaagacgtagacgcccaacaacggtggcataataggccagccatgcaggcggaaacaccagtcggcagcggacgaggcggccggtcggtgaagacgtagacgcccaacaacagcggcataataggccagccgtgcaggcggaaacaccagtcggcggcggacgaggcggccggtcggcgaagacgtagacgcccaacaacggcggcgtaataggccagccgtgcaggcggtgacaccagtcggcggcggatgaggcggctggtcggtgaagacgtagacgcccaacaatagcggcataataggccagccgtgcaggcggaaacaccagtcggcggcggaggaggcggccggtcggcgaagacgtagacgcccaacaacggcggcataatagggcagccgtgcaggcggtgacaccagtcggcggcggacaaggcggccggtcggtgaagacatagacgcccaacaacggcggcataataggccagccgtgcaagcggaaacaccagtcggcggcggacgaggtggccggtcggtgaagacgtagacgcccaacaacggtggcataataggccagccgtgcaggcggagacactagtcggcggcggtgaaggcaagccggttggtgaagacgtagacgcccaacaatagccgcataataggccggcagtgcaggcggagacaccagtcggcggcgacgaaggcaagccggtcggtgaagacgtagaggcccaacaacggtggtgtgaccaaccaaccgtataggcgaagacaccagtcgacggtggacgaagcggccggtcggtaaagacgtagacgcccaacaacggtggtgtgaccaatcaaccgtataggcgaagactccagtcggcggtgacgacggcgagccggtggtgatgttctgactgatccattcctggagcgtaagagataagcttaaagccatgaatcccttttatgcatatttggatttggatcctgcagaacaaacatataggatgagtagtatctgatgtaaatataatactcgagaaaaatgcaagtattttaaaatatttataaatatgtatttctcctcttgtcaattttgatttccccgagcagatgactccttacgtttaaacactctgcccgactagtcatagtccccaagcatcgggagtcggcctaggcacttcccaaacatgcatatgagtgacatgagttcgtcattaatagaacaaagtttcacggatcagaatttactactcgtgtacttttgcaattattaagagcagaaaataaatttatctcatctctatgcttttgatttattccgaataatacttagcaccttgcgttactcagtccatccaacgagcccccgggtgctaggaatcggcccaaaggcaaactatccattggcaaaccaaacggaaagcataggaagatagaactccataactcgataggtacttttgtactcagattatgtcgcaagcaatcaagataaatattatgaaaaatatgatataacatctgtagcccccgactcgctactcaatagagaaccaattgatgtagtgaggcagaggaaaataccatataaagaaaaaaacaatgatgacttagctttgtaatattccccttggtgatggcagaggtgaccaatgtgggaacaaagtcatcaatcaataacaatgaagacaccagtcggcggcgacgaaggcagtcaatggtgaaagcgaagatgcccaccaacggcggcataataggccagccgtctaggcggagacatcagtcggcggcggcgaaggcaagccggtcggtgaagacgtgaacacccatgaacggcggcataataggccagctgtgcaggcgacaataccagttggcggctgcggaggcaggccggcggtagacgcccaccaacagcggcataataggccagccgtgtacgcggagacaccagtcggcggcggcgaaggcaagccggtcggtgaagacgtgaatgcccatgaacgacggcataataggccagccgtgcaggcgaaaacaccagtcggcagctgcggaggcaggccggcggcgaagtcgtaggcgtccaacagcggcggcataatgggctagccgtgcaggcggagacaccagtcagcggcagacgaggcggccggcggtgaagtcgttgttgttatcagcaatggcggtggcgaagacaagccgacagagtggactcgcggccgatcgaccggaaagctgagacgcctcgagtccatgaccagcatcaatcgcctcaatagtgccgcgtaattatatgcgaacaacaatacaaaaatagcaagagattaatctgagattaaaaatcaatatgataaataatgataaaactaggcgtccggcgctagacgagtagttagcatgagtagatataaaaaattgctcaatggaaaatatcacataaagaggaaaaataaaggcacttagcttttttctcagtgtcctccgtatatatgtgttaatgggtggacaggagatcatatcggcagcttgtgacagacatgcaatacatgcatgagtgctgcacttccctgcgcgaaaattgctcctattggttggctcagattccacgtcgactccaatttagattagtaattgaatatcaccaggagatttaacatcatctaaaaaaacgctggcggttgagagttgatccgttgcttggtgatcctggtagattgatatcgccgaacagattaaaccagatgatggactcggcatgtcaaacgatcaagttgacgactgacgtcccgtcggaatttccggcggcggcgatgcaagccaaactccagaagagaagaaccggtccgaagatgaaggtggtgctgacggcagccataggagattgaatctaaaacttgccgtggtagattgttgtaatccctcgattgagtttcccctgactgatttggatcaagtcagagaagaggagcttgaagaagtggtcgacggaaaggaagtgaaaactcccgaagcaaaaacgaagtcggcgactcatgaagttgattccatcgcgctcgttgataggaaactcgacgcaacccctacttggcgcgccaactgtcgaaacatgaattcggcaataataaaagggggtagcgcacgaaacctaaaagtggatggatgcggagacaaggatttagacaggttcaggccctctcaatgagaggtaataccctactcctatttggggatttgaatccgccgggtgtagtattgatctgacgatcaggttgtgtcatgccccctagagggcctcctgcccaccttatataggagggggggcaggattacaagatagaatccttatccaatacggtatcggtttcctaaatctactttacaatcttatcaaaccaggactttaggccgttccgtgatatacaaggaaacgtaatacccaagtcatgatctgttacatattccatatatataagttatcccctataactagtcggataaccatgccgtgtgggtatggggtacccataatctccacaatggccatcaccaaacacaatgacaactatagtccaatacagcattcacaatgagatcgatttgattatgttgttagtttggtcagatgggcaaagcagagcaacagatggcttcatctctgcttcagcttttcctaaaactaacgtactgtagggccatcggtcactcacaactaacaacatgcacaattaacaatactgtgaacgcttcgctggctcgtacaccaatcattgcaaaataatcgtggagttcaaccctataaaaagttttcatacgtgctcagttggatcataggaatatctatcaaaaatcctttggattggtccgaaacataggatttgataggaactctaatatatgttaacttttggaaaaaaaatatttgtgtctatctattttttttgttcttgtgtttttcctgtgctctatccaaacagctattcttgtgttttttcagtccataagatttgagatgttagagcactttaattctatttcctccgtttcacaatgtaagactttctaacaatacccacatttatatagatattaatgaatccagacacatttatatgtgtctggattcattaacatctatataaatgtggataatgctagaaagtcttacattgtgaaacggagatagtatatctttttcctacattttaagaaccatgcattccaaagtagcccataattcacaacaccattggcatgcagtcactattacacaaatcccaataagtgccggttgggaatcggcaataggtggtttcccagccggtaccattttatcggcatctatgctctagggaataggtgatggtttcagaaccaacacctgtagagattataggtgccagttcttaacccacaactagtacctatagcattcaataaaataataaaaaaaaacagctgatggagcatatccaccgaccgccacctcgcccacaccggccttctctaccactgcctccatcaccggatctggaggagaagaggggagggtggacggagaggagggagggccatcgggaaagagaggggccggcgagcctcctccaccgctacagccggctctagaggaaaaggaggaagcgtatccagaggaggagaggaagggaggatgccggtggagaggtgtatgtgagagagagacgaggccgggtgtgggccaggggataagggtggggattggggccggcactcgcttgtttcggcttggctcgggtaacggttttttaaaaaccaacacctttagtttattataggtagtatcagtttttatctagaactaacacctataatataaatataggtcatttcttaaatgaaactcacaccggcatcagtttttaacttttttttctatacttttctttatagagatgagaaacggtaataggtgtcgatttcaaataaaccaacaactatggagtggtaccttttatggtagtgcgtcgaactgagggaactggccgaaactggttagctagagctagctcccaaatactaagttccaatcatagagagcaattccaatcatatagttagttatatgccacctgtgcaattaattaattaatcatggagcccgtggatcgacgacgacgtaacggccggagatggggcagcagaggtagttaaagctacggcgaccgccactgtcgcgctttcgtatatggcgtccacatgattaattaacctgttaattctgcggccagtttttaatatattgcgcttatggggtgcctaactttttcccacacacgcatgattagttcttcttagacaaatcatttagggcgacaattgtagtctttcttagcggatatatagtatgtaaaattaatgatatggaacagagagagggagtaaagaaaaacatggattatagaagggagcgaagaaaaacatgatttgtcaagtatcggcttaaaatcgacttttagcatttattaaataaaatattgttgtttgtgaatgaaaaaagaaaaggaagatacaaaacatttattttggtgcgttagagaccttgttgttttaactattataaggttactgtaaggtactctctctatcccataatataaggcgtgatcaaattaagttggcacgtagtagcaaatctaggatgaaagtagagatggtgctaatgcacatgactaaaaatataacttggtactataaattatatttcctgaaaaatatgaacttaaaaatccatgtttcattttggaaaaacatatatgtccagttcaattagaccctccaatgtgccctaacagatgcaaagcaagagctcctggtagatggcgttctcactggtttggtaattgaattgggcttggcatagcatttagcaattaataaacattggatgacaaatggagcactaatcacaccgtagagctataggcaagttttcttcttctctagtcgctgcaggccccaatatatatactttgattgttccagtgtcttctactagctttgagcttattggaagaacacttggggctgaaagctgaagctgcggcacctcaacaagccccaacagtgaattcgtccagttggcacagtctacacaactaatctttatattctaatttctcatatattataagctttattacaacaaaattaaaaattagaaccatatgaaagtaaatttaaatgtcaatccaatgatataatttttaacaaataaatcttatttcatattttactaacgctttgtttagttcgtgtgccaaaatttttttaagtatacgaacacacatttgaagaataaagcgtagactaataacaaaacaaattacagattcagcctgtaaactgcgagacgaatctattaagtctaattaatccgtcattagaaaatgtttacggtagtaccacattgtcagatcattgcgtaattaggctcaaaagattcgtctcgtgatttacatgcaaactgtacaattggtttgttttcgtccacatttaatgctccatgcatgtgaccaaatatttgatgtgacggaaaagttgaaagtttaaagaaaaaagtttgaatctaaacacggcctaagtgttggtcaaatgttttgaatgttgaatcttaaaatgcgtgcatgctttatattataggatggaaggagtaggatagtttcagcnacgtgattattattaagcccgtgtcaatttatccttataatcttaagattgtggaataaaaaggtcagaatcccctacatttatgaatataaagagtagtttataactagatcgctaattaactagttcaatagtctatcnnaatgagnagggaagagtaaagatccgnatgtagtagatcttcatcattttcncaagttcgtgtgcttcattgtccatcttcgaaactagggagctgttcagattaaagttaaaataaaccttatcaattttttgcattatcaaaattttagcaggatttattatgtatttattaaattttagtaagaaactaaatgaatgcacatatttagtaactctattaaaaaataatatggtttaaatgacatcaatctgaataataattaaccgccaatatatagcaaaatatccctgcaaacattctaactgtttggatatatatagtatatatgtagtatggatacatagagtataatatttctcttttttaataaatagcgttattgacttttgtacatatggttaaccatttttcttattctaaaattttatacaaatgtactataagatataaatcatatttaaaatactttaagtgataaaacaacatacaataaaataagttgtgattacgtaaaccttttaataagatgaatgattaaaacagaggtagtattatacagttttattcggtaagaggagacgaaattttagggtccgttcactttgttgctaaaaaaactttaccaaattttggtaatgctaaaattttggcatagttaccaaaatttgttgctaaaattttggcaggattttctatatagttaccaaaatttgatagcaaactaaatatagccaccttttgataactttaccaaaatttggtaagattgaaaatagcatcaaaatgaacaggcccttggacattatcacagcagtgttatgagtcgtgtttgtgctggtctgctgcagacggcgcacggtttgattattaattggtggtcggcgtcgtacgtggatggcctcacgtccacaagttagctagctagcctagccatgcttctcctttgattatgtgcggcatattcaggacagtttaaaggtcggtgggcacatattcagcctcctttaaattgcaccacgattgaaaagttaaggactagaagaacacatatgaccttaatagaaatatatctatataaaacaaatgattaaaaaatataaaaatgattgtttaaatatagaccacggaaaaaagttagaaaccagggtcagaaagactccagaaaatttttaaagaagctgaagctcttgctaatttttctgcaaaagtttcatactatcattcattccattgaataaaataataatatttaatcctttgttttcaaaggtctttgtaggaatttaggaatttgtgtaagatcgaactatatttttcctataaattagaagggttctcagcggtatagtgaaatacgctacaacaccgaatttgctatatcaagttgacagaaatttagatacaaccatattgctctaaaggcaagctcaatgtatacggtgaagtgtgatattagaagtgtgcccataaatagttactattgttagagcaattctcataacatacaatgttatggttaagatctaactataagatgtggccccactaagatggaaaaacttgcttcaactctagttcatgagatgaatgagagaggaaacaaatattttcttttcgtttgtacgtagtagaccttaagcataagcaccctagttaaagtatttctcataatatatatggctcactttataaatatattgtcttaaggttaactttttgatacattaatttttgtttgccttgagattcgtgcattaacagaaacaactccatctagctgcagtgaatttcaacgaactacacgagtccccataaattccattagcaaattaactcttctttgagcgatgagttaattttgtagagctccttaaaactcattatattcacattatagagagttaaggacctataaaatctccgatacatcacttgaaacaacagtcataagaaacaaaaccttttggtgtggttaattagtactccctccgtttcacaatataagtcattctaacattttccacattcatattgatgtcagtttcacaatgtaagtcattttaacatttcccacattcatattgatgtcaatgaatctagatatctaacttacattgtgaaacggtggaagtagacagtatcagtttttaacaaatcaaacgggccagacaagtgagatgtacttgcgctagatctgagcaagttgatcacaaaaatgaacagctaaaattacatgcagttcttaccttattggtggagcttcacataaagaagtacgtagtactagtatgtggtggcaactgtcgtgagccaccggtggaagaaggaagagaaggaccattctcagtgcaaagctcctcatttgagtggtctcaaatgccacataggctgaaaccataccatcaaaattttttcactcccacaatgcaaattgcttcaagagataccttaaatatgcatgttagtttctagtatgttgaatttcagtcgtgatatgttatcaatatacatccaagtctaacttttacactaaacatcctcagatccgctaagtaaaataaatctctccaaaattccttcaatcctcactccccctcccctcatcggactccgatcgaaccgagttggctgctggcgagcactatggatggcgccatgtccaactccgagaccgataaggtctgatcttcatgtggcgacataagaaaggataagacataatctattataacgaatttaagaaagtgttatttagatttattgaattcttcttgggtcgttagtattttttttttggaactgagtatggctcggctcggctcgtggaagctcgtgaaatgccaggctcggcttggctcggctcggttctccaaccgagctgtacattaggctcggctcggctcgtggtctggctcgtgagctttgcaatagcagcagttgtattgccagtagcagttgtgttgctttgcaatgacttggttattcagataataactctcaagtccctacaaagataattaggtatattgtatgcagccaacatataacaaattgatgggcttttttggttttcggccagaagtctttctattcaaaccgagcctactaagctcgtgagctgctcgcgagctggctcgggctcggctcggttcacaaacgagctaaaacccaggctcgggctcggctcgttcaggattcgagccgagccgagccaggcgagcccgagccgagcttgagccgagttcacgagctcgagctatttgtccagccctagtatcatacatacagatactggtagagtagtattcaatcatagagcggcccgacctgacctctgacgaccagtttgggtccctgctgggagggagggttgagctaggttagacagcagagcgatatcgacgacgacgacagagaattccgagaaagaaggaagatcctggtcactgtcgggcgatcgcgcgacgatcccaggctgcgcggacgtggcgcccgggaacagcctccctccccccctcgtacgtggacgccctcccctccacaactccaacgacggccaccacaacccatactccagcaggtgacaccacccggccgccccttgcacatgcccaatactactagctagctcgtgcatgcatgcaattgcaagagatcgatctcacacttctcaaatttcttttgacgatattgctcacagcaggtacgttacgtgcacacaaggaccagcacacaaaatcgatttttgctgcaccaccaccatgtgcacgtttgtttaacgcacgcagttatatataattaattaatctgatggccggcacgtaaccaggcaacacgtacatacgtagtactccctctgtattttaatgtatgacgccgttgacttttcgactaacgtttgaccattcgttttattcaaaatttttgtgcaaatatgaaaatatttatgccatgcttaaagaacatttgatgacgaatcaagtctactactacttaaaaagtaaaacctgcttccgtcgtccgttgagaaaaaaagagcgacaaaaaaaaacttcactcggaaaaaaaaaggtccgactcatccagtggtaaaaaaaagtgagaggaaaaacaaaaaaaaagaaaaaaaaaacttcgatcgcgaaaaaaaaaggcgtcaaaaagtccgactccccggtggagaaaaaatgccgagaaaaaacaaaaaaaaaagcaaaaaacttctaccgtattttaaaaaaatatatatataaattaaagatgtttttgcatccgtgtatgggtcggtttttaaatccgttcgcttttggaaatacaagtccgtatttgagtcatttttttaagttcgttcacttttaaaaatacagaaggaatcgtataagaaatctctttaaaaaactcgcatgctaatttcagacgatcggactcctacttatatctcatgattttctaaccaaatatatatccaagtgaatttaacgcagtgaatttcatcttaactaaaccatatctataactaatataaatatttggatttttccggttgtcacaagtcggacgaagggcgccttcgtccctcgcggtgcgccttcgcccgcagcccccgaatcccaatccctctcagaatcggatacaagggaaacaattctcaaaatcagcacaaccaaatgcggggattttttgtccgccccccaagaaaagtcccagtcgaaattcatcaagaacacgcatgaaacattccatcaataacacacataacaaaactttcaaccaagaacatatgaatctccaccgacaccattcacagagagagagagaaagagacgacgccgccacctctcccgcccccgtcggaccgcagccgcctccatgccgccggatctggcggaggcgaggtccggcccgccgcccctcccacccccgccgggctgcagccgcctccacaccgccggatctggcggaggcaaggcccgaccggcgttccatgacgtccgccaccaccaccaccgccgcacctccccaccatgcacagagagagagagagaaagaaacgacgccgccgcctctcctgccttcgccggaccacagccgcttccatgccgccagatctggcggaggcgaggtccggcccgccgcccctcccacccccgccgggccgcagccgcctccacgccgccgttgttcggggagagggcgccgccccgtcggttgtgggggagggcgccgccgccgccactcgcgggaagaggggcgccgtcgccgccgctcgggggcgcggaggggagggcggcgatgtgagatgggagggagggaaatgggctagggttttggcggctaaggagagggaggggttttgtttccccgatatcgacgctcggccgtccgatcaaaaccctaaagatcggacgatcggtgtcgtccaggctaaaatcagcccaagagggatcgagagtgaggccatttttccggcccaagcccaggttgtggcctggggaggggagtgcacttgcgcgtgcacaaaaggccgtggaccgaccggcaagggccggaaataagtctattttaggtccctcgggccgaaaaaaatagaataagttcatttttagtgcttattttttcagaagcattacaattataagttattgaatgtgtttatttcaaagcaaacctaaaaggaagtattttctttctttttccaagtaaataattgttaaatgacgtttgtattaataaaattaacaattaagctctgaaaaattcaaatataatttcaaagagcgtaactaatcatggagaatttaaaaaaaaattaaatttaaccatgtcattttatttctcacacttgctttacttgtaaatttatttaattatacacatacctacttaaaaataccaaatatttcagcgaatttgtattttaattaattgcatatttttctaatctgtacgcttcacattgtaacacacaggcacttttgctagaccaaacaacacttttggtcaatatacacactccgtaatcacccggtacaacgcacgggcacttttgctagtcataataaaataaatgataattacataaatttttttttaaataaaacgaatagtcaaatgttggacaaaaagtcaacggcgtcatacatcaaaatgtggaggtagaatgtatacactctctacgtacacgaaacttccaacacgtagtcgccttaactctagttaccctccatccgtacgcaatatccgaagggacgtgatgcaccggcgcgcccggcccggccgccggcgtaacagacttccgacccgagaccgacacgatcgatccaccgaccaacgtggcgacccctcattggtagccacgcccacgacccgcaactatagtacgtacaacctctctacacggcacgtcgacgtgtcgtgtcgcgggccgacccgcaccgcaggggaggggccgccccgcccgactcgatcgatcggtccgtcggggatcccgtcccgcgcctgcatcgccacgtggcatcccgccgccacgggctgctcgccacgtgtgaaccggccccgagcccgtcgcagcgcgacgcgtgtactctgctcctccccacccaccgtgagagctagtgctcgggtataaatagcccaactcgtggatgtcacctctcctcctctcatcgcctcgctcgtctcgtttcgttttttcccaagtacaaaagcagcgcgcgcgcgcggaggcgtacctatatacgtatttgcctcgagcatctacgcgcgtatatacggtggaatatacgcgactcgacagaaggggatacgtatacatatacgacgtcgtctatggcgccggagatggtagcggatgagaaggcgaaggtggaagcgacggggaggatggcgtcgatagagatggagcccaagactctcaccctcgaccagctcaagttcgcaagggtatgtatatatatacatgtatatatacgacgtatatctaccgctagctacatgataccattggatttcgaatgttcttctctctctctttcttttccttttcttttcttttcattccgaattcacacaccgagcgcgcctcatcccataacctggccggcccttgcaatttcaaagcgaatttgcacttccgatcgatgaattaggccttacaaacaccgaattgataaatcatcccttaattaatttgcactgttggagtaacacaattttgctccgcttggaccttcaccaaacttcagattaattcgttgcacacagggtttttgtttttcaatctttcatgtttgtttcatgcatataggagtataacagatacattagccatttaatttcaaacttaccttctgagaagcatatagacatatatatatatatatatacttcgtcaaatgtgaagtgcaacaaaataaattaatttgagatactacacatccatcatttatttgcactattgattggttacgaagaaagcaactaaatcatttttgacacgaatcaatagtgtcaaaaccagctatatattcagagtatatattaagataaattcgttacacttgtggctaaatatcgttggtgggtctctcaccgtcaccggcactgttcctgaacctgttcaattaggccacgcctactaacctgtacttccacttatctactcttttctgttgtggccggtgatgaccttccaaactcaaattaattaaccttaatttctaccgtccacaaaatgcatgcatatataccctggaatcgactaacaccttttttaaaaaatatagctatatatatatatatatatatatatatatatatatatatatatatatatatatcatgcattatttttttaaaaaaagttctggttataaataaactactacttttgcacacaacaattatcggtacatggcattattcaatattcatgtgcatatactcggttatatttagctggagtacgtgctaatgttacatgacgtcgacacggtgcacgcaaggaaaaaaaaagggagggggcaatggcagcggtggtaataatgaggcaacaacgtagccgcttacgtaacggtgcagcgacgccactgttgtgctgtcccatgatgtaacgcgggtcaccgtcacgcaacggaatacactgaagacgtgtactgcctcatgttacccgtctcgcacaacggatgttgtgatagcgacctgcatcttaagccatcttaattacacacttggtagtaatctttcatcttatacagtatattttataaaaaaaataaaaaaaaatcagtcagtgtataagaaatatttatattgtatcatctaataataataaaaatattattcatacaaaacttttaaataaaataaagagtcaaatgttatataaaaaactaaaaattggagtctttcgtgagacgaagggagcatgttcttctacgactatagctagacagctagtagcacctccttgcgtacgtgtacattgcatgtatatgtcaatatgtgtacgtgtacgccaacatatatacatacatctcagtatttattatcccttcccacgtatgtttacctggcttgtacggagcacgtacaacatcagcatgcttacatcacatattcaatttatgtaaagagtagttttgttataccagtaattcataaggg

SEQ ID NO: 77691 - DNA, 722 bp, Oryza sativa
aaagtgaaagtaagcaagcacacatatataccaccagcagctaattaactgatcaataattaattagattcatgcaactgaagcgttttcaatatgcatctgggcaactaattaactagctaaatattaatcctgtgtgttttcttttgcaattacagattgcaccgtggagaactgcatcttctgcaccgggatgtggcaccctctgtcgggtggcttctgtggatacaagaggaagaagaagaaccggagataggctcttctgcaattatcagccactgaagctgcatgtctcgtcgtctcatctttcttctaactttgttttctagaaataaattgggtaccaattaagtttagttgttatcgatgagttgtcgctttgatagatcgcgacgtagctggctgccgtgcttgcttgcattgcttagtatacatatgtgcccaaattaatttatatgtaatttctgttgcttgcttgaagaattaattacttcatcagtgcgtttaattaatttcatgcgtgtgctacattaatttctgttgagcttttctccatttcattatgcttgcgaatgtgaatatgtgatcggttaagtagttttggcagctgtcatagacttatagtactctcaattccattatatttggagtaatacatatggtatatattaattaacgtacccttgaaccttgatttctacttcccattgagcaagctacat

SEQ ID NO: 77692 - DNA, 951 bp, Oryza sativa
tattgctgttacctttttcaggatattacggctccgagatgtgccctctactgtcctgaaagctatgccatgttcgtgcaatgtatttgttgtgtccaggcacagattgactattaagtttgcaaatcaggctcgaacaagcagtatgttttgcccatattctctactatttcttttgggaaatgcaatggtgaggcactcattttgccttaaacctttctattttttgcagagtcaagcgcttgtgtaaggactcagtcaatcagtcataaatcattttcccgaatacagaagaactggctgctagacaaacaatctttgcatgaccaccctgaggatggaacaccaaaatcttctggagatacgagttatgcaggctctcatacctgcagctctcgtagcacttctactaatgctggtaaaagttcaggaagtcatggaagaagcctttttggaagcttagggcgaaaaacaccgggcagagatgtgaacacggatcccgatgctattggccgattgaaggaaatcccttatgttgccttgagctcaattgatgaggtcagacctgtttccagccttgaaaatattctgactagtgttggctttcataagctttccataagttgtattaattgtgattcaattcttagcaggatctgcagtctcaaccagtagatgaagtagcaaaactgagaaaggaattgcaggatacgttagtgatgtatgataaagcttgtgaagatctcgtccatgccaagaaaaaggttagtgatgtgtgataaagcttgtgatgatctaaccaagataaggttaagttcttttggctgctgtttggcttgagttactgtgaccagttttttacattactaggtacatgaagatatctatattcatatattaaaagtgaatgttttaattagcttttttccatgttactctgatgtttcagat

SEQ ID NO: 77693 - DNA, 590 bp, Oryza sativa
attatattatagttatttctagaagttttttcactttagatactcccataggcaaaatagtacataagacaacataaaacaatacatctaacatttgtaatgatttctttaaaattttagagcaaatgtgcatgttgaatgttcaatacctagttaaaatgaattagttataaatcttagaaattttaaccattgtaatcatttgtagaagttataaactgatatatgacgcattataacaagattactatgtcagtagtggggaacctggcgtcaacaggcgggcctcacggtcagcgaggaagggaggccagctctcgtggaccaaatccgccgaggtggtccacgagaggtcaatgaccgggatttgccagcacatatcgaagcccgggatcactggtgcacggtcatgtgtccttgccatgcgacagtgcacatggcgggcatggtagtcaggtgcattgaggtggtgtcaccacggcactgacataggcagccacagatgatccacgaggatgacagattggacggacggggcgaggaggggtcggcttgccagacaaccggatgtgtgacttgatggttgccgg

SEQ ID NO: 77694 - DNA, 7074 bp, Oryza sativa
  unsure (1)..(7074): unsure at all n locations
actcataaattgaattattatactgcaagttaattattttgctatagttcaacttacaaatataaacatttcatatgaaaaatgagaaaatactcatcgatgacgggctttagttaatgcccgatagagattaagtcatgtagaagttgaatttaaacttgcatatttgtgaagtgttatatcgcatattaatacaccttctcaattatttttaatttttttataaccattttagtgacatgcaaacaacaaaaagatatctcctcgagagattaaaataatttccccgtcacggctacgaggcacttggaggcaccgcgctggacgccggagacgagccgttggggaagcccaatcatggtcaagctgaggaaaacgaggcagctcccgctgacgcctgacggacgtggcgaatgccaacaggagtgagacaatgaagcgcgtgttgtcgcgtgcttcgcctcggtggggaggcagagcgaggcggtcagcacggtgaagccgaagacgacggcgatgccgctggccttgatgttcgccttcgccttggcattgcggagctcttcttcctccttcctcctctctgtcggagcaccgccggcctgctcgtcctacattggaaagtctgtggatgaccaacgggtaatttgtaaatacagtggggaaacaattttttttaagaaaaaggaaaaaaggcaaaagaaatgaaagaaaggctgaagtgataagttcaccggccgtccctcaactttatgccgagtctgtttgaggtcccctaaccacaatatccgaaatgtgtacccctaaactatataaaaccatccaaaaaaggtcccgaggcagtatagatgcctgattttgctgacgtggcatcctagtcagcaaaaacaattaaaataaatatgtggggctcatatgtaagtgagagaaaatagtgtgggccctctcttctctccgcttctctcgagcgggcattgtggcagatgggggagaggtggccagcagtggagcaggggcagcggagagacggacggcgcaacagtgagctcagcggcgaaggagaggagcagcgcgtggcgtggcggcaggagagacgagaggactggcacgcagaggccgagctgctgcgccatagcgacggcctcagcctcggctttgccgtgatggacgatagcgccacgatgctcggtgcgctcctccatgccgcttaccgacacagcgcccgccctccccctcccccaacccggtcatctgcaacagcagcttcaacaacagcagtgggagcgagcatttcgcccccctacctgcaggaggaggcttcctcatcggagagcagcagcatgtgttgccggcgtcctacgccgcggcaggtgtccgattcatggccacgggagaagaaacgccgcagagctttggctttggcagcctcttcaatggcgatctcctgcaggaggcgaacgggagcatgtatcattatcagcagcagcagcggcagctgggcattgtgccctcgtcgcagccactgtcagggactcgagtgggctgcacatgggccgctggctgcaccacgggctggtcagcccatcgccaagaagcccaagcaaggccaagctgaaaattatatgagcagcagcagcttacaggagatggatcgaacagattcatttggccaaggcggcgaacgacggcggcggcgacctagaggctggctggcctctttgtcgatctctcctctatctcccttcttctctactagtatagaagctactagaaccttctagcccttgtatccttccatcttccacctcagaaccactccactattgtaacagacttggttgttccctgtgttggatttggcactgctatttctgaaattacattgttgagtgggtctctaacaatttggtatcagagccaatccccaccaagctcatcaagcaagctgccatgggaagtgaggacaagtttaacatgcttttaaggatgctcgaagagtgcgagcgaaggcgggaggaggcagaccaaagaaggagagcagatttcctgtctctcaaggcaacaatagactcgtggatgccccaagaatagaagaaagctgaagaccttcagtttttggttgaggatgagcagtccaaggtgacgcccaccacctgttcaatggagtgccccaatggcagcagcccgagcacaacagcgagatccatctacgacgacgagggggctactccgacgatcatcctggagcttggggatggtgaggggaaggatcgcatgcccttcatcattagcaaggacctttccgagttgacgcctatcatgtgtttgacaatatgctcaagcctcgacgtcgagcctgatttcaccgtggctgcggtggttacatgctccaacactgccatggactccaaggagttggtagccaccgatggtgcaaccggcaccaccaacattgacccccgtgtttgttccaaggagacgcacaccaagtgtttgttgtttggccccgatgtcaacggtgtcactgatagaggtgtgattgtgttccaaagtaggatgggtgtgttcaaggtcgttccgatatcaagtcagtccatggagttgatggttgacgagaaagcaacctgcactgacaccactcaccttcccaaggtgatgcacccaagccatttgatgttgggccccaacgtcaacaccggtactatccaggctggggttgcgtactcactattgcttggcgcgccagaaggaatagcatcctcgggaaaggccacactagtcatggcacaaaagcttaactccaatttctgcctaaaatgggtggcgctcaacaggtgttcgaccaaatgctccaagggctacaagaagctgttgatgagtcatcccaagagaaacccatggccacctccttgctcaggtagagtggttagaagatggaaggagtggtattgccttgggctgcgggcaattatttggggataatattttatttcatgccaccatggccaccaccaactcaaattggaaccataatactttggctgctggtaaacacatggttgacggaagtagagctgaaaccgtggcctgacccacaaccaagtcaatatagcggaggcgtgatgtgaactgagcaagtcccatagcctgcaccagtttttgcacatttgatgggatatgatttttgcagtgcaaattgcataagagaccaaacaccttctgttgcactatattgtgcacctaaaggagatttaaatcatgaaaaatctgatcgagctcataaggatacattggtggcaatatttaacttggaacagttccattatgtgggtggtgaggaaaaagttatagagggaatgttatatggcctaattacagtaaactgcaactacttgatcattcctgctgctacaatgacaacaacatctactcaaaatatatatatggagcttgttggttggaggctagagaagggttaaatgatatagctaagggaagaacttacaaaatttgtaagtccatgcgcatgacacttaatcatgttgagagctggctacagaacccaacaaacatattatacaatggtcagttgtttaactgtccagtgggggtacattttggggtcagaaggatttctgagattattgctagaggtgctggtgagaatcagaataggaaggttaagacatgtagttatgattccatttttgatttctgtgagaataatcctagtgatggtagtgctgcagcaaggttttccattgatgggattgataccaggacagattcagagatgatatatgcatcaattgcaaacagggattattggtctgttaaattattcgaggtcataaaagaggggtgcccaatacgccacttgttactaggtgatgtcaagatagaacaattgctgcaatgtgagacattcagtacaagacagacaaatatagagcaagttatcaagctacagctgagcaattccaaggaaatacaagagctacaggtaccatgggatccaggaggttttcttcatcggcttggggacaagccaaatttcaagaagaggggattgtcaaggactcgggtgggctgcacatgggccgctggctgcaccacgggctggtcagcccatcgccaagaagcccaagcaaggcagctgaaaattatatgagcagcagcagcttataggagatggatcgaacagattcatttggccaaggcggcaaatggcggcggcggtgacctggaggctgcctggcctctttgtcgatctctcgtctatctcccttcttctctactagtctagaagctactagagccttctagcccttgtatccttccatcttccacctcagaaccactccactattgtaacagacttggttgttccctgtattagatttggcactgctatttctgaaattacattgttgagtgggtctctaacagccacatcatctgaatgtgagtagtgatgacaggagcaaaaaacctaaattgaatctgacatttaccattgttcttccatcattcgtccagtggtaacattttacatgtcttgcatcaccgcttgctcgccggcctccccatctccttcctctctgcttctcgtgcctcctcttaaagcggcgttcgttgacgttggagctccctccttgccggtcgtcgacagtagccaccgtcgacaaccacgacagtcgtgcgcgggcaagaaagagggaggtaacatctgccgccggccgtatctggcgatcatccgtgcccgctgcgctgctcctctcccctgccggtgcgacacgcgctcctcctctcctgtagtagtagtcgcgccggccgccacctctcctcctctcccgccactgccatcgcgtcggcctcttctctctccctctcccgccgttggccgcctctctccccctctcccgccgcctccgctccgccgctggccgcctctctcccctctgtcaccacgccaactcgatagaatcaggagagaagaggaaaaataagaaaggagagatgtggggcccacaccattttctctcacttatatgtgggcctacatatttattttagttatttttgctgactaggataccctgtcaacgaaaccagacatctatactatgtcgggacctttttttagacggttttacatagtttgggggtacacatttctggtattgtggttaggggacctaaaagagactcggggcctgatcggttcagttggctgcggcgttttggactgcagctgtccagcctagacgatcggctgcaacccaaaattctacagcaactgttatgttttgaatgtgcacactgctgcaaagagcagctgcttgttggttgttaggaaaaagtatatacgaagtccctcatctcgtcatcggattacaaaatcatttcccaaccacaaaaccaggtatataacatctctcaaaatacaaaaccggttcactctaagtcctttgacggttttaaccgatgtgacagctgaatcattgtgggacccacgtggaccccacatgtcagggtgtccatgtcatcatctctctttcccctcttctctcccttcctcccactcttctcttgtcgtccgccacgaaggggtcgacgatgcatgccgtcgtggcgccgctgccgctggttccgggtggcgcgggcaccacaagcatcggcgccccggcagcggcattgccacgttgctcgcgctgccagagaacgcctgctcgttcgcggccgtcgacgccaccatcgcgtggctgtacatcctgtcgagcaccatcatgcgtaggccctggcccgcacgtcggcggcgatcccgttccgggacttcacgcactctatctcgtcctatttcttctcgatcaaaacacatcccaaaaatccgagaaaaatcaaggaggagcgcgggatactggcgcatcctcgtgagaaattcaggctagatcgatggcggtagagggacaggacaaaataagaaaagaaatacagtagtcttctagcaaaattgttgtgattttcgtctgatcgagacggcctctccatctcgatttgtattctatgttctagccttcagggagctccagagcatgcatgcaggcgactaggcgaggcttccagggttcgttctgctttgaattccgcctcgataaggttactaatctctacccttggtcctatgatgaggcagccgcaacgccacgcnntgcttgcgctnngccgtagaacgcatgcgcgttcgcggccgtcgactccgccgtcgagtggctgtacatcccgtcgagcaccagcatgctgaggtcgcggactggacaagcgccgtctcccggtccgtcgacgaggggtcggacgcgtcgtgcattggcgccgacccggctgggttgcctgctgcccgtgctcttcgtcgtgaacagggcgagcgccagctgctgcctgctgcccgtgctcttcgtcggacatggcatctccgttcaagttaggaagtcgggtcgccgtcgggagatgagcgggggcacctccggctcagcaggcaccgtctccccggccagtctacagtggtggacgcaggattaaaataaaaatgaggtgaagatgctcatctcaataagaacaactaaacacaaaaaaataccatatttatattgtaatcatataaacatatagtataatcaataaattaaggcaaacaaaaaacaaaaatgatattaaaatagagtaataatttttgcgccatacataattcatcatacataaaaatatactagtaaacatatcaatttgcaaatatgagttaattcataaagcatggttgatagatatcttttaaaaagtaaatatatgagaagatatcgcatacccagaataagatgattattattttgcttagattagaagggagagagagaaaaacattaggccctatagtaggggacgggggtgagcaatgttgaggaattgagtcgggaaagcatcacatacgcaggattaaaattggacacttgggctgcttatttatgggccaattgtgatatggagggttggggcggctcaaaaatgatatggagggtt

SEQ ID NO: 77695 - DNA, 989 bp, Oryza sativa
catattaaatgaactcatatggaaaagttatcaaaaacaaagttgtacaactcgtggagatctaccaattttcttttggtcatttttccatccgaggttgattgagctatataaaatttaaattttaaaatataagaaagtcaaataatattttaaagcaataaatgatttcaaatggaaaagttttaaacaacaaagttgtataacttaccaagatctacaacttttgttttggtcatttttctatatgactttgtttgaacagtttgaatttgaatttcaaattatgacaacttcaaacaacattttcaaatactaaatgatttcatctgaaaaagtcatcaataacaaagttgtagaactcatcaagatctataacttttattttggtcatttcttcatccgataaagtgatttataaaattgttcacaaaaatgcacatatctcttataaagtttataaaactacaagagagatgtacattttattaacaatcttataaataaccttgtcggatgaagaaatgactaaaatagaagttatagatcttgatgagttatacaactttgttggtgatgactttttcagttgaaatcaattactggttcaaaatattatttaaagttttgaaatttaaaattttaattgataaaacaaagtcacaagaaaaaataaccaaaataatagcagcaagaacacaataacatgatagagcatgattttagaaatatttagaaaaaagaatcatctaatttggagttcatagttttaaatttttgaaattttatttttgcatacggcttcttaagtggccagtataaaaaaaaataatttttccatacgggcgcttaagtgtcatttttacatgcggtcctcttaaaagacccgtatgggaaaatcgatttttccgtacgggccacttaaggggacgcatgcaaagacgccgctagttatgctccgtttgcaaaaatcaaggggtctcacaagt

SEQ ID NO: 77696 - DNA, 11349 bp, Oryza sativa
gggtccaaggactacgttaacccaaataattaatttggaggacttgtttggacgttttgaaacctcaaggactaaactaagcccgaagcgaaacttcagggaccatattagctattctcccattcattaactagtgtagtatagtaaaatactatttcctccgtttcacaatgtaagtcattctagtatttctcatatttatattaatgttaataaatttagatagatatatatatgtttagattcattaacatcaatatgaatatgagaaatgctagaataacttacattgtgaaacggagaggatattaatcctcaattatattcagaaaattaattaatcagaattttttacaggaggcggcgctgtacgtgctgagcacgaagccggcggaggaggccatccggatcttcaccgagggcctcaagccggtgcacctcgccgccggctgcggcggcggcggcaggaagagctccacgatggcggcggactcgtcgtcggacgacgacctcgacatcggatgcttccacgatgactacgccggcaagtcgtactgccgccaccatggcggcggccgtcgccgccgtcgccgttcatcttcggccgtcgagaaagacgtcgccacggcgcccttctagttctagctgcttctagaagaaccctttttaccttttttttttttttttttgctttgtttgataagctggccttgtatgtgtttttataccgaacgggccggccggttttgtgttgagctaaaagcggcaaattttggcgtgtagtagtttgaaggccatagagaggcctcggctagaagaagaggcgtgacggtagtgaactgtcgttgcatgtaaatatcagtagctagctagcacgtacgtattgcactgtacattatgaacgcaaagtttttgtttcctttttgctttccctttcgagagaaagatgaatgtttacaattacacatttacgaaagttgactagatattttccaaggaagtgaagtgacgactactgtactgtgaattattccatctctccttttgtctccttccatgacgagtccagtagtagaatgctggtctgacaaccaactgatagttgaatttgagtgtcaagttgtcacaagaacacgaacaatctcgcaagtgtgcgcacggaatgagaaagcctactaatctaactcgggccttaggtttagcatgaaggctctctttcctgtctgtagctttgatagaccgtttccacaaatctaggtaacggcccaatcgaggtctatttcattttgaataagttcacattcggtccacctttactgtctccaagtttgaaataagtctgtaaccaaaatgatataactaagtccctcaatttacaaaaccgagtcatctgagaatatcctagacagtattaaacctgattttagctgttgtggcaagcttagtcatcgtgacactactgggaaagggacattagctagaaactgaaaaaacttcttttagcctacataaattagaattttgaacgggtgtatgtttcattgatataaattagaattttcatattctattcatacttctatggtcttaatgttatgtgagtggtccggagtatgattgggctagaccaagaacggataatacccaacaggcactgttcattgtcttccttagctcaaggcgaaacaaagaggagggaagatgggcgccggtgctccggcgaccaaatgacggtgaggaatgtagtaggacatgtcccacgatatgactcatccatagatgctgaaggttggcaatgaagaaaaccagaacaagagggacactgggggcaacgaggtggtcccgatagagagagaaatgacaaagacaagctctagtagtgacacgaccggatgagtgcatcaaaacatgttcccggacgagaggattatgttttccttgtacacacggggaaacctgactaatactatttattgtcttccctagttaacataagaaatagaagaggaaggaagatgggtgacggtgctccagtaaccaaacggtagtgagtaaggtagccggacatgtcccacaatgtgactcatccatagatggtagcagttggcaatgaagaaaaccagaacaatgggaacgcagcaagcaacaacatagtcccaatagagagaaatggcaatggtgagctcctgtggtgaacacgacagagtgagtaagtcaaaacgtgttcccgaacgaggaggttatgtttttcttgaatgcgcaagagggagggaacacatgggagagaaggggcgccagtgagatgagatgccaagggagagggggagcgtgtgcagcgagggagagatggaggggggtgctaggagggaaggacggaggtgggagaggaggggcgccagggaaaagaggggctgcgggggagggggagagataggggcgccgagaaggagggagggaggcagaagcggaggctcgggagggacactactacagacttcttatctgtaacggcctttcctatgccaggggcttgcagaccgtcacaacattgtcatctctaacgggtcaaaataaatactgacaaagatatactcgtacaaacattatccatatgcatgtatttcgagctcaccgatgacacctataggtgacgggcttatgtttaggcccgacaaagattatctttgtaatctttgtcacccccctatattgcgctcatcatcgatgacaaccatctgtgacaggctcaatattaggtccgattgagataactaaaagcccatcaccggtgtccgttcgttgggcgttactgatatctattgcacactataaatactccagccgtctaaggaatggttatctcactgttcactattttggtgggaggtgttggaggtgaatttttgtctttttttcaaagaaaacagaaaattcaaaaaagtaatcaaaaaatagtaaacaattcccataaatttagtaatacttatcttacaaaaattattatctaatacttattcacttttgcaacaatggatcgaagttggatgtatggaactgtgcgacgacatagcaaagagtatagaagtggcatttcaaattttataaatgccgcagaggaggacatgaaaagaagaaactgcgattacacgtgttgtccatgtacatattgtagaaatgagattatgcttgatagtggattcgacgtacacactcatctgatacgtcgatgattcatggatgactacacatgttgggtgaagaatggatcggagagcaagaatcagtcgatgatgttgcagctgcagacagaagtggtgcacaaaattagaagatgaagatgagcatgacatgtttgtaccttctccattgggtggtgaaatggttggtgcggatcacgatttgcagtaagacatgttgcgttatgttgaggactgtcacaccctgattttcgtttcaggatttataaattatttaataaattattatcggaatttatattaaatgttcattaatttacaagtgaagttaaatgtgggaaataaaatttcctaaatataaagcatggatggatttaattattattaaattccccatggttaattatactctctggaatattctcggatttttcggagctcaattcctaatttttaatcatacaaagagcatttcagtaattacccacatattaaattaatcattaaatggtctaattataattttgttaagtactttgagtgtccaagtattttcaagatttttcttggaattatttgagcataggaagtatttttaacaattcaaagatcatttcattgattaatttaattggaaaagtaattaaagttcaccttttccttttcgggccgaattaggaaaagtcctctcactctcggcccagtctcctctcagcctgcagccctttttctctctttcccgaagtctgctttgtgtccctcctttaatcagtccttggaagtagaagcccagccgaaagtctagtttgcctccctggcactgttcatcttcaagcttggacagagccgagccgcccgtgctgtgccctgtgcagccaccgcttcctccgttaaattcgccacatccggagctccgtttgcaaaattagttgaggggaaatattcctcttatcctcctctatcctctcccccaagaatcggagcaaaccgttgagtatcttatccgaatcgagctcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgccgccgccacgtgctccgccccgccgtcgtcgccggccgagctccatccgcgtcgtgccgccgcctccgtcgtcgccgccggtcgccgtcaccgccgtaaggtgcgcgggagggtggagaagcccggtcgcctgacccccaaagccgctgatcaccggagccccgtcgccgccgtcgaccgaagccgcgccgccgctagacctcgtcgccggccgtcgtcgttcgtcgtttggttcgagggtgagtaccgttgggttcgtctcgtcgtcctctacgtgtacatgtcctccaaagtcacagccgaccatccaatctccggcgaggtcgccatcttggtccggccattgatgaggtcatcatgacgtcatcatcgtttttctttttcctgtttttctaatagattaaatcttcggaattcataattaaatcatcgtaactcggttttgagtggttcaagttgctaaattcatctaaaatcatgatctacatgttggtttactttttatgtattgtttatttggtttttattagtctttttcttcgttttgcgtgttagcttgtcgttttcgtcgttgcgaaggttcgtgagtgcgtcgggagtgttcagaagattaattgaagaccgattattgcaaggcaagtcacacagatcccaaacaaccctttgagcatgttgaacctgtttaaagctattgatttatttcaacttatgcattgttttcgaatgtcattgggtggtgagcctttcccatttaattatggccgaagatgactttattttcctatgggttataatttgactagcatggaccttatatattggattggttcagctagatgttatttatagttgcttagccgtgcttagaaacattagcacactattgggataacttatgacttactattatttaatgatggcttaataatagttcacgatggtcaatcgtgattggttaattaattactcgccaactaaaacttgataatggtgggttgtgagcacatggttttgagagtcgtgctcatgacaattaaggaccggttcgcgagctactgttgtgaaacatttatcgtgccaaccacaagccagcatgggcaacggctttatcttttgtatagcgtgattcattatagtgcgccagactgagaagtggcgagaagtccacgggggtcgctggggagtccatgccttgtttataagggggtgattatgatccaggaaaggtgcgctgtaatgggttatgttgtgctaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgagttgagcaatgtttttcgtgattagtctcacacctctcacaatatttatagatggtatacctggtaataatttgcttagctcctggtttggagattagatctgtacagccgggtatggttgttcaggatggttgggcctgtgcagcatgggtgtgctgttcagtgttgattaaaatttctgattaattactccactgttttacttctcttaaatctttgctaaatgctgcttttgcaaatgagcctatattatgccatcctttggtatccttgtgcacttgcatacttgctgtgttgtgcacttgcatacttgctgtgtggcttgctgagtatgtcatatgctcaccttgcaataatcattaaacctcagttgaagataaaggatccagaaggagaagacgtttggcttataccccagttgagctgcctgtgggagtggagctgaagccatcgctagaccgttattccgctgctgttttcttttcttttgtaagtgtgtaacgttattattatgatggatttgtatattaaattgtcagtttgtgtacctcggctgattcctggacgaggattttatgcacaaataagttcggaaattactagtgaattttcgggcgtgacaaggacctagcttacaatgagagagattctataaagttcaccaggttggtcagtgactcggagacacctctatacaccggatgaaagtccaaacacaccaaattgtcagctaccgtggatctactgaaactgaaaataagtagtggatggacatacaagagtttcacagattttttaagaatattgaaagccatgcttcctaaggagaacacattgtccgagacgacatatgaagcacaacaggttttatgtcagctggggttagaggtctgtagaatccacacttgtccaaacgatagcataatgtaccacaagcaataggcggacttagatgcttgtcttgtccgcaaggtttcaggacacaagcaaattgtcagttttttctttaacaggaggcggcgctgtacttgctgagcacgaagctgacgaaggaggcctttcttcacagagggcctcaagccggtgcacctcgccgccggcacggcagcgtcaggaagagcttcacggtggctgcggactcgtcaacaacgacgatctcgacatcggctgcttcgacgatgactccggcaaggctggcctactgccgccaccatggcggcggccgtcgctgccatccactactagaaaaagcatttttcccgacgcgggggtctttttttcgcaggcggacatgatccttgaagccaaatgaccgtctataaaaatataaatcggggtgaagttcattgtattttcacaggcggaccacttaagcgacgcctgcggtgctttgatccgcgtgcaaaaattagagatttttagtgttgtttgggtacaggcggaagattttgccgcctgtgaaaatgtgttttgaccgcctgcgaaatccttctctctagtagcggttgccgttcatcttcggccgtcgagaaagacgtcgccacggcgcccttctagctgcttctagctagctaggagctagaacatcttttagcttttccttttctctttttagctttcgttttttttttgtttgataagctgttcttgtatgtttttataccgaactgagcggcaaattttggttgtagtagatgcaaggcctttagagaggccgcggctagaagagacgtgacggtcgaggagtgtacatgtgctaaattagggctgtcaacgagccgagctcgtctgcctagactcgagctcgagccgagcttgagccgagcctataaaatgttcaagctttctgataggctcggctcgagctcgactgccgagcttgatttttaagtaaaacaacatatatttgaaatataatctttaaaaatatataattaatttttagttcatcatattaatataagaggaaaaaaggaataaaataaatatatgatgccaatataagccatataaataatatatttgatctcataatttattaaataacaacaaaaatcatatattactaagctcgttggaagctcgagctcggctcgacaaagctcacgagcttagagagaggctcgggctcggctcgtcaggagctcgagctgagctcgaatcgagcctaggacgagccgagctcgagcagctcgcgagccttgagctttttttgacagccctaatgtgaatatcagcagcgagcgagctagaagtctagaactgtacattaacgcatatagtttttcatttgctgtcccctttggagagattgaataatgtttaaaacttgctacgacgattaattagccagatatttttcaagtgacttaattacctatgatttttcttacattttagtccttttaaaaaatattttctaaatagatccctaaaaatgtactccaaatatacgctcttcttggcaccacttaccctggctctgaggtccagcatgtcggcacgaatgacgctggtgatgagatgttgaacctcggcacaaataaccttggcgtcgagaaaatgatccaatttcaaaataagtctttttttagaaatctatttataaaataaatttttaaaaagagctaaaatgtagaaactataacttaaggcctggttgttacagctccaacttctaaatttaactccaggagtgggtttgaataaagtggtgaactgcttacccaggctccacactctagtcattttgtgagacagctccaccatctccactcccagttttggtggagctgaaactgtttggctgagctcaagctccaggaggggtggagctagagctgaagctgtgccaaacaggcccttggttgcccgtctgaatgattccattcctctcctctaccctccttcaggagtcgtgtacaagtgttgtacccgcgcttgaccgtgttatcaaaagaacaagataatcaattggtcaaattgaagtggaaaaattatacttcgactcccttaactatggtccatgtatgattcataacatttaaccacaaaaccggtatatcgactcttccactattaaaaccgatgcaaactatatccctgggtggttttgcaaacggttttggctgatgtagcgtctacatggtggtattgactcggtcttctttccacgtatcattgatgtgtcgcttatgtgacattttaaaggtaaaaagacaaaaaaaaaggggaccgacatatcatccacacgtaaaataaaagtgggacccacgtgtcatcctcttcctcctttatccttcctctcccctcctccctctcctttttcccccttcctcttcctcttttttcggcctcctcgttccccgtgctcttctttctcggcccaagcgcgtcgccgcccacctgctgcgccgcacctcttcctgcctgaccaccaagctccggagctgcacgcctcatcgtttaatcgcgctgccgccgaaaaccacttcggtcccgacgccgccgcgcagggggttcgacttcctgctgtcatcgtctccgagaccctgccggtgaggtctgccgctgcccttgagaccacgggcctccagccgacatccaagggagcttcttcctcgatgcaggagccgaccgccccagccgccggtgtctgccgcctcctcctgaagccaacgccgccgagcttctcactcgccaccgcctcagccatcaccatggccgttgaggtcaacaccaccggcgtcatctctctctctctcttgtcctcaagccgtcgtggggcaacttcgccgtgcgcaaacagttcggcaccgacgacgtgggaccgacatcggagcgccatcccgacactgaacgcagcgacgagcactgccaagacgcaagaggaggatggaggaagaggaagaagaaggggccgtggaagaggaaggagagagaagaggggagaggaaggaggaggaagaagggaatgaggaagaggatgacatgtggggtccactattttttctgtgtgaatgacatgtcggtcccacgtatttttggattttgttttcactctaaaatgccacataagcgacacattgatgacacgtgggacaaagactggatcaacattgccacgtaggcgccacggcaaccaaaaccgcttccaaaaccactcaaggatatattttgtaccggttttgatagttggaggagtcaatatacccggttttgtggttggaggttatgaatcatactcgggctatagttgagggagtcgaagtatactttttcgaattgaagttctctgttctcacacaggacacgaacaagctggcgaaacagagccacctaaatcgatggcccagcaaaacgagcccaccaatccaacatggacaacaatatttcagtagaataagttcacagtagaataagttcactttttgaccctcaaaagttatagaaatctaatctgtgaccctaaacaacaaaaccggatatcttgacccccaaactcttaaaaccggtccaatttaactccctcggcggtttcggagggcggtttcgctaacgtggcgtctacatggcgatattgaccgagtcattgttccacgtagcgttgacgtggcacttacgtggcagtagaattaaaaaatataagtgggacccattagtcattcacacaaaaagaaatgtgggcccagtcctccttccttcttcctcctccctctctcccttctctctctttctctccccttcttccccttcggccggcgggcgggagggcagcgagagcaagcggcggcgggcggcgaggccggagctgcggcggcaggcgaggtcaggcggtggttggccatctccggcgccgtcaacagcggcgaaggcgaggcgaggcgacgcggatcgaacaccagcgcagctccagcgctttcttcttcctccggcacgcccagcgctacttcggttcgtacgacggcgccgaggagcacaagctcaatagcacctcctcgtcaacctcaacaactttgagtacctcgacctccccaacgcgatcctccaacacaactggtacgagccggacaagctggatctcaagaaagtcgccatcgtcaccgccacactctcgcggccgccaactgaacgaggatgcgtcgtcgccggcatcatcgaacctttcctctccgcccaccgagtcgcattctggcgcatgggggatcaggtgatctcgccacaaccggcgtggccgtggctgctggaagaagtggaggacatcctgcactacaccttcaaccgcaacggactagagtatgaagctttccttgtcctcaccacggaggaagacgtccgtgtgtgcgacccactaacatgcgggtgtcgcggcggcgggcggcggaggcacgggtgtggcgcggcggcctgcgagtggcgtggcggagacgcgggagtggcggcggcgcccgggctaagctccaccgccgcgaagacgaaggagaccacaccacctcccgatgacatgaaatcggtggcggcggccgcacggactcccgacaccaaaatactaggggggtagcacgcgtacccgtgccgtg

SEQ ID NO: 77697 - DNA, 16909 bp, Oryza sativa
cacacctccaccgctcgccgatgtctccaccgctcgccgctgcgggagagagagagggaccggcgaggaaggagaaggaactagagggaggggagagagaagggatacgtgggtcccacaatttctcttctgtgtccatgataaataggtcccacacatactttttaattctaaataccacctaaacgccacgtcaacaccacgtgtagaggagacccggtcaataccgccacgtagacgccacgtcagcaaaaccgccttttaaaaccgccaagggagtcaaattgcaccggttttaagagtttaggggtcaagatatccggttttgtggtttagggtcacggattatattttgatcacttttgagggtcacaaagtgaacttattcctatttcagtgatcttccctggctgtagcttcgatggacttgtactgcactggctgtgttcgattgttgggttgggaaccatccctctgcatgaaaaacggagcggtccattagcgcgtgattaattaagtattagctaattatttttttaaaaatgaattaatttgatttttaagtaacttttgtatagaaatattttgcaaaaaatgcatcgtttagcagtttgaaaagtgtgcgtgcggcaaacgaggaagaggaggttgggaacctgatgtcaagaattcagacctactccctccgtcaaaaaaaaaaacaaacatagaactagtattaggatgtatcacatctagcacttgattggtttttttatggaactaaaaaaactttaatctagaatgaaatgtgactccttctagtacaatgaatctggacaaatagctgtctacggagtagatgctatcttgctgagttgttagctccgctgtctctttttgtgcctggaggtttcagtttagaagttggcccaatctggagtctttttgtgctttcgtgtaagctagcaaattaacccagcgtttctgtgttttttttttctttttggctgtttttacatgttattggctttattaacaaactgggtcgatcagtggatcaatctctgattaaataaaaaagtgcagatgtgctgcgagagttcttttttaatattctttttcaaccaattgacttgttccatgagcagcagccagtgcacagctaatacaaataatggttgcagttttcaatctaggcctgaaggtgccagggtgtgcaatgcataatgcagtctgaaacttcgtatagtatcttcatgctcgtttgtgctatgcaagattcaaaacagactttttttaaaaaaaaatgaggcatatgattttcaattactagaaaaagatgagaagacagtcgttaaatgttcacttgatgctaaaacattaaatgttcagaccacaaacaatcgaagctaagtactcgcacaagcacgggcacatccacgatacaaggaccaaggaagtagctctacaaactgacattaaaaaaaaaaaacagctctaagtagtagtattacaaaactgacataaagtgttacataaccattcaaacaggcacaatactacaacaacgattacaacaaattactagctgtgcagcgtgagcgcgatccacgatggtggtctatggtttctcacaatgtaagatctgttcctcctcacacagctgactaccatccagaatactagaccactagttgttgggacgatgtaacctactacttcagtatttacaatgtttagaaatacacgtacagcccaccaacaccgtggtaatacgcagatgtgatgtgattggtgtcctaaaccaaagaagagaataaaaaatggtacagtctagttatttgagtcgaacaacatgtcctggaaggtaaggctgctaaggcaacttaacatactcgatcaagagtgcaatgctgagcacaatattacaagagaatatcttgcttgtctggcaatcgagaaaagaaattccaaatgttcgatggtgtattcttcttctgaaagcaccaagctttatatagatgaagtgttactgctatgtattatatgagagtaccttgcttgtctggcaatcgacgaaagaaattctcaacgatcgatggtgtattattcttcttccgaaaccttgggtgcctcattatgtaaaatcctgcgattcccacaagaaccttctttggtacaaaatacacaacaatcgataccatgacaatgatgaactgaaagattgcagttgctctaggatccctccaacataacaatgattggatcctctccccctgagttgctacatcacccacaactgtttgaaccctgccggcaacgctcctcagtctatcgtacctcattcttaccaggtcaatactacaacttgattcgacactatcaaactcctcatcaatctcatctggatgtacactgcctaaacaagatactttatgatcaaaaaaaggaggcttccttggtctgaaccggtaattccacaaagctactaagacaaaataaatgatcaccatcgagagtactagcttatggaagcacagagccaggacaaagatgacacaagaaatcaaggcaacggcaggattcttccatgaggtcacgctctgaaacaaatgaatgaatggggaagcaacctgcatgagtcgaaaaaagttcactttgcttttcctcatactccagcagctggtgcctccggtggcgttgcacatgtatgcaacaatctcactccttaggggcggctccacccggctgaatcgaagggccatcacctcagctacctctgaacgaaacttatcttcttccattactgtcagggggtgttcatagtgcatcttgggcagagtggaccgtgcgtacatgcctaataggctgataaaagattctgatgacaacttcacagctatctgcagctcaccggctttcttgaacccacggcgattcagaatgataagagggtaggagtgtgcatatactcgatcagtctcaaggcaagataaatgaatctgtaccttgccaatctctcgatgggctttacgcgtgtgtgggaaatggtcaaaaacacccgcagtcagtacggtcgcaatgtcatagacgctccacgtatgctgttcattgaatacatgttcagggccatcgaggattgtgcgggtccgtacccacttatcaccatactttgcaacacaatacggattcactgttgatttgcccattctaagtgggaggccggtagcgcgcaatatcccaagatgaaccctaccaactgggggtctccagagtttcctgtcagcgggtctagtgtcatccatatagcctttagaatcatgcacgatacgatatctaccatccagcatgttctttaggcaaattcgcatgcggctactgttgtcattgccatcatccacagaactgtcgaactgtggcttatcagggtttttaagatcaaaccacttgctgggcatgacatcaaagtggtcgtgttcatcgcctccttttactatagaagacaatggtacagtctgttggccgatgacaacctcatctttaccgggatttgcaacaatcacatgtagctcaaggtcatcctcaaagaatggctctgcagcaacaaataaaaggtcctctttccattcatagctaccactggttgtcctttgctttccaacttccaagtgccctagtcctctgaacctgtttccctaaccttgccctgcaaaacacccctgtgtctgtgcctgtgttgcagccggccatgtcctcctgttcatcgtctcctactgtaacaccctggacctcaactactgtgacccgcaagcaccataggtttgggttctcatacactttgggtatataccctgataaacctacatgacgatatgcttcatcagcctgtgaccctatccaaatcgcgagcagcaagctggcctgtgctaattttgtcccgtcctggtcgaggagtgggtaccatgttggttccagtgggacatcatccagagacctttttggaatgttcttgagatccaagtgtagcttccctacaaagtcatctctgaccagatccttatcgttgactacgatatccacagtggggctgggaatcttgtcatgctggaaggagaaagcaaaagtctcgttccactctgggttcttgttcctcttaaagcatctggtgacacccctgttgtaagcaccaaatttgacctcgacatagggatcaaggctgccattggcatccatgtccggcagcttgcgagcctttattacacgcacaaagagaagctgcattcgctcaaacaacctgccaggctcgaaatttgggttgatctccatcagatcaaaaccggcagtctccaggacaaccggatcatcatgttgatctttgccataaccataatttgtttgaaacaagtagttgtaaatgccatttaacccattgccctcagtttgatgagtatgacgatcctcagtttcaagcagaatcctatcaacagcatcagtaaggaacaacttaagtagcacttttgcattgacgccctctgtattatccaatgtatattgcatcggatctacgttagctgaatggcggtgaaaatatttttcaggtagcaagaccttgccaagcaatgacttggagttgctcatctgatcgaagcagtagacagcagcttcaagaatgaggttaccagaaggatcctctcgctgtctcatatcaaaagagaacctctcattccatacagcaacattttccttgatggtcgtactcttactttgactgttgaaatgaagctccacggaatagttggtctgggaggtattgctgcttgagggtatatcagcgcttataacctccacaaccagataggtagtcgccatagaccctgtagtgtgtcgacacaatcagcctgcatacgtgagaacatttacaaattctttcttgcaatcatttatgaaaccagctcaaatgagttactgtttgcattaattgcaaaagatagcagcatatacaataatcatctagtaagaattatctggatcaagagcaagttaaaccatctcgcttgatattgtagtagtattgaatttttggggacatctatttcaatgacaaactattcgtattagatcaacactcgagaactcatcgcgtttcaatctttttcctaggagtgaaaaaaaattcttgtttttacgagtagggatcacttagtatttgtaaaaaaaaaaaacaacaacaaatccccaggtccgagataccggaagttcagaaaaacttgaccgaagtttcaaattccaatatgaatctgaccaaaactatgttgaaaaaacagtagagttgagtaaagaacccgttccaccagtttggtttggcccgtcgcttcggccgcccttcttccatccccgctgtagtccgtcgagccagggcggtcttgccggcgggcggcggcggcggtgcccgactaaggcaccgagcaaccggcgctacgccagatcttgggctgatccgtcgagttcctggcctcatgcgagtgaagccgcctttgggcgcagattcacagcaccgaggtaccggagctccctgatttgccgccatacagcgccgaccggagccgactcgcgcactccgatgagaggtttttgttaaggggaatggtcaatcagagaacgctgtgttttcaattgattttgtgttggtcgaggggagatcagcaatcgactctggcctaggagttctatcgccatggacgacgagaaaaagaggttcgtgccttttccttttcttttcttttctttttttcaagaaccaatgtgatggctccgcagagattgcgcacttagcaatattatattttttcttctcgtactagaaaaaaaaaatgtccgcattgcaatggaagccaatttaatttgtagatatgcgtaggtgaataaataattataatccaccgcttcgtttattatgtgcttattcgaattacagactttttgtgtgcaaatattttatatacatgttcttagcgactcaaaagcaaatgttgtaaaataaagtacaataaaaaaaaccaaaatgtcaaattcaagttataattttaaatttgcttatagcaataagcctaagccaagcaatgagacattcaaacacgagctcgatttatcgtttagctttatctcaagtcgggcaggaattgaaaacggacaaaatcaacaacttcgattatcctttattttggttggcatgctctttttgaaagtaaaaaatgattcttatgaattattgtaatgatatccctagtagtgcgtatgtgttgacgggtggtaccgtgactacggtattttacatggtatggggatcgttggtactagggtatatgcaagattgaggtaaaaaagatagagacaaggatttttatataggttcgggcaccttatctgacgggtaatagccttacttctgttgggcgaagccggtgttgctcttattcatcataatcacatcagtacaatatttggaataacctatcgagctgtcatcgacttggcggcatagataatcaactcgtagacgacggtagggtagtcttcctcctcgaatataaactcgtcgagatcagagatgacactagatcccttccttgtcacctagaagggaacaacgttgatattctatacaatccaactgtcggggttaatctcatctctgagtcatttgcattcgcttacctgggcgataaagctataactccaacaaacaaattcttcaagcactcgaatgaaaatatcattgaaggatttgggattgtgcaagacgtacctctctgctttgaagacagggaggcagtcttggattttcatgtttttgaaatcaaagattttgacatcctaatcggacttccaattgagcagcttctcataaatacgccccgattggacagcctcaagataactttttgagggaacgaattctcagtttcattcttgcgggcaatgttcaccttgaccgactctctcccatagaatgagtatgcggaggaggttacggcagttccccctaacaagtctcccaagacccttctggaaaatgaagtcctcgacttcatcaaagaggaagcggagctcggtgcgactctcgaactcccaatcatggaactgccacctcgaactccgcttgagcttaaacctctacctgaaggcctacactatgctttcttgcacaatgacaaagaagcccatgtcatcataagtgacaagctttatgaagatgagactcaacgtcttctttctgtgttagagaagcattgcgctgttcttggctattccctccaggatctcagagggattaaccccatactttgcactcatcgtatccctattgagcacgagagtactccctccagggaacctcaacgacggcttaataatgtgttgagagaagttgtaaagaaagatgtcctaaaactcctgcatgccgggattatttattctgttccatacagtgagtgggttagcccagtccaagttatgccgaaaaagagaggactgacggacgttgctaatgctcaaaatgaacttatcccgcaacgaaccgtaaccggatggaggatgtgcatagactacaggaagcttcacaaggcaacaaaaaaggatcattttcccctaccctccattgacgaaatgttggaacggctggcaaatcgttcctttttctgtttccttgttgggtattccgggtgtcatcaaattcccattcacccggaggaccaaatgtaacaccctgaaaattcgaccaacaaaatcaaaactctaagaatacggattttcaaaatctttttaaataaattgcatcatgccgattttattcgcatatttcattggattttgatttcggagttcgttgatcgcgaataaagaataattaattaggaataaaacctaaaattaaactggcaaaataaataattaaaatataatttaaaataaagattaggtgaggttggtaataaataaaaatattatcgcgaccatattagtatcaattaaatttaagtgcgatggaataagaattaactttaattaaattcaagtaaattatataaaaataaaatatgggtaatgttaatctagggcgaatcttttggttagagcaacacaaatattgagtaaacttgatttgtgcaaaagttagaatttatagggcgagatttaaatagaaaatagattaaattagggttaataaggatctagcactattcattgcctacaaggtgcttgatgtggtcctagcctagctagcctcaagccccgcgccgccgacgccgtgtcgtcgccgtcaccgcacgctgtcccattgatggctgccatcgcgcgccgtcgccatcgccgttgccgcgccgcgcgccatcccgttgcgccgtcgcgtcgccatgccgccgtcccgtcgcctcacgccgcgcgctcgccgcctcgcgccccgcgccgttgccgcgccgcgtcgccgtcgcgtcgcctgtcgccgtacgccgagccccgcgccgcgccgcccacccgtcgcgtcaccgctaccgcctgccgcgccgcgcgcccatcgccgtagccgcctcgagccccacgcgccgcgccgtcgcgtcgccattagggccggccacctctcctcgcgccctataaatcccctccccggtcaccatttcaccccacaccaccccacctcctcttcctccattttcccctctttcctctccaccgcgccgccgccttcatgccgccgcgccgccaccctcggtgctgccgcgccgcgccgagtgccgcgccgtgcgtcgcctgccttgcgccgccgtcgctaccgccgccgtcggtaagccgccgcccctccccttgttcggtcgccgccgccgccccgggtaggcagtgagccgagagagagagaggaagggagaagccgggagggagagaaaaagaaagaaagaagagagatgaaaagaaagaaagaaaagaaaaaaaagaatagaaaagaagaaaagtaaaaataaatagaaaattagggagagattaaggaggtttagaaaattaaaataattggggttagttgtaggtttcttttagttgtagaattgcaaaattttatataattatagaatattttggtaatctctataagtaatcaattcgcggtagaaatttagatttatttaagagctaaataattatgttgaattcttaggaatgtacttctaaatcacaaaaagacttaggatgaatgaacttaaaattggaatgaagtggttttgcaaactttgtagtcgatatagaaagatcgattcgcattcgacttttatttgagtttatttggatttcatttgaattctaattgagttcaaataaattcttcgcacgtacttttagaccctgagggagttgcggatccgagcgaggatcaagacccgcagaactacgagcaaggcaagtcatcactattctttgaacatgttgatcccaattgcgaaattattttgtttacaaataaaattgcatgcaatgatgaacatcctacttgtgattatgccatgccttgattattgtttaccccttatgccttcgtaaccatgtttacgtatgagtccctagttaattatgacaactgcttagaaatgctattctagaatcatgcatactcatatttatcaaatgctatatgcttgggcaattacctttgggaaggtaattgagatgcggcatgtggagacatgagcgccacattaccatgatgttgatgatatgatttgtgaaaggagaaataaaattaaacaactgttttcgactggggcggacggaggatttgggtggtgtccggaaaaggctagtgccgtccccggtcaattaaggaccaagccatgaagttaagcatgaaacgacccccgtacaaccgcacttcttgtatgggtatagacctagcggagtagatagctgagcggaggcagtatccatgcatagtggtttcttgatgtatgaggcaggggctctacggtggggcagccattggtaggaccgcgaggcgggtgtctacagtggtgtcgccatcggtaggactgccatgtgaaaatctaaacataattatatcttaatgcatgtgtgagtcttcccttcccgggtgcgccagaactcctctcactgctagaaaccgtgtatgcctagagtgcatgaggatgtatggttcatggagcgggtactgccaatgcgaggtctcatgtgttggggcgaagctcatgtgttgggcagtcgcggagtgcgggtaaagtgtacatccactgcagtgtgagtaaaccaaatctattcgaatagccgtgctcgcggttattgagcaccgggacgtgtattacacttggctagactctaaattcttaacttgtgtgggatgggttattgcatgatgattttatgctgttgcagccacttcctgagaggcgggaaggtggacgtcctcagaaaaccatgacgactcagtggcgggaagctatccttgggatcacaatggatggtggacagaaccgtcgttgtttaatgtgaacactggtactaaaatttgatcagtctatgctaggtcttaggcttgtgaaaagaattacaaaacttgctttgcgcaaaagaaccatagccatcctttgaatacccctatcatgtgcattgttgctgtggtggcttgctgagtacggttggtactcacccttgcaatatacaaacttaatcagaggccggagatgaagctccggaggatccctacgcttactactaggagggtgatggagacgatggcgctcagtaggtcttagttacggtcgttgcctgtggcaatggcgtgccgctgccttaactccgctgccttatctacttctgcttttggaatgtattccggaccgctcggtccgatgatctaagactatgcctgtgggcttatgatataataattcgcactagactctcatgtatgtgcgtttggtatttcagctatgaactcgtgcgtaccagactacttgatccagggaaatggtactgtttacacaggcgagtgaatgccttggaggttgccagtccagggatgacatgtacgataagctgccagcgatggtgccggattcccaagccagggatgtgcacaaggacatcttggtcgaaggcagaaggctctgcgaaatacttggaaagattccagagacggtgaacaagtggaagttgctttccgacctctgggtagagctgctcctgtccgtggcgccgtcggacaacgcggccagtcatgtccagatgctagcaaacggaggcgagctcatcacccacctctgggcaccgttgacgcatgccggagtcatcgagaagaggaccggaactgaaaacagtgctttccctgtctaatgtgtactgctcgtatcgtatcagctcattattcttttttgttagagttgtgcgtcgaaaatgtgtacaaggttggttatagtttagtacttggagttataccgagtgttaaaaatagagtaagagtctgactatgtcctaagaatctcttttaaatagagggatggacctattgtaacggcatggcgatttagtatagcaagagggaatggttgtccacagtgtcaggccatgagtcgttgtaactctgatacgctgttgtcagggttacggataagacatacctcctatcctacgacttatggaatacacggatatggtatgccttcacgtatacggatcattctcatatacgctgttggaatccatcacaaattatggaaaatatatctccacgagccaagtgatttccaaagtcctactcggaagggatagaagtccgagatagagtttttgttatatcgtacaagatccgatgtcttcgagttttacttggggattaaggtgatccacggtataaaagggaccccagggagaggtgcaaggcatcgaatatcatcaccaacacacccaccatagtttacgaagccggagtgcacggaaccaagtcgctaggagatctcatcggacacgtcgactacgatctcgatggtattgttagttccgtctacttctattgtaatctgtggatttcgtcatcaatcccatataaactgggctagggctattacttgacaaggggcctgaaccagtataatctttgtcttctgtttgcttgatgtcgtattacgtagatcctcattccaacgtaccctaatatccaaatcatctggtctacgagcatcactcgtcgacagtggcgtgccaggtagggagacttggtgctcaaagttctccaatatgacttcaagccctcctgacagcagtgcctagaccggcgtcgatccaggagctcctacctcgacatcgctggtgtggactcaagttggatctattgtcttttcggtctacaccgtctcgccaatctcgactagcccaatcaccatcgagaacgagaaaggtacggctacgactccgagaaacgacgccccgccggcaattcctcccacgcaagtagagaacataacattaacggccccaacacctagaaggaatcctcaagcggccgaattatgccctctgcacaagagaccagagccgacaaggatacccacccagaaaccaagatcttggtgtccagtccataagacatcaaagcatactctggaggattgcccggtgatactccatgtgaaggctgaactctatgcctactgggagtgtggaattcaacgtacttcacctacgggtgccacctactgcccgatccacaagtcgagatcacacgatctcacaagctgcaagatcttccttaggaccttcaagccaccgcatcatcgcgaccaacaaccacgagttcaagctcagtgtgttgccaaggagcgagatacagcggcgacttcagaccggttcgtgggctatgttggcaccaaccccaatgaaccatctatgctacacctgctggaagattacggatcctcttcagactcaccacgagatgtgaaagtggtcaataccgccgagacaagttcatccgcggtagcgggaacgcctgctcagcaattgcgaaacctcgacgcgatattgagataaagtcattttgatctggtgacaaacctagacgttgatcaatgggcagcacgattgcgagaaaccatggccaacctcaatagcgcagtcgcaaacgctgcagttgaactcgcaccgtgtgatccgccccgaggagacggtgaatcagttaacgagaacgcggaagtggaaaaccccactggagaacatccttcccgtgaccgatcacctcgggtagcccgagatcctactccaccacgtcgcgagaaccgtgatcttcatgaacgcctggacgaccggcggagggacagatgaaatcggaacgacaatgaccgtcatcggcgccgttctccctctcggtgaggagagaacacccctcattgatgacatcaccaccgcttcccttcacgccgaggaaggaatgatgatcgaggaggccgccctaacaaagaccgagatcggctggtccacagtgaccgtcgggatgacgacaacaacaatcgtcgtgacgctggcgacaacaatcagcgagaccagggggccgatggccgagtttaggacgacgtccgagatcaaaggttagacggcaacaataggcaagatcgcaactcccattctcccgcatctggtggagatcgagggtgcaatcaccgttcaagaagccgagctcctgaaccaagcgacccttcatcctcatcttcgttgtcttgttcctcggacagacctcctcgacgatgtcacaaccacgggccacctttcgtcccaggaggtgggtgccgagcattcacgcccacacttcgagatatacgatggcccgaaaaattccgaccaggagtgatcgagaaatatgatggaagcacagacccagaagaatttctacaagtctactacacaattctctacgctgctggtgcagacgacaacgcactggcaaattacttacctgctgcgctaaagggatctgctcgttcatggttagtccacctcccaccccgctcaatctcttcatgggaagacttgtggcagcagttcgtcgctaacttccatggaacatataagcgccacgcaatcgaggatgacctacacaccctaacacagaacccaggtgaatcattgagggactacatccggcgcttcaataagtgcaggaatacgatccccgaaatcactgacgcttctgtcattcgtgcgttcaagtcaggcatccgagatcgatacaccacgtaggaactggcgacacggcgaatcacgtctgctcgaaagctgttcgaaattatcgatagatgcgctcacgcagacgacgcgctaagatgaaaggagggatagagcaaggtgggtgttgagaagaagtcaaccaacagagacacaccagagtcgagcaagaagagaagtcgcaagagtgggaagtgcaaaccttcgggagaggtcctcgctgctgagcaggtggaaccacctaggtgcccaaacctctagaacgacgactcacgcaaataatggtgctctatacacaagactaacaatcacgccatggaagattgttacgtcttcaaaaaggagctcgcgcaacagctggcaatcgaaaggggaaagcgagtacgtgttgtcgagacggccgaagaagcggccaccctcgactccgactccaaattcccagaatacaacctacatgtctcgcacatcttcggcgattctacatcgtacacctcaaaaagggagtacaaaaagatagaacgcgaagtctgctctatgtcgcagggggctactgccaagatgatatggtcccaacacaagatcaagttctcaaaggcggaccaccccaagattgcaactacacctggtagatatccgatcgtggtcgagcccactattcggaatataaaggtagcacgggttctcatcgacggcgagagttcaattaacctgctcttcgctagtaccttagatgccatgaggataccacgaagtgagctaacgcccacagatcagtccttccatggaatcactccagaatcgtcatcaaagccgttgggtaaaatcacattacccgtcacctttggacaggacaacaacttctgaatagagtagatcatctttgatgtcgcagaatttgacactgcgtacaaagccatcattgggagaaccacactcgtgaagttcatggcagcgtcccattacgcttatcaagtgctcaaaatgcttggaccaaaagggacaatcactattcagggaaacgccaagttaacggcacaatgtgacaagcggagcctcgacatggtcgagcatactcccagcccacccgccacaattgagcatcccaaaaaggtgagcaagcccaacaagacgccgaagctagacggttatcgtcgtagagagggaaagagtacaatacctggtgtactaggtcagcgaggccctccacgatgcaaaaactagatacccacagatccaaaaactgctttatgctgtgatcataacatctagaaagatacgccactacttccaagcccacaaggtcactgtcgtctcttcgtttcctttgggagaagttgtcaaaaacaaagacgttgtgtcacgcccagaaattcccgaatagaattccaagcagaatgtgcattaaaatccccgtccaggaccagccggggtacacaaacgacaaagttgccatacagatccatgtcttacaaacattataaaagtcttacataaatgcagcggaaaaacaaaagataactggagctaagccttgacttgatctgcagcgggaacaccactcacaggcatcctcgacggcacggacgaagcctactcctcagagaaaccaccatctgacgcatactcaaactctggggtttggggaaaatagagcaagactgagtactacccactgtactcagcaagtcattttggaataggggtatgatgcagggaattatcaagggatagctataatggttcgtttgcataaagcgggcatttacaaacagaagttgaaagcagtaaaatagttgtaataattaatcaatattaatcatccactgtccaacgctataccccgttgcaacaggcccaaccatccacctatactattcaattccattagactagtctagggtgagtctaatcacggtgaatctggttgaccgcccataatcgcgggcacggctattcgaatagttttactctgatcagatgtgtacaaatgtacccacaagacacagccccacgacacgtttccgtgtgccgacatgccaccacgacatactggaaagaggccgtgacaggacccttcgcataaccccctctaaccaagcacaccacacctcagatttcacccccactccttgcaaggcagcgggcagtcccttctcgtgcctaggtgaatccggaagccgcataggctgtcgcagggcccatccaaactccatcatgcccacccttgcctggatgcgtcggctagaggaaagctacactataagcccagccgttgcccacgctggcttgtggtaagtacgaggaattcttctagggtttcccgcgaaccggtccttaatggtcctgggcgcgaccatcaaaaccatgcatccacggcccaccatttaatattaattaattaaccaacaccggagtggtgagcattaaccaacatcaatcctagaatctgatatctatgcatttaatgtagttccccattgtgtgctagttgaactaagcaaagctaagcattccctagtccaatctctagtcatgttatatcccaagctaacaaaggaacatggtacaagatagcatggctatgacagtaggtaaacatcccatggtgatattataaaacaatgcagtatttgaagaaaaacaatggagcatt

SEQ ID NO: 77698 - DNA, 9625 bp, Oryza sativa
ttttttcgttttaaatgtcaccacgtgcattttcaggttaagaataaattaattaatgcatatacttcttgtttagttttagtggaattccgatagaacaaattaaaaggtcccattctggcaactgtatgggctgcttatattattatgttaaatcttagttgcctggttcttatcactcatgctcagtctgaaccactctaccttaatttgttgcaatctgcacacatttctgactctgaaaactgcacgtcgtcgttcttccatttctccatatataaattcaaggtgattgtactgcaaatctgcagcatctcctactcctagctgtacatgattgcagggtagtacgtactactaaaacgtacctacctaaaattgcagatattgttgccaaactaattaaaatatcaatatgtatacatccagatagaatattgtaacgtgtgataccacaagtgcagtttttaattgggcaagctgggtctgaagttaaatattttcaggttatctgcttgactgcttggcattagaaattggcagtgtccctgtaaagccagctattgtgtcagggcagagagaagagaaatgagatgaggcaagtgtgctaatcagctctcagctcagcatggctgctgcatgcttacctctgatcacaatactgattcggccccatgagtgagaagaggcgtctattttatgggcagacaattacggcttacacatgtggtgcatacaataaggtacaatccgctgctgcttagcatataatatagtgttgattagaggtatattttatatggtgcacacacatgttgctgggtgttggtgtggcacaggaggcagtggtaatatatattggccagttgctgtattttggggaggttgttttgtttgtgggagaacagcatgagggtagttggcctgttggactcaggaaaagggcctttttgccatagttaatttgtacttgaatcacttctagaaatgcttgtgtttacatcgatcgggttaacaacttcttttgctgtctttgttatggagtgagctagcttccatgctggattaagagttaaattacaaacgaactaaggtctttggctagctaattaaggttatcatctgtccatggggtttttaatatgttctcggttggttgatgcatgcaactagttaaccaggtaaaatcatccatggctaatccttgattacttaattggccgattaccacttcacaaaggagtaaacaaacccaagttgatcccactgtaaggtgcatgaatctcccacattatgtttgtgaagggccagcagggctccctgtggattggttgagcactttgttgacccgtggacaacgctagcttagcacggggtgtgtgcactgcgcacacaatacatctcaagtggacatatataaatgtaggaaattagcaaattaaggagaagagtattcttttcttttccttgaacttgtgtgtctgctttaatttggttgaaagtgttcgtcaagttttgcagtgtcatcaatccaaacccttaagcatgttcaacacaccatctgcaatgttttccatgtcatcaagaaaaaaaacactgagaatctggtatatacaaataaaagaaaacattaaaaaaagttgcactcctttcggccacagatataaatatttctaggttatttggcaaatattaaggtagattagaaagtattttaggcccatcattatataaaggatggttaggagaggaagggtgattgaggtaagatgtgaagaaatttatgtgagaagtaattgatgtgacaaataaatactctaggaatattatattcatagataaattaaagaaaatacttgaaatgcttttttttttcacgaagaatgatttttttaggctgaatgactaaatagatgaaatatttatagtaaattatttgagggtataagcaaatgaattagatattataaaattgaaaatagaattagaaataaattcagatataaaaagttagctacacatacgtgcgcattcatccatcattccattcctcaaaaaagtatagagattttatcacttactacatatatctactttttatatatacatatatattacaaaattgtttaaatgtatctttcaactttataatatttaattcattcatttatacccttgaacaatatttattactattttttcatctattcaatcattcaacataaaagaaatgccagtgccccttctttccacacatgtaaatattccaactatttgaaatccatccgaatataaacattcagtaccacttaatccatcgatcatctttggttcaaatttcctcctatcctaataaaaaatgtccctacaagcattttttaagaagaaattgtggacgtgttagggattgaacacaggacctcaggttgaaaccacacaccccttgctactgcactatcaagtgcatctgctctatcctactcccaactataattccccccccccccaccatccctcgtttattgagaggcatcaaagtttcttttactcaatcttaattttatctatgctagataaactaaaaattaatgtgtgtatttgtggacggagggagtatagttacctctactttgaatttgctcttaagcccggcatcccagtgcagggttaaatgcatcttccacaatttatatccgtttctcttagcgatctgtcgacctgcaatcacatgccatgcatatatggtgtgcattaacattaattggagctcaaaaggttatatagcaagagaactgaattaccaagagtaattgcactgcggcttacagctagcaaaagaactgcatttattcagtacgcttgtagtgaagtcaaagtaaaatgtaatctaggatgaaatatattaatcattttgctgaaaagtgatagtactactccaatgcattagggcatctggaaaaatcagtatgaaatgattgggacacatggtggctgatcaatttggtcaacttttaaaaatacagaaaaccgatggcagagttgattagaaatgctcaattaaaccatctaaaccaagtgttagttttgggtgaagttaaatgtctcttgcgacgatggcgcgaagtttcagtttcagagaactaggggactcgtcagagcacttgccctaagagctaagatcaacaaaaccataaacaactaaaataactgttctaaacgtcctacgtccataagcttgtaaaaactggagcattaattaactaattggagagaacacaaaaattagagtaaaatttgttaaattgtttatctgatgatcgattgcaattgggctggtagctagttgtatttgcatgcgcgcttctgataatgacgcgctagatctgtaaagatcgactggatgacttaatagtcgctggtcagactacagttaacgcactgatcgatatatacaatcttggtgacacatggattctgaatgatttggatagatcagattcagaggcaatcctggatatatctcaggatggttcgccatggagactagggaagataaagcaactgtacatctgcacgcatgcgtattgtccgtgtcaccaacatcaacatctactgatttgtaactggcagcttatatagatttatatgcagcaaaatgtacaataactgggtagatcaatcagcaacttggcacaaagcgcatgcatactttagtttgaccagcttgatcgtcagaacacaagtctacgatgtgaccatatatggggtgaagtcagcgcggggcaattcctttcgcaaatacgcgtcaatttgacgaaatccacaagtccatgtacatacatttcgtttcattcttactacgctgtgtacatgtcaattgtcaaggttagcatagctgttgtactaccgcagtttcctacatgtcctttgtcctctccttcaattttctactacaaacactgttcctaatttatggctttactgcggtacaccacaatattatttgttggaagtttggaagagttcagcacacaggacacatatatactatggccacctagccgtcattattgcaaatttgcaagtaacatgaatgcatagttgtaccaaattaagtacataatatatggtacaggtatacagtgtatagtactatagataccatgatggtacacatatgcaaatgttgatgtgcatacaccctagctaggcatgaaaatgaagtacttctgaaaacactgaacatatgctaaggtagctagattaggcccccagcacccctgcaaggctgcaatcataatgcttaagacacaagcatgcatgtggtaaaatgagggaggagatcagagaagggggaagaggaagctaaaaaagctggacagggatgtggataggtctgttgcatagaattgtttgcacgttgtatagcaaagctagcaatgcaagcagcaagggaagttgcaggtgaatattaatgaaagtaagcagcctttttctagctagtcttaagagaagctgcatgcttctgctgcccactgcatagagaaagtcctcatttgtgctttaggccttcatcagaaggaggagatgagataagagaagagaagagataattcagactagaacagaaatgcagagagagctagctaggtgcagccaaattaaatagacacccttcactctttccattacactgcaggcccaataggagcactttgataggcatcagcatgcaggagcaggacctctgctcccctttgccttttcatggcgccccatcttatatgcaaatgtcaatgtgtcattgtgtctgtatgcctaggtacagctaaatataaaagtagcttaattcagcttgatagctatgcataccagaagaagtcaagaaaccatgcacatattgctcaagcattagcaagtaaatcatggcagtacattgacgtgtgcatgagagggaaaatgacttcaattgatggatgtatatatcgacaggctaactactacaggtatcgcattagcagaaatgcagaagagttttccttttttttttgtcagtaatagctccattggttgtcctaataagccaaaacagaagctagaatttaaatttttaaagttaattgtaaagttgattttaagatattttcaacataatttcttttttatattggtttttaggtcgccacgaatttttattgtataataaatattttttgacttattaagaaatatgggaaacgacgaggatctaataaaacactcacagcaagatattaaataactgatgttatatgcgggggaagcaagtaccttttgagccgatcaattgaagcatcacatcacttgcacgtcagggccacttcatgaaaccgtgtatggtttttccgggtgttgcttaactccattttctgttcatatcctgcacacatgaatgccctgattgagcgaacagtgttgtgccttttgcacagggcaacaagatcgagaggtcccatgtatgcttgcaaggatgtgtactactacaccatatttcaggcccattaagggtgtgtttgaggagaaggggattggagagattgggaagatacgcaaaacgaggtgggccattagcatataattaattgagtattaactattttaaattgcaaaaatggattaatatgattttttaaagcaactttcctatagaaattttttgcaaaaaaacgcaccgtttagtagtttgggaagcgtgcgcgcgaaaaacgaggagctttctcacccaatgtcactggaacgaacacagcctaagcttactatatacccttagctagctagctagctagggtccttcatatatacgtgctctctactttagcagagcaaaaatttgaagaagaatctaaggtgaataatcaagcatcattaagtgagcatggcatctaataccaccctctcggctagctctagctgtatacatatatagagtagctactctagtctttatgtaggagctaggtttatagtacagggatggatcgatctctccctctcatctggcccctgagggcgcgggatggaggtcggcgcggggtcccggccggtgatggatgcttgccgtcgcgtgcgatgggctctctgtcgccgtggcatatggcatttagctagtaaaggagccacaggccggtgaggggaccggcgcctttgagaatgtgactggtgaaggctgggccggggagagctaactagcaagtgaagagaaggcagaatcaagcaaggccaaatgaatgatcgatcctgcataagtattacgttgtgccaagatggacttgacagtgcagtgacaagggatatgtgtttttaacccaagatcccatgttcaatcctccaatatgcttataatttcttttaaaaaatgtttgaaggaacatatcttcctccaaatctttttttttcttttttattaaggtgtgcctaatatactgactgacctgccatgcttaggctcccccccccccctctctctctctcgcataatggagggatctttgggccaatgacattccgggtgaggtttggcgcaagaggagcagcatatttctggtgttttatagggcatatgcacatgccatggaccaccaattatacagcattgagggcgtggccctttcaacatcatcagaacctttgtgattgattggggtctagtactatcaaaacctagctattacactagatttgtagtactaccttctaagtgttactccctccgtcccataatataagagattttgagttttttcttgcacagtttgactactcgtcttattcaaaaaattttggaattattatttacttttttgtgacttactttattatccaaagtactttacgcacaacttttcgttttttatatttgcataaattttttgaataagacgagtggtcaaacactacaagcaaaaactcaaaatcccttatattatgagacggagggagtattgttttagactctctttactcttcagaaattttagatattaacccattttttctcttatgtgatttttatctgaatgctatcacactcatcaataaatgaggtatcttgacactttcttaattcctatgcccaaatctaaaacaatttatatttggatttggaaacaaaagggaactagaagtgtttatgtttaaatacttctattaaaaagatagcaagaatcttcccagtttgcaagagaagttgggcacccacacactagcagaacaatttgaacacggatgcgtatccccagacactatccatggttaaacaccctagaggcagatggtatcatatatatgcgtgcagtatgaactatgattcatagtgaagggtcaagtgttgtcaatatatactgtttgagatatttaaccatttgccacatttagatgtgacaattaactttttgccattagacccacatgtcatagacatatgtggacccacatgtcattgagataggggtggtaaatagttatttgccaaatctaacagtggcaaatagttaaaagcccctgtactgtttagattactccaaattaatattagctgaaaagagatcacatatatgtaccctatatatgtgttttatataaagtgtgcgcgcacgcatgggcagtgcatacgtgactcaactagcttacttgctaattgactacagccatacttcaaatttttctggctataactccgcttctgataaaattttttgatgatacatcgatcatgaaatcagcattttttttaatgatcatttgtttatatgtacggatcagtgattttatgcagactatgatgtaggagcaactggcctaaacctaggccactaaactacatacattgtcagagcttttgtaataaaaaactggatttatatatataaagaaagaactgtatgtacttgatgggccttgcaattttttttttaaaaaaaagctagggttggaggagaaagctgcagcctgtagataatcctaatggggaacctgtatatgtttgataaccaaatcctttttgggatgataatctttgggctgattcaggggctccaagttgggttttgcttgtgccaggcctgcaaccgtccactttgggcagctggagtgctggaccatgggcctgccaaactattgtttcggtcgcttctacaactacgacactgcaccctgtcacctcctgcccatcccgaacgacgccacgtcaccctctatgcacacaagaatccgtcgtacgaattgtgttactaccttcgtcgcagaataagaggaaagtaaggataaaatgataaataattgtattgggatttaatagtcttttttttattgatatatgtgtaggatgagtgaaaaataaacttattttcggacagaaggagtcctaagcaactgcaggcaagtatggatcctagagaagtgctctccaagggataaagtggaacaaatgatttgaaatagtgggcattgctaccgggttgttcagatagcaacagccaaatatgcagctgatgccttgaatcccctatcaaattgcatattgactgtcctatatctgcaaactatccaccacaatattccccgcatccaagcgatacaaaatatcttgagttaaggatagaaaaggaatacacatacctccatatcttgctatattagtgggcacgttgagttgagggagatggcttcaaatggcacaccttatcaagctgatcgaaactacagtcgacatcattggacccacgtatctgcggcagatcaaataccagccacacccacagccacagttccacctctgacctctccctttcactatgcaagttttctccacttgatcagaattgtgtcacggcaggggagcaaatctgacattgctgttgctcctgctgtatgtagcccctgcaactgggtcatgttaaaagggggaaaaaaggaaatggcaatgagggatcagtcctgtcctaaacagatactccctccgtcctacaatgtagcaacctaggatagaatgagacccatcctaggactacgaatctggacatgagacatccagattcgtagtccgacccatcctagattgctacattatggaacggagggagtagagatcagctgtcacaaccatcggcttactccaactcaattgcatcggtttgcttctgcttccacaggaaatgaaaaaagacaacatccatgtaaaagtcgtactctcctttttttcccctggtacacattgtatgcaacatctcccctcttttcttgcatgaattgcttcttcctgccaattggagtggtaaacagtaaacagactgttacaatgcagcttgaaaaattcagaaggcatcctggacgatgaggttgaaaaattcaggaggtcttcccagcatacaaatcgactaaaaatctgtgttctagcccatgttgagctgataggctcacaccaaccagatccttggctggtggccggtgctattagctccattaaagatttcctctagctacattgcaaacagtacagatgtcctggacccctggcttggatattagagaagaggttgaatactaaatgatgtggaactgtactatacgtccatctccaccagattgc

SEQ ID NO: 77699 - DNA, 10505 bp, Oryza sativa
aatcagggcatcactcccatacctgacatcaaagaacaaaaaggttcaaaatcctcgcagccagctagaaaaggggcattagggtgtcacaagtgaaagaaaaactacttcctccgtttttttaatatatgacgtcgttgactttttgagatacgtttgatcattcgtcttattcaaaaactttatgtaattattatttattttattgtgacttgatttatcatcaaatgttctttaagcataacataaatatttttatatttgtacaaaaaaattaattttgaataagacgaatagtcaaacgttggtcaaaaagttaacggtgtcatatattaaaaaacggaggtagtatataacagtacacaaatcatggaactactaaaaagctcaaaagagattaaatatgaaactactaaaaagtacatgtgcaattgtttcaatcataagaatcaatagggcacacatcacatttacacagaagctcataagtagcacgagttgttgaagttcagttcaagtgaccaaccccgacggttgatccagcaaattatgtcaccattcctgcatacatagacatatttaagatttggaacatatatacagtatgaacttaagctgtagttacctttccacttccaaggactttatggatgaagagaagtcttcctggttcaacccgtaatggataatgttctgtttgataataatctgagtctgatgacccatcgtctgaatgatcttctggtatcccctccggaattttcaaggattggaaaaaccttaaagcatcatcttcgagctgcttcgtattacttgctgcttggcattgattagtggtgtcatctaatgatcttatattacccttatcgcacacgaaatctttgtgcctagccataacagtaacatcagtttgctttttaatactagatagaaacttgtcaaagtccacatccgatgagcttgaagagcccgataaacgtttaacaaacgaatagaaaggtgcagcagtatcaacatcagttttacttgattccacccgctctttgataggttctaccactacagagttcatgctatcatcaccagacttcaaagtatccatactaactgcagcagtattatcaaaaccatttgtttttttgttattacttgtttcctgctgctcctcatcacttccctcgccaaaggaacatatactatcaccacgggatctcaaaactctcaattgagtaaagacaccagcctcaacttcatttgcaatgcttctatttactttaggagattgtccatcgccagtattaccttcctcaggtagcaaggttgcactacagatagtgttttctttcacatggttttgttgtttgctaggatcatcaagcacttcatcacataacaagctcttggatttggacaagctagaatcttggacatctaatggaatagtaggaggtgcaccttcaagattatttaacttccaaagtaaggagatgctaaaaattgttgatataaatcaagccttaatagacatgcaaaatatactgacctgattgttgactgtgatatttcagtgcaagttccatacgggcaagttgaagttcatacttgagtttacacatggaagcttctgcttcgatccacagattcttatatgccagcacatgtgcatctttatcattgccagacttattttcctctatagatagattctgcaaacaagggagtaaagcacatctctgagaagaaaatcactattgtccacactaagcagatcgcaacaatattttgaagtcaatccaggatataatataaatcaatatctgtaaaatagatgttttgaaatctgtgataatatctgacagaacaggttcaacaaacttttgagcctggcaagtatttccatcacaatttatcttttccagttttgattgaaggtagttgatattggcatgatcatcgtttaatagacccttgcatgagacatagcataagcttaaatgacacaagaaataatttgattttcattgttgagtagagataccaccaaacttttgtttagcagattagcattttcagtgagcataattccaaaagtcctttggcagagttattattagaaatggaagtcaacacagtgtgctaggcattaaatttcttcagataatacagggatcatgttaagcttaaaatggaatatcagtcattgtgaatgacctatcatttatccaccatgacaacgcaatataagtgtagctatttttagcaccttcagaagaaaattgaagtgaggataaaaccatcacaatttcaaaaaccatgtacaagttaaaagctataaacgaaaaacgttcaacacagatgtgatatgaagcatagctgttaaatacaagttccaaaacttctattgattttaagttaagcaatcagtactcatgaaaaatataattataatcagtatgggtgaggtaatgttcaaaagttaaataaaatatatgtttttttctcaaaacatgaaaaaaatgaaatgtgtaagaaagagtctgcatcacaccttgcttctttttggactcagagaactgagattttgtatggcagattgaataagttcttgataagattcgtccaactcataatcaccattgcaactagatataagcgctactgacaaattgtacattgacttgattaactctgcatgatagttacatctgtaggtgatgttctcacaaaatgcattcaggtcctcctgaacaagtgagtgatgatgagataaaggttcctgaactctgctcataggcacttcagaacacagaatttcctgtgaaaaccttccagttatagaattctcaccaacattacaagtctcgccagaactattagctaaatagtttcccactattcccgtatcgttagtacatctgttccagtcgctgcaatgtctatacgcagtctgaaagccagcatgatctttctgctcatcctgcacgctatcaaaatgaccaatattaaacctacatgggtttgcatattgcaggaatcgacccttcaaaacaggatcacttggtgacggatctattcttttcatgccacatactacaggtgaggcagcaacagatggcatggataggccataattcaaagatgttgagcaggacgtaagatgtgataggtggctatcataagaataacggccatcagattgatgtatgggaacaggttctttgtcgaagcaatcaataatgctgggaaacaaagaaggcttatggagaactgatgatccaatctcactggatgcagctgctgaagttctttggtgaattactggaattttctcttccagccagcttgatcttcctgttgttgagggaatccagggatgcagctgcttgatggaactaaattgatcctccgggtatacattgtgtagtgcactatcgctaaacagaaatccatcggtatttgcagtacctgcaaattaatttggtttgtcagttgtatacaatgaaatttttgtcaaagccttggtgacaatttcttgatgtttatatttacacacgaagatagcaacaagagaaatagtagtcctcttgccaccgtcaaatcatctgtgacgctgaaaccaccaagcatcagtaacaacaagtgaacaatcagatgtctctatatgtacaactttaatgccacatacggtgagactccatgcactaaacaaaatctttatctaagatgatcacatacttttagaagtaaaaaaaatcttaatgtagtatttttagaagtaaatcgcatagttaactacccaccagtaattacgattgtcctcgaccgcacacaaaattccagttagtatgactgcacaccctaaatctacctcttataaatcaaatacacagcgtaacgcgtaaattaaaccagtgtaagatgcattcatgaactgtcaccactcaccactaccacaacacccagaaaccaaattaatcacgcagcacgtacagatacaggccctaatcacgggaggagcgcaagctagctcacctgcataccccgtctccgcgataacggggtgcatggagctcgccggaggttgcgccgaagacgagtagtacgatggggcggtggggaagtcgggccacgggctagggggtctagggctgtgggattggggtaatgttcagcgaggcggtgacgatcgacggcgaaaagaagcgcggcggagggccaggacatggccgcgtgcggcggcgccggtgccggctgggggagcccgcgatcgccggaggagtagggcatcatctcgccgccccgccgcgccgctgggtggaaatgtggaatcgcgtcgccgaagcgtgcttccgatttcaattgggtcggacgcccaacgccgcgtgggccactccataatgggcctcatggaccgtggtcggtaggctcggcccaggaagaaatgaggatggaataagttcatccgaggtcccttaacttatcgacgaatccgattttcgtccttcaaccggaaaaccagatacaacgggtccctcaactattaaaaccggtgcagactaggttccttagcggtttagatagcggttttggctgacgtggcgcctacgtggctaatttgactaggtcttcatctgacgtggcattgacgtggtgcttacgtggcaattcgatttggaaaaataataatatatgtgggacccacatgtccgtttcatacaccaaataataaaaaatggtggggcccacgtggaccccacatgtcatcctcaatcccctacggctgctgctgctcttcttcctctgttcttcgcgacgcggctcctgacagagcggggtggggggagcggcgtgaatgctgtcgcggcgacgctgtggcggcggacttgcgggaggacgcctcctagctagcagcggaggtggaggcgaacatcgcctttcccttctatgggaatccgatgatggagtccgagaccaacgccaacgcggtgcggcgcccacaaaagcggagagaggcgggagctctggagactagggtcgtacggaggggcacggagcagggtgcgcgtggacgagtgtaacatactgaaaattagctattttctaattatgcatcatgccggtttttatgttcttattaaccttctaaacctaggaaaatataattagagagagacctccaaaaattaacttgcataaaatccctctctggtatttaatttcttttatgtctttcctttaaaaatatatttggttaaattaaggtgtttctcgacttggttttaatttaaaaccttattttgacaaaattccttttattcaaatttagtttggaaaccccttttcatttgtatgaattatggtccaagaaaaccctccaaacctacactgtgcaattccaactttaattggaattaattgtcgacccatcctttgattctcgatccaaatattcaaatcctttcttttaatctagccaccaatttaattcttgtggcttgattttcttctcggcacaagaaatattattattgcaaatattatgaataattgctcttgtgctaagaaaatagattatatcattgtcatccaaatttcctattagcctcaaacaattctttgaaacacatgccatatattttgaggctaaaaccctacttatccttctccaattatcttcttcccaccttcctatttacacattcaattttattcatatatcccttaccctttcatttgagtgcatcaaataaattccattatatgctacctctaaaatattgcactcaaataattaggaaatatctctttggaaattatctccaaaataaattcatctcaaaggttagccacttaaatttcttccaaatattaatttggattttaactccatccctcaattccctacacaaattagaaagccttcctattcatttgggccgaattttctctcttccttcggcccagaccggcccaagtcggcccagcccctcccactcaagccgactccctgctcctcctcccgtgggtgcttccaggcgccgccaccgtgcgccattactgccgccgtgcacgactcagctaccgccgccgccatcttgccgtcgaagcgaaggaaccgccacccgacgtcagctacacttcattccgccgacgtcagcaacagggacgaaccgccatcgtcggccaatcagaggacagagcccgcgccgtcattcttttctccacgtcgctgcagccgtgtcctcatcgaccttctcctctgaaccgccatcagccaccacctctcgccgcctataaatataaggcgagccctccccttttctccacacatcaacagagcctcgagctccctttctctctctccatccatggccgatcgtcgacgccgtcggtcgatctccccatccgtagctccacctcccctatcctcgcgccaccggcttcgcctccatccggcgagtccgtttttcccctttcccctctccctccacctttaagtcaagccaccaccgccatcatccatgccggctcgaggtgagcccttgccgccgccgttccggctatatatctctccctctcggccagccaccgacctccccgggtgcgcgtcgctcgggaacacgcgtggccgctgtcgtcgaggccgttcatccaccggagcatcggcgcccctcctctcccttctctctgtttgctcggctggaagagaagaagaagcagaagaaggaaggaggaagaagaaagagaaaagaagaagaagagacaaagaactgacaggtgggcccctgtacagtactatttcataatttccctatttaattcaaattctattctttagaagtccatatctcctaaaccgtagatccgattccagtgaaacttggacctaaattcatctaaattcaaaatctacattttgatatcaaattttctattttaagattttatttgaatttattcaaataccgtttgaatttatatttgacttttcaaatattttcctttatcccaattaccctttagccactaaaaagctgtcggttggaactttacgccttccatggagacattcgcggttttctatccccgacgttgaaccgttggttgtaaagcccggcataaaccaaacccaaggtcaaagtgctgctcctggcaccccacgccttgatgcgtatagcggtcggagcttcactattccatcgacctccatagcacgccgcacagttagctctcggactctgtgtgatcctagccgctccgctgccacccacggttgtcgaagtaacacttccgccctactaaacctgcacctacctcctattccctctagccgatatgatgtctgctgacaccggctagagaagacactaaatctagtcgttatgttgccaactctagcaacaactagcaaacaaccaaatcctagccgataccctgctagtcaaatcccaattgtcatccaaatttcataccctctacaataccacttatccaccatactctcagcctcatactttttgtctatcagaacctatacataaaatatagagcctggccgatatattgccctactcctcaatcggcctaaatataaccaaaccctaggtataatcttacacaaacctaccatcagccaataccagtcacatatctgctcaaccaattcaattatccactatactccctatccaccaaccaatcaaagtctgcacataaaatataggtgatcttagccgcttaattccctctccaccccagctgccaactctttataacccacacataaaatatcagcccagtaatccatataccctataaaagagataggctatacactaaatcctaaccctcccaaccgtttatctctttcttgctattttatggcttttattgaatttggttcttcctcttctgtagtagagtctattatattttggatggcaacctgtggtatttcaaagatcagataatcaggttgcctatctcgcatttatttgcgttggagcaaggcaagttattattcctctcctttgagcataataatcctatattctatatttccagtatcttgtgcattagccatacatgattctaaatgcataacctgaatatatagcaaaccagatatatgctagattttgcttagccatgcctagttagattacataaaatataataaacttagattggaatagtacggtagaaatggttgatttccgggtggctagtactgttccaaccgacataaaattgccaagtacatgtgaagaacatacgagtacgaccgcaattctcgtatgggcatagacctagctgattaagttatctagcaaaggtggtacctctatacaatggttctattttaagtcctcgagcaggaggcaaatttacgccgagcagggcgattgtgatatttaccgaggcacaggtaaatatatgagatttattgatgtcgacttgtttgtgaaccctgattgcgatgacatggtgtcatacaatcagttctctctaaagaccttgggaacgctagaactcctctcgctgctgataacgttacgttcagagcgtatggggactagagtttatggaacaggtaccactgatgttagtaaccgaaaagctttgccatgacaaggctaatgtgtttggcacgtcatggattgcgggtaaagcgtacatttactgcagtaaagtataaatgaatctattcgaatagccgtgctcacggatttgagtattgagactcatatggtatttggttagaaactttattccaaactttattaaatactgttgcatttaaaacattttaggctttcttcctctatattctttgctttctgcaagtaaacctagctctactcagatattaccatttcatgcattcattattgaatataatagcttgctgagtacgttgtactcacccttgcttcaaccctttttttttccagagtcaatttaatgttcttaccgaagccgggagttcaatcatataagttagtgtcatttcaatctaattctcaagtctagattagatagatggtttaagtctatagcaaaacattagagttggctcattctatagcttctactgtaatagttagccacaaatttgtaaatacccgtatattttgtaataacatctcctctggagccttgttcaaatgtatgcaatgaagatctagattgttgaacctgtatcaatctactgatccagggcttgatacagtctaaacatgtcggtttccgaatcattagtttcgggacccgacaacgagggggagcgccgcctgggggggagcctgctgcggggtcgccatggccgccatgggtggaggtgaggagggagacgagtggattctccatgtctcgatcgccctctcctggcgccgcgaccttccgcatgtcccgccccaacgtcgactacctctacaccaagctcaccgccgccatcgccaaggaggacgccgccctccgagctgccatccccgtccgccagcacgtcgccgtctgtgtccgatgcctcgccatgggggagccactcagtaacaggacgcggtgcttcccggcaggccatggagctcatggagggttaagatgaaatttactgtgggagttcgcttggatatatatttttttaaaaaaatcatgagctgcaattaggagtccgatcgtctcaagttaatatgcgagtttttttaaacaaatttcttatatgattccttatgtattaccaaaagtgaacaaaccgactcaaatacggatatgtatttccaaaagcaaacgaacttaaaaaccgactcatatacggatgacgtaccaaaataccggcaaaaacatcttcaattgttataatagtagagatttgggtcaaattgccacgtaagcgccacgcaagtgccacgttggacgaagacctagtcaaacaatacacgtaggcgctacatcggtcaaaaccggggtcaaatactgccgagggatctcgattgcactgttttgaaagttggagcatgtgttgtacccagttttccggactagggacgaaaatcagactaagcgacgaaaatcagacggagtgacaaattgagggacctagagtgaacttattccaatgagagtactacgtacttcagttggactgggccgagaaatgcagatgaaattcaggcccagttacgcgtggggagcatgagcatgagcatcatcttcgggcagctgctgctgatgtgttgctgtcgacgtcgccgctaaccgtgctttcagctcgtgatccgatcagatcagatcagtcgatcaatctcatcgcctccgcctgaacaaattcccggggtttcctgctttgcttagtagccaaggaataatccgccgagccgggtatgtacgatcgagacgacgacggcataaagcgtgtacacgccgccagccttgccatggtgatggtgtcgtcaaaacattaatattcccccggccggcgaggctgccggctagtgcgccgggaatct

SEQ ID NO: 77700 - DNA, 953 bp, Oryza sativa
atgttgtttgaagttgtcatattttcaaattcaaatttaaacggttcaaaaaatattatatagaaaaatgaccaaaataaaagttatagatcttgatgagttatacaactttgttattgatgacattttcagttgaagtcgttcactaacaaaaaattctgtttgaatttctcaaactttgaatttcaaatttcaaattgtttaaatagagtcggatggagaaatgaccaaaataaaaattttgcatctcgatgagctctacaactttggttttggtgacttttccatttgaaattatttattaaccctaatttttgttccaagttgtcaaattttgaaaattcaaaatctgaattattcaaatgaacttatttgtacaaaggaccgatacaatagttgtagatctcggtgagttatacaattttgttgtttaggatttttgatggttgtgtatgtgaatgaatgtatatgaatgagggatgttggggtgtgacgtcctagcctagggcttaataggattaatagaatactcataccgacaagttacaacttctcttccggaagctgatctccaaagaactttgatgttaagcgtgcttggcggcctgagagaggctagacggcatgcctaaaaataaaatttattttttttgggattatactcatctgtgactggcattaacttaggcccgattgagatgactcatctgtgacgggcattaacttaggcccgattgagatgactcatctgtgacgggcattaacttagacccgattgagatgactcatctgtgacgggtatagttaatgcccgtcacagataagggtcatctgtgacgggctatagtttaggcctgattgagataggtcatccgtgacaggctatagtttgactgatcgtctgggtcaaaactatcggtgacgggctttaattatggcccaattgagatagg

SEQ ID NO: 77701 - DNA, 716 bp, Oryza sativa
aaactgtcgttggggagggtttggggatccccgtgcttactgttgatgaaaaatccgcgcttggctgatggtgctagaactgtattggcgcgaactaagtcgacgaacacaacggcctgagagatctgcttagctccagtgcaagtccaaaggttcatgagatacagcgtgctaccagtttgatcctgcaactgacaagatatacaaatagcagatcaatgagccgatcggctgataagccgatggagtaattccagccgatgccgataccagccgatagcaataggattttgagctatcggctatatgtttaatgtagaatatgacacttgatgtaaataatgatataaagacaatcggttgatgatgatgtaataaaataataatataacagtattccctctattacagattataaggcattttgtcccatcatgattttttttcctttgtcctattctgattaaatcacgtccgatatctttattccaaaactaccgtcctgattaagataggagccaaaacatctcttgcctaccgcaagacctatcttgcatcttcccaactcgtgtttgtgtatccaagactcccatcctagctccaatgtcttccaatcttctcccaaatcacaataccgactagggcacgaccgatttgcctcctctgctagggactctttgtcacactcaaggagtcccgacgtcaaggtcgtgtct

SEQ ID NO: 77702 - DNA, 5050 bp, Oryza sativa
ccccccccccccccccgcggagcgctttctctctttctttctcacctgcactactgactactgctgctgctactcgaattcgacccattcagctgcatttgtgctgcgcccgcggtatggagcagcagctagctagagtgaggagagtagctagcacactggtcgctagctgcttctggatgatggataagggaatggatgccattctcaatttctcatagcaggagagagagagagacatatggcgatgcagatgaatgcatatgcgtgcatggatggaattggctagggggtgtttttgattttacttaattcgatcgcgacgcctttagctatgttgccaaatattcgagcaagttgaaatgggtggtaaggtgaactggtcatgtgcctcgctttctatctggtatcgtcgaatattgcaagtggatagaagatggtaatttactgaacgtaacggtagtcggcaggtggttttctcaaggtttttcaggtaagcaaacatttgtggagtatattttaatatatgtgtttttttttaaaaaaaacattgaaagactcctgaattttgcatatctgcatctcatgtcctacagtaaaacagttcagcaacaggagcaggctacttatgcttattccttgaactttcactgtacataaaacgaaaaggtgtttcaagagtacagcaactttcaacttaataggagtacagcaacttaaaaaggactgaagtttatctactagactactatagtcttgtaaagcagagagttggcagtttgatatttttaagatgtagacttgcagaggcagtgaacttccatcttgttttactatcgaccccttcaattgcagattgtagtgtcttgtgagctcaacttcagcagtaagcaagtttttcttgcttttgatattctcagcttttaggatacgttactttgcacctttgaggtgcagttctcttccagtgttctgccctgacacacagtacttgtgtttgttcagaaaagcactggcttttcctctaaatctgactttgtgtttagatctgattccagcatggcactgcattccattcgaaataatagtttgcttaccttcagatacaacttaaaaattacttactggaaaagaaaagtatattgaatgccaaaatgaaatttcctaaagatttttacagtactgcatccacagtggaagttttaacatacctgtcgtggaaacgataaagcagagaatatattaggaaaaagacaggaaaaatatttctttcagaaaaaaagaaacaagaaaaaaggattggaaaactttttcaacaaagtaactttgtctctatcttctcttgcaaaaaaatatcaagaacgttctttttaaaaatatcctaccaaattgttattaaccacctaagaagtactttattccatggggaaaaaaaggtaacatcaatttggattctacctaaagtttatcagaataattatccttaacatagacatatcttctccattaccacctttttttttgtgaaatacacagatttttatcttcaaaattcccttttgttcttctccatcacctgactgttcatgttttagcaaatcccagtttcaccattgcaatttcttccatttttcatatgactaacaccaagctgaaatttgttctctcctttattttaataaagctaaagtttaaattaggtgcctacaagaataagtactttcaaaggctgtatatattatctaagtcctttcaacaactttgccatgaaagaaccattcgtacatccaaaaataacccaaatcccatcatttcaagttcactcagcggaccatccatccagcatctcaaagaaaaaagaaagggaccatccatcagaaccaattataccccattactttcattcaaaaattataccccattactgatcaagctgaatacactaactcaaatggaagcctgagggagagatgtacaatgattatagtgcgcaataagaaattaggaatcgatggttggtacttaaagttgacaaggcataaatctttcaccaaaaatttaaaagataatcggatggctctgctcagtgtaatctgaataagatatcaagctgaagaaacatgaaatgggagacatgggacaggcccctgattaaatcaaaccaagacaggaaaacactggtcaaaagagcagctttaggtttaagttgcttaattagttggcataatgaggacgaggccatagccgaaagaatttgcagctgcgcttattataatcatcagataaggcaggcactattcttaacagtttgaccattgaggcttcaaatatttcatcatgtaggtgagatcaatcaaattaatggactatagcttgatcacatagcacatgttcgccgcatgaattcccggcaccgcatgtcaagttgcactacgttcaattcgattacgtgtagcgcatttcctgataaacgcattgctggaatgctagtagtcactagctaattaagcatacgtgagcaaacgattcgacattagtttttgcaccgaggtatgaactgtgaccatcctatgctaattcagccactaacaactgttttagcattgccaacttgtcttgtcaactcaattatttcacaagaaaaaaaaagactacctaagatagctagatgctctgataaaagcactattattgcatcaacactgtgagaggttccaaagctggaataaacacggcagcaaaattcagaaaccaaacagacaggataaaattacacagagaaagcaaggaaaaaattcctctgagagtcacagagattgctaagttaagagcacatgcaacagtggtgcatgccctgcgtacaaaagcttggacagaataagcacaaggcataatatcattgagggaggcacgagctttggaactcgttccaaagcgacactggcttgaaatctgaagaagagaagaaaaaaagagtcgcgagattttttagaatatttcagagaactttgcctttcctcccaaacctgacatatattcctccaacaaacacttttcctgccttctgcaccacttctctcagccggtcaatcactaagcaaacacttcgtttttgcagagaaatcagtcactaaacactcttgatactaaacacttgataagcctgcatttacataatctcttgtctcccacgctttgcagtgacagtgtctctgagtgtttagtaggcgttgcaatcgagcgtgagtttcgaaagggaaaaaaaatgacaccttgcatgcgtgattctgaatttccgaccattgttctgttgttggacaattggtattgtaatttgtaaagaaacatgaagaaacgggaacgctgaaatgtgaacttcaccaaaagacactcgctgccattcgtgtccgttctgatgcaaaaaggctagacacgagcatcattcgccagctcatttccctgcatcttgagaatactcgtctctctttttctagcataattagtacttacctgtaacaagattccaaggattaatccacggatgatgtggcagaacaggtgtactggatcaatcctacgccctttcctcacaaaccgggggccccctttcacccccatttcaagcaataaaatgagggggaaaggcaagggttctacactacactgccactgcaacaccctcttctcctcttcctcccccaaaaaaaagcctataaaaaagtataaaaccattgcaccatcgagcaaggcagtagcagtgatcgaggagaataaaagcagaagtagtagcagaagcaagaaaacactttgagcatttttgttttgttctccttgcagttacagctgaagcagcaagcagaagattaaccctcttggctaagattcaggttaacctgcagcgagaggttagctcagctcagcttagcttagcttaagctttgctcgagcttgccgtgcactccactgtctcttttccggtggtataatttggtgcggcggtgagctgccggccatgtcgaccgtctcctccgcgctgtcgtcgttcctctactgctgcttctcccccaccggcggccaccggcacggccaccgcgccggcgcgtactactacagcagccacccgacgagcaccaacacctactactacgagggtggcctcgccggacgcaggatgggcaggagcaggccactgtcactgcaggtatttgttcttcttcagcttgctcgttcgttcttgctttgcttgctctgttcctcgcttcctctgtttagctatgctacgcatgcagaagacggacatattctttgttcagatgaatacgtatttgcaagctagcttgtttatgcgatattgcgattgcgactagtcgtgttcagattattctcctcagatttttgtccgccacttctgatgctgtctcctagcttaacgctaattaatttcctagcatatgctcgtagcgataatctgtgctgctgtgcacgttgctgtctagaacagcccgcgaaaccaagctcatgcatgcgtgcgaaaaagagagcgataaaaggttgaaggaaaaaaaaagggcaacttacataggacaagggaaacttttccctcggcttgccgcatgcgccggtgttggagacagtaaaaatgtactcgtaccagtagcaaaatactacagtaggtgtatgtatcattcatgcgtgcgattgattgaattgctgcatgcgagtacatacagtaaaatatgaacggttgtctcctctgttttcccccagacagtggagctcaaggttcggatgtgctgctcaggctgcgagagggtcgtgaagcatgctctcatgaagctcagaggtatagtttgcaaatctcaattatcataaaaagtttttgaatcttggcaactaagggtttagatcaatttgttgtgacaaatttttttggcaaaagttttggcgggtaaaaaatttggcattgaagttttactaattggtgcatagatgcatggtaaagttttgtcattttactagcaaagagagagagagcacggctcccaacgtg

SEQ ID NO: 77703 - DNA, 8043 bp, Oryza sativa
tttggatctaaacacagccgtagttaaattcataaatatggataattctgagaatcgggtttccatggacaattcatgtgatgatgttcctccgtgtgagtatagcaacgaatgggatgccagccagggtatcttcttgtgctcgtagctatagctagcagcagctaggtttggtcgttggtgattgtggttatgccagtttaaatattctccactgctggctgcatctgcacgatgatttgatggatagtactactccagccaccacagagagaaaaagcctgggaataggacgggagcatgatggtgttcgtggagcctgcggaacatacaccaggccaccagctgccaaaactcagccgccaacaatagtgaccctaaaattaaaaggcttactactagcttcgagctcttcagttcaaaattgaggaccgattttagttacaaactttttatttgaacttctaactttttcatcacatcaaaacttttctacacacacttctaacttttctattacatcattccaatttcaaccaaactttcaattttagtgtgaactaatcacaccctgagttcactcttccaactttatcagatatataggcactcgattcagaaattccactctcaaaaatcataacacacacgaacgtttgagcataagaattcaatctatctttgaggtttcaaactaaaatcaggtggtttttgtggtgttcatgtataagctcatctcctcacgttctactccaattcacgtgtgtataggctgtaaattaaaaaactaaaatttcggcccatatgtttacatgggccgtgacgacgcctcgagtagcatattggcctgaagccctgaacacggatgagaaaaaaaccggaaaaaacttggccgatctcctcctcaccgcacggcaaaggctcctttcccctttcccgcaaggctcccacgctgacgaaatcgacgccgatttcccgaaatccccaatccccaatccagaatccactcgcttttcgataaaatttctgttgattgcgtcgaaaccttcgcaatcctctcgcacgcatcacgccttgcgcgccgcatctcgtagccctgaattttgatttgattctgctgcctccggcgcgcccctgattggcgaggaggtggtggtggttgtggtgggtgcggccatggcggcttcgacggcggcggcggtggcaccggactggtggaacgacgtgaacaactcgccgatgtggcaggaccgctccttccacgccctcgccacgctatacggcgccgtctcgttcgtcgcgctggtaagccctagccctacgggacacgttagaatcgatttaggttttgaaaaacatgggctaataataggggaggatattgggtcgtgtagccgagcagtttggaagtttcgtctttaattgtctcgatcgagggcttagatttgatttaagctgatgttttgtgcgggaactttgtagcttaccgtatgcttgaattgtatagtgatggagacatgggcatcagtctcatttgagtcgtttgcacttttgggagaatttttgcaggtccaattgatcagaatcgaatgtagagtacctgagtacggatggacgacacagaaggtgttccatttcatgaactttattgtgaatggaggtgagcatacttttgcactttgccactgcttcattgatacatgctagctttttcggaacttcagtttatgattttggactggtttgtttcagtgcggtcaatcgtgtttgtgctccgacgagatgtgcaacttgtgcagcctgaggtttgtggggggaacagtttatgtttctctgacttgtttctgcaatttttttcgaaggtgcaaagtaggaatgatgcgtaaccatatggcattgtaggtatttcaacatgtgctcattgattttccggggcttgcattcttcacaacctatgctctgttagtgctcttctgggctgagatttactatcaggttagttttacttggatatattttggttttgtcccatgggtgtttttgttctcattggttcatgatggcatttgttaggcacgggcaatgtctactgatgggctcagaccagctttttatacaatcaatggagtggtctatgcaatccaggtgactttgccatccacatttcttactgttgatataattgcttctctctacaaactcatacatgaaactcattatcatgacaattggaaaacttgttactggacggatcatccattgataatgtaaagtgattggatgagtcccaattgaattgttatgtttgatagtatgctatcagaaaaaaggttaaacagagaaaataaagcaaacactatcataaaaccctcgaaataagttagttagcgtagcatgattccaactgactaaatcttgactgcataatgtacaattactcatcattgcacaaatagtttattttattgtggagacaatgatggctgttagcttgtggggactccctggatgtacactttctgttgtgctacattttggtgggcatggatgtcaaattaacctaccacttgccattcagagcatttttcagtgtggacatgttcacaaatttctaccgtattgagagcatatttcaatacatagaattacacaaagttttgctacctttcctttttgaagtacttttggaatgatctgatctttgcatgattttcagataatactttggatggcgttgtggtggaaaccagttcgagcaatggtcatcttgtctaagatgttctttgcaggtaaatcttgtgtaatttgccttgtcttgcagttagtatggattttttattttgaatgagagcttgtggaaatcatagctggagatagatgggaaaactatctgatcataagttaaaaaaattctcgcgtacgtttagttcctcacatcccctaaatattaatgaacatgaaggaaatacattgagtcatgataaaccaggcgtagtgcaattttgagttttcttgttatacatgataatttatcatttattctactaatacaaagttatttgccagcgacatctttatttgctgcccttggatttcttctctatggagggaggtaagctgtccttggttttcttatttttgttgttttgggtgtttgtcttttgaattatggacaagaaattagtatgcttctgaagttatttcccacatgttatgtccatgagcttttgtatattggattatttggaaattggaagtaggcatgcctgggtgggtgtgcagttattgggtactggttgcggtgattcttttcatagcatgttacttagtgtaattttgtggttatctttgtaggctatttctgatgttacagcgttttccagttgaatcaaaaggaaggcgtaaaaagttgaatgaggtactatcttttatcattggcttctattccagaattaatactttagataatttgcatttctaacacatctactttttcataggttggatatgtgacaaccatatgcttttctggcttcttgatcagatgcgtaatggtacgtcctatgtcaatattatgttagggaggtcttcagactttaattactccacttaattagagcatcttacagatgtgcttaaatgcgtttgataaagaagccgatcttgatgttctgaaccatccaatcctaaacttcttctactacttggtatgtcttcctgttcacttgctttgtactcaaccttgtagttttatacattgtttttgtttatctcgtggcatttatatcttgatctcctctaatgtcattgttgtttaatgttagaggctctgtgttggtcattttaatttgccatgttcgaatgttcacatcgaggaaatcatttcttacataattttaactggtgtcaaacaagggataatgctagaatgtgatatagacttgtggaagatatgtttcttttgcttgtttttaccctgattggaacatggggcacatggtgggtatgctgatatcctaattaagtgattgtgtttacaaaaagagctgaactgaaattctgttgggaatgtgactcaaggaaaaatggttttgctacattgtataaaacaagagaggaaactagtgaaagctatttatttggcagaacacagaaattgtatgtgcttatctgtgcataagcattccaaactatagcatattgattttgccgaatgagtttacaaaatgcttttgctgttggagtatattcagattgtatgaagtaattgagactcaagacagtcactgccatatttatttgcttttgtaagaatggtcattaaaaaatggcttgccaagaataaactgcaaaagcaatttctttgtcgtgttattttgaatatgtctagaccaataattgtacttactgagtgcttgttgatagcgttcattttctctttggcagttggttgagattgtaccttcagctttggtgctgttcatattaaggaaactaccacctaaacgggggatcacacagtaccatccaatccattagatcagtccagggatccccaatgtgcccttgcaaattgttccttcaaactggtgagtacagaaatgtaaatcttaaccacggatttctttgtaggtaggttgcttggttttcatgtgaaaaaagctcaacaaaaattctgggatatatatagtttgtaaaaagtctaacatcccgtcatcccaaattcctgcaattgctgtactgcgacccaggagtattctgcaactacaggttttcttctgtaaactgaaggacaaatatgctttgattatttgtttgattatttgtaataatgtcagctttggtttattgttcctggtaaaaagccccttgcacgcttcctcctgactccccagtggtacacattgttcattactacctttttttagcctggacaatactgggcaatgttgtgttccttggcagagtattttcccttttacaccttcctgttcactggattgcttatacaagctctgatgggcctggatgtgtagtagacattgggcctcgttaacatctgtaaacttgagcaactgatattccaaagttgatcatagtgcgggaagtctagcaatgaactgttgagaagagaagatagatccatgttttgctatcaaacattgcaattataggttttgccacccaaaaggtatttacatacataatttgctgagttttatgtattacttttagtttcctttgttttcaatctggagatcattttcaaattgatcattagctgaaactggtagaaacaggacagatgtgctgagcccttgacattcaagaaatttatcaaattttcatcacccagttgtcaaatatgtttgggtgggtatgagatataggcaccagattgattccaatgaaccaaagccagtttggtcgaatccctaataattgtctgatcaaagaaagagagaaaaagagaacacatcgaaggtgacgaatcatgagtgaaaccgccgttaagcaaatcatattacgaacagtggcagatgatcatataataaggagtagcaaattctagagttgcaaccttcgagcgacaaataggcctaaggaggttggagaaaattacgaacctccaggtacaagttaccagtgttattagtcctctgtccgtcccaaaatataagagattttggacggatgtgacactatatccaaaatctagtgtcttacccgtccgaaatcccttagattttgggatgaagggaatacgtggaaggaacaaatgagtatatgaaagaaaatgaaagcacgcacctgtcaatcaggtcgacagcttgtatataccgggagcatcaaattcagaaccacacgaacaggttgtccaattgacagcagaggaatggagacttggagagggtataaacaaagctcatcttcatcttaggccttaggagtgcatttttagaggcttctattctgactggtagctgtgtgttcctgttgggaatatctcaatccaactgcgattcaactcccaatctaactgccatttcccgtttctgttgggagtagtagcgttaatgacgttggaccagccctgctggactgtttatgaactattgtacgtctgaattagtaattccaactctgctttacttgtccggacaaactctgacgaaattcttgtaaagatcttgtgaaatttgaacattccatatttccattctacatctactactgctacatgcaacacaggattctggtccaagacagtaaaatgcttggatgctctctcggatgccggcagggggaagggatcggcaggacgggcccaacaggaaggactcgtgtgcagacaccggacagagtgagagattgctgtgctttgggcagcagatgtgtcagtgtttatccatccattcctcggctaccttttgacagcaagaaatggatctccatagaaaccgcatggccccagcgaattcagcatccacggattctttgcttggatttgatgttcttcttcttcttgtgctatgctctctccttcaggccatccatcatgctcaagtctgaatactgaatccatggctttggctgatgctgtcatccatatagtgtgtgtgtgtgtgtgtgtgtgtgtgtgttttaatgcatgattcttttattgaagtgcattttctgatgagtagttaccgtggatgattgacttctaagcaagtgcggagttggtaagttgtaccacagacagacaacacgtatctcatgtacagtacagttcagcagggtaacgtagtacccttgctaaccagggtcgacagggactcgcagtagttgtaaatgggacatatacactgatagtggtactgttcattcattgattaacggctacacctacacctttcctttcagaaacattattgtggtcatgttattaattatagagaaaattgcaaaaaccaccccgaaagtcacttgaattttgacattccaccctataagtcattttgttgtaaatacccacctgctactaagttttgtttcaaaaaccaccccaatgcgcacgtgtttaaccgaatcaattcgttattgctgatgtaggattaccacaggctaagctagccaagtcaatcttgtctaagtgcttgcattagacttattttccatatttgattgattttttttttgcatatagcaaaactcagtgcaacaatgtttaggctctcgtcaacaattttatatgtggaatctcacaaaaaatgtatcacgaatactctagaagtatttagttttggcaaaggccatattgatggctcacattttataaaaatatgttgattcggttaagcatatgtttaccggggtggtttttgcaacaaaattgagtaggtgggtggatatttgcaacaaaataatttatggggtggaatgtcaaacttcaaatgacttatggggtgatttttgcaattttcccttaattatatgccaaagtagcaaattactccctctgttctaaaaaaactctttttagatgccatagcaacggtcacttaacacattattcaggtaatgttttttccccaactgtttttactgaactgattagtgctaacaaaacgagcggtaactcgccggtgatatatttttcctggctgaagtatgatgctttaccactgaattacatttggggaaaatggcctagcttagagtagcttagcaaacatccacacacaaaggtgaaaacctacaaagacaaccctgcacgcttatattttggaaagtagtatgtagtggtagttggaagatcaccatccagaaatgcgttgagctcccaacttgggacctatgcgtttgcaggaattagtggactatggaggtagttggtgccggccggccttacacttctttttttttttttgaacgaatgccggccttacactcctgaatttgctactccctttaaatttcgaattcagacggcatggattttgattataaattaccactagctcgtagcagatggttcttggccaccttatccatgat

SEQ ID NO: 77704 - DNA, 727 bp, Oryza sativa
ggcttcttcttgtttttcttcttcttcttcttcctcctcttttcgccggggcgatgaaacctgttgtcgaaactagatttcggcaataataaaagggggtggctatcaagctggaaaagtgtatgggttttgagacaaaggatttatacaggttcaggccttcttataaaagaagtaataccctactcctgtccggggatgaatccgccgagtgtattattgattgtatgattcgagaaaaatcaacatatgcccctagaggcgcccggaccccccttatatatgggaaggagtccgggttacaaaagataatctatatccctaacggaatatgaaaatataggtaagatacagtcgtaaccgactaagtttcagggtgtttccttgatacacaagttaagaaacaaacccaagatacaaataagaaattctatctacattaggtatcctgtgcccagctcgaataccatcgccgtgtagatatgggatacccatgatctccacagtagcccccgagtcctttgcagtcgaccatcgtagccttctcaaagatgataatccgagtacttcaaactcttcaagccaaaatctgccgagtggactgtaaagggcgaaaagataaagaatatggtgcatcgaatagatgcacctaattaggtgtagcccccaactatgtgattagttaacaaactaaacatatagttgaaagacaaaataataacacaat

SEQ ID NO: 77705 - DNA, 1639 bp, Oryza sativa
attgatcatcaaagtggaaactaaagcgaccaggggcaagtaatctattagtagatatgagcttaattcgagcagtaatgttttgagtgggtagcaaggtatcagtaggaaaagcaaagctttcccatagaatggtgtcacctttgctcttcacgatgaggtttccagtattcaagagcttagcttgaacttgctccgcatttgaagagctcacgttgttggtccacacaacctggccattataatctttcaacagcatgccgccatcggatttcaactcaaattttgattcccatgtgtacacagggtggagaggatttgcgctccagacaacagttttctcggaggagtttgagaaccagatggagaaggtggaggcattggggagatattgtagaagccacaggtgaaagtacgatctggtgagtagagcagatccaagctgcgttcaacagagagaggggagcctggcaagagggattcaagagctgaggaggagtacaaaagcagatggatcaatgtgaggagaagcagagaggtgaagattgcatccatggtggttgccgcattcaagctgatctttcaaatgacaagcaatgcaagctgttatcggaactagctgcccaaacttgcagaaaaaagtgagattctaacattctatatactactacgaaggtgataagactaaattcagtctgccagttattttgcgtcaatgggcagtttccttggaccaaactatgcaatgcaagtaccatgttggcaaatgattcgtgtatacatttccaacctgttgcacaagtggcactgtggcatgacgtgtccttgtcaggatccgtaaatctggacagtaaaataagatttgcaatatggtaatgagttcagtgtacttcaccagtccataggtccatcctaaacggctgcacatgcacatattcatcccccatttccaaagaagcctgacttctaacatgacggggaagctcaggctttgaacatttgaacacaaaaataatggcaattggccatgctaatttttatttacatgtggtacttcatgcattgtgagtttgtgattgggtccctttcagctttgagtatactcacgtggaatcttcaacgagagatttcagcaagcatacacagtaaggagagtttaataatatttttttattggctgaacaaatctgtgaagacatttcttccgatcaaatgcccattgcttgaacaaaacatttacatccttacctaaaataaacaaacttaatacgggacgtggacagattcatcgactttgttcgtttgttacctttttcagctcacatccccaattttcacatgcacgctttttaaactattaaacagtgtattttttaaaaaaatttctatacgaaaatttctttagaaaaccatattaatacatttttttaaaaaaagctaatacttaattaattatatgctaatgagtactttctgactgcaacaaacgaactcagccttaaagatataggcaacatatccagacagagtcacgaaggggatatcaatttacaccaaacaatgctgtaaaaacagcttctcagacgacacagcacagcaccagggttcataattccaataaagaccggtcaaatacagt

SEQ ID NO: 77706 - DNA, 18038 bp, Oryza sativa
ggccatggcggtgctcaccggtgaccggcccgaagttgggttccggcggcgggatccaacgaaaaaggggtgaccggggtggcccgcacgacggcgaacgcgacggcgttgtcggcgcggctcggcgtgtcggctactgacgaccggaacggtggcgtcgtcgtcaaaaagaagggcgatggcgctagggcgttagagggctcgggagggctcgacgagatggggaaaaagagagaaggggtggcggtggtgcttaaatagaggagggggagcccggacgtggccggtagaggcgggaatcgccggccgacgtggggaggtggaggaggagagagaggtgggattcgaaatttcgaatcccggccgtctcgggcgcgggcgcgtgcgacagggagggggagtaggtgcggaagacacggcgcatgcgctggcgtggctgacgtggcccggagaaggcgggaacgtgggcgcggcggtggttgtggagcgcgtcggcgccggctggaggaaggggatgggcccgataggtgggccccacctatcagcgaccccgggggagaggagggaggcggccggctcggctgggcctcgacctgtcggccggctcggctgggcgtcggcctgtcggccggcccagcggaaagaagggggggaaagagagaatgggccggcggcccaattgaaagaaaaagagaaaagaaaaaggaaaaagaaggaaaatggattttcctgggattaaatattgcttgtgctcaattttaatcggttaaaattatttctagagttatgagaattccactaaaaatcttgttagcgtttttcgacatgtagaactcaagaaaaattccacatgccaaatccgattattatttgcattaatttattagggttttctcttgctcttacaccggtattttctctggtggattataaattcaatttaggcttgggaaagaacttcagggtgtgacaaacctacccccctttaacggaatctcgaccccgagattcggaggagctggtgaagaggtgcggatgggcggcctttagctcatcttccctttcccaggttgcttattcatctgagtgatggctccactgaaccctgcagaacctggtgaccttattcctagtcctcctttcactggtctcaaggatacgaactggcttctccacgtaggtcagatcttcttggatgtcaatgtgctccgaatcggcttgttcttcgagtacccttagacacttctttaactgggacacgtggaacacgtcatggataccgatcatgttggatggaagttctagctgataagccacttctcctcttcgttccaagattttgtatggtcccacgaagcgtggtgccaacttaccttttgtctggaaacggtgtactccccggagcggagtaacacggagatacatgtaatcccctgcttcaaaagtgagttcccttcggcggttgtccgcatagctcttctgtcgagactgggcaattctcaacctctctctgacggttctaactttctcttctgcttccgttaacacctctgttccgaacagttgacgttcgcctgtttgattccagaagagaggtgtgcgacacttccggccatacaacgcttcgaacggtgccatagactggcctgatagctgttgttgtacgagaattccgcataaggcaggcttttatcccatgctccaccaaaatcaagcgcacaagcccgtagcatatcctctaagatctggttgaccctctcggtctggccatctgtctgtggatggtaggctgtgctaaaattcaaacgggtccccaattcttcctgcagcttctaccaaaattttgaggtgaactgactccctcgatcagatacaatcttcttgggtaccccatgcagacacatgatccttgtcaggtacagctctgccaatttcttccccgtatatgtggtatgcactggaatgaaatgagcaactttagtgagtcgatccacgactacctagattgaatcgtggccagatgatgtccagggcagtcctgttataaagtccattccaatctcctcccatttccattccgggatctgaagaggctggagtaaacctgctggcctttggtgctctgccttcactcgttggcaaaagtcgcagagtgcgacgaattcagctatttcccttctcatgctgacctaccagaacttttctttgaggtcttggtacattttggtgctgcctggatgaatggagtactgagtctgatgagcctcggtgagtatcaaatcctttagttccttatcgtccggtacacataatctttctccaaaccagattgtgccgtgttcatcttcgtgaaaatcctgggcttttccgaccctcatgttctttttcagctctgctatttcaggatcatttacttgagctgctctgacttgatccacgagtgtaggtcgtgcctcgaggacagccacgtacccgtattctacaagccccaagttgaggtgttcaagctcctgctgcaattctttacacatgccctcggtgcatagggcattgcagtagctcttcctgcttaatgcatctgccaccacattggctttacccggatggtaatgaatgctcatgtcataatctttgattaactccaaccatcttcgttgtcggagatttagatccagttgggtgaagatatacttcagactcttgtgatccgtatatacttcgcaacggttgccaatcagatagtgcctccagatcttcaaagcatgtaccaccgctgccaattccaggtcatgagttggatagttcccttcatgtggacgcaactgccgcgaggcataagcgaccactctgccctcttgcattagaacacatccaagcccgtggcgggacgcgtcgtagtagacttggaagtctttagtctggtcgggcagaatcagaactggggcggttactaatttctttttgagcttctcaaaactctggtcacactcagctgtccatttaaatttctcatttttcttaagcaactgagtcatgggtctggcgatcctagagaaattttcaatgaaccgacggtaataacccgcgagtccaagaaaacttctaatctgtgacacggtcttaggtggggtccacttggtaactgactccacattcgacggatcgattgccacgcactgagctgtaatgacgtgacccaagaatttgacttccaatagccaaaagtcgcatttactgaacttggcatataactggtgttcctgcaacttctcgagtaccagatggagatgtcgttcatgttcttcttccgatttggaatagataagaatgtcgtcgatgaataccaccacaaacttatccagaaattccatgaacactttgttcatcaggttcatgaagaatgcgggtgcattggtaagtctaaaagacatcaccgtgcactcgtacaacccatatcgagtggtgaaggctgtcttgggaatatcctcttcccggattctcaactggtgatagcctgatcgcaggtcgattttagaaaacactttagccccttttagttggtcgaacaaatcatcaatccgcggcaaaggatatttgttcttgattgtgacctcattgagtgcgcgataatcgacgcacattcttttcgtcttatccttcttctccacaaaaatgaccggagcaccccaaggtaaagtacttggtcgaatgtaccctttctgcagctgctcatcaacctgcttcttgacctgtgctagcttgttggttgccattctgtacggtttcttgtaaattggggcagttcctggtgccaaatcaatccggaattcaagttctctcttgggtggcatggtagtgaggtcttcaaggaacacttcgggatactcgcagactatggggatatcctccaatttctgcaaacccttctgctcggtggtcacagggttttccacttcaatctggtttaaggagattctctgctttggtgagactggtgacatgtacaccacggtctctcccttctcattggtcaaggtgactgtgcgattcgcacaatcaatgactcccttgaacttggtcagccaatccatcccaagaatgacatctaagtctttggattcgagaaggatgaggttggctagaaatggtgatatttgaatttctattagcactgaagggctataactgaccgaggttgaactatttcctggggtatgaaccctcattggtgtactaagcttttcttttcttaacccatgcatccccacaaatttctttgaaatgaaagaatgcgttgcaccagaatcaaaaagtactgtagcagggactgagttgacagaaaacgtacccagtacaacctctggtgctgctcgcgcctcctctgcggacgcgtggttgtcacgagcctggacaaaccttggcccgacacgccttggcttcgggcatttgtcagcaaagtggccaagctcgccacagttgaagcaggaccctggctttgttccagtctccttcttggcttgggcggatggagctgactgtgctggtgttattggtgggcgcggagctgctctgcggttgggctgacctccatggtggttctggctgccactggcgccctggtggaagctgctcgagttgaaagggcggtgctggcggacgatcatggtggtaggtccactttgctgtctgggagtgaagcgcggtcgcgggtggcttccttggttggaccggaattgcgctgcctttctcttcctgtccattttgttgcactgatcctcctgatggattgctttgtcaaccagcttctcaaaatcggcgtagcctccagagattaactggttggtcagctcgtcatctaggcctgctaggaatttctcctgcttctcggcgtcagtgcggacatcctccgatgcatatcgcgctagccgattgaactcatggagatactcagtcactgtcctgttgccctggtggagtgcctggaactcccttttcttctgtgccacaaccccgtctggcacctgcgccttcctgaagttgcgacagaactccgcccaagtgacttccgtgcctggcgggcgggtagccatgtgattgtcccaccaagctgacgcgggaccctggagctggtgtgtggcgaaggcgaccttctcctgatcattgcactgcaggagatttagcttcttctcaatggcatggagccagtcattcgcctccatggggttggtggtgctagagaaggtgggtggcctgacgtgtagaaactccggcagtttggactgagggggagggggaccaaactattgctgttgctgctcggcttgctactgcatcctctggtgcatctgctggtgctggtgctgcatctgttgcatcatggctgccatcatctgagtctgatgagccattacttgggccagagtcggattctcggggagcagtggcggaccattgccggagtcgctgttgggatgcacaccatcaatgcgttcttcgccgttgctgccctcgcctgctgtacggctaccattcctggtgtagaccatctggaggaagagcggacggaggggggggggaaagaagagaaacaggtgctcaggaactaagctttattatataggaatttaaactgcaattgttctgatctgaattaaaatacttaaaacagcaggcaaatccttattatgacagccatatcataggcacatgatattgaccatcgactgacccccaagcgaacagacctaaacacacaaactagcagacaaaaactaagcagtcgataaactaagggaaagcgagcctaatactcggaacggctcctgcggtcggtggagtcgagggcgtcctcctgctcgtcaccacgtccctctgagcggctcctggagtttggcagatacatctcgccgctgcccggctccgagccactggaactgctgctgctgtggtcgcggctgccactgggagtagcaggcaaccaacccccgttgccactggctggacccctggcggctaatgctggagcgaaggagagagcggacgcgggagctgacactgggacaggagctgggactggagctggagctgcaggagctgcgggaactgcgggcggaggtgggttcctgggcgcaagctgaatgcgcacgggtgccgtcgtcgacttgcggggcgtgttgcggattcttcaactgagcattctccttctttaggcgtgcgatctcatccttcttcaggcgtgcgatctcatccttcagagctatgatcctcacgagcttcccgtcattcaaggccctggatgccttgcgcagatccgagtgcatcctgtccattcccctcatcacggcacacatatgaccaaaggtggtgtcgttctcgccggctgtcgaacggaaggtgctgacgtcgtcgccacttgcttgacgagggtgaaaccggtacgccgtgttgcagaagatgtagttgtggcgctcccgtaatctggccatcatcaggtatgctgcctcctgacaggcgtgatctgctgtgcctccggatgcctcaaccaccatgttagcgaggcaggtatgcacatagccatgaacctccaggcgaacacggtgagggaactcgccactgagcggtggaacagtcgaatactctggcgcattggggtagcccaccaccagtgtcatgcgagccaactctgccacaaagtcatccatgccttctccgcgatggttgggtgggtgatcggccatctagagaagacaaaggggtaggatcaatgcatgctcaaatccaatttaaatgaaagagtaaaagactcaattaaaataagcgaataagagtggaattttatgcatagatcatttttgcatgaaggcgaataaataagacgaacttacatagcgataaaataatgagaaaattagatacatactaataataataagagcataaataccttgcaacccatattcctgagttaggacctaatgcattcctcccatcaaatcccgactgactgtcgaataaatcccaagtaattttactaaaagcctagactgacctggtttggcaaatcccacttaaacgggcgaccaaaattttcccttgcaccacaagaacagatcccaattttcctagaactaatccaattgcaaagaacatatgcaatgaaaaggattcagagggctcttaggtttttccatttggcttgtcctacggcccagaaattcccgaatagaattccaagcagaatatgcattaaaatccccgtccaggaccggccgaggtacacaaacgacaaagttgccatacagatccacgtcttacaaacattataacagtcttacataaatgcagtggaaaaacaaaagataactagagctaagccttgacttgatctgcaacgggaacaccactccacaggcatcctcgacggcacggatgaagcctactcctcggagaaatcaccatctgacgcatactcaaactctggggtttggggaaaatagagcaagactgagtactacccactgtactcagcaagtcataccggaataggggtatgatgcagggaattatcaagggatagctataatggttcgtttgcataaagcgggcatttataaacagaagttgaaagcagtaaaacagttgtaataattaatcaatattaatcatccactgtccaaatagttgaccacccataaccgcgggcacagctattcaaatagttttactctgatcagaggtgtacaactgtacccacaagacatagccccatgacacgtttccgtgcgccgacatgccaccacgacataccggaaagaggccgtgataggacccttcgcataaccccctctaaccaagcacaccacacctcaggtttcacccccactccttgcaaggcagcgggcagtcccctctcgtgcctaggtgaatccggaagccgcataggctgtcgcagggcccatccaaactccatcatgcccacccttgcctggatgcgtcggctagaggaaagctacactataagcccagccgttgcccacgctggcttgtggtaagtacgaggaattcttctagggtttcccgcgaaccggtccttaatggtcctgggcgcgaccatcaaaaccatgcatccacggcccaccatttaatattaattaattaaccaacaccggagtggtgagcattaaccaacatcaatcctagaatctgatatctatgcatttaatgtagttccccattgtgtgctagttgaactaagcaaagctaagcattccctagtccaatctctagtcatgttatatcccaagctaacaaaggaacatggtacaagatagcatggctatgacagtaggtaaacatcccatggtgatattataaaacaatgcagtatttgaagaaaaacaatggagcatttgcaatataggatcaacatgttcaagtgacaagcatgacttgccttgctctgcagctgaaggaacttcggcgactatttcaaggtacaccagagcgtcgggagagccgaaatctaagcgacatacaaagcaaacaatacaaacaagctataagactactgaaacagagaacaaaaccatttttaatggattctacacatttttcttgatttactgagacatgaatgggcttaaacggagctcggatgaattagatatgaattttagaagattcactgtgtttttactataaacagaaaaatccttaattgaattattgcgcaataaataaatcccgggagagagagggggcggcgccgacatgcgggccccacatggcagtgactcgaggagggcggtccgcggtggaccgagtccacgaaccgggaaaggacgacgcaccacgtggctctgacgtggcgccgacgcagcggccacgcggcagccacgtgggcggccgtacggacgaccccgatctacccaagggtagattggacggcgggtgtggctcgcggccggcgtgcgcgggcacggctcaagccggcccggcggccatggcgcgcggcggctagcggcgcgcatgcggcggcggcgcgagacggcgaccggccggcggcggagggcgacggcatcgcggcgacgcgggcggcgaagcggcggccaagcggctaagcggcggcgtggcggctagcggcgcgggagagagaaagaggaaggggaggagggacctcaccgacgacgaccgacgacggcgagcaacggagggcggcggcgacggtgggacgatctctggaaccacctagcgaacacggtggaaggggttagagagggagagggaattggaagagggcgaggacgctggccgaaggcggcggccatggcggtgctcaccggcaaacggcacggagtgggtttcggcggcgggatccaatggaagaggggtggacggggtggcccgcacgacggcgaacgcgacggcgtcgtcggccggctcggcgcggcggctagcggcgaccggagcggtggcggcggcggcgaagaggagggcgacggcgctagggcgttagagggctcgagagggctcggcgagatggggaaaaagagagaggggtggcggtggtgcttaaatagaggagggggagcccggacgtggccggtagaggcgggaatcgccggccgacgtggggaggtggaggaggagagagaggcgggattcgcatttcgaatcccagccgtctcaggcgcgggcgcgggcgaaagggagggggagtgggtgcgggagacgtggcgcatgcgcgggcgtggccgacatggcctggaggaggcgggaacgtgggcgcggcggcggttgcggtgcgcgacggcgccggctggaggaaggggacgggcccgacaggtgggccccacctattggcgaccccgggggagaagagggaggcggccggctcggctgggcctcggcctgtcggccggcccagcggaaagaaggggggaagagagaatgggccggcggcccagttgaaagaaaaagagaaaagaaaaaggaaaaagaaggaaaatggattttcctgggattaaatattgcttgtgctcaattttaattggttaaaattatttctagagctttgagaattccgctaaaattcttgttagcgtatttcgacatgtaaaactcaagaaaaattccacatgccaaatccgattattatttgcattaatttattagggttttctcttgctcttacaccgatattttctctggtggattataaattcaatttaggcttgggaaagaatttcagggtgtgacacgttgtcagccgcattgccaaatgggtagtcgagttaagccaatttgatgtccactttgtgcacagaatagccatcaagtcacaagtcttagcggattttgtagccgattggactatcccagatgacacaccgaccagtcaaacagacaacgaaacttggacaatggcattcaacagtgcactcaacagccaaggagctggaaccggatttatcctgacatctcttacaggagatcagttcaagcacgcaattcacctcaatttccgggcaacaaataacacggccgaatacaaagcgctactcgtagagataaaagcagctgctgcgcttggctcaaagcaactaatcatgaaaggggattccgagctagtcgtgaaccaagtacacaaagactacaagtgctccaacccagagttagccaaatatctcgtcgaagttagaaagctgtaacatagattcgacgggatcgaggttcgacatatctactgaaaagacaacatcgaaccagacgaccttgcacggcgcgcttccagacgagaaccactcgaccccggaacctttttagacatccttacaaagccttctgtcaaggacatgcacaacgaaagcaccacagccaacaccgacaacaggccgggggctacaaaggtcgcatatgtcgtcgcaaacatagagacaacagacaactagcgcatcccgcttatcaagttcctagagtcagatgagctactggatgacgacacggaggtagagaaactatcctgttaggccaagatatattgtttgatcggtaacgacctatacaaaaaggccccgaatggcatcatcctcaagtgtgtatcattcgacgacggaaacgctctccttctcgacatccacgaaggcatttgtgaatcgcacgccggtggatgcaccttggttggaaaggactttagacaaggtttttttggccaacggccctcaaagacgcctgtgatatagtgcaacgatgcgaagcctgccagttcttcagcaaacacactaagttgccagcacaagcgcttcagactattcctctgacatggctgttctcatgctgggggcacgatatcctcaggccatcccacgaggacagacggctatagattcctgtttgttgcaatcgacaaattcactaagtggattgaagtagagccaacaaatcaaagccgacaatgccataaaattcatcaaggggatattctgcagatatggattgcctcaccgcatcctcacagacaatggctcccaattcaccaacggtgattttcaagattactatattgaactgggagtcaaaatatgctttgcctcagtatcccatcctcagagcaatggacaagtcaaacaagctaatggaatcatactccaggggatcaaaactcacgtgtatgataggctcatggcctacgacacaaagtgggctgaagaactccaatcggtcctatggtttgtacgaaccacaccgacttcgtccaacaaagagacacctttctttctcgtgtacgtatcagaagccatgctccccacagagctacaacatcaaagtacacgagttcggaaatactctgacgaagagcaagtggaaaggcgaagcgacgatgtgaatctactcgaggagcatcgcgaacgagttgccatccgagcagccttgtatcagtaggccttacgccgatatcacgagaagcgcatcagagctcgtacacttgccatcggcgattacgtcctccgacgagttcaaaaccaggcagggcggaacaaactctcgcctaagtgggaaggaccgtacacggtggtacaagtcttatgaccaggtgtgttcaagattgcagatggcgatggctgcgaactatccaactcttggtacattgaccaactacgaaaattctatgtatagaatcaatgtatccaagtctgtaagcatcccttacaaaacatcatatcagtaaaggtacctaaaggtattttgagttcttttatgaacaaaacatttctaacagtgttctacccagagatcccttaccacgataatatctcatgttgaaatcaaacctaacgaccctttacgccattctaacaagcctctgagaaacctacgagaatttcgactggggacgaccagagcagataaggtcttgtcagaatttaagagctgaacgaccatgtaaaacctggtcatataagagtgctcaatggttgcgtattaactaagccatgtaatcggaaattgacttttccaacttcacgactaggggctaggtaaatcgcagtttcaactaggcaagtttcgggtcgctaagccttctcccccgagaacgattttcttcgaggacaagattgggggctagggagagttcccagctcgatagcaggcaagaaacggcttgtacagagagtagtactcatacacacaataccttgcttacacgcttagtagatagagttcaatcctgtttacagagcttaaataaaaatatccatagagtacaaatctttttctaggtgtttcttttacaagagttgaaatctaccatgacggccattgccagttgttgatgcgaaaaacacacactggcctggaaaatatgcttaactcctgtgcaggtccaaaatcttgcctttaggttcgtgagcgtgccagttgatttgatcctgcaatcaacaagaataaagacaagaaaaaccgtggttaaatccataaacgatagccgatcggctagttgccgatgacatatcatttatcttcgtgctgatgtcatgtttgaatcgatcggcaataatgaataaataagataaaactaaatctactcgatcggctgtagatattaacaacatacaatttttactttgatatatacttaaactaagtgattggaatagatcgttcgccatgccgagacagtataaatcacttaagtcgaaatatatattagagcaaagattatatagatgtttacaacatagccgatcagatagatctagcacgtatcggctaatactccgatactactttatactaagatatcgaaacaagcaagatatattaaataatgaacctaatataacttcaatgaaacaagatcttaatataaagggtagatttagcgtaacaaataagcatacgagacgtaaaatagctaaaccaggtaagatcggttgaaactccgatgctatctctattgatgattataaaacaggctagatatcacaatttcagatagaacttaatagatcgaactcaaccgatgcagcattaagcataaagataactgtaagatctaaacaagatgatgaaaaccttttagagatggtagatacacgatataatctagatcaatgacgaaatctaactctatcggctactccctatcaaaagaaaccagccgatgacaagttatatagcgcaactaacaaagattataaagtatatgtgataactcgacgaattacatagacaagattagagtttcataaagatggaagcactaatcccgagaacacaaaccgtcatggcaagtttacctctagttgaagatcgaatcgatgcagctcaacccgaaagcaagaactcgtcgaaatagaacgaaagtaaaagggtggcgatacgccgaaagtgttattgaacatgtgttttttgattacatgggttcgggtcatattaatacccaagatacaaaatatgtccttgccggacacgactcttatctctaacaaactctaagataccataagtctttgcagcagacttttgcccaaacatatctctatggaaattacataagttatcataattaatagatacaattgtctatctgagagctttatgtccattgtggcaattctcatgaagcacgttgatcgatcctagaaacagctttgaaaccaactccatcagaatccgctgtgccggctccatcggctgtaccggctccatcggctgtatcaaccatcccctaaccgatccaacatagccgatgccttcacagctgatgcacactctattcttcaacatctctttgccgaatccgcttcgattccaatgtcggacctggttcatatcttaccaaatttggtcgttaacaccagttcatggacgcaaagatcttctcagccaaaggagcaagggaacacgccagctgatcgagttcattcgccgacaaccgcgaagggtgaaacccttcacgcaggaactcgaggttcatctgcaagcaatgatctcggatgcaggcaagcacgtggtccccggcatatcggctggcgtggcgacactcctccttcaggtagttgttgatctgctggccaatgtctcctcaagctgggcacacgcgctcttcatccaagataggtagcccgccgtggtctcctcgggctctgtgcgatcaatcttcagctggcggcagacctcggccactgcactgcagcaactcttgaggtatgaattcaaccagacttcgcgatctcggagcgcttctacagcttgacccttctttaccaccaccatggaccattcgaactctgccacctcaaatttcgtttccgacaaaggactcgacgatctcgctcagcaatcatgctcttgaggtctggaaaaggcaagggtttaaggaaattctcccatgaggacatatgtctggagaatgcgaaaaacctaaggcaacccacttgagttctcttggcggagcgaaacacgcgcccaagcccgatgggtcagagatgacattcgtgttgtctaacacgacaatgtccccgacaacgtcagaagcaggtgcctcgctcagcaaggccaaatcggttgtcacgatatcagggcgtccgccttgctggacgtcctcggcatcaaaacatctacgaagaaaaaggacgctacgaattaacttaccatgacatcaaaagggatgactattctaccgtggacaaaacaaacccaaagtgtttatgcaaaagacacaaggatacaagaaaggaaattactcctcaaatagaggggggacaatttccccgagatccgccacgtccgacatctcgtcctcacacgtggcatcggctcccccttcgacagtatctctttcagatcagcgtcaggaagggcgagcttcacacacgcgagcacctgacaagcacccgtgtggatcccgttggagatctcctccgagactttggcggcgtgtttggaggggatcacttccatcgcctttgccagcttggacagggatgacatcacggaggtctcgtcggggtactccgggatggtagacttgacaccacacatgagagcaagctggtggaggctggtgaagctcttccggagcgactcgcggatggagaggatgtgatcctacatgtcattcatccgctgctccaagccttgtcactgcatctcgttgttggccatgatttccctcatcttctaaaggtcatcgcgggcaacatcgagttccgactctagctgggccacccgcccatccgacgctgtagcacgggcggctatgtggtccatctcggcggccacctcctgagaagccgtttcgaggaggcgccagccttcggtcatcatttgtgaccaggtcaatggccccgtcggagtaggaggcggcggtgcagccacgggcatgacggcggacgggatggattcggcgacaacagctgcggtgtccacgcaatgagaagcggcagcgggagtcacgctggtcgcgacctcatccccgctctgtgcagagatcgctgaggccgtcccgccgacatcagaaatacactcaaaagaccaatcaacatgacaacaaaaggaggtccaggattccacttacctgctagcggctctctttattatcctcctcttcggaggaggagggagacggcccgtatcctgagtaagatggaaaatcaagatctcacccccattgccctgcaaggataaataaggtagcaagatagggatggaatggcctacctcggagccgctggatttctgacgagatccggggccgccgatcgtacgagcccaacctttcctcttgagcccgctgccttcagcgctacaggtccagaggcgacggcagcgacttcctccacgactttctccttgagagaggaggaagtctaatgatcgacaagggggcctatgacatccgtcaaaggtagaacctgcgggagttgaagtcacttcgtctcccaacaaaatgaaaaggcgaaaggcgttcggttcactcacattgatggcgtccaccttgtcggccgctgacttgtagcagaggggagtgggcagttcatcggttgccgagacggggctgatcagcacgtctgttgacggtcgttatcgatcagtttcgatcatcaatattaccaaaatagaggagaactagttatgcttgcaatgcatatccttgttataataataatattccactagtattaggtatattgaccttttgcagggaataaccataaagtggaggagaatcaacatcaacccagacgataaatcaatcgaacgatgtcgagaatcagacttatgcatgaatgggccaaaaactcagaattgacacgatcaacgtccctcacccgctgcatcacgacatcggcggaaagatctgaaacgcaaggaaaaaggtgaagatgggtcaaaccgagaacacgagatagctattaaagagaagacgaagactgcaacacgagaacaagtaccccgcgacgagatccgtgtcacgtccaaatccccctcgaaatcgaacgcggggtgggcgcgggcctggagtgactggatgcgccgggcaatgaagtctcgagcgacatcatactcagtcaacccttgttctcgcaggccaccgatgacattaaggaaggcctcaagtgaaggggtcaatagaggtttggaggtccagcactcctgacgctttggttggtcctcaggcacgacaagaaccggatcgagttcttcaagctcaagatagaaccacttcgatcgccatttggtccgggatgtatggcattgaaagggtatgtacctcgctttcataccgtcatgtaagcgaaacccacaacatcccgagaccctgccagtttccatccagtggagttcataaaagaatcggaaaaggtccaagaagggcactaccccaatgtaggcctcacaaagatgagcgaagatgctcaggaaagcaatggaactggggttgagatgtagaagcgtgaggccgtagaaattcaggatcagcaaaagaaattccgaaggaggaggcaaaaaaccacaatggatgaaatcctctaccactaccatacgacctagggcaggggagcgatcagcacctcttttctctcttgccatggtctgtttggaagggagggctcagtcggtgtgaagcttcttctagctagctgcgtcggaggaagacttgccgaggtccgccattggaagaggatcaccggaggaagatgaagaaacttagggcttttgggagacgaagggttcgaggttgctagaagactggaggattttttggaaaacagacttgaaatggatcccaaaacccctttaaataggcgcactacctaacggttcgcattccaaggaaggagagagattgccgccgaaaaatcctaaggcccgttaagggcggttgttcagacttcaatttaaattcatattcaaaccgttggactccctctagcgttgttgacgactacctgtctcctcggttttgcgccgagatcgactaagtacgacaaggcgctggcaggagaagttgcgagcgacaacgtgaattc

SEQ ID NO: 77707 - DNA, 653 bp, Oryza sativa
  unsure (1)..(653): unsure at all n locations
aaccagtttcggccagttccctcagttcgacgcactaccataaaaggtaccactccatagttgttggtttatttgaaatcgacacctattaccgtttctcatctctataaagaaaagtatagaaaaaaaagttaaaaactgatgccggtgtgagtttcatttaagaaatgacctatatttatattataggtgttagttctagataaaaactgatactacctataataaactaaaggtgttggtttttaaaaaaccgttacccgagccaagccgaaacaagcgagtgccggccccaatccccacccttatcccctggcccacacccggcctcgtctctctctcacatacacctctccaccggcatnctccctttctcttctcctctgcatncgacttccttcttttcctctagagccggctgtagcggtggaagaagctcggccggccctcttttttccgatggcccctccttcttttcggtcacccctccctcttcttcttcagatcccgtgatggaggcagtggtagaaaaagcccgtgtgggccaagtggcggtcggtggatatgctccatcagctggttttttttattaatttattgaatgctataagtactagttgggggttaagaacttgcacctataatctctacag

SEQ ID NO: 77708 - DNA, 749 bp, Oryza sativa
atcacaacacctgtagagattataggtgccagttcttaacccacaactagtacctatagcattcaataaaataataaaaaaaaacagctgatggagcatatccaccgaccgccacctcgcccacaccggccttctctaccactgcctccatcaccggatctggaggagaagaggggagggtggacggagaggagggagggccatcgggaaagagaggggccggcgagcctcctccaccgctacagccggctctagaggaaaaggagggaggcggatgcagaggaggagaggaagggaggatgccggtggagaggtgtatgtgagagagagacgaggccgggtgtgggccaggggataagggtggggattggggccggcactcgcttgtttcggcttggctcgggtaacggttttttaaaaaccaacacctttagtttattataggtagtatcagtttttatctagaactaacacctataatataaatataggtcatttcttaaatgaaactcacaccggcatcagtttttaacttttttttctatacttttctttatagagatacgtcttgcacaatcccaaatccttcaatgatatttcattcgagtgcttgaagaatttgtttggtggagttatagctttatcggccaggtaagcgaatggcaatgactcagagatgagattaacccccacaggtggattggtaaaaaattaacgttgttcccctctaggtgacaaggaagggatct

SEQ ID NO: 77709 - DNA, 10690 bp, Oryza sativa
cttaacccatgaaatcatttcttttttgtttctttcttttccctggtttcttttgtttttttctcccttccatggcattatccggtatggctggttgcgttgtgtaaacaaattcttattcttcaaatataatgacgtgcaatccttttgtgcgttcggaaaaaacccatggaatctaacttattgtattcatagttataattaccatattcaagtcattaccagaggatgaaaggtgctcatcagagaataggaggtacatgaacttccatgtatatccacgttcgtgaattcggcttgactttttttttggtttgttggaaccatgccaccctatatttgtaaaatttgagatatgctacccgtatctcaatgacatgtaggacccacatgagtcaataacatgtgggtcagggtggcatattcacaaattttgtaaattttgtgtggcatggttcaaattgtccccttttttttaaggattacaggtgactaaaatctagcaatatcctctgcactggttactctgggagtagttagtttcacttattattattttttcgaataagagtttcacttattaattaggccccggcatttggtaatgaaactaattattaatcacgcggagttttttgcttcaccgtttaaataattggatgtcgatctcaagaatctgatagagctagcacatgatgatgtatatactacccccgttttttaataaatgacgtcgttgattttttctcacatgtttgactattcatcttatttaaaaaattgacgtaattataatttattttgttatgagttgttttatcactcatattactttaagtgtgatttatatcttatacatctatataaaatctttgaataaaatgaatggtcaaacatgtgataaaaagtcaacggcgtcatctattaaaaaatggagggagtatatcgatgccgacaaggcgagatggatcaggttttccaaatgttcagatttgtgagccccagcaattaatcatgcatatatatgcatttggtttcatacgatacacacgttgtcaaacacatggatgaccctgctccggaacgcaatagcaaaagaaaaaaaaagtctcatttctttctttattaatgctttgaagttgttgcgtattagcctagatatatatgtaattaagttgtcataattttattgtgcacccagatggcaggactaatacgcaacgaaagagaagttgcaggagttaaaggcaacttcttttttgcggggggaaagaaatatattactcactcataaagttctcgcttaataaatgtgagataagattacaactctctcccaaccaaaatccagcaagaaaatcagctctagccgtatttgcaagatgatggctaatgcaattctggctacgacatattttcttaatagaaatcaccctttcacccacaagcagatgcctcacttcatgaatgatgttggctagaacagaaaaatctctaccggtaccctgcagaagctggaccactgaggcacaatctgtttccacctgaatcggaagcaaagtccaatggatcgccagcttaagcccttcaacacaggcacgcagctctgattctagcgggttgttgcatctttcaaggggtttgcaagaagtgaagatgatatcaccagcgctattcctgaggatcattccaagaccccccttaccggagctagcgtcaaaggatccatccacatttaatttcatccagccatcttttggtctctcccagcatggttggtgattgttaagcactcgatatttaggccgttctttcagaggtacagtcctcacgacatgcttttcttttatcaggtcagctagaggagcttgcagtttctggatcagtgaatcgacatagctctgcataaatctctgtgacgtctccgtcggcggggctgacttgccatgtattagctcattcctcacgtaccagttgcgccacagagtcatcaagaacatggcctgttcatattctggaattttttcaaggcaatcaaacagccaaaaccttcctaaaacagaggcctttatatctactgaaacacttcccgatttatgcatacatgaccaaagctggctagcttgaatgcacctgcagagagcatgagcatcgtcttcattttccctgtcgcagatttggcacatatcagattgttccaattttctcttctttttatttaccatggtcgccaggcagttggaggccaccctccaagcaaagattttgaccttttgaggaaccttgcatttccaaatcatctcccatgctttgttaatattatttgtcccagagctagaactttcttttatattcactaactgagctgccaatctgtaagcgcttcgaactgagaacataccgttcttattagggtgccaggcaatgaagtcttcctccgatcttgaagaaatgcagatgttcagtataacctctgcatccaaattatggaaatactgatggattttcggcacatcccaggatccatcttctgtaattaggtcagacacccactttagtctgcagtttgctttcccagtgattggtcttcttgagtgatctcttggcagccatggatcccgccagatccgaattgaatttccattacccactctccaaataatgcccttttttaacaaatctaggccatactcaatgcttctccatgctggggacgagttactcccaaaggaagtgtcaatcagggaaccatgggggaaatattttgctttaagaactctagcacacaggctatctgggtatgttatcaacctccatgcttgccgggccagaagtgcctggttgaaaagccgatagtctctgaaaccaaggccacccaagctttttggtttcgttaacgaatcccaggctttccaatgcatttttctctggccgttcatggaatcccaccaaaagttatttgttagtttcgttagatcatcaataacagattcaggtaatttaaaaatccccatcacatatactgggatggcttgaatcacagccttgatcaacacttcttttccacccgtggagagatggttctcaccccattggatcactcttttccaaatcttagcttgcagactctgaaaacgtcctttgtgcatccgtccctccggggtaggaaatcccagatatctatcttcaaacctgtctctttccacttgtaaaatttctgatatagcctcactgacagccggggtcgaggctcctcccatgaggatagaacatttggctgggttaattaattgtccagtgcccatggcataggatgagagcacttcttttaccacttccgcctctctttggtgtgctttaaagaataagagggtatcatcagcaaagagtaagtgggaaattccaggggcagctctgcagactttaaaaggggtcaaagaattctgggccaccttttccttcagcagcaatgacagtccatctgccacgaacaaaaataggaagggcgagagaggatctccttgccttaaacctctagttggagcgaatgattgaagtagggttccattgaattttaccatgtatctcaccgaggtaacacacttcataatccagttaacccatcggcgagcaaaacccaacttattcattgccatctccaagaaacgccaatccaccctgtcgtaggcttttgatagatccagtttatatgcacaagctgcgtggtttgccttcttgttcttttgcatagcatggaaacattcaaaggctaagagagcgttgtcagttatcattcttccctgcacaaaggcactttgttccacagaaacaagatcatctaggatcggtctcaatctgttaaccaggcatttggataccactttgtagacaacattacataagcttatcggccgaaagtctcgcaaatctactggttgttccttcttagggataagaacaatggccgtatcattgaccccttcaggcatcagtccagtttggaagaaacggcgaactgcaccgattatatcagctttaattgtgccccagttgcgctgatagaacctggctggaaagccatctggaccaggtgatttcaggggcccaatttggaaaattgcctgagaaatttcatcctccgtaaaatcctcacaaagcttctcattcatgatatccgtaaccttttcctggataagacgagtaacggtttcaggattaagatttggatcagcagtgtacacatcctgaaaatattcagttgccatgctctccaacttattgtcgaactgtgaacagttccatttgcatcccgtagtttggagattttattcttctttgctctccatactgcctggctatgaaaaaatttcgtatttcgatccccatcctttagccaattaactctggaccgctgcagccacagcatttcctctctgtacaacagctcgttcatatggtctgtcgcattgcgaattaccgttctgtcggcgtttgattctataagttccgccaattttttccgagccttctccagttctcttcctacatttttcactttggctctgctccaagatcgcagcgctgtcatgacctttgccagggctttgttgatgtcttcgagatcagccttttctcccgcaactacccaggcttcctcaattacctgggtagcttctggttccctctcccacacaatctcataatggaggcatttctgacgaagttggtggggatctttcactaccaggttcagcaaaattgggcagtgatcagaacatggggagacaagatgcacaacctgagcggtagagtatatatctctccatttatcatctgccactattcgatcaagcctaactttaacattcctccatccctccctcttattatcataagtgtgtgatacacctttaaatcccagatcatgtaattcacaatcttgcaggacatcacggaaatcctgcatttggggttcaccccgtggggttcttgagaagtgttcaaactgccacatagtttcattaaaatcaccaatgacggcccagggcaaggacgaagattggtggattgttctcagcaacgaccacattcgatgtctattctcaacacggggttcaccatacacaaaagtaacatgccactgtggttcctctggggacaattgcacatacgcatcaatatatcttttattaatatctttgacatcgactaaaacagactcatcccaatacaaggcaagaccaccactcataccttcactgctaacaccagtaaaacccctaagacccagtctccctcttaagcgactcatcttctccacactttgtctagtttcacatagaaaaaccagtcgggaactcgcctcctttgataaggcacacagatctcgaactgacgcagggttccccatcccacggcagttccaggctaggcaactcatttctcctggcgagaccctctcataggtcccgccagtttaccagcagcccctgggctggttgcttccatgtcttccacgccaatgtttgcctccactcccttcttgagcctcttcattgcccgtgttgagcttgccgtttcctccgctcctctctggccatactccaaaacagcctgctggacaatgcctgagctctttgttgtcggcaaagctttcctctttgttgggcttccaaattcttcagtagagccatctccaaaggaaacttgctgtacattcaggtctctaattgctgggatcatctccattgaaggtattgagctggtttccttactaaccaaatccttgcccttcttctgtccaaggcttgacacctccgagacgtgcagcatatttgtctggtcagcaagttgactatctattgagtcttcaccttttccttctctaatatcaaaaccatcaaaagcatccacccttgtgggttgatcttcatatctcttagcatcctgtctaatacccgctgacgaagaactcacacttcctgggcccctgaaagacaattttctctgaacaccttgagaatgaactgcttttactttacccacttttctctcaaagggttttaagggcgaacaacggagttcagcagaaaatactaaaggctcattctcatttgtcagtctcttttcgcattctttatctgagtgtccgataaacccacagaagaaacaaaagtgtgggactctttcatatcgaaggtgaaatctgcgagtctcctctttgccttgcacctttatcttaatagctagcattcttcttagggggcgattgactgggagatccacccgtatacggaagaaatcatgcttattgcatccatcctcctggacatccacttcgcgaactttgcccatcttactgccatagagttcacctcttgctctgttcatcataactaggggaaggtcatagatcctgacccaaatagggactgtatccaagttcaccatggaagggtttaacaagccattaaactccgccaccaataaagcatctcctctgtgcaaccatggacctccttgcagcacgaaattatagtccccttctgcattaaaagacacaatgaagaggttatcctttagggacttgtaactcatctccgcccgcaaacgccatgctcttctcatatcctcaaacagagccgactgattaggaaacttgagcgagtagaacctcgctaggatcgtccattgaccggccttctgaacttcgttctcttcgatttcaatttcaaccgcatcctcctcctcatcgacaacctctccttcagtgaaaactgtagggccttgactgctcaggttattacttgccaacccaccatcatgatttccagacgatggcagcactcttgaacctgttgcctgatcatgtatcccatccacgctttgattcagaactagtacagcttggagttcagattccaacctgctccctgggggcaacgacgacgcaccggaaggcttcgggtgggcaactatcgcattgatagtcccttgatcacccccaccctcggcagccgccatgaccttaagcacaagggctagatgaccgaaccctagattgaaacctgcactagatatctgtgacccgagagatatttttgattttatcccttccttgtacctgaatttataccccagcagctccgagtccttttctttcacggttgatcgccaaaacagatccacatcaatgatatctttggtgtgacccctgtagaacttgccgtaccagaatttgacaacaggcgtaattctaccaaacttcatatccgccctcctcctcggattaggattccattgtcccatgataagcctccatcctgcccgatgtcgaaaagcattaggccagatccaaccagaaccagcacgattaacctgatcaccaacccaattacagatcgcagacgtgacctccgcagactttctgagcagatcggagagaacctccatccagatcctcctttcatgggaggagaaggctgccgcaacccagtcgcctgggtgccgcccagaccctaactcacgccaaaacatgtttgtacaagttaaaggcaacttgaaaacaatataggagtatatgaccaccaatcaaacttaaatcactgaaatatcgcttacctttcatacattcatcagttgtctggataagagtggataaaaagaaaacctaataaatgttaatgtgatgaatttgatgacaatgaccccgagttattttttcaaaacacggaagatgctcacatacattgatgcacatacacgcgcaccacctataaccataccggagagactgtcatttctcaatattgacaaatttattaccacagatagcaacaataaaatttaaaaaataattaatcgtaaatacgagcacgtgcatcagatataaaacttaataaaaacttagattgatagagttacagttttttttaaccccgcagtgtatacttgtattaaaggagaggaagccactgtatagtagccttgaggctaagagttaccgttctagtcaggggcggatccagcgtggggcggcggggtctcgagcctccactactactgatgtaaagactatgagagcccccacaaagaccccactaaaattttttaccatatataactttatctaggtttggtttagacctcattgcctatttctttattgatcccgccactgattctagttcatgacaccataagttattcgatgttgatccggccactgattctagttcatgacagcataagttatggatcacatcgataaaaacatatgccggtttagttctcaaccactgtactaattctttagctggtttcaaacaaaataggacaagcatataaagatgcgatggaatttgaaaacatagattgccaagtgccatatctctactgttttgccagtttgtccacgagccaaaagaaggctccaatgagaattcccccgtacatgccggggtggcgccacatgacaatgactgacaggctggccccacgtcctacctggctggccccacccctgctctttctctttctcttcttccctttcgtcttcgtcttcgtcgtcgtcgactcgtcgtggccgccggcaactcacgcccaccgcgcgcgcgcgcgaattaatacaaacacattaacacacacagagagagaaaattggcgcgcctcgcgctgtgcgccttcgaattttggaggcgacgcgcgggaggacggaatcggccggggattcgctgcgtcgccgcgcgagagcgagaggaggaggaggaggaggaagccgggatgggggtgtcggacaacacggtggggctttcgctggcggtggcgtccagcgccttcatcggcgccagcttcatcctcaagaagatcggactcatccgcgccggcaagggcggcgtccgcgcaggtcatctctctctttgctttgctgcctcattctcaggtcaaccgttgtttgcttcttgggattggtcgccgcctagctcaattggtcgcacggcatctcgcttagtttgacgacgcccgcatctcaatcccttctctggggaataatcgaacactttggtggatcttgattcgtatgcagcaacacctggaattatggattacgcagagcatttttgcaattggatcccatcctgtcctgatgattagggtggtttttttgtttgacaaatcgttgcttacctgcgccgccgcgattgggtggcggctgctgttgctccgcttctagatcttgacgaggctgcggttggttagtccaagtcgtaagcctgctcgtgcgtgcaaatcagcatcgcggtcgtcgccattgtcgctgtcttctagatgcaaacggaaactcttgctgtttcgtcttggaagaccttgtcaattcaaatgcttttgggtcggatctctaaaatttgaacccagatatcttgactttcagatgccgtgctccctatttatccccctgcgttcaattaccatggttggcattttggcaatgtaaaagcaaatgtttttttttactgtttcatctccgttgccaatctaaacatggattctttttctttttctttttttttacttactctgatgactctttgtgggtaattgccctcccatttcatcttacctgcttcttttctaacacattacaggtggtggaggatacacttatcttttggaacctctatggtgggctggaatgatgacaagtatgctcactctacacagcatttacagttagcttaattaaacttgacaatgcagctgaatgtcatctctgttgattgcacaagtgttgcttggggagatagcaaacttcgttgcttatacctttgcaccagccgtacttgtgactccccttggggcactaagcataatcgtaaggtgatttttttcaaaccaaagccttaagttcagtagtcagcactatctttgattctcctatatatggttgacatacattttgttttttttctccaatttggacagttcatttttagcacatttcgtgctgaaggaacggcttgagaagctaggtgttcttggttgtgtatcatgcattgtcggttcagttattgttgttatacatgctcctcaagaacatatgcctaattctgtagaggaaatctggaacttagccattcaaccaggttagtcactgacacacatttctgcaacactgtataggtcacagctatataactaacatgctttctctgaacatattgtggtttcaacacctccaggatttctaacatatgcggtagcaaccttagtagtcgtggcagcactagttctcttctttgaacctcgatatggtcagacaaatatcatgatatatctgggcatctgctcttctatgggatcactaacagtaagtgtgttttgctattggatgcacaatctagtggtaggcatatgtggttaacgaaccattggtattctgtaggtcgttagcatcaaagccattggtgttgctataaagcttacgctggatggaatgaaccaggttgcttatccacacacatggctttttgttatcattgcaatcatctgtgtggtttctcagataaattacctcaataaggtaacacattttcctggctaccaattacttggtgcaagtatgttttgctcgattgcttcctcatgatctatttttcagtttttgaaaatctttgaaaaataaatttgtttt

SEQ ID NO: 77710 - DNA, 1260 bp, Oryza sativa
catatgccaaatcatggacttctgatgtccttgacaaagcttttcagcaggattgtatgtcattcacaatagcaaggcatatggcttcgttttccagtgcagcggttctatcaaagtgcgaaataagctggttaaatcgcttatcccggtgctatgcccagaagcgtcatcgatcatgaggtaaatgctctcctgctttcaggaatattacttgtatatctttgtgttgtatttcttaaattgatcatgtgccatccttgatgttcggaaaaaaaaatcataccgcaggacgtgctcaaaggttttgttctgcaaattgcacaagattcacaatgtagtgatgaagttagctgaagatttgaaatcttgaagaattctagcttgcgagatgcatgaattcttctcttttaggtgagaatccagagattaaagacatcgattgatcgatcgataaatggcccaattaaaaacgtttcacatgcgctaaggcgcaaaagtcttggcgatcgtacataacataatatgtgccaacgacaaattaaacaactagagaatcatagttgcggttgacgagtacaaacctggcgctacaaataaaactgacaacaacatgctgaaggcctagctagaactgttacatggacgcttggcccatttcgccccatcagaattatggatttgtggattacattttgaggacaagaaccatcaattggtgtcgctggtggtaatcctgatgcagtaccgaacactttttcttgtttttgaaaaattgtcgtctcgtctgttagcatgcctgtctcatttcattctgtttatatagtacggagtatatgttgaatgcatcatcagttttttttgcatgtttattcatgagatgatgaaagagttatgtgatgtaacttcacatcacatgatcacatcgaactagagaatgaatgcgtgccaccactacaccatttttaattttgcaaaagaaaacaaacaagttctgccattatcatttgtagtatgtactacgtactagtataactccatatataggtactactccactatgctcggttctcgccggtctgaagcttcacagatcgatcaacgtcacagttgtcaccttggaaagttcaagcagaatgggaccaaattggcaagtagatcagcgagaggcatcggggaagatggctgggtacttcttcaccaacttccatgtggacgatcactaccaacttcttctgcaaacacaagcagtttcatctctta

SEQ ID NO: 77711 - DNA, 9743 bp, Oryza sativa
tacgagtttatatatgtacacttgttatatatacatactggtgatgagctagctatagctaatggagattgttacattggagagcccgtactctacgcatcatgtatactgggcacatggattgttcttggtgctgccgttgtttgtgcaggtcaattgggctctccttccaaggcatcagcaacagcagctatagctagctaagctgtgatgaagagaagagaagagaagagaagagaggagaagagaggagaagaggcctttaaaatgtggggagcgagccagcctgcaggccagctatcaagctaggacaggcagttattggagggctgcaggtcagatcctaaatccttctcctacacatgcatattacagtctctcactcctctctcactccatatgtatatatgcatccctagctatacatctttctctctccctctgcacatcactgctccgttcttgatttggtttgcgcatttgtctcttgtgctattccttctttcgtcgtcgtccctgctgctgcttctgttgctgctgtttcttctgcgccagcaatacactgtgcaatgtgtgaaatgttcatcaggccggctagctagctactagctggcagcagaactctcatacacaacatggctagtttactgtgcagtgtgtgaacgaaatgccaaggttaatttgtgtgtggaatcccaaacctttctgcgagcaaggagtgaaaaaaagggataaagatgtggattagaaagcagtagtagatccttcttctctccttgcctcctattgggttcttccttttggtgtcaggaggaggaagagagaagtatagaatctccatcatcccggccatccatgtggatagacagcaaaatttgcaggccacattgcacatacactggttgcgcatgcattgcatgaactgaacttgcaggactgcaaatgcacacttgcatcgatatggtagaattaattctgcttcgctccccgactcattcagggtactgggtctgggcgtacgcagtgataacagaagaaattgattattgcgttgatagtagacgagctgcctttttctgctagcttttgcccatgagtctaggactctagcctctgccattaatttctgagtgtcatgctgggtttatatgtacaactggttagctagctgctcatgatctatttaggtcattgtagagattgccgtacgttaattaatattgatactttctttgattaggttcaggctcccatgcatatgccctttgtcaggaattcagtattttcagtctgattggtgttaatgtatcagccttttagcatgtttgcttttaacatagccaatattcaattctattcctatatattggcagatcattctgctgtttcttctgcgccagcaatacactgtgcaatgtgtgaatgtgcatatattatctatgataatttccctttttagcaatgaattacgcatcacaaattataaagtgtttgccaattattaattcgattagtttttgttcctaagattgaatcttcatgcagcatgcatattttctgtacatatgtaatcttgctttaattctgcacaattattttttagaaaaatccctctgttaaacgcacatatgtacatatataggaaataagaacatgcatgtattggttaaattgagccaataaaagttaattgtttaattgattgataaattaaagcacattgcatcaatatatatataagtatgaagaaaagacatcagatatatggtataatcttacaagatcataaagttttagtgtatatatcattgatgtatttataagagcctatagcttaactagatcagagcatatgtgcacattcttgaagcgtaatcaattaatctatcctgtatataggagtattaattaaggatatgtttaattagcaaaccatatcaaattatctaaggacttattgaactgtatgcaagttgaatattggcttgatattttggattatcaatatctatacaaagtataaactggcttcatgaaacactgaataaaagtaccagatatatatcaacataaaacttaattagcatttccccgctaattcttcctgtcatgcattagttacttcgtcaatgctatggtgtgcaacaattaatgtaccattaccaaatattaatttgtttcgaccaacgtacatgcatgtaatgtttgtgttaataataatctgtcactgatagtatatgaatttaagattttgatgagtgatatggttttgagaagagcattttatgcatgccttagttttctgcttctctctatcatgcccccttttcttgattattttcactcaatttcttctgataacccgattatttggtttttatatataagtgtgaaaaccgtagggctatatatatggatcatatattaattcttgcatgtgtgcgtctctctcttaaataaaaataaagctgcacatataagtttggttgttactcctacataagtatcatattcacgtacgtccaaacgtcagcctaatttttcctgcgtgcatgttaattaattaatttgttttacacagcaggtgtggttaattattattaagaatgcaaaccattactatatgcatttggctagccctggatcggcgctttactccttgcaaccatgcgtgtttcattgataaagtagctacttagatatatatgaagttcaattctaattaagctcaaaagatatagaatttattatatagttaggactgaggacaaagtaacgagtttcttcgaatatttatctatatatttatattgttaattaacagaaattgaaaaagggacaccccacattattctagctagaaacctaattaaaaattaccactttaataggagaaaaggagatatttgcattgtcagattttaatggttctagactataacgatgtgatttgattaatattgttacaattatatatgtggcaacagaagctaattagagttttttatcaattgcaatttctaatttaaaatattgttatatttataaattacaactgtacgtgttatggagatagaaactaaaatttgtatatcaaatcaaattgtactattgtatatagatttcaaatatatcaatggaaaaaagaagctaaaaggtgtgaaactaaaaaggtgtatatcaaataaattgtgtgggaaaaatccatgctagttcattaattaccagtatgctgtcccctttttttagataatgagtatactgtgccctttttatgtcttgtttttctaaatccagtgagaggcactctgtctagttcacttgaaatatgtgcaccatatatatatatagtatgcttgatctctagatatactagtattaattaaatgatgaaattgaagtgaaccaagaaatgtcttaaatattttttttgaacgaatagaaatgtcttaaatatcacatataatgaaacgcatgttgtaatttctttaattttctcaatgtacatatgtatcttgtaggatttgctagttgtaattttggcataatctttcgattaattaggcatcattaactagacagagtggtcctctctatatatacacttgatatgtaaaatattgttggcccgtaagcattcttcagagagagtactaaagttagctagctagggacagcgggtatattactatagctagctagatcgatgcatgatcatgaagtacagtaggagacataacacatataaacaaaattcaaaagttgttaaaacgtacgatcgatgacatatggtacattatttgtgccacattgccatgcatatgtaaatgcagaaaccgatcgtttttgaacggcatgtgtatgcaactgagaaatgctgtgtgtgatgcatatgtatgcaatacatatagcgatatccgtagatagaccgattgctttggtctgaattaatgcatgctgcaagtttggatcaatcgatcttctggtgcgggtgatcgacggggaaacggtgagagattgaaattgtagcgtgacatgtatgtatgatctcgctggcttagctagctgcaactaccggtgccgtcactgccgtgccgatctttatatcgctacgcatgcacggtgtgcatggaccatcctaagtaggggagggagcgcatatgtatctcggggacgaccggccggccgcccgcggatgcatgcatccatcaatgcatgtgtgtacattgcatgagaggtgtggggacactcctacttagctacatagctagttaaatggtgggtccagcctaagcattcgatcacctagttcctctccttccaatttttatttttttaaaaaaatgcatatatacatactctccctgtcacataaaaaattaacttctgtctataaatctagatacatgtacgctacatctatgcatgttcgtaacataagttgtttttttttgagacggatgaagtatatgctatgttgtttcctttcatttatacacattaaaaatatgagcgacactcgtatatgctacttgatctctcctattgaaatctcacattaaattaagaggtggggtaaattaccatgctaccctctttatttactctaagtcatctttcccaaatcaaatattgaagttctctacgaagactaatactagaacttagtatagtaattactccattcgtttcataatataaggcgcaactacttttttcagatgttctataagagcaggtacaatagcaagctattagccagctataaacgtattttaatgagataaacaatgagagagatcagcagcgggatacagatttgtagccagctgcagtacggactccaagacgcaatgtgtgtatgacaggtgggaccacatattaatagtatagcaagcaactattgtatgaattggttattagattggctatagatgaattggagttagtagtgggctatactattgaacttgctctaaataagacgtgcatgcatgcatgcaattaattagtacctcttctctattaaattatgattgtttaaaattctccaccctcaacatctctaattctattgggtgcatgtattttatttattagggtgatacaaattaggaggttataataattgtttcttagtctttggagtaagggcgattgtgccttatattttgaaacggagggagtatattattgtactgatgaaacttaggaagggaaatgcaactctaaaaatgttttgaaatatcaaaacgacaagtattttgaaaaagaaagataaatgttataatgataaaatatttattttgccggatcgatcgaacgattggtcgagaccagattgtattaagatttggagagttacaagatatgtatgtattacattatccatacgaaaaaagtcgagatccgagtgatcaggcacatggaatgcctgtccctcgaggaaaaaacatcatgtccaggttatagttattggttactatatctaaaaaatctcttcctcctttcatattacaatctctctcttaaaatctctgaaaatcaagttgcatcattgttcacgatctgcgatcgaaattccgtgtattgcgctccttcccaaccaaccagcacactgtcatgaagagcatatcgaatgcgttcatgtaggtcatctaaaaataccgtacttcctgcactcagacatcatttttttagataaggtctttttttttatccggtctatatatacattcaatgggatatatatgtaacccttttcaattgggaacttagccactcaaacaacccaatctaacattcgctcttatgaagatttgaactcagtttcttagagtgctactcgtcactgtaaccactggactactagccaccatttatttagaggaaagattgttctcgcccgaaagctagaagtggcatttatccatccttttagcatcttcctgatttgggttggtgtatgcacgcgctacaaataggtggtgacaatcttcaattcctgattcacttggcacaggggcagctcgattgatgtgggcagccacgaacgacaagtaaactaaaacaacaagtggtattctctctcttctttctctttcgtcgctcgtataaaagattgtacgttgcaatctcgtcctaaacagtgacaccatagtactgcgaaagcctttatatataatttacgaggatgtcgatccgccgaactaaatgtgacgtgcctcatatatatttacttatcagaaacaagctagtgctttgcacaaggatgttttgactcatatatattataaactcaaagagaaaaacaaagatcatacgactcaattcgtgacactaaagcctcttttagaattgtggatttttgctgaattttacggggaaatggactaaatattgtaaaaattctagaaaattctcgcgtctcagaagagccctgtaaattgtcccagtcatctagtaacttctgatctaattaatgcataagaaccacgaaggtggagctaggaattaaggttgtgtttatttcttttcaaagttggaagtttggtttgaaattggtacgatgtgactgaaaagttgtgtgtgtatgacaggttgatgtgatggaaaaagttggaagtttggatccaaagtttgaatccaaacacagccttactaaggtcagtgatcaatcaatgaaatttgtcaaatcttcacatttttcatttttcttagatgaatttacaagggattaagcatacaagcctatatactgtcctaggtatgtacaggtatgtacatgtttccatgcatgcatacaacctcctcgatctcactcataccatatgcgcagtcgtgctcttttggaattgatagttgaaaatcttttatttcgttttggtgtaataccaaaataattactcggtagattctaaggtattaattggttatcttatccgagggatttagggacttgtacattaattattactcgatattttttttcaacaacaaaatttattagttgtgcgtctatcaattcagggtggagatgcaatacgtacctagaatcgagcatgtggatagcgtccaatgtgctggtgctcgtacttgtcatatggctattcgatgattcgtgtaccccatttgtaaaaaaatatagcaatttatatagttcaaatcttgttccaaacataatattgaacatcaagatgattttttttagcactaaactacccatactatccatatgcttcattatcacccaaccagcttgacttcacacccactcgagcacccaaggagacaaactttattaatagatgtatcaaatcctaaaagttgttatattatgagatgagaaaagtagtagtatgtgtgtatatatatatatatatatatatatatatatatatatatatatatatatatatatatatatatatatatatatatgactctgtcatgcgtcttgatcggtaggtcgtccgccctgaaagttacatgtcagcaattatagtgaaggggttaactactgtttggcacatgtccacacgtgaaatttggttcaatttctggccagtacaacatccatatgatccttggttgattgatcctgtaataactgtgggtccgaataatatcacatcaactacgtacttgtaatatttgtgagtactactactaattgcattgcatgtcagaggagtatatttgttcctacgtacggtagaccaagctagacatggcccaccactcatcggcttctactcatcaagagctacaaataattaagcaaagtgagagaacggttaaccatgcacactctggcttaatttgcatgctgaaaggggtgtactgctgtgctggcagtaggtaggtttgcagtagtacataaagtgctaaagcgcttttcattgtgcaaacagtgaaaggtaattgtttccgagaatttcacagcttttttcaacaaagtttagcttggacaacatggatctaactagcttccaaatagataggggtaaaaaggaaaagttgagagtgataaaggtgcaatattctactccctccattctaaattgatctacatatttcatagctacaccaagacaaaaaaaaactaataactctctcatactacatttactccagcaacaaactcgatgcatgcaccatccccattatttcctagccaatagcaaatcaagatattgcatgtgggttataaatacttatgtgcatggatgcatgcatcaatgtccatttactccaatgcgcaaataacgaatagacttaatgaataaacacaaatatatagatcatttaggaataacctcaaaaaaactatatgtagatcaatttggaatggagggagtatgtgtttacagttagtggaactagaaattttgctttaagatacatgtataaccatgtatatatttacatatttttgcccccttctcatgttcgttttcctgactgcgctctaacgatataacattttctttcaaaagaaaatactatttatacctttgtcaagttggaattaatatatacagttgatctggagaagagagataaggcatcatcctttgaacatgtcctttcatactcgcactatatatagaagaggaaagattaatttatacatacactatacagagaagataaattaatttataaatttccaaattcatatctaaaatttacatattactaactggtcctgtggtgctttgtcagacgatctggtagaattttcgtttggacgcgggcggcggatcaaataatgggctatatcttctttttggactttggagaacgattgacgctgatctgtcctatatttgcagcacctgtttgattggtcccccatcggattaatcatccaacagagactcgattttcgtgcaaagatagagggaccattagttaggaattgaatatgaaaatccatctaacatactgtatgtacgaaaaatcaagctttcaatctaacaaaacgtcttaaaagcttttgtttgtactgtgcattcgcccttctagctcgatctcaatgttgatggtgcactagtacgatcgcctatttaatttgcctattacgacaagtcgtgttaattgggcttgagacgcaaaacttggtgggatataagcatatttatgcatggcagaactagaaactaaacaatattatagatgctgataggtcaacaagtgaaaaaaatactagtcaaaaatctcccttatgtcatctaggaaacattcatgcgtgcgactaaaatccatatgtaagacgggtccgtcgagccactctaactaattaaaagacgacagaaatggattgttctaattaacatgtttttatgtcccaacgaatatactccctccataaaaaaggaaagaaacctagtagaaaatacgacacactagatagctctactgcgtctttgtttttctatacaacagagggaatattcttttaacaagatgcatgaagttctattaaactgagtgaacaatttgaacattccagatgtatttcactgtcatggccaataagtaaaaagtacagctgtgtgtgttacactttggcagttaggctatactgtcgattagtacgttcaggacgatgtatcaacgaaccccctgatgagaatccaaacgtgctaattggcatcactttttctagctagagatatatacgcagaaaacgtgtatatatatgtgtggaatacgcctaagataaggttccaatcagg

SEQ ID NO: 77712 - DNA, 23127 bp, Oryza sativa
aaattttataatctcataacaataaaaatactatttataaaaagttcaaataaaacagatgattaaagttgggcgaaactcatgattgcacttaaaatgggacggagggagtacaagtttcagtcaagaaacacagctggaaagatgttgcttaatttgcatgaccctggtgactcataggagggttccatacgtatcacacatatcgcatactttctctgattctactttttttctaattaggtccgaatgtccttctgaatttaaatataaaacattttatacacttgtgcaaatgatcatgcatgctatcccttcatttatggagtacgtacatatgacaagctggatcatttatatttgtgaaggaataggccagattttcttattttcatttgcaagggcaaatggaggagaaagtattaaaaaaatgtgtataggagttgaaaacaaactacatttatgaaagagttttaggagcttaagcaacttatatttatttaatcggaaggcatagtctacaagtagattcttcgagagaaaactatgcatatcctcaaatacctagataagattttcttttttttttgggtaactacgtacataagttgatatatgcatcaaattgtccccactgcttaaagagagagtcattctcttttcatcactctccctctcccttctacgtaaaaacctcttctctttcatataaatcgttttgaacaccgatttctcaaaaaataaaaaacaaacgacgaatatataaaaacatattatatatagtttgtgctctaaaattattagttttctaaccagagaagttgtggttacatgcatgcatttttttagaaaaaaaaacaatattggacaaccgaggatgacattctaataataaaggaggtgtgagcatgttaataattgaacacgggactttataaatgaaaccaaacatcctcttggctctaacgatgcagtagcaggcgtatctcaccttaatgcttaatgcatgagtaagagtaagttttcgtaacaaaagaaaagtaaacctttgcatttgattccagccaccattagcagactaggaacttgtgatattccttagccgcgtttccatcgtcacgtgatcgttagctagctctacgaactataagatctcctatgataatgagttcatcaattctcactacgaatggttgccaaaagcacacgtagcatgaaatttattcacatgtcatattaccagaaagttatgtaaaaaaaacgtactattatatatggacgtaacattttatccgaatcacaacgaaatatcgctaaaataaatagacaatacaataaggacgacggaaatgtaaatacgatggccccgcgggccgcagcgatgttctaaggacgtccgatatgggtcccattcggcaggcatgtgttggcagcggcaggagtgacagtctctccatcccctgctcaccggtgacgccattaagttttcttgggtggaatgataatactagcagagaaccactgagtcgctgctaggtgggtccaagaacacatcgggcccacacttcagtgaaagcaagaaaggagagatgagtacacgaggtccgtgctggagacaaaactgggcgcgctgcagctgcaggccaatgggcggagacgaaatggcatctttgtcatcgtctcacgccaactgcaaatgctacgcagagactaggaccacaattcagtgagagctaatctttctcgagctcagctcccaatgcaagcaagagtattctctgcattttgggttactctcaatctcaatacaaaattctgcgatcttctccgtattcaactttaatcgtccgtcttatttaaaaattattttaaaataaataaaaaaaataaatcatgcataaagtatcattcatgttttatcatctcatgacaacaaaaatattaattataaaaaattttcaaataagacgaacgattaaaattgaatacgaaaacgtatggttgcagttaaactgagacggaggaagtaagtactctcctcttgcatattactctcctctatcccggttagttccagtagttgactagtagttggcccgtactaatactagccaggctttaactgttgtggtaccatacgctactgttcatgcttaccaagccatcgtgtccatgagtgcatccatcccttgaacgcaatagtgagtactgatcgagtagtggtcgctcctcagtacttgcattgcatgcacgcatgaatgatggctgcagattgttgaacagcgagttattgtagatagagatcgatgactatatatatctcctgatcctttgattgctggatgagaagtgagacaccatcatgggattcatgcaaggagaaatcattggtttagctcattcattattgttgttttatccgtgcttaaaaatgtgggtttcgctcgtgatacgtctcccgcgcgaccagtcgtgtacatgaagcgcggttggatgctccgtggctgatcaagtagcgcatgcatgagctgctctggtgtatgttagtaggacccgccctcatgtgaccgactgctggctagctcctgcaccctgtcattccacagctgttctcgtgccatgtcacccgtacttttaaataaaccgacatctatgaaccggtacctattaggtattttgtagtggtgctagcttgtgcactacttcccatcccaagggcgaaagaggtgttcgtacatgttcatttatttgcaaaatgggtgtccctggcagcttgacgacgctagtgacatagcctcacgcacggtgcttggcagctcggcatgttgtcaccaccaagtccacgtagctcgtgccattggtcctagactcccagcgtttgacagtgcgtctggacattttttgaacataagaaattaattgttcgatcccaacgagaatcgaattgatgatctgtatgaaaatattgtaaaatcactcaggacgccctattgatgcgaattggctataggtgtcagattcctatccagaaccaattgggggcacctattctcaaccgtataggtgccagttccaaaatcggcacctataaaggttgtaggtgccggttattagttaagaaccagcatctatatatagtcaatgaataaaaaaaatgccagctcgatgcatcagctcaagcagctcgtcaccggaccgggaccaccacgttgctcaccgtcatcgcgtactgcaccattatccgtcttgcagagcatgaccagaggacaaagcggaggggaaaggaggaactcacatcgaacccttggttggcagtgacgcctccatccacctcaccgctgcgttctcctcctggtctcgacgcaatgctctctggcccatccattccccatcgctccttgtccccaatctccccatgcactgtagtgatttgatgcatccttgcatctgcttcgcaaccaattgaggcatacaaatgtagaacacgtcaatgaatacgatacaaattggacacaaaatgatctcacataaacatatactacactattaatacctggtctcacatgtcatgctcacactgtgtcttgtagtctgtgctgcagctgggctacaaatctgtagcccgctgctcttctctctcatcttttatctttttaaaatatgtttatagttggattatagtcagctattgtacctacccttagctagagtagtctcctactggcaccttttgtggcatggtgtgcggtcataaatataatgacacgaaatgcatgcagcgcagggcctaaagaagatgaggcctactcctagatgcagttgcagacacgtcacctggatgggatggcggccatacatctactagctctccccaatccccatgcctgcctgaagctggttactgtagtaaacttcgaaccagatccgagtcttcctttacagcgacgtcccatcgaaaagataggaacaaatggccagaaaagatagcacagagaagccgatggatcgatcaggatatggaagcttaggttccagctacccctactagtgtaggacagcgaaaccctccgttttctgccgccacatgagccatgaacgaccactcgaagttctcagataacacgcaagccaaattaatttgaaacctctgagagcaaatataatagtaggctataaactgactaaatgctgaagtggaagaaaaaagagatgagagagagaagaagtgggctgtaaacttacagtcggcttagacacaagaaccaagaaactgtgtgagagagacaagtgagtcatatattaattgcaaagagctaactaaattatatgggtgagctgaaagaaggctacaaagaaccttatacccaacaagtcggctgtattattagtcttgctcttaggagcatccagaacacggaatcgaatgtaatcactttatcgccagattagtagatcgaccatgcatgcatatgatgatgcagcttactgtccgttagcgcatgtccgaactgaaaaaggatcatcgcgaaccctgaatacattggtccagatgattccagtggaaaaactatagtcctccattattatgcacgcatggatgatatggagttaggcccggtcaaaaagaagcgatggcgactcgaactgcagcgtgtgaaaggaaaacgaaaaaaattcagtagcatatatgcagcacgcatgcacactgttgcagatgtaggtgttggaattacagcacgcatggcttccacacacgcagctttcagctgatcagctcaggccactggcgtcaacagagggagagctagcaaataagctggatctcctgcaggggggagatgtctccgtgtcatcaacatcccagcagctatatatctaatctgttcgatactctctatacaatagaatcgaagtccatctgaccctctccccactcgcttatctcgatcagatgtgatcgattcaacaagttatatatgcatgtgtatgattggtgcttgtatggtggagaagagagaaacgcaatcgtttatagccatacattttcagccatgcatgaaaatgtctggatcacgacttgtcgtagaggccaatatgtacacacgtacagttcggtcgatggatttcgtcagctactatataccggtatacttttgctcgttcaagtccaaaagttaatagtatggtttcattgaatttctggttgtagctagcaggtgggcatatatttagaccaagtacaataatagactataagtcggctacaagtttatgtggggagataagagagaagagagaaaagaaacaggctacaaatttatagccaacagcagcacggactttaaaacgttatatgtgtatgacaagtggaaccaattattaatgatgtagtatatatttatagttaactattgtacgaattagttattagattgactatatataatttggaggtagtagttggctatgctattaaacttgctcttaccgtcatcgcgcgcgttccttgtgtggagatgtttcctgacctgaacagtactgtataccgttcacatcatgcagctatttatcttttgcttttttgacaactacacaggagatatcaggatgcaaagaaacggccggcatgcgcatatagaatcttcgacgactatgcatgcatgcctttaaattccatcaaaactcaatataataattattcttttttggtaatatctggtggtgtcaccagcacaactgttagacttaagctttcaacaacgtccttacaataaatttattctgaaaaatctctggatcactcatgcgaaatgtgtagtactccagtagcgactagccaactatactactgtgccacgaaaataagcagccgcgggcggggcactgtacgcctgtgggtacgtatctctcgtacagtacaccgtaccatacctgtgcggacggagttaggacgtctgcaacgatggcggccgacgcgacatttcaccggccagctgcatgagaattgtattgcgacttgcgagagatatttgtagtactcggcagcatgcatgttacattgttacctgatctcaggacgacgacgaatcgacaaatctttatctacacattgcagatcggcatcggcacgggcgcgcacgcgtcacggagatcggcacggggcattatggcggggcactgtgctactgctagtctgcgacacgctgcaacagtagccacagcaatgcagtggtagtagtagcagcatatgctagctcttggggagcctggaccagtacacgcgcttttcgttctcgccatatatgcagcgcagcacgctgcaggcaggcagggagtgaggagtagtgggtgtgggagattccccttttaactcgtggcgcatgcatgctgctgctgctgacgctgccgcccgactggccgacgagccggcctgctgctgccgctgcttcgattctctgcgcctgcctctgcctgcttgagttcctcttcgttcgatgatcttttctttgggagatgtcttcttgctcttcatgcgctggcgctgctcacgagatcgatctctgcgtgcgtcggctgctgaagaggaaggggatttttgcagcccagcgccacaatcatagcccacgtcagtgtgtagcccatgtgacatgcaggctcgggctcaacgtaagcccagattttgccacgttgttatgggccatatagtagaggccttctcaggctgtaacaatcaaagcccacagatgtcgcgccaaaggcccacactaacagaagaatccacgagcgagcactattggcccgtggttgaagcctcaaggccgtatgtatgcccgtatgtctccctgcggttgccacttgccagtggatagttaaggcctgtttagtagagctcaaacttctaaatttagcttcaggagttgggtctgtagtggagttgtgaagctgcctaaacctagctccacctctctagttcattttgtgagagagctccacctatctctgctccatttttggtggagcggaaactgtttggctaagctaaggtggagctggagttggagctgtgccaaacagacccttaaggtcacagctccagctccagatctcctagatagcctaaccaaacagtttcaactccatctgaaatgagaatggagatgagtaaagtgctctcataggatgaattagagagatggagtcgggtttaacctgctccataactccactttagacccaactcatgaaactaaatttaaaagttggagcttaaataggtttcttattctggctttctattcgcagcatgtacatgcagaggttaaaagatggaacaataaaactatattgtcactataatgtcacagagaagtacagagtgcagagtaaaataatctacgggaagaggggagaagggacgcacgagcaagctaattgagctagctagcacgtaatacagagagaccaaatgaatgatcaaacaaataagtttacaacactctatctagctagctacgtcgtcgtacgtacaattttcaatttaatctcatcacaatcccaactcacacaagcctgccacgagctatacatcatgcttaggtcgatcgatcagctggccaccctgcagtttgtcctgatggtgccggcgttgccggtgagcacgccgatggagcccatcttgaccatggcggcggcgaagtcggtctggaacgagtccgggttgttggtgtagccgacgacctgcgcggcggtggtctggtcggcgaggagcgcctggtcggagctgagcaatccccggttagcgacaatggcggcgtagtagttggtgtcaaaggcgttgggcgtgacggcgtccatgggcaccatccccgccgcgggctgcccctgctgctgcgggcactgcgtcgtcagcgcggcgacgtagctggggtccatgctggggtcctgcccggcgttggggcccgacgagtagaggcggttgctgaaggagctgcagtgcgacacgccgatggtgtgcgcgcccgacagtgccaccatttccgcctgggtgagccccttggcgccgaacatctggttcagctgcgccacgttcgccgacggcggcggcaggttcccgttcgtctcctgcgccaccgacacgttgccgtctctcctcccccccggcacctggtacgcgttccctcccacctgcacgtacacacgcacgccaattgttactctgtttctcaaaaactgtactaaaagtataattttagctgctgtcatcttggctcgtgcatcagcggtgtacctatatccatgtgatacacggaaacatgtagattagggatggaaaccgtacagtggtttgtgttctcgagttagttagacgcggcacatggttgattgggttggtggtgaagcggcggggggacgcatgggccgcacaacgggagggaatggggacaaactaaaccgatcgatccatggcatgtggtgttgtggaccgatgggcgtgccggccacatgggcgtgagacgaatccacgtaaactatccgtcccacttgctcatcctgcccccagaattaaacccctcctcgtagctttcggtatttaatttcctctttggttatcccctaatgtaatcctgattgataccggagagggctggagtcgtcactactcactagcgttgctttttgcaggtatatgtctttttcatcatgtgatgatgtgaaaggttatgcacacgcatacgcatcatctatgtgttgtttccagctccagctgaagtttcagtataacggtcttaacagagcaccatttggagttcataaattgataaatatgctagtgtctatttggaaaatacatgcatttggtcggttgtgaattattgacgtggtggtatatactgtatactccattgacttaccactagtgaggaatctttgactacttgttcagaatatgtcaacttgaacaatatgaaactgcaacggtcgtatgatcagtaatgttcatttaaaaaacacatgtaacacaaaaaatggttctaaacctgctgaccgtatatatcatgtcgtaatgctcctactttaccgttgtggcgtcagtaataatcaaatttagtccaactgaatcaatataatcatacgaacgtactagtactagtactccataattttgctccgatcgatgtctcaacttccttctacactgaattgcatggcgatacagtttacgatttgtttgcatggagatcggagcaaagctagattaggaatgattggagttggcccatcacaccagcctcctaaaataactgttcatcacccccagagggttaaagtgaactttattagtgtgccaagtgccatgatcccacgatcagattggattacttaatctccattcttttggcgcatccccaaaagatgatcgattttggaaagcaaaggctctcttttccttaacctgtgtgagggcgacacggccatgtgacgctgatacggacaccgaccggtgggtccgtgcagacaacgggctcattatacgtgaaccaaccaaaacaaaagaaaaagagcggcctctgcttctcctgcagtcgcatcgcggcatcggcacatatcgtgcgtgatgccgccgtggtgcgttgcttccagaaaagcatcggcaatgaatcacctcccattctacgccgggtcgggccggcagcatcgatcggaaaggagaagaacagagtaagttcctactgccagtcggagtacaactactttcagcgtcagcttttggagaaagatagaacgaaagttggggcaatccgtgtagggcccgaccggttttatattccaggctcgatctatctatctatcactcgcaaatcacccaatccaccgacgaatcaaccgtgcgccgtgcgcgttgtgatcccccccgacttgtacccgcacgggcaagtagcaagcactagcagtgatgcgccggaggaagcagctggtaattcaatggagcagaagaaaacgtacgtaccagcgcgagggcgtcccgggcggcgaaggcgaggacgtcggcgcaggagacgacgccgaagcaggccgtctcgaggcgggacttggcgctgtcgatgacctcgaagccgcggaggctcgtgttcgggggcgcgtccttctccgccctgttcccctgcgtcgagtccagcagcaccgacgcgtcgcacccctgcatccacaaggaattcaggtgtctcgctattacgtgcaccacatgtcaaaacgaatgcagtaaattaggtaacacaggtactacgtgcttgattgattgactgtagcactgtactaatgttttggatgctaggataaaacaggggatgccagatggcaaacatgaacgagcgatttctagctgtcatggttccagagtatcccatcgttccgtgcaggtgcagacacggtgcagcaatctaccgtgcgtgcattattcccctacctcgatcggcttatcatcctcgcagtaaaattaagtacagtactacatacgcgagaaacggacgaagcagagcagggtgcgcggcaaaagagatgcagaggctccatatgcaagcgaagcacatccccacagtgacatcacgttgcaaccattggatcactcaaaaaaacacttgtatgtgcagccgccgcatatatgcagttgcaactttgcaaaggcatctatctctagcttaattagcttcacatccccaacaagctagtatacgtggtctcattaatggaggaaccgaatttggtggtgtaataagttactattagttactgtactgaccctgacgaagcagtcgtggaagtggagacggacgaggccggcggccatgccggggttcccggacaccgccttgctgacctcctcctgcacgatgatctccgccgccgggcacagcgtgtcgtagtacccgacctgcagctgcgcctgcgacctcgtcgccatcgccatggccatcaccgccacggacaggagccacagccgcattcctctgcttcctcgcgcctccataatatcgatcgatcgatcgatctgctacgctgctaggctctcgtttgattcttcgcttcttgcttcaggcgctgatcttgcaggactgcagtctgcagcagcaagaggggcagcttttaatcttgcgtggaagcgagctatgcttctcggttaaggatggtgatgaggtggtgggactcgaggtggttttataggcgtgagagcgagagacgacatgtggggggtgaagtgggggagcgagatgcatggtgccaattggggtggtgcccttttgggggcgagcatgattgagtggaggcgatagaaaggcattgcaaagaaacaactttgatttttggactgtaaaaaatgctccaggcttttggtcttcatctgcattctcctgtaaatactaacccgagggtaattgagcatttgaactggatattgataggcagtgcactgcagtagcaacaagcagtcaagcagaacacatgttatgttacaggaaaaccgcgggcagggtgcatgttgggctgagctggcatttgagatgatgagaacgactcttatttgttttcttttcttcttctgtagcttggaactttcttctctgttctcaccttgtcagttgtccccatgcaaatctgggccctggagtagtagtactacatcagcatgcgattattgctaaagtaaatgatgggacaatggatgtttcaagacagaggtccctcggaatcacgtctgctgttttgagcttgtgaattttgcgactttattacctgaacatttaacgattgggatgtgaaactgacggtctggaagaaatggctggatgtgccctgcttccagcacactcctgatccaaacttaagtactcctataaatttcgctatatcacacttcagaacaagccaaccgtgtcctccggaacgcaccgtagcgtggtcggtttgtactaaaaatgttggggttgcttcagtttgtagtgttctactattattgtcatctctcccattagttgcatccggtacgcaaaatagcgtcagctacgcggaatgctgctgcccaagctcttcgttgccagctagttacacttcacggaatccacaggcatcatcctaatcgattgcttcgtttgactcatgcgtgctactcctacttacaaactgggtcctccttgcttccacatgcatgatcgctatcaggttttctggcagtggttaacaagagaaaaaggactaactgtactggtatagtgcggttcgttagggcagtgcagacgacagacaactcaaagccagattcttgcacgatggcttccacgttaaggagaagctaccttagcctgaaacccttttcttcactcgcaccattaaagcttaatggtgtgacactacgtttggatctgttcggttagctttacccaaaggaatcatagtacatcatgaagtataaacgcagggccctgcagatttgggtgaagttgcatgcagtaattaaccaataataactgaagaaagtaggaacattccttaggctgtttcaggacaaaacttcactgtcagaataattcgagttcaagcttctttagcattcagaaacgtgtttatctacctggaaaaaaaagggataaatcccctctgttaactgctacctaccagatggatgagtaggggtggtactgcctgcacatgcatgcagatgcagccatgcaggtagtcgtgtttggtagaagctggatgcataaatcgcgcaaagaaacctggcaatttatagcctaccaatcaatccagcatggactgctgtcgctttgacctcaatttgagaagccatgataaagtgaggttgcataaatcagtaccagcactgtagaagaaatatctttttcagcagtttgcttaatcagtaacagtactaatcgaattgcttgcatgatcactaccatacttcattaataccggtatcaggattcagaagtattatttccttagactcgtcttgtactcgggcgaaccactaagtcctccttttgtttgttcttccatcttgatatcaaagttggctctgctttggttgcattgcatttgcaggcctgttgcctcttttcgccagcatcaactttacggccaataactaacaattgttcgtagaaagtctcagccttatcaatattcagtgtccggttcaacataaaaaattgcgattgctagattagattgttaggttggctttcaattttgcttggcacatgactaaaagtgtgtacgcagcgtgtggcgccgatccatgcattcaccagctaaataaaaaacacttttttcccctgtatttccaggcaacgcgccatggcttcgcaggatttttttagcagagcttcgagaacctgtgagcttgcatgtctgctaatctctcgtgcctcactgtactgtccaaattccaaagagcaatgaatatctcacgcgtaatggttggataatttagttcaaaaccaatgcgtaattccattgaatttttgccgtttgacaaattaaagcatagagacaaaagaagaacaaaaactctctgatgataggaacaagtagaggcttcaaaaatgttgttgttcagcaagcgaggcctagctcagtttgcaaccctgcagtttgtgcggatctggccgtcgctgccggtgagcacctggatggcgcccatcttgaccatggcctggccgaacttggtggcgaagaggtacatgttgtaggcgttctgcgccacgagcgcggcggtggcgttgtcggcggtgagcgtctggtcggaggcgaggacgccgcggccggcgaggaggttctggtagtagctggtgtcgaacgtgttctcgctgccgtcgtccatggccaccgtgttggcgctcccctgcgggcaactccgcgacagccgcgacgccatcgccgcgttcagcgccgggtcctgccccgtgctggagttgtacccgtacagcctcgagctgaacgagctgcaatgcgccacccctatcgtgtgcgcccctgattaaaaaaaaacacagagagaaaaatattgtttgttaaaaaaaagaaaaaaataaatcttttcgagaagaagagtggtggatatgcatgtagcctaatatttatagtgacttaagtaccattctaatatcttgagttcaaactaacagcgaattttagattagattatttgtggggctaataagttcttaatttattgcctattcgcctgggccttatgagaattccagaagttgggctgaattgaatagtgggctgtcattaacaagttgacctatgtgggcttttatatggacctgtacctgaaaggatgaccatgtcgtcctgggaaagcccatgagtggcgaaactttgtgtgagttgggccacatctgaggtgggacggggcaggttggccatcgcgtcggacgccacggaggtgttgccgtccctcctcccggccggaacgcggtacggggtgccgccggcctgccgtccaccaccgaccgtatgcaagttaaaaacaaattcgcagccaccgtgaaagagctagctgcgtaccagcacgacgctgtctctggcggcgaaggcgagtatgtccgcgcaggagaccacccccttgcacgcgctctccagccgccgcttggcgctgtccaccacctcgaaccccctcaggctcttgttcggtatcgcgtccttctccgccgtgctgttcgccgtcgaatccagcaaaaccgacgcgtcacatccctaaaaacagttcatcgatcaaccatctcgatcagctgattgatcccatttccccggaatgaattgaacaatataaaggagagatcgaattagagattggtttattgggatcgaccttgacgaagcagtcatggaagtgcatccggacaaggccggcggcgaggccaacgttggcgctcacggccttgccgacctcgtctctcacaatcacttcggcctgggggcacgattggtcgtagaaccctacctggagctgaccttgcacacctccaatgcacaagctcagtgccacgactactgcacctgctaccgccaccaccaactccattgcccctcgatctcacctagctagctactactataggcagctgaataatgcgtcaaagatctgaacaatgtggacaaatttatagctaggaggctagcaaatgatctgaagaagaaccccaataactagtaaatgaacattggtcactgcagtggactaaccagtctacatgttcttatcaactgcttctactactagtaatattcactgacactgacaggcatgcgcagacaagctttcaggcagccatgtgaaggcctgtagctagaaacatggccaagattttcaggcaggcagggctttgggatatttggtgcgatgtgtgcaaaaaactagccggtaaaacagctgctgcgaccagggttggaaatttcggtcatttcagacccctccgatacgatattatttcggccgaaattttttaatttttccatgaattttggtaatatttattcaaattcaactaaattttgctcaaaatttcagaaatttcggtatttcggtgagcaccgatcaaatcggctaaactgataggtttaaccctggctgcgacttgcgattgaccatctgttgtttggtgccattgtagtagtgaccactgaaccactaaacgagtggcgttgtaaattaatttgtcattgttaccaagggataggagattactcggatgagggattttaaactgggacagtgcctgcgaggattaaaaactgcagttgcttcaagatcggtcaaggcatccggctagttgtctcatgtgctagggacagaaccgaacgtgcatggagttctagaggcttggatataaaaatggcagccatcatgtggttaagcgtgcaaatggtgctgatcgaggtagttttgccctttgcagggcatgtcatagggcagggatcggtgaagggcagcacaagtgtgatagtttttatgctagtggggcactggggcgtacgtttctttgacctgtaaaataggaacacaaatgagatcgtcctgcagggatagggcatcctataggttttgtaaagtactgcacatgtggatgtggccaagattgtaaaatgcatgtgagtgatggtgacaatagtccaccaacttacaacttacaagatcatttcacccccttttctgaagaatgcagacctgtttggttggattcagactagagcactgttatgtatcttctgcgtattcataacgcgttgatgccttcttttgatgtctttgtgacactattactagtacatgatgagagcccataatagagctacaagaattacaactgcaataaccgacaggagaaggcatgagcaggaagcgcttttcctcatgcgtgttgttacagatttcaactttttctgcgcacgctgtacatacaaacacgaaacgacatgttagctagcttatcttagaaagatgagataaatatatgcgggcatctgtagaatcaaacaacaggcacggtggatcacctgaagctggttgcttgtctcttctgttttctcgtctaagtcatcctgcaacgtttgtaaaaggcattagtataggaaccaagttaattcagaaacgatgcttacaaataggagctactgagatacttacaatcaacctagtgtgcagatccaactcttcgttgatcgccagcgcaatgtgcttggtgctgactatcgtctcctccagcttgtccaattcgtcgtcttgctctgcatcataattcagagaagttcagtcactgaacacctgtacattacatggagcagcacacgtacgtgctgacgccagacgagaagggaagaaaaaaggtatatcctctcttacctttaataacgttcctctgcaactcaatgatctcacggttgtccatattggcaatgctgcttacatcgatctttgcgtggttgtcgtccggtccaagcaggtcgctcctaaataaagattcagaaagacacaagtaggaagaagtgtttcatcgtaaagttcagagttcagacttgttggaactcagctgaagctgcaagcggttaaactagtggagtatataagcttgcaaattcacctattggagaagcgcttccgggtgaacggagcgccaacctccttcaccttggagctcagagtggagtgcttggctgctagcttgttcaactctttcaggcttctgccaggtttaagcaaacaaaattaacgttacgtttaggccaatttgatcaatatactatcgtccaattgcaatatcacgtgtggcttgcttaactacttacatgcgttgcttgtttgggagttgagaaaggtcttcctgcatcatgtcaagcctggtctcgagaatcgcgactttcctcctgatttcggcggttcgccgctgcagctcctgcggcagcgacggcgagacggactccctctccgcgatcctctcgacgacgtcggccacgagcctctccgcctcctcgaaccgcttcatccattgctccaatggggaagacgccgctgatgatcgatgatcatcgtcattagcacatcgtcagtcggatgcaaaggttaaaaagaaaagaagaaggttgagatgttgatgaagatacccgcgtgctggtacgtgatcggaagaagtggacgcgccatgtgcaatccgcgatgtaaactctacgagtttttcgtctgatcatccttcagtgaagaacaggatggttaataattgaggaaggttctctgatcttgtggtgttcgtttccgggtcgaacgtagggaggaaaccagagcagctacgagtaggtttctttccggcgacgaccggctccgttccggcctcaacgccgtagcaaaacgatcgagattgttatgtacaactaggtaagtctgcacgtagtggcgtagagccgtagaggacaaaacggagaggggccgtgggctggttgactagtacgttatacgaacatgggctgggccatccaggcccactttggcgtggtaacctaactaggcctagtgactgttacgtgggcctttttagacccatatcatagtggaaaaagtacatcgaaagtccctcaacttgtcatcggattacaaaatcatccccaaccgcaaaaccagatatacgtcatccctcaacttacaaaaccggatcactttaggtcctcgggtgattttaaccccggttttgtctgacgtggcagctaagtcaacgtgggacccacgtgggtcccacatgtcagtgaaacaacttagtctacccttttcacccttttcccccttcccccttgcttacgacgctgggtggcgcatcgacgcgacgccgcttggctcgccgggaggtcgaggcaagcctccaacgctagatgcctcgagttcctacgagctcactggcgacgatgagggccaacgctgcccttcttgcggagtcggaggtcgagaggaagctagaggccacgcgggcgagcttagggtcagacaggcttgggaggacgtagcacaacagcggcacgacagagctggcatgaggcgtgtcggcggtgtcagctcgtccgcttcccccgccggccacagccgcgcgtcgccatcgccgacggctgatggcggcgtcgtcgagtcgatctcggtgcgggcctttcgtggcttcggcttcgaccatcgaggtcctgcgtggctgtgcccggctcgccgccgccgtgtcgccatgccaccccgccgcccatcgctagccgccctactgccccgagttgacccaccctccccgggccgcccgcacgaggggggcggggaggtcggcgagctcggccagcactgagcccacgcgccgccacttgggagccgccgccgtaccaccccaccggccctgtctcctccctccctatcactcgccgctggcctccccgcttccctctccgtcacttgccgtctccttgctaagcaatacactgtgacgctactgcgtccgcggtcacggcggagagagctggcaccgcgggagaagctggtgtggaggagggggtcggccgcgggcacgccacgtcgccgtccacggcctccgcccgcggcatttttccaccaccatcacccccacctcgccagcgacgaatttcctccatccttcccttctcctcctccgccccctgttgacataaaacacgaggcctgggagatctgcttaactccagtgcaggtccaaagctcgccttcgggtgtgttagcgtgccagttgatttgatcatgcaatcaacaagaaatagaaacaaagaaatcgcggttaaatctataaatgatagccgatcggctaagtgccgatgacatatcatttatctttgagccgatgtcatatgtgaatcgattggcgactataaatagataataaaaaattaaacctactcgatcgactgtagatattaccaatatatagctcttatatcgatatatatttaaatcaagtgattgggatagatcggtcgccatgccgagacagtataaaccacttggatcgaaatatatactaataacagaactatatatgtttatagcatagccgatcatatagatctagcatgtatcgactaatactccgatactactctatatcaggatattaaaacaaatataatatatcaaacaaaaacttaatatacttaaatgcaataaaatcttgacataaagggcggatttaacatgtcactgaagcatatagagcgaatatggttaaatcagataagatcggctgaaactccgatactaccctaatcggcaactagaaggcatgctagagattggtattctaaacacgacttaatagatcaaactcaactaatgcagcattaagtatgaaaagaagaacaatatctagacaatcaagccgctggaagtttcatagagtagtggatatcttatataatctaaatcaacatcaagatctgtcacgccccgaactagccccgagcggagctagcccgtgacgctccaaattaacctgttaatcgataccagtcccaggaaacagtgctggtatcacaggaagacagaatatcacagcaacggcggtctctttattatagagtaggagtacagtcatgttgggctgcggacagatcccgagctcacaactgcattacaaaagggaaagcggaagccaagacttggaccaaacatcacaggcgcgacttgggaactaggccgaaaccctaaaactcattgtagccgacttgctcctggaagaactcctcgtcagcgggatccgcttcatcttcttcagcaactggggggggaatatttatatagagcaagggtgagtactcagcaagccatgggaattaagtgtttaatgcaggcttcaaggaaaggttgttgtttttgcaattgattttatttaaactcttttctgaaacaactaagtgagtgcttctcaaacgacacggatgggacagtgtgtctcgtctggccggagtatgtacaaggtatcagtcttttgaattgatcaaggttggcatccggccaacagctttcaaacggccacccgggcctggctgatcccagcagccgcagattttccaaacatcgaacccaaaccacatcagcaaattccacaaagcagtagtcaaacaaaactacgctaggaatcacctcacatccacccatgactgtgggcacggctgttcgaacagtttgataacctctgcagagagggtacactttacccacacgacattactaacccgaatcacccagcccgtgtagaacggccacgtctggtgacctaagggctttcatgacaaggcatttcgaaagccgacacaggttcaccatatgccaacgagaggggtcccagaccaacaccagattaggtcccagaccatactgtgccaggaaacccgggggttctccccaacaccaccccgttgaatccacatgtctcttggcatcatggctcccccgattagctagttactcagccaggggtgtcccattccacccatgtggtcgtacttgtcttatgttcggatgaaattccaaggaaacggtccttaagtgcaagagcgggagactgtatacccggtacgttccccagtccgcgattttggaaattcatttagttcgcaagcaccgacccaggtgtcgggttttccaagtcttttgtaatacccaagttttacccatggttggatattttatattttgagggggggtgttctgatgcgcgtacccgaaggcccgtgcatcgaagcacaacagttaacaaggaggtttaagtgttcaataattcaaggagggtaattgcagcaattaggattggggccggcaggccgtttcgcaagccgcggccgaattacttgtgtaaatcctattcatgcaatatttgcggaaaagaaatacttagatttaaattataggtgcaagatgatcaaaggtgacttgctttgctcgagatcttgagcttgatcctcgaaatcctcgcactgcggatcttcgggctccgaaactacacgcgaaacgggacaacacagcaaacggcgaaaataaggccctattattgacctctaagcatgccattaggtagatcttaggatttgaggaattttggaagttgaacggagtaaaacgtacttacggttgggaagatattaaatttctaagattattggatttttggtctaaaggaaaaaggatttatttaaatccttttcgaaaagaaaagaaaagaaaagaaaagaaggagggaggggaattagacttccctcgggcggctagggcgcggcccgagagaaagggggcggctcggccgaacttaacgggccggccggcccgagaaggcggcccaaggcatgcgcgcgggcggggaggagtgaggaagccggtgggccgggtccatcccgcgtggtccagggtaggacccgcttgtcggcggcttggctcaccgtgagcgaggtgcacgcggggcgtgctagggtctggggaggggaggcacggcgcatgcgcgcggttcgcggaggacgcggtgcggcgggcccacgcgcagcctcacggctcgcggtggaccgcatgtgcaggcagggctggagggagtggcggaccggggtcagcttgacccggtcgcggccgaggtggcgccgacgtggcgcctacgtagccgccacgcgggccggcgggaggtagacgacgacgtcggtcggaacggacggcggacggcggcggcgagcggcggagcgaaccacggcgatacaggcgaaagcgagcacaccgggaggttgcacgggacgaggggagacgagccaacggctcggattcgccgggggatgctcgacggcggcggattgcggcggtggcaaccggcggcgagagaagggggaaacggcgacggcgcgacgggagactgattcgggcaagctaaagcatctacgcgactccgggaatccgttgctagcgtcggattgggcggagctacgccgagcgaggccggcgacgagcgggcgctacggagcacgggcggcgacggcggcgagcacacagcgagcagcggcaacggtcggggcggcgctagctagctatgggaggctactcgtgctactacccgagtctaaggggaggagatggaacgagaagggggaacggagagaagcactaccgtgcggggtgatggggcgcagtgacgaggggccgacggcacgggagtgatctcttcgcctcaggccggggaagaggaagaagacgagcgcccggagtccccttccgtgtccttgcgcgcaccggctcctccggcacacgcgacggcggcggtcggcgagagggacggcaatggcgcgggcgaaaaacggggaagattgggaggggaaaaaggaagggagggcgcctgggtttatagggcggcaatgtcggtttggaaaccgaccttgggcagtcaaggcgcgagctagcgctcggtgctcgcggccaaaacggcgacagaggcggatgacgccggcggggaagagaaaaggaaaaaggaagggagaaaggggggcttgccccttgcctctttgggaaacgaacgagggagagagggcgatgaggcagagccc

SEQ ID NO: 77713 - DNA, 1870 bp, Oryza sativa
tcctattcaaaataaggagcaatcttttgaagaaaatccatttcgactgcctcaactattcgtatccttttaactgtaaaatcagccatagagaggctccctcaatcactaaaaccagctcactttgcgttctgagtgtattaggttgtgtttagatgctagggtgaaaagtttttgacgtgtcacatcggatatacggacatatatttgaagtattaaccatagactaataacaaaataaattacagattccgcctttgaactgcgagacaaatttattaaacctaattaatccgacattagcaaatgtttactgtagcaccacattgtcagatcatggagtaattagtcttaaaagattcatctcgcaatttacacgcaagctatataattagttttttcctatatttaatactccatgcatgtgttcaaacattcgatgtgacagcaattaagcatatgacaacatccacacactggtcctgtatttttagaaaataagaaataaaacttgtattttacactagctctgtgatggacaaattagaaacctacatgtcccgttcatttctccaacaagagttggatgaagataaagattttcgtggcacacttttcaaactgttaaatggtatgttttgtgtgaaaactttctatatgaaagttactctaaaatattatattaatatatttttcaagtttttaataattaaaacccaatcaatcaaacgttaataccactttattttgcgtaaaaaacttaatctttatcttcatctttagaagaaaaacaccccatatgatgttgcttgtaacaaatcacatggaatgtgcactgactagtacatatatactttatttaattgtttcagatcagacaaagaaagagtaactccaacacgaatttactgagaatgaggagatggatgtccatgaataactactctctccatccaaaaaaaagacaaaccctgagtttccgtgtccaacgtttaactatccgtcttatttgaaaaaattaagaaaaaaaattaaaaaagacaagtcacgcataaagtattaatcatgttttatcatctaacaacaatgaaaatactaattataaaaaaatttcatataagacggacagtcaaacgttggacacgaaaactcaggatttggcttttttttttttctgacggagggagcacttttggaagatgttgaaactatctgttggattatgttattttactatgtaacggactgtacaaactacctgttggatgatgttattttgctatgttgacttgttgagacaatttttggactggtgatatattgttaagcacattggaatgtttgaaacctttgtaatggactgtcaaagctatgtgatgaacttgtaatggatttattggtgtatgcaattgtaatggactgattgatttgcaagatgacttatttttttttttgaaaatcatgaattatctgactgcaaaattgtgctcggagcgccccaagtttttatactccaaattttcgatcgaaattttcatatttgaattaaaaaaatttcggaagaaaaaattccgaaatttcggttctttcgcccagaaaaaaaacgttttgtaactgcaaaccctggcgcggcaaaggaggagggagacagaagggaaagaaacgcgtccgtcaacgctaggccacctaatgcaatgcggactccgacgccaagccggtttggaattggatccataatcgatcggtctatatattggcggggtggaccgtgggccgaggcgaggccagaagctgcttccattcgttgccacgaggaaattaaagcgcacgcaacggatcgatcgagaggcgcgacatccatgcagaagga

SEQ ID NO: 77714 - DNA, 1484 bp, Oryza sativa
aactaggatagcatcatcaacatcagaatcgaagaaaggatcaaactgaggctgtacattctcctggccagggtcaacacctatctcctctagagtgactaggacatcatcatcagcatttgaatcgaagggatcaaatcagcctctccattgccttgagcatctatggcagcactgtgatcgaatctagcctctccattgccttgagcatctttggcagcactgtgatcaaatccagcctctccgggatctgtggcagcatatgtatctcccggttccaaatttaaatcaatatccattgttctttgctctcgaccttgacaaattccatgggttgtagcagaaggtgatgttcgttgttgtatagaaggagaccttatccgtatgctaggggacagtaacattctgctcaacggggttctaaagaatggcattgccacgcagggagacttcctttttttgcctcttttccctccaacattggacccatctagtgtaaccctgcaaaaggtgttgcaacgaagttgtcatgaatgcacattttggattataagttgcatcaaatgttaagagtgaaaagcatagtaaggttctgagaaaagataaaagcatccattctgtaagacatctagtactggttgtatagcataactggacagacaaccatgtgatctaacaagaaattatacaataacaagaactccaatttatgaagcaataagataaggaaaagacttatgctaaatgtttgcataaactagaacaaccagcaacagctccctgtaaatagaaatacagtgctatttccttgctctaattaatcgaattttgcacaagcagtagccatgaactgaactatgtgaggttagatgtgaaaattcatttaacctcgcaatagtgagcatctatagagttttcctgaaaataacacattttaggaacacaaaatacatcatcgaaaaaaaatcgaatacgaaccttggagagagagcagttgaggacaaagccgcggcagcgaggcgctcgacacgatcctctgcaccgccgtcgccgacctcctgagccgctttcttccatggtgtgacaaatttgcgacgtctacctaccctgccctcctccttcgtcatgaccaacggcgtccaggaagaacacccggtatcttccatacaaaatcaagaacggacaagaaatgaacaaccaaataaacatggtaaaaaataccagaagacaagaaacacatggtaaacaacaaccgatcaattcaaagaaactactccgtaaaccatacactgttgtccaggaatcagatagaatttatcattttaatttagttctgctggtgtagctcaactatagtgtcagcattacattaggcacaaataatgttcagataatatctactttatccactgatctagctcaactgtggtgtcagcattgcattagtcacagattacctaggtaaaactgctaattacaagtga

SEQ ID NO: 77715 - DNA, 1433 bp, Oryza sativa
tactacgtccattccaaaatataaccatttttatctataaatctagacatataatttttatctataaatctggacatacagttatatagattcatagttaaaaatatttacattttgggacaaagggagtagctagctagctacttcaactacaactgcatgtattataggccctgtttagattttaacttttttcttcaaactttcaacttttcaactttttcgtcagatcgaactttcctatacataaatttttcaactttttcatgctgcatacgtaggtggtgtgatgatgcacggcgtccgatatttgacgtcctacgcggagtcttttccgaagaaacgcattgtcgttcgcgcgttccgctgttccgcacgcgtgacctgatgcgacgcggacaccgacaccgagacggtttgggactggatcagagtatccgtctatatatttcattcgtcgccacgcgtcatcagatcgatcttcctagtagtgctgatccagagacgatcgatccatggagcaggtcgcgccgccgccggtgcgatactgcggcgtcacggaagactacgagcagcagttggacgaggagccaccctcaccgctgtccccgagccgggtctcttccccgctgccgctgccggagcagaaactgtccaccgcatatcttgtggagctccggccgcggcgcaagaacgccctcataaacaacggcccacgctacaggtgtggagatcatgggtatcccatatctacacggcgatggtattcgagctgggcacaggatacctaatgtagatagaatttcttatttgtatcttgggtttgtttcttaacttgtgtatcaaggaaacaccctgaaacttagtcggttacgactgtatcttacctatattttcatattccgttagggatatagattatcttttgtaacccggactccttcccatatataaggggggtccgggcgcctctaggggcatatgttgatttttctcgaatcatacaatcaataatacactcggcggattcatccccggacaggagtagggtattacttcttttataagaaggcctgaacctgtataaatcctttgtctcaaaacccatacacttttccagcttgatagccacccccttttattattgccgaaatctagtttcgacagttggcgcgccaggtaggggtagcgtcaagcttttcgccgatcagtgcaatgggtcctttctccggcatcgacgacctcgtcttcccacccgggcagacgtttcggttcggcagcctcgacttcgtcaccaacaacttcggcaagatttctctccttgactcggaatcggaccagtcgggagagaaccggatctcagtcccgtttggattcccaaacgcggctgaaacctacttcaagaccatctcaatcgagtcggcttcaaacca

SEQ ID NO: 77716 - DNA, 11023 bp, Oryza sativa
  unsure (1)..(11023): unsure at all n locations
tctgacgataaacgccacttctgatctccccttactgaccgaggaaataagcttcactgctacagaacaatctacctccacaacgatgggtagcagagtccattgaagagccatattaatcccttctttgcaagctagaagctccgcctcaaaaggaccactgcaatgatcaagaaaaccgcaggcagagaaaattacttctccttggctattcctcagcactgcaccaatacaccccttaccggagctggcatcaaacgacccatctacgttgagcttcatccatccctgatttggtttctcccatctcagaatcgctggggttgaagcagatggatccttcattttcggcattctgctatactggacgatatgcttccctttaattaaatntatcgattggcactgtctaacttncagtaaggacgagatataactntcaaggaatctcttagacactccaacagggggaggattttaccatgtgtgatctcgttacgaacataccaaatacgccacaacaccatcaggaacatagcatgttcttcccgcggaactatcttcaactgatctagtatccagtctgctcctgtacagtttccgacaatgcctttggttccttccctactacttgcatagcatcccacagcttttttgcttgcggacatcgacagagagcatgtgcaacgtcctctgcctccaccccgcagataccgcaggtgccagaagcttcaagcttcctcttattcttgttttccatagttgcaaggctattggttgcagctctccaggtgaaaaccttgactttttgcggtacattgcatttccaaaccaaattccatgccttggatatttcagcttcagaggaccccgacccattgtcaatagctgctagctgaagagcgagtttgtaagccgatctcaccgagaaaatacccaacttatccggatgccaggctaagaagtcttcctctgctcttgccgagggtcggattgtcaagatcaactcagcatccactggccagaagatcctcttaaccacctgttcatcccatgtaccatccactcccattaaatctgcaacccatttggttctacaattacctctcacagcaataggtcttcgcgagtgattcctcggcagccacggatcacgccagattctgattgagtgaccattacccaccctccatataacgcctttctttagcaactcaagaccatactctattgctcgccatctgggtgaagcatttcccccaaaggcagttgtcaattaaggaaccagaagggtagtatttagccctcaacacccgagcacagagactttccggcctgtcaatcagccgccatgcttgtctagccaagagagcttggttaaacaatctaaagtctctaaaacccagaccaccgttttgcttaggttttaccagctggtcctaggatcgccaatatgttttcctcttgcctctatcagcaccccaccagaaactacgagaaattttattaagatcctcacaaacagaattagaaagcttaaacaagcccataacatacaccggtatggcttggatgactgcttttagcataatttcctttcccccacttgataggaaattctctccccacatgatgattcttttccaaatcttctcttgtaaactttggaatttacctttactcattctttcctctggcgttggaaaacccagatatttatcctcaaagcttttattcccaagctgtaagcaattcctgatcgcagtttgggtatctgctgggcaagactcaccaaacagtatagagcacttcagtgggttaattaactgcccagtccctgcagcatattggccaagaactgacttgattgtctctgcctgctcgacttctgctttgaagaataaaagcatgtcatcagcgaataacagatgtgatatccctggtgcagatcagcacactttaaccggagttaaattcccctgatttaccttctcatccagcaataacaagagcccatccgcaacaaacaaaaacagaaaaagcgataacggatcttcctgacgtaagccacgagttggagcgaatgtatcgaggagggttccattgaatttaacaacgaatctcaccgttgttatacacttcataatccacttaacccatcagtgagcgaaacccaccttgtacatggcttgctccaaaaagacccagtccacactatcataagccttcaagagatcaagcttataagcgcaagctgccttgttctggtgtttgttcttctggataaagtgaaaacactcgaaagcaaggagtgcgttatccgttatcagtcttcctggcacgaaggcactttgattaaccgagatcaactcatccaaaatcgaccgaagtctgtttaccaagcatttagagacgattttatatagaacgttgcataagctgatagggcgaaagtctttcagctccacaggctgatcaatttttgggatcaacacaatagcagtttcatttgccccttctggcatgattcctgaatgaaaaaattccttcactgccgccaccacatcagacttgatagtagcccagttcctttggtagaatctcactgggaatccgtcaggcccaggggccttcaatgggccaatctggaagagggcatcggctatctcttcatctgtaaattccttgcataagttctcattcatcgctgcagtaaccttcttctgaaacaactgggacacacttgcctgatcgagatttgggtctgctttgtaaatctccttgaagtaatcagtagccaacttttccatagttgttgccgtattatgaatagtaccatcactagccctgagcctagagatcctattcttttttgccctccacaccgctttactatgaaagaactttgtgttgcgatccccctctttcaaccaactaatccttgatctttgcagccaaagcatctcctctctatacaacagttcattcatgcggtctaaggcctgacggatctctctactgtcagcatttcattccattaacattgccagatgtttccttgccttttctagctctctaccaatgttcttaaacttcaccttactccaagactgaagagcccccataacccttttcaaagctttgctaatatcccccagatgcaacatctcatctgactctactcaagcatccttaactatgtcctggactgctggttcacgttcccaacatatctcatagtgcaggcatttagcacggcactgtctatcactcccggttgtaaacttaactaggatgggagaatgatcagaacatggcgaagtcagatggaccacctgtgcattggtaaaaatatccctccaactttcatctgccaaagctctatccagccgaacctttacattggctgaaccttgtcgcttattatcatacgtatgaggtacccctgaaaaacccaagtctaccagctgacaagtctgtaacacatctctaaacgcctgcatttgggcattactccttttcctaacagaagtatgctcaaattgccatagagcttcattaaaatcccctacgacaagccacggcagagaggaagtctgtttaagagcatttagatgagcctacatcctgcatcgattttccactcgtggttcaccgtacacaaaagtcacatgccacaaaggaccatccgaggacagacgcacatacgcatcaataaatctttcattaatagaaattatttccatgtggatagattcatgccaaaacaaagcaagacccccgctcatcccctcatagttaacccccacaaaacccttgaggcccaatcttgatcgcagacgtttaactctatcgaccttttgtcttgtctcactgagaaacacgatatgggaacccgcctccttaaccaaggcgcaaaggtcatgaactgacgcagcgttcccgataccgcgacagttccaagccatgcaattcattgctcctgacgggacccgaccatcggtcccgtcagttgaccagcggccccagggctggttgcctccttctccttcccggttactaccccttcagtcttcctggctctcttcagtgcccgtgaagaaacgcccgattcaaacacagatttgctgctttcttccaccatttgttgatattccagcagagcttgcatgactctccctgacttctttgttgcaccctgtgtttgaggttccctcctgtcctctccactgcaatcttcagacaattcatcaccgtaggaagcttgctgacttatagtcttaatagccggtatcatctcacaagaaggtaatgaagttgtatcttccacaccatccaaccgaatctcaggtccacgtttatggcttgctccctctcttcctgggagagaaaccttctgtacttctgtctcccccaccttcattttctctgcatagcccgccaactgttcatcaatctgtgtgtccccttccttctttgcagactcaaaaccatcatgagcgtccactcttggtggaaccaagtcctccccctgatctccttgtttctgtcgtgaggacaatgaacttgcactccctgcccccctgaagaacaggttacgcaccacccctgaagatgatggtactttcaccttactcaccttcctctcaaagggttttagaggggagcatcttaactctgccgaaaacttgaagggctggtcattgttgactcctttcctattgcactccttgtcagagtgtcccagatatccacatatgaaacaaaaatgcggcaccctttcataccaaagatcaaaacgctttgtgacctctttgccctgtgctaacatctttatagccaacttcgactttaacggacgcttgacagataagtccacacgaatcctaaagaaatcatgtttgttccgcccatcgtcacccacatccacctcccgaacttgtcccaatttgctgccgtataattcacctcttgctttcatcatcagtactaaaggtaggtcatagattctaacccaaatagggactgtctccagtggaacttcagatggcctcgacagaccatcaaacctagcaaccaatagagcatcacctctatgtatccatggaccacctttcaagacaaactcataatctccttcagcactgaaagttatgatgaacatattatcccataaggatttataactcatgtcagcccgcaatctccatgctctcctcatatcatcaaacaaagccgcctgatttggcacccgcagagagtagaatctagcaaggattgtccactgtcctgcctcctgtacttccccttcttcaagaatcacttcaactacatcttcctcctcctcattcatctctccttcagtaaacttctctggcctcaaagtattatctcctgagcccgtgtccatcttcaaagcctgtgacgaaacctgctcctcatggccgtcctccacaggaaacaatgcccttgaatccggtgccgcactcatcggaccagccatggtgctatctgccggcttcgggtgggcaatcgtttcaccaacgatccctaaatcacccccaccggcgacaatagacatgggtcctttcagttgcggagagaggaatagccctaatttgcatattagattggcaaggaccttttgatctttgaatcttacctttggccgtcctatttcctcatatatgtagtgattctcaacagagtccataatctgcatcattaccaccccaggaaaccgactcggatcacacttcctcaattccaatcattcccaaagatgaaagattgcagatacttcccaaaacaaccgagaaatcaactgaccatccaacttgatcaagaactcaccacatattccgtacgcaggcagaaaccctgcagacctccttagcagatcggagataaactccatccaaatccatctcacagcacaggagatagccgccgccccgcgatcgcctgggcgtcgcccaaaccctagctccgtcatttccggcaatcacatttactataaaagctcttgtttgaccatgttaacttgtaaaattaagttaatcgtgctatctaattaaaaatggtctcatcaatggcatgcagaatcgcagaataatcgtggaaggatataaaaggagggggcatcatggccacgtcggtttgtcgtcggagaccggagctgacttgtacatataccggctggactagtcaatccaatgactctgaccaatcgacgatggatattgggatgggatcggcatcggacggcccggatcacgcggcacaagggctagtccttttcacatgcactaattaatcatctgtagtacagtattactcctgcttcttaatcaatttcacactctaattgacacgcacgcacatggccatcgttgatcatcgatgctatgaaaagaatatactccctccatcatccataaaagttagaaatatctcactttgagtttttctaaataagttattattatttatagtctttatacattcaagacttaaatgaaaaaataaattaaatgtttgattagtatctaagaagtcatctaaatactcattggttgcatgcttgcattcacttcttaattttgtaacatctaaaatgatttaatttcttcttgttcttggtgacaaaaataataggtgtaacttttgtgaatggagggagtataatcgacatggatgcaatgatgtatgcatgagatggtgataaatatgatgatgccaacacatccacaagactccactaattagaccgcttgaccagcgctgatttgcataaaaccagcacagataacgtccacccaccaccgtacttctgaatataagatatcctatatatcaatatttgttatattagaatatgtcacatactattacaaagttgattttttagacggagggagtgcgtgtctcacaagtcacaagtacaactccataaagaaaaaaccaatcttatctatatgtgttcaaggattgacactaataataccccatcagtgtcggcagtattaatcggcattgattaatgaggagactatcagtgttggtcttactgtatccacgatactttagacgggaaacctatttttggtacggccctaaagtgattagagagactagtgttgattttacagtgtccataatactttagatgggaaatctatcttgatacaacatgtttagttgtgtttaatagttttagcatgcaataatatgtgtcgtctttgctggttaataatcttaaccgggactaaaaagacctctgcaacacctacctagctataaggctcctcccatgagttatcatatcattgctaaaattctagtgtcgattgggaacccgacaatgagagcaagtttaatagtatagccaaatactagctccaattcatttatagccaatctaatagctcattcatacaatagtacactattaatatctggtcccatctgtcatacacacagcgtcttggagtctgtgctacagtctatagcccgctgctcttctctctcctcatttatctacttaaaatatgtttacagctggctttatagcctgctattatacctgctctggtagccctttgtagataatagtgcaacagtaaacacatgaatttcgtatttgtatacaccaatgggagaattgcaacagtatagtacatacaaacaactactacatgcaaggaatatttctccttttccttttcaaaatatcgagatcagtctaccagctgtgtatgaccactacatatggggaaaaaaataaaccgaaaagaaacaacctctgcagtgtgcaatgttgaattctacgacgatgctgctgccagagtgtggttgtcgttgggatgtgacacgacaatttatatttgcaagctagcagctggatgtacgagtagtcaacacattattacggttgcaatccttgaccggattaaataaacagacttaacttaacttcttgagatgattcacctaatgacctaattaagaacatcgtccctgtgcccacctagacctagctagttataatctctgttcgtttaaacttccgtttccgtgcgactaatgacactgaccgagctggttcaaatatatattcacttgtcatgatcgatttctaatatgtgctgaataatataatggcttctaaggcaatgtttctttcagcttgagattattataatccagattattgggagtaagctgaaagaaacatacaacttattaaagtagcttattataatctggagcacagcttattataatctaataagctcatttaggtgagctttttccagattattgggtgaaaaattacccaccatgccacccactccctctttagacttgcaaacccaataatttaggctctaataatgtaggaaagaaacaattaaccgcttattctactacagattataacaatctagcttatagtaatctgactcagtaatctagattataataatcctaagctgaaataaacagagcctaatactggttggtaagcacaaacgctttgattgcaattagttactcctatacgtgcttaccagctacttcatccgtatcaatttactgttctactccctctgtcatatgatatagcaaccaataactgaatggaacgcctccctccgtcttataatatagcgtagtcacatccggttttaggttgttgtattttgggacggagggtataataaatttcacactaaattaagaacaaaaatcataataaaaagaacatgacatactactctgcagtatatactctcttcggcataaagaaaaaaaaggtaaggatttaaaaatttctatagctttcattaatatggggagaaaaatttatgaggaagagtaaaccagaagaatgagagagtactgttgggttgatggttaaaataatacttcctccgtttcacaatgtgagtcattttagtatttttcacattatatatatttatatagatttattaacatcaagatgatttctaaaaaaaacattaagatgaatatggaaaatgctaaaatgacttacattgtgaaacagggaaagtaataacaatgataatatcatagtattaatgagattttagaaagctaaaccgatagtatatactttacgcatctgacaagcatatgcagtcctatttatagtaggagaacaatgacttttgtttgtgatcaaaggacacgtgcggtttttccattgacggtacctgcattaaggtcaaaattaagcgtgtttcggttttgaagaagccaaatccaattttcaactatgcacacataactaccatttcgttcggagactaaacccagcaatttagcatacgtggtctaatcctaccatcgacaataataatataaattaataataacagaggaaaaacattcagcaacagtattactcacagcaagactttttaatcttgctgtatctgtaacagtacacccttcatccaaaaaaaaaataatttcaacaacaaatctaaatatagactatgtgtagatttataataaaaaaattgattcttttaattttgaatggaaggagtatgcagtagtagtaaaaatatctcctagagaatttttattctatgagaacaaattatatattaagctcttttttttgccctatgaacacacgcacgcaaaccctacccctatgagcatcttcaaagactgggcccgactgggccggcaaattctggagagattgacgaagtaaccctaccccctatgagcatcttcaaagactaggctggactgggccggcaaattctggagagattgacgaagttaccacaggcgcctagctgttgacgggtacgtcgcctaccactgaaagcacaacgccgataaatcctggaaaattcgctcccatggggagtcgaacccaggaccttaggtgctactgaggctcttgtaaccactaggctacaggccgatattaagcttttgaaacaaaaaaattggttactattaatattttgaagtttctaaatgatggtcaagaaattaatcgacttaatttaccctattcattttcatattacaagttgttttgatttttctaatcaagtttgtaaaaaaaaagtaacatctaaaacatcatattaacttcatcaaatctaacattaaatatacattttgataatatgtctatgtttattttaattaaaaatattactatatttttaaaattttggttaaatccaaagaagttcaacatcaacttataatataaaacaaaaacagtagtagtaagtagatactttctccttaaaaaaaatccaacctaagataggatatgatatatcctattacaacgaatttgatattttaggttagacttttttttactgaaggagtaaatctgatatatgaccattttggattgatgccaaaatgtgccctgccaatttattggtaccttcaatagtaatagtataggtttggattgaagccaaattgtttggctattcctatgatcaatttggcactaatctagagtcttcttctctgtatcatcaacatttggcaacatattagtagcaatccaaacatgtataataaatctctaccttacaaaaaaaaattggtaataccaaaacatgccaagaatttggtagatactctctccgtctcataaaaacgaatctaggaccggatgtgacatattctagtactacgaatctggatatgatatgttacatccggtactaggttggttttttatgggacggaggaagtaaggtagagaacaaaagagccccataatttttagcgcagtggtaaactggggagtggattttcacccctcgaggggatatcctcttgttgtttgcacatcactcaaatggttatgaaaaaatttgaaagaaattgagaagatgtattaacatgtgatatatcactccacaaacatgcaacttctacatctcgcaaaaaaaaataaattcgtttgttttttcgttgcgagatgtagaagttaaat

SEQ ID NO: 77717 - DNA, 32273 bp, Oryza sativa
attttttccataacaaagatacatgtaaacaacgagatgatgaaaatagtttctccggtaaactgtggtggagaagtggagaaccgaataggccttgcaaagagagagggggaggcgcctggcgtacgtgagcgtggcgtgggcgcgggagagagaacaagtcaaaggatgcgaacgcaacaagacgagcaccagcagcatggtcaggacgacacaacacaactagtctcctcgactactcgtctctcggtcttccttccctccccctcttcctcctcttgctcttcccttccaattccaatcccgcgcgccgatccgatccattcccaccaccaccaccgtcgtctccctcactccaacctccgccacctgcgaaacctaagcttgctgctccgccgacgaggctgatacgtgctgagatactactagtagcacctgtacgtctaagctagagctatggggtgcgtgtgctccaggcggtttcgggacgacgccgcgccgcgctcggtgcagccgctcgccgccgcctacgaggcgcgccggggtcgctacggccctggcgacttcgactccggcgagctcgccatcccgccgcccaagctactcacctcccacaaggtactctactactactaccaccgtaattttctatgcatcatgtgctgcatgtgttggaattttcgagctccatcgatccatcgagatgtgcttcagctcaactctccgccctgcttgcctgcaacttccatcggacagctgcatgtgctgctctctacttcgcgatttgtttctgcttagttaggtagccagccggtgagaattctccacgacttgatgcaccaaacacgcgttgccgcaaacggagcgctttgtttgggttcgaaatctcaatccgccttccacgtccaattcctcaaaatcacaagttgggggtattattgatttgatgttattttttgctgcgtttcttctctcgccgccgtgttcagaaattcagagaagccgtcaaactgagcatcactgtgaagctttaattgagctgcctttcgctgtcaaggcttccatggggacttcatctgaagctgctctctcgtatttcagtctccgctttgattaactcaaatcaaactagattggcagtggtctgaggatgcagaatttcacaaaccgtggggaatctgcactgcatctttgcatgaattctttaagcggatcaggggaaagagagggacacaccaatacatacagcaagtgaaaaccaacagcttacacacacaaaaattcatcaagtccgtgtaggatgcagcagagtcaatcttggcggcccttggtttatcatattgtaagcactattgtcctataggaggaggattccgtccttttgctcagataagtgaagaactgccgtgcttatttaacgttcacgttgctgtcagcctgagtctacttcttggactggtcaagccagcgacccaaccatgagcttctgcttttgttccttcctgctgaccacttttccatgccaaccatggagtttgggaaattacatccttcacttttcttcttgcaaagacatgagtgatctgcttagcttctacttggaagaaaacactaaatgtgcaggagctaataagtgagacaaagtacagactgtataactggaaagaagctgactttgtttatgtactctcagcatgttactagtgttataattcaggcacccagtgattcggcagtcatcctggagatggaaaaagatatagacagatggttactaaagtatcgggttaagaaatacaccaatgcgcagcctactttgatctggccaatgcgcatcaggggtgatcgtctatatatcatcagaaaaatgaaaggaggccatctcccccaaagtgaaaggactacggaatagccttagaggagtgacctccccattttgtttcatttcacccgtttcattcattgagtctatgttttcatcgaaaagcttgcacttcaaattggcttgtttcataattttgcaataagattgacaggaaaagcactgctagttcaaataaatataccttctttcttaggttctttgttacgacgaaacatctgatattattcttcttagaggggataatacgtttctctcgctcttccttttgctttgtttgtgctataactagttgtctttctattggaaattgaaggcagcaaaagcggagactatatcattagaagataagagtagtcttttcctttcatattaactctgacatactaagttgtgacaggtaccagaaacaggtacacttttaggaagagccagcattgctgctgtcgaggtgttagataccctcgggagtagcatgacaaatttaaatcatggcagtggatttctctctgggggaacaaatcgaggcaatagagtctgtattttagcatttgaagtcgcaaacacaatagctaaagcttccaatttgtggagatcttgctccgacacgagtataaaggaattgaaggaagaaatattgcgttcagatggagtgcaaatattggtctcctcaaattccagtgaactattgtatattgcttatgttgacaaaaggtatgattggttcaagaaggaagttgtcctatcgttcctttttttttttgttgttaatgcgattggctgacatggatttgatggaattctacagggatgaacttgacatcttttcaagagaagtaattcgatttggtaacctgtgtaaagacccaacatggcataacttaggacgctatttcaacaagtaagaatctgagaagtatgcttttcatttaagatgctatttacaatcatatcagcacttcctgtacttaacactatgctgttgctgtgaattctgatgtgcagattaacgacagattttgcgcctcaggatcattcaaaagagcatatggaaactactatccagcaattgatcaatttggctcaaaatacttctgtatgtatcacttgataatttctgtattttgccgtatgtaattgataatacttataatttttatggagtcaagatgtaggattcattaatttattattattattctcccttcaaattattgaacggttaaactgctgtaggaatcaggattcaagaatttttcattaggccttaatatcttatcatgaaggactaagtctcgttgcataacatagaaccacagttttgaggtgctggttcgaaggatatgctgatgggcttgttttgtaattgcaggaactctatcatgaattgcatgcgctggacaggtttgagcaggattttcaaagaaaatttcatgaagaagagtcagtgccagcagccagacgtggtacagttatactgatgtcatttttaagaaaatatattgttgatagatgctagaatttaagcaagagggttttccattagctcaccttaattagtgacgtgctgtagattgctctttaaaatacttaaaatggacagacgtatcatgtaacctattcggtcacgaagtggttttccttgggtgtcttcttttttatgtttgcttctttcacacaatgttgttcaaagtatagaaaatggtgatgcttattggtttcaatcttcttgttcttggcagagagtgttatgatcttgcatagtgaactaaagcgccagagaaagcttgtgaaaactctcaagaagaagtctttggggtctcgaactttagagaccgtatttcttaagccacattttgctctgttgcttgattacttcataccaccagattgcatttattggaatatggcccattgtctaacaatcgcaaattgatgaatactctgctcataatatccacacatttttattttgaagaatgcttacactgaattctgtcattggctatccagattgtggagaagcttgttgatattgtcgtatttttacataagcaaattcgggattcattcagtgaagctggtaggtgatactcaactggatggtttgcagtagcttaaaatttgtgcgacgatatgctaacacctctctaattaaaaaagtttctgtaggtgctgaccttttcaattcagagcaagctcaaaacaaaagactaggttcctgcggtctagccttacattatgcgaacataatcaatcaaattgaaaatattgtaagttgttttgacttttgatgatccatacccatgtttttcatcccttctggatgtaccactttcaccgtctacacgtttgctatatctgatcttaagactcagtgctctcataatctactgtgtctgctggatatgccccacttccatagctcacatgcttgctatatataatcttaatattcagcatttgcataaagttttgattatgttgatgaatcattcatttattcattttccttaagttaactacaacagtcagttgtaatgaatattttatgtttggtcagtataaagtatctattagtttcttagctactgagtactagttccaacaccatagtgcataggttgtattaccaaagtctagatgtttaatccttaatctccactacagctgatacttgattgattatagagtcaaagttctcaaaacaatgtgtaattatgcaggtttctagaccactctctcttcctcctagtgctagggacaatctgtatcatggtctgccagtaacagtgaagtcagctctcagatcgcgattgcaatcagttaatgcccaagaagaggtttgtgttctctgcagccctgtggtggtaaaacggttcatttcctatattctttatgcacatggaagcagtagtagtatttagatatgactagctcaacactaataagatcttgttacatgctagtttccataagcatattttgctcctgaaaaaggtgaaagtaaaatagtccatgtagattgaaatcttaatatgataataattctgtatatatcatgttaacaaagttgaggactttatatttccagttgtctccaaagcccgcaaactgataaatgtatgctgttttcattatgtgcagcgtactgtagctcaaattaaagctgaaatgcagaaaactcttcgctggattctaccgattgctgaaaatacaataaggtgggcggaacttgttgcaaagtcctactgacttctgagcttagggttattttctccctaaaattcattcctttgtgttttcatacttttaccagagcacatcaaggttttggatgggtcggcgaatgggcaaaccttgggttagtatcaaatcgtgatttgcttatcatataccttggaatttccattgataatataacatgagataaaatagtaacaagtattgctccttgcaacataacctaacatactgctattttctagttgcgaaatgaacaagaaatcaggctcccagctcagtatcacccgtgtccagactcttcattacgccgataaggcaaagacggagcaatacatgctcgatctggtggtgctgctccaccatttagttgtccaggtgaagaacagaggctatgggagcaagtcctcaaagcacgaccagtcccgatcccgcaagggaatggatcttcaacctgaatccaagctcaacacatctccagtgaacaacgccacatatccgagcccgttgtcggagtccgaacgcgagacgctggaccacctgagcttcaagaggacgggctacggtaggagcaagagctgcgagcctccacccaatagagggaagaaggcacatcgaacctgggattcatgccggagccatggcagctcgccggcgagggaattcggtaggaactcagcttcagagcttgacaagacgatggacctggatgtaatagatgggttagatagactgacttcttaccacccaacatcccccacattttgttaggtatatgctgcacaaaaataggtattcttttggtgttcctacggttgattgatcgtatatatatcttgtaaatgtgtgtgatctacctatatattctcttacatgtacatatatacatagcttagtagtacagccctgagtttgagtggaaatatagcaagatcacaagtgatgctctatgcctcgttcccatctctccttttgccttacaatttgtgcaatgtaaaggggaagtttcagcacaaaattctacatcatagtgttacttttttttttgaacgactcgcatgagacggtgcgaagttctattgatagagcaggaaaaaattacaagattacaaccgtggagggttgtaaccaggaacaagaaaaagaaaaccatcacccacacaccgacagcgccaacacacaagtccggaagaagactatcaccggaccggccgccgctagaccaacaaaaggaacacagacgagatcgcccccgaggggatgccaaaacgacgtcttcaagaagagaagcgacggaaaaaccgccgccgccgtccgtcggggctcaaaggagccaagactgggcttacgcccagcaagcacccttgaggggtgagacagcacgacaacgccctcaggagggggaacatcgatgtcggtccggtcaaggccgggctaggttttcacccgctgctcaccacctgcgaatccacgactgacgctccgatgctccaccaccgctcaagctctgccgacatgtgggacccctgcaccggcggcccccacccgctagccttcgtgcgtcgaagaccgcgccacacccaccggcagctcctcctcgcaccgaggtcgcctcctccaccgccggccgcgcctctcgcgccaagccggcctcctccaccggacgcgcctctcgcgccagtccggcctccctccatcggccgcgcctctcgcgccaagccggcctccatctccgccgcccgcgccgagccggcctccgctgccatcggctgcgcctctctaagccaagccgatctccgacccctcctatagtgttacttatcaaactcctgtttgggggagcttcttgttagggttctctctaggatcacctaggtttagatctagtcgggtagtactcttgggtggatgaacaacattatagagatgaaacgagagggtttagagaccgaccggttgaggtgttggaggatgaagaggtgccggacatcatcgttgttgtcgcgtgctagacgtgggcggcagcaacggtgtgctcgatggtgatggcggtcgtggcagtggcggtcgtagtcgatgacgagacgtggtacagcggtgagacttcccgtcactggctacgccccctctcgatcggttagggtttgcgggtggagatggcggcggcagcgaacctcgtgtcgtgtcgccccggcctccatccctctttatatggcgcaggatgacgggggcccaccagccattgggctgggcgcccccgatcagggcgcaggtgaaggccaccttgagccgttgggttagggagggagatccatctaacacttctggcagctgcagcttctcatagaatctccagttaccagaagctcccccaaacagtccagctttttacccagattcttagaatatgtagttgtagaatctggaaaatgaactagaagccaaaagctaggttttccaacttcttcagattctcaccagctagcttctcaacaattgtttctcaggatattaagctccaccaaacaggccgaactttgtagcagctggcctcccatcgtttatcttttagattactccaactaaaatttaaattaaacttagttttaagttgattctaagggttttttttaatcttagtttattttttacagtgacttttagatcgataaaaacaaacataaaagttttactcataaactattttcagttgtttcgtataaatcttttttacggcttaataatagctgtagagcaaacaaaagagaaacgatgaagcagacaactgagaagaggtcttggccacaaattgcagccgggtccaacaagtttatccagcaagattatctttctccagtctctcagcaatcttatccagatgcagatatagcagcagcatttctcgcacaagctcattccggcgatgtccatgtccaccacccacctgtacgcggcgagagagacccgaccaccgcctcctccgccgctcgccgtcgccgtcgccgtcgccgtcgacccgcccgccgaattaattaatacggccacagcccacaggtttagtaccccgtttggatttctcctttccaagagaccaatatgccaaagccgtaagatgaatagtgtcctagagttgttctagaggaaaaggataattgacagcaacttttctccaacctggcccttgtcgattgatccccatgctgtatatgatgatgatgatacatctatgtcaattgggttctagaatgaaaatattgtatgtgaatcttgtcggtgcagatgccagccttctagaatctaagatacactaatgggattgtacaaggtcaggcatgtgcatgcatagtgcataaccccagacagctctaaacaagttataatacattaacatgcagcatatcctataggggttctatatttctctaaataagataatagcagtacatctgttctaaaatatacaagtaacttttagctatgaattttttaatggaggtatagctatgcaagcatatataaacaagaaaaatggtccctatgtccaaatagaaaaaaatgtaaaattaatctagaaaaaatgtcatgtctttgtcatcacaagcataactttcaaccgattagtgggcgaaaagcactggatccagataaccacaaagaagaagaaaatcaccctcccccaaaatcattccaaaaacatcaccttctccagcaatgatctgatccaccacagcacattggcctctcatgagatcagctggcctctgcgaaaattactgggaaaaactatgaggctacgatcctgaccgtcgatttcggatcggacggatggatcaccatggataccattcaccgtggaagaaggaaggttggtctccaccatggcgccaaactgtgaaagcaacagccatggagaaggagaaaaggacatgcacatactactctctgactcagcaaacaatcacataatcctctaagaaaataaaaaaaatgatttcttctagagataagatcaagaactcaacgtccaagtggcaccactaaaattcctcaccccctaaactccctataaataattcacctttcttttcttttctgatctcatcgactcgacgacgacgacgcattccgaattattcaagaaattcaagaagtgaacagaggaggaaaggaaacatggcttcgtttgcatccacggcggcgccttggggatgcgtcgccggagctcggcgtggcggcggcggcggcgggcggtgtggggtgcgcgcgtccgcggcgctggcggtggcggcgccggcggcgaggacgcactacgaggtgctcggggtcggggcgggcgcgagcaggggggagatcaaggcggcgtaccggcgtctggcgagggaggtgcacccggacgccggcgccacgggggacgaggacttcatacggctccacgccgcgtacgccacgctcgccgaccccgacgagcgcgcgcggtacgaccgcgccatggccggcccggcggcgtcggcgttccggcgggcgcccgcgtcgtcgttccggcggcggacgtgggagacggaccagtgctggtagggcagaagcacaactccggtgctccctgccctactgcgccgcgctctccgccgccggagctccgtcgggcacggcggtttgccggcgagtgacgtgggattctgtcggccgtcggatccatcatagaaggcccagatcgaagaggaaaagaggaagcggagcgagatatttgcagaggagccctccatttaccatctattgtcaacaaggtcctcccgcgaccatctcggccgttcgatcgacttgtgcggcgcagattgagccaaaaagagaggcgcagtgcggatgttttcctatgggaccctcaagtattcggtattatcaagcatacccccatcccgccgccggcggcggcggcggcggagcaaagtgttgccgcgccggcgagtactgcggtgatcgccggcgtttcgtggggataacaccgctaatgcatggttcttctcctgcaatcctgtgtatatgctgtaacacgaagagaggcaattttagagaactcttttgtgtgctgattagcttgtttatataataggttttagctctgtctctctcaactgtaaatgatcaagaaactattgtttcttctctttccttttcaaatcatcatcgttgagtactaatttgaagaacactcgaatgtgtatctttggtgattcaagttttttaatttttgcagttacctgaataagcatttctagtttttgcatcacttctagtgtcagagacaggatacgctgtccattctgcactctgaataagataaaatatagacatgacctagtttccaaaaaattaaaaaaaacatgacttgaactgaactgctgaagaagaagcagtatacgcctactacttaacagagtgaccagattataaaaagggattttgttcacttgaaatcatctttaggatcaaaagaattgtgtaaagaacacctgcaaattgcgattaactgggaggacaatttttcctgtgaaccataagatgggataaatgcatcccaatacaaccattttgtgatgattctgctagtgctatccacagatgatgtctgttagcacagaacagaaggcgatgcagtctcgggcttgtttgggaggcctacaattcggcccaccaggattcaggccttagcatgaatttctttcatgacaccaaattgaaatctcttgcaccaaatttttcggtttcattcgccagcagtagccgttgccatgccaagatacaggacagcatcacaacgcatcatcgcagcaagtcagaaacagccaatcacatgatgccacgtgcatatagatcgatcgggttcagagtttcttttttaattcagaccatatgcatgctattattctgagttctgaacaatattattctgcagtacaacaaacatgatagtacttgaaatcatcttgaattatataagcccagttgtttatagctactgtatatacactatacagctagctactatacagatataggtgaggtctgatgaacggctcacctcacatatacagatcataagttttttttgacgcaacagatcataagtcaaaacagaatagcattgacatctccatctctgacagagcacaactactgctcgcgtataaacgatcgagtatacaacaatttttgctgctcacctactcgcaactaaacctttcttgtactatctgtttaatgtcttaacctctctgattctctgattgattctgcaacgcatcacacgcatgttgactctttaatttctttatacaacaacttgtaggtttctcggaaggacccatccattcatttgacgaactattttccttagaaaaatgatataaaatagtgaagcccagtagaagctagcttggttatctagctgatcatgacatgaacaatcaaaatttttgcatttgatttgttcactatctcctctctgtctcttctcatccatgggagcacttctccattttctctccctactactcttcctctccttgctccaaggtaagcttagctcaaaaacaaaatcatcaagcatatgcacatttgtaatttaattcagtggacgacgcagctatctgtttttaagcttaattgttcacatgatttgcttgtaatttctctaattcagtgctcgaaatgttgtttgattaagcaagaaatcactgatcaagatgaactcaattgtgatcaatatattaccaggagcacaggctgcgacgttcaccataagcaaccggtgcggctacacggtgtggccgggcatcctctccaacgccggcgtcgcgccgccgtccaccaccggcttcgccctctccccgggccagacgctcgccgtctccgtcgccgccgcctggtccggccgcatctggggccgcacgctctgcggccaggactcctccggcaagttcacctgcgccaccggcgactgcggctcgggcgccgtcgagtgctccggccgcggagccgccccgccggccacgctggcggagttcactctcgccggcggcagcggcggcggcggcggcgatgacttctacgacgtcagcctcgtggacgggtacaacctgccgatgcttgtggcgccgtcgacgccgccgccggcgagcggcggcgcggcgagtaataacgggagcagctgccaggtgacggggtgcgtgatggacctgaacaagtcgtgcccggcggagctgcaggtggtggcggcgtcggcggcgaggagagcggtggcggcgtgcaagagcgcgtgcgaggcgttcgggacggcggagtactgctgcagcggcgcgcacgggtcgccggcgacgtgcgcggcgacggcgtactcgaggttcttcaagggcgcgtgcccgcgagcctacagctacgcgtacgacgacgcgacgtcgacgttcacctgcgcggccgccggcggcggctacgacgtcgtcttctgccccggcatgtccaggtaaattgatcacaaaatatttctgcacgcacgtcttggcatgcatgcatgcgtgctttttttttttcaatttcacattggccctatacaatggcacgtcgtgtacatgtgcatgccatttggcatagcctagacggtccacaccctctatcataatggcactaccactacagacactgacgtgtaagataatagtagggtgagacccatatatcagtgttgtcattggcagtgatattatggtagaggatcctcaccaagcttttgaccagattgacttcggcgtctcgtttctaggcttgtttctttttctttcttttcgattacacggaaatcgtatacgtgcacgcaccacttctatgaatgcgccatctaacacgtacatgagattagaggtgggagacctctcggttctgactctaataactataaaattgatgtctttatccactgataaaaatttgctggctatattttttgtctgcttttctaattttaatcaaagaaacacgctttgggtattagaaaaaaattgttcgtctgtgtcttcggttagttggcattggtaataagttttagtttctgtgactccacaggaactcgaatgacaaatcacaacctgaaaatgatcagatatttaatcaagccttgattaactttttctcgagattacataatttggatgacatagacgcctagggtcgtgacaaaaattttaaaccaaataaggttcaatcgggacattgcgtccatcttaaccgtgttgttcctgattggttttgcagcacaagttgctgatataattttttagttcaatcattttggtgcatcgatcacttgaacgtgacagccagtgctggcatgcaccacgcatcacttgaacaagtttagtatgaacaaaacagagtgtctctctctgtctctgtgggaaagaaaacttgggcgtcgtctgcagaattggctagtttatatatcgtttttggctacaagaatggcgccaaattttttttttctgtttacaattaatttttagaaagtttctgtttacaattatggttaattaatataaaactaagtacatttttatttgctaatgttgcgatgattgcaacctgatgcagcctaaaatctggtggaaatcctgaggcagtaggcttgccacctacctactcaacaatggcgttcactggaaatgcagagagcttgacgatgagcaggaattcgcttgtgatcctcctgatgatcatcagctcagtgatatcgacgctatcttggtgatgtcaattcaaacattgtatttgcgtgatgtatcccattcatgattatagatttagcagcatatttttgccagtttttcttggaggaaaacttcattctttcagagcaggcagcaggttcatccactgctaaaactataatgcacaatgcttcaagattcgcaaatatataaaacatactgtttctgaaaatgcggatccagatcaaactatttctgaaaatgttcacaaatttcaaaaactaaagcaaattacattgtaaaatactgggcgagcttcttcttcttgacctgtacttgtttaccgaagcacgctgacgtccggcgtgcccactttctgatcttcttgtcttcagcaatgtcggaaaaatcacagtgatcatcatcagccaatattgtgtggggttcaatggacataaactccagggcaacggcattctcaaggatgaaatagaccagctcctcctgaggacggtaacaccgaaacccgctcatgtagaccgtcttgaggtgatcatggcggctcaagcgatagtcctcccttgctaccttggtcttgcgaacccgacatttgtacttcttgtaataatacatctgcataattgtaaactctaagcacaaaaacatgaaagctctagctgtttaatctatgcatcacacgaaaaatactacctaacagtatctaacgcatcaaaagccacacatttaccaaaagaatttccatttagttggattcttgtttttatccctctaacaaacaatgaaagcttgatctaattcccactggttctagtgcaatgaaggaaaagaacgacagaaaaacacaattcaattttgtttttcttcaaacattgattattataggtttaaaaaacatttagtatatcatagatagattgaatgcaattgaaaccgcgctaaaaattttaacaggtgtacataatctcaaatgaaaatgagtgaaggcaaaggaattatagcgcacttaatatgactgggtaaaatggatcaatactcacatgccattctagcacctccagtagaggagtgaattccaagtagtgcgccaattgaacaactcccttacaagtattcggagcactagttaagacatatacctcacacttcagatgcctcaaatgcataaacatgttgcgtggttgtcgaaactagatttcgacaataataaaagggggtggctatcaagcttggaaagtgtatgggtttggagacaaaggatttatacaggttcaggccttcttataaaagaagtaataccctactcctgtccggggatgaatccgccgagtgtattattgattgtatgattcgggaaaaatcagcatatgcccctagaggcgcccggaccccccttatatcttggaaggagtccggattacaaaagataatctatattcctaacggaatatgaagataaaggtaaaatacagtcgtaaccgactaagtctcagggtgtttccttgatacacaagttaagaaacaaacccgagatacagataagatattctatctacattaggtatcctgtacccagttcgaataccatcgccgtgtagatatgggatacccataatctccacagtagcccccgagtcctttgcagtcgaccatcgtaaccctctcaaagatgataatccgagtacttcaaactcttcaagccaaaatctgccgagtggactgtaaagggcgaaaagataaagaatatggtgcatcgaatagatgcacctaattaggtgtagcccccaactatgtgattagttaacaaactaaacatatagttgaaagacaaaataataacactattgtgcattacatgacaaaagcgtacgcggcgcctaaataggcatgctagccgactgctttttagccacaataaaagaaatccgagtggtttacactctaaaaggttcacgaatgaactcacttgacaggcatccgaataaaaaaactctaaagattacccatcaagtaccataaagattatggtaataaataagtcaaatagcctaggccatgactatttaccatgaaaactggcatataacacgccaaggaaatgactataataaaaacaagtcattcctagttaacccaaacagcttttgtagcctaaaaaagcttgcaaaaacagcataacgcctttctgtcggacacctttttaacttgcattgcaataattccaaagaattatatgaccgcataaaaaggatttcatcagcattgggcaacactgttgtgtgcataatattgccaaagcaaaatatgcctaagtccctaaggaacacaatgggccacgctgttaaaagtattgggctgaagtattgttcaggcctaggcccattagcacctccgatacccttaactgaaaaatccgatatccaagcggcgcttcgtcttccccgccggaactctcgccattttccccactccctgctacagtgcaaagctgcgccggcgaactagggttcacaactccggccaaatccacctccgaaaagtgcatcaaaatccttctcgtgatccaccgcctcaatccctcacctctcccaagccatccctcgaatcaaatcagcacatttgagtgaaaccgatggcggaagagagagaaagcttcgaaggccaatgggcgtcgtccgacgtaacggaggaggatcttaaggagatggtggcgcacggcgttctccctgccaaggagatcatcgggtggcgaccagcgcacggtgaggctttcccgtctccggatactcatgagattgtggtcttctcgcatttcttctacggcggctttgctcttccgacctcaaaatttttccgcgggatcttgaatttctatggaatcagcttgcatcacctaaacccgaattccatagtgcatatcgccaatttcgtccatgcttgtgaagcctttttggggatcaaacctcactttgccctattccgccggatcttcttcctcaagccccaaccaaacaagaacaaaccgtgtgtagtcgggggggcaggattccaactaaggggaactctgagccaaaaatatttctcgatgcccttcaagacttcgaacaaaggatggcatgcaaactggttctatgttcagaatcccgagcctgctcttcccgggtactcttgtcttcctccagtgtaccaagatacttggaactctcttccaatcggagatgaagcagtacaagccttggagttgttggatcgtatgttaaatcttaaagaacaaggcttacagggagagcaaatcactcggcacttcatcaaatgccgactggcgccaatcaaggaaagatcccgcacagcattcgagttcgacggcaaacatgatcccaaccgtgaagaaccagattccctggatttcaaaatcatgaaggagaggatgtataaaatcttctcaaatgcaattgtagtcagctactctcatcaattgccagttgtgccatataatgcattcaatccgcctccacaggtatacatcggaaaccctcaaaccgtgatcagaacataattttatcttcatgctgagttgactaactatggaagcatcttgttcagggatatgcattgatgaagtcagatccaccagtcactcagcgccggtctcctcgccaacacaccgcgcagggaggtggagggccaacgatcagaccagatccgcaacctcagacctccaaattgactggtcaaacaggtcctcgcaagagaaagctggtactcgatgatgatgaaggcgacgatgataaatctggggataagggcttgcctaataaacccccaaagcgcaccatgcccaggaaaaaattggctggccgtgcaatgccaaagatcagaacatcttccaggtattagatctctcggtatgatttccgcttcggcatgttttccgatgaagataatgccaaatactgaaagaacactctgcaggaaaccatctgatatagatccatctggaaaagaccccgatcctgccatgacagagcaaaatatatccaaggaccccgagccgactgctgaaaaccagccgaccgctgaaagccagccgactggcgcccatgcttcgggcgatagggccaatccgagtgacctgccgccgactggaaaccagtcggcaacaactgaaacggcaacaactcaagagcccccgactggaaaccagtcggacgcaggccctgatcaagagatccccgaggtagaagcgcagacgacgacttcgcaaggaccagaagctggtaacgactcgatagctgggtcttcaggtaaagaacaaagaccacctcacgctcagctaggtacatcttcaggttagttgtcttctcgaacaatggtgatttaaataacctcagtatatccgtctaatgtcttggaaacacatcaggaccatcaggtgatgacggagaagaaatccctcgtataaaggcgaccgacgactctcgtcctcctatcttgatcaaatggtgggacgagaactcacaagccgccggcatagtcataaaccgtcaaaaagaagatgaagaagtgtgccagctgaagaaagcgctcggagaagccactcgtattgtaaatgtaagtcttccgagtgacggccttcggtaactttgttttctttttagcaggactgaaccatgatccatcatgcagagaatccatcttcgcaatgaggccaagactacaactttggaaaagctggttcctcatttgggaactctagaagcagttagggaccagctgcatgagaccaaggagtgcgccaaaaagacagagaaagagttaagggaccgaatcgcccagctccaggatgcaaacttcgaactaagtggttcatcaaaaggtaatcatccagatctgttccattgatttatgctgtcataattgcatcctcaatcatctggatttcaaacagcgcaagccgccaggatggaacagatggcgaagcaaattgaagccctgagagagacaagacagaactggctgcgcaaagggactcggccttgaagaaagtcgaaggtaacgccagctaacaatctgagcttctctccttataacgcaacagatgctcatcataaatgtgttttgcagatcgcaagatcaaatctcaagctcagtttgacgtcctggttggtaagatcaagaggcttgaaggagcaagggataacgtcgccaatgccgctgcaccaattatccaagctatgttcttcaataatggtggtccgagtgcactcgacgcaaccgaaatatttgacaagctgagtgttgctccggaagtatatttcaagaatatcaagaaagctggaagtatgggagctggcatggccttggcgatgacaaaatccttgtacccgagaattgaagtcgacaccattgatggatttgcagacgggacaagtgaagaagctgcccttgatcttatcagcagtgcgcaaaatgcggctgataaaattgcgagtgatgttgtagagcaatttcgcaatgacgacctccaaccgagtaatgaagactctgatgatgaaaggactgattctgactgagtttgaatgtaatacatggaggctcaatttgtacaatactggtgtatttatgctgtgcttgatgattcttgcgaagtttttgatttcttaaaagtttttgctaagctttgttgagcctaaaacccaaaggagctattaaaaactttcagtcctcgcaaactaagtagaaaaaccaaacaaggcaatgataaaccaagtaagcaaactgaattgataaaaaatcacactccattattatgatgatagcccccgactgacaacttcaaggagaaaacttgatgtttgacagtcaaaatagggaaatacaatgagaaagttaagcgtagaaacgacgaagatgttcaatgttccaagagttgtcgacgagagtgccgtcttcgcgcttgagtcgatatgaacctggccgggtaacttcagagataataaatggcccttcccatagaggagataacttgtgccgatctcgtgtggtttgaattttccgtaaaaccaggtcgccgactagaaaggcacgagatcgaacattgcgattatgataacgtcgcaacccttgtaagtaccgagctgactgaatcaaagctgcttcgcggacctcttccagtcggtgcaagtcgtccactcggtcttcttcatatcgttcttcacggaaattacggaagcgcaaagattcgaactcgacttcactcggcaacattgcttctgccccatagacaaggaaaaaaggtgactggcctgtggcccgactgggcgtggtacgcaaagaccaaagtactgatggtaactgtgacacccatttgccggcatagggtttaagccggtcaaaaacacgagctttaatcccttgaagtatcatgccgttggccctctccacctgtccattgctcattgggtgtgctactgaggcatagcaaatcttgattccaaaatcttcacaaaagtctttgaaaactccgccggtgaattgtgtgccattatcagtgattatccgattgggcactccaaatctatgcacaatgttgatgaagaagtctcgagcattatctgctgtaatcgtgacaacaggcttagcttcgatccacttggaaaatttgtcaatggccacgaagaggtgcgtgtaaccgccgactgcctttttaaacgggccaaccatgtcgagcccccaaaccgcaaacggccaagacagcgggatagtttgcaactcttgagctggtaagtgaatttgtctggcgaaaaattggcaaccttcacatgtgcgcacaattctgtcggcgtcagacactgcagtaggccagaaaaaaccctgccggtaagctttgccgacaatggtgcgcgcagcagcatggtttccgcatatcccagaatgtatgtctttcagcaattgtctcccttcctctaaagatacgcagcgttgcagaattcctgaagggcttttcttgtataattcagcttcatgcataacataaagtttgctccgccttgaaatccgctcggcttcatctttatcttgagggagctcttgagaagttaaaaatcgtatgaagggctctcgccagtcggcttcaaccgtagcgacatcatgagtgcccgcaacttgagtggtatctttgtgaggtaccgtcggcgtataaaggtgttcgacgaaaacatcagagggcgccgcctcacgcttggatccaaagttggcaagtctgtcggcggcttcattgttgtgtcgaagaacgtgactgagctcgagtccatcgaacttgtcttccaacttgcgtacctcttgtcgatatgccatcatattgtcatcaaggcaggaccactctttcataacttggttgacaaccagctgcgaatcgcctcgaactattagacgctttatccctagggaaattgcaatccgtagcccatgaaggagcgcctcatactcggcgacgttgtgagacgccgaaaaatgtatccaaagcacataacttagtctttctccagtcggggaaattaaaaccactccagctccagtgcccgaaagtctttttgacccgtcaaaatgcatggtccagtgctctattttctccacgggggtatcctcttggcactcggtccactcggcaacaaaatcagctaacgcttgagacttgattgaagtgcggggcttgaatgatatgtccaaagacatcaactccaaagcccacttagcaatccgcccatttgcttcgcgattgtgcagaacatcgccgagtggaaatgatgtgaccaccgttaccgagtgaccttgaaagtaatgagacagcttcctggtagtaattaaaataccatataacagcttctgaacctgagggtacctcgttttggaatcggtcaggacctcgctgacgaagtagattggtcgctgaactttctggacatggccttcttcctcacgctcgacgaccaagactgtgctcacaacctggggggtggctgatacatacagcaacaacggctcctgcgggtgtggtgaagctaagaccggtggcttggtgaggagttgtttgaaatcttcgaaggccttctgtgcttcgggtccccactggaagttatctgttttcttcagcagcttaaagaagggcatcccccgctcgccaagtcttgaaacaaatcggctgagcgccgccatgcatccagtcagcttctgaacatctttctgggtacttggcggtttcatgttgaggatagcagtaactttctccgggttggcctggatgcccctacgagacaccataaaaccaagcagcttccctgacggtactccgaaggtgcacttttcagggtttaatttcatcctgaaagcgcggatgctcgcgaaggtttcttctagatccaaaattaaatcatccttttgcttggtcttgacgactacatcatccacataggcttcaacgttgcggccgatctgtgttgaaaagcatctctggatcatgcgttgataagttgctcctgcgttttttaatccgaacggcatggtgacgtagcagtatgccccaaagggcgtgatgaatgaagtcttcaagcagtcggattccttcagtcggatctgatgataccccgagtagcaatccaaaaaactgagaagctcacagccggcggtcgagtcgactacctggtcaatgcgaggcaacccaaaaggatctttgggacaaaacttgttgaggtcggtataatcgacacacatgcgccattgccctgttttcttccgaactagaaccgggtttgccagccagtcaggatgaaggacttctttgatgaagcctgctgctaacagcttggttaattcctccttgatcgcgtccttcctgtcttgtgcgaatcggcggagtcgttgtttgataggcttggcatcttctttgacatgtaaggagtgctcaatcacctctctgggaataccgggcatatccgaaggtttccacgcaaagatatctttattattttgaagaaaggtgatgagcgcgctttcctatttacaatctaactcggcgcctattacagcagttttagtaggatcagaaggatctaagggaatctttttagtctcggcttcggcttccccactttttgaaatcttggcagcgggcacttctccttcgctcaccgtggttgcagccagtcggatttcctctcgggcagacactatctcgcgggtttgggccatgtcgcaactctccttgtcgcatgtgacagcttgcttgatgtcgctccgtagggttaggactcctcggggaccaggcatcttcatcatcatgtacgtgtagtgcgggacggccatgaacttggctaacgccgggcgtccgagtatggcatggtatgctgtctcgaaatcggcaacttcaaagctgatattctctgtgcggaagttttcccgagtgccaaaagtgaccggaagagtgatctggccgagtggagttgcggataatcctggaattactccatgaaaaggcgcattgcttgattttaactcggagcgagggatctgcatatcatccaaagtcttggcgaagaggatattgagcgcactgccgccatcaatgagggttctgcgaagcttgacgttgcggactactgggtctagtaccagggggtaccgccccgggtggaccactcggtcaggatgatccgagcggtcaaacttgattgcaatctctgaccatcgaagatattggggcgtgtcgggctgaacagcgttgatctcccgttcagtcaacttctgcttccgtttagactcataagccatggggccgccgaaaatatggttgagctctttgcggtggtcttgaaatccagccggggtgtcgccgtcgtccttcttccttgacgtgctttgttcctcgtcggagttcttccgagtagacttggtgtactgctccgcgaactgcttgtagatgaagcactctttggccacgtggttggagtttggatgatgcgggcattgggagttcataatcttgtcgaaggtgttgacgcgcgaacgctgtcgagaagagtgagcggcggttgcaacaagttcctcaggcttacgcttgcggtccttatgattgttacttccacctcctcccgtagccggcgtatttttcggcttccaactgggacccgactgcttcgatgcggtgacggcgtcttcggctttggcgtactcgttggctttttcaaacatgagcttgactgttctgggaggtttgcgcccaaatttgccgaccaattcttcgtggcgaatccctttggtgaatgcggcgatgatgacgtcgtcggtgatgtcggagatcttgttacgttgttcagaaaatcgccggatgtaatctcgaagggattctccggacttctgaatgacgttgtaaagatcatattgcgtgccgggacgctcgaaggtgccttggaagttggcgatgaagtggtcgcgtagttcggcccaagatccaattgtaccacggggcaatccatggagccaagatcgggcggaatccgctaaagccactggtaaatagttcgccatggccttgttgtcacctcctgctgcgcggattgcgagaccgtagacggtaagccacgattctgggttagtggtaccgtcgtacttctctattccagtcggtttgaagccggctggccaatccactcgacgcaggtcgtcggtgaaggctgctaccccatcaaggtcgtcgtcgtagcggtctggcgagtggtgacggcctcgagctgctcggcgctgcatgattgtgtcgcgaagatcgatggggcggcgacgaggcggtgaacgtggccgttctactcggcgctccccacggtagtcgggaggcgagtgcgcggaccgctcgtcgtgacccctgctcctgcgattggatcctgcgccggtgatgctgaggcttggatgacggtagtcctgagatcggaagtgtggaactcggctaccagtcggcgtgtggacgctttcggagttaactggaaccgaggccgcaatcatggtcttggtctggttcaggatgttgacgacatgatcagattggttgtgctcgttttccttgaggagggtgtcgaggagggtgatcgcggcaaccgcattctgctgaggggtacggaaaaccggtatcccttcaacatcttgctggccgatgagatcacgcgctcggcgcccagcttccaaggttcgctgccgtcggtcttcagcctccttcgcgttccgctcatgctcctgctgctcccggcgtagtcgctcttgctcttgtgcttggcgctcctgctccagtcggcggcgctcggtctcgcaacgtgcttcggcttcccgggcttggcgctgctcctccgtttcattgtcggccataaagacgccgaagaaaagaggagtgtagttgtcttctaggcttccgtcgaagtcgtcaagatccacgtcgtcgtagtagcgagaaccgaactcatcgtattccacgatttcggtgggacgtgagtcgacggtgggagagctgtagtagccatccagttggtccgttgaaaccgtgccgagtggttggaggatgacgccgacttccctgaagctaggcgaaatcggtgttaagaccgacttccgcctaggcctacgggatggagacggcgtggtggtggagacggctgccgaatcgtcagggagctgcatcaagatcgatgggtaaggctcatcgtcttgatctggcgttgttggagtagatgcgatctcggccgagtggtttgaagccgactcgatcgagatggtcttgaagcaactttctgccgcgtttgggaatccaaacggaactggaagtcgattctctcccgactggtctgattccgagtcaaggagagaaatcttgccgaagttgttggtgacgaagtcgaggctgccgaaccgaaacgtctgcccgggtgggaagacgaggtcgtcgatgccggtgacggaacccattgcactgatcggcgaaaagcttgacgctacccctacctggcgcgccaactgtcgaaactagatttcgacaataataaaagggggtggctatcaagcttggaaagtgtatgggtttggagacaaaggatttatacaggttcaggccttcttataaaagaagtaataccctactcctgtccggggatgaatccgccgagtgtattattgattgtatgattcgggaaaaatcagcatatgcccctagaggcgcccggaccccccttatatcttggaaggagtccggattacaaaagataatctatattcctaacggaatatgaagataaaggtaaaatacagtcgtaaccgactaagtctcagggtgtttccttgatacacaagttaagaaacaaacccgagatacagataagatattctatctacattaggtatcctgtacccagttcgaataccatcgccgtgtagatatgggatacccataatctccacagtggtcttgtcaatgtatgaacctgaaagacaaccaaacaaatggtaaggcagtctaccaagcaagcaaacaaatatacaaaaaggcaaaccaaaagatgaattccttggaacaaagggacaaacctgtcctaggtcatagtcgtacatatgtaaatccaagctaagctccttgacaggtaaagcacttggaagcacagtgaacacatggtcaagttgattaagttcaagaaatacgattgttgccttcactgattttgggcaaccatgaagcatgattgagattgcctcccctctatacccaaaacgcgtaagacaggaaacatgaaattcaatcatctgcacctccgtaccccaaatccgcagatgttgaagcttgtcaagttggcatggtattaccaaatcacccacgccagtgcacacactgatatccaagtcctcaagaagagaacatcgtgacagcaagtctggaagatcccccactatttttacatactgcagcgcgagccttttgagcatggtaaaaccagaaatatttggatgtacctctattaatacaacagctaggaacaaagactcaagagcagggtcatgcttagcatccaaagcatcaagtgagaagtggtaaacatcttctagcagatgtttccgtgttggccatctgtttctgtgccgagattgtaggttaacatctataacctttgccatcgatatgtttgaattcatccttgttgaggtcacagttgatgctgaacttatttaaccctattcccttgtggcgtcggacaacatgatttactgtcttagagaagtaccatcggtcaattttgagagtaccctcatcagtaggctcctgcttggtgccatcaaagcacagattagggtggcatgtccagagcattctccagtttcttgacacaaggctcgctctagccgcatctctgagtggcataaaagatactataagctgctgaatatcctgtcattacaagagaaaacaaacgaaggcatgctcaatcaatttgtaggtgctttgattctataataatagaactcatccgtgcaataaggcccaatgtttcatctatgtgaaaaatcacacaggcaggcaaggcatggcaggtgttgatagatgataggggaaaaaatgaacttttttttttaccccggatagagagaagtcagggaaatttagagttttttttgggaatacgcaagatgcgcatctttgtattaagagaaataaagagtatttacacgaacccaaacaagaaaataagagggggacgggaagataggagaaggacccaaagatcttaagcctattctcacgccagcatatggaaacgacctaaaccaagacctaaatgattagcaccggtagcaccgcatgtgtcaaccgccagagagttgcttccgccgccatagctcgggctatctctgaccagggcctttgctgagagttgaaaaccctattgtttctctctttccagattgtccatgcagttagagttgcaattgtgtcaaatccccttctgctagccgctcccactttaaggcgggagttgcaaagccagagataaaaggagtcttcattcagggggagacactgcggtagaccaatgctggaaaggacagcccatcaaagttggcgagactctgggcaagcgaccaagatgtgatcaatagtctcttcatgttgatcacaaaggacacatctatccgggtgaggcaaccccctagaacgcaggcggtccgccgtctagtagcgcctttttgtgaccaaccaggcaaagaaccggcatctcggggagggggggcgaaggtcttccagatgggttcggattggaaaggaaccctacctagaaagagtgcccggtatgccgaacgcgaagagtagactcccgatgcttcccacttccaaataaaagagtcggggtggtcagagagccgcacagaggacctcaggatgctccagagctgaaggtactcaagaatagcctgcaaacccagcgcccctgtgcagtctctaatccatctcctgtcttgaagggcctcggcgaccgtcctgcgacggcgaaaacgtgccgggacagccgcccaaacagccggagcaatgcagcgaatggaggaaccctctagccaaatgtcttcccaaaaaagaatggactccccattgcccacccaacgcagactgttgaagccgtcgcaaagtttcgctcgttcaaggaaaccgggatgttgaggccgtgccatggcttatccggcgaagtgcgctgcaaccagacccatctcgatcttaaggcgatgcccatgcgatccaaatccggtacccccaacccgccgtagcattttggagcacaaacaccaccccatgcgacccgacacttgccaccatgggtactgactttgccggcccaaagaaaacccctccttatcttgtcaattcctttaattacccacttgggtgcatcaagggcaatcagcaaatagattggaatcgagcttaagaccgaattgaccatggtgatgcgaccggttggagacataagatcatattgctagtgcgggagccagcgagcgatcttgtcgacaaacggctgcaggtcctccttcttgaggcggaagatggaaagaggcaggccgaggtatgtgcaaggaaacgaagctagcggacatggaagcgccgattgaatcaaggagaggtcatcatccgagcacctgatcggaagcgccgaacatttgttgaagttcgtgtggagaccggaagcttcgccaaagatgcgcggcactgttgtggcggcctccaaatcggcaaccgtcggcctgacgaaagcgaccacgtcatcagcatagagggagacccagtgagggatccccagcggctggaggagccccaactcttctaccttaacaaagagggagctcagagaatccatggcgaggatgaagatcataggggagataggatccccctgacggacaccacgcctgtgccagatcgtctcccccggcgccccaatttagagttttacctcagggaggtcttgtatctggaaagatggcggcggcctgagtgagtcgctgacactgcggtggtgctccaacctcctcaccttggtggtcgtcggatactccattccatacgctgcagggggagcgagggagacgcaggttagcagtagcagtagaggagagacggggaagggagaaacctggacagagtgtaacaacaacttaacaagggatagggtttatcatattttgaacccgactcgaatcgatcgggaaggatagagattcgatcggcaatcaagaaatccatctagtagcatctttgttacctgcggagaggcttcaatgcgctaccagcgagaagaaaccggcgcatgtccgccatgaatgatggcaagctagtagagtagatagatgggacggacaggtcggaaggagatggagctgacaagtgggtcccacatgtcggtgacccgagcatagaggtaggccgctcaggttcgcgatggctcgataggcatcctgtcttactataaagttatcccccactaactccttaagcttaacatgcaaagatgccacatcatcatccactgacaagatgccacatcatcattcactaattaacaagatgccacatcatcatccactaacaatcatcacatttaaacatcatgcaaacatgctatatcttcatagtttttataatttaaaagcttttcaaatataaacatattaaattatcatccaacataattcacataatgttttaatgtatatctttattatattttatgatatcctatatacttatataagtcatcctcacttagttagtgcttaaatgattaatctatggtccaaattatctctctcctttttttctctaattaagtcatatcacatcaattatttttagcctttagatgattaatctgcggtccaaactatctccctacttttcttcttccataaagtcataccaccttactttttacgaatgaattaccattctatatactatttaaatttaaattatcataaaccacattaatttacttaatctgatgttatctagctatcttacacgttattttttttattgttatcatactgaattctcgcagcaatgcgcggggtttcacctagtattttgaagggttgaaccctagtttgaagctgtcagaaaacaaagtgcccaaaacacacacgcataaaaggaagtaggcttcaggcaatatctaagggcaagtacaacggttcagcgagacccgtcgacatgcactgtttttttgcgaaaacccccccgcacggcgctcgcttcggcccatccgtcgtctcgttcgtcgacgaggccagcgcgtgcttccaggcgaagcgacggcgatgaagcccattgtacaacccaatccgggtaggctcgagaggcgcgggatcagctgcacgggatcagctctctcgcgcgcggaacaggttcgcgccttcctcgcccgcaaaatctctctcgcgcgtgttgaaatagccccccctgcgttccccatccaaccctatttcgatttggccaccatgtcgcggcaggcacggaaggaggcggcggcggcggcgcaagatatgctgaagttggatgcggctcagatgcgcaagccagctgcatcgcaatctcgaaagggtgcggcggcgccgatgcggaaggcccagggaggagctcgggcggcgtcgatggtgccggagcagagcagttcagggttggcggcgcgtgtgccagagcaccggagttcgagatatggcgcggctagtccaccaccaagctccttcaccgacggcagctgcttcttcaacggcagtgccggcggcttcttcggcaacgccggccaaagccctagtggtcaaccatggagttcttaatcttcagatcctgcaacatggtactatctctgaactttgcttctgtgatgagctcaatgatgggaatcatatggctaggaattaattttagatgttatttgcacttccctcgcttatacaagatttgggatacactgtcatgagtttcagtattgtggttgatgcaaagattgattgcactggtgcagatttctttgatagtttaataaagctatgtaactagtttttatccactgtataacatcaaagaggatgaagcactgaaacaaacattagttcctacttttacacataacattagtccctagttgctttcattgctcatatatatgtgtaaaatatggcaggggaaacaatgcaacacctcttggaggcttcataaacttgatccagcctaacttgtctcaacaatttaattttgttggagaccaaaatcagtcagaagatgattactcgactcctatttcagctagggacaatacatatgttaatgttgacagtggtgatgagacacctaggactgagaaaagaatcttttggactcaagaagaagatgttaggatggtgagtctcactgtaaattcactgtgtttatagtttttttacttaccataacagtccaagtgataatatatgctaattaacatttacagatgagctcttggctgctcaattcaacggactcaaccgttggtgctgataggaagaatgaacaatattggactgatgttgaggctacttacaatgagactacaccaagtcataggagaagaaatgccaagcaaatcaaggaccgctttcataaggtaaataagtggactgaccttttccatagtgcttggttgaaggctagaatgatttatacaagtggctataatgatcaaatgtggattgagaaggcccatgtattctatataaaagacaatgagaaactcaatctaggtccttttgtgttgatggaagtatgg

SEQ ID NO: 77718 - DNA, 1360 bp, Oryza sativa
agagagagagagagagatggggagggagggagagatgggccgagaggaattcggcccatcgaacctgagggaggcaaaatagacttttgcggaggaatttgatttgggacggattttggattcgggattaagcttgacgatagatcggggatttgagatctgagatggcacggacactagacaacaagcaaagaaacagatttcgcaattaaggtttttaagagatagttttcccgctaggcgccacgacggaacgggcgctacaagatctaacctaatcggctgccctctactaacagatgttagccgattgtaggttaggtagcgatattgttagagattatgtatgatatatgataacacgacgaattacgtaaacaagattagagtatcataaaaatggaagcactaatcccgagaacacaagccgtcataacaagttttacctcttgttgaagatcgaaaccgatgcagctcaactcgaaagcaggaactcgttgaaataaaactaaagcaaaaaggtggcgatgcgccgaaattgtattgaacgtgtgttgttgttttttacatagggctcggggtctatttatacccaagaattacaagatatgtccataccggacacgaccattatctctaacaaactctaatataccataagtctttgcggcagacttttgcccaaacatatctctaaggaaattacataaaacatcctaattaatagatacaattgccttctcaggactctatccatgtgcggcaatcatcttgaagcacctcaattcaacccgatgtcatacaccaagtcgtactgtcgtaatcggctgcatcggcttacctagtccgacttagacccagccgatcctaatcgtaaccgatctggactccagccgattcttgctctgttctcggatagatctctgcctccgactccacttcgatctaatctccttttccgatgccgatgttaccaaatttggttgttaacaccccccccccaccttgccggcaacgacgacaaccacatcgacgcgagcacaaggtatgtgagcacctgcttcccctccgccctgggcgccgccgccatcgccaccacagccgcctccgccgtcgcccacagcttcccctcggcctcctcctgtcgcccacaatcctgctccacaagcttgctgtgtgccgcctccagcgcacgcgccgcgccgatgacggtgtgcacctgctgccacagccccttcctctcccgcagcgcgagctctcaacgccgcctcccgtcactgtcggtagcgctcgtgcacgggaaaaggataatggaagagaggggaaaggggggaaaagttgtgtttcactgacatgtggg

SEQ ID NO: 77719 - DNA, 871 bp, Oryza sativa
acatttgtgatatttttgacctgattaggcctccatgaaactctctacatgttactagatacaaactgattttatcaaattggctactctaagtattacaaagtattatctgggagaagatctgtacaaaggggggcattggattattcttccagagcaaaaaaccgatgaaattatctggccaagcctggccacaatcaagcaatacctactttgatctaatccctctacatttccaatatgtatgtcatcatacttgtcatatgtatagaactttgtatgtactaaacatggccgtgcgaaaactttggttttgattccagataactagaaattctccttgtggaagtcgaatttcgtgctcgtctttctcgagaaatcttgagcgagctcacgcagttccttcgtcagcaccggcgcgccacagtagaacacccctgtaatgtcaaagaagaatcaaatttagtgtaaaaattcagaattccaatagtgcatgaagacatgataggattggattgagatgatagcatcatgcctgataatgatacagttaggtaagggagcacttcttgaaaacatggcaccagcatatcttgggaatctttttgtgcatatgaactgaactttatgggtgaagaattttaggatacctgactatgtattgtttaatgtatagctcgagcctaaagggactgtatgccaagcggttgtaactatcatcaagtaacaatgattggtcaatccataaattatatagtactaatatgattcctattcaacctaacaaacttctccccaatccacaaactaagtgcataaataaacaaatctcaaaagtctgatgttgctaatgctatgcatgtattgcttg

SEQ ID NO: 77720 - DNA, 15547 bp, Oryza sativa
ggcacgcgcggcggagctgcggcagcaacgccgggtcgacgctggggtcggcggcgcccgtcgcgctgaagttgtagaggcggtcgctgaacgacgtgcagtgcgcgcggccgacggtgtgcgcgccggacagggtgaccatctcctcctgtgtgaggcccttggcggcgaagctctgggtgagctggtccagcgtgaacgtcggagccgggatgttgtccgccacctccggctcgagcgacgccgtgccgtccctccggccgcccgggacgtcgtagcgggggcccccggtgagcgcgacgccgtccctggcggcgtaggcgaggacgtcggcgcaggagacgacgcctgggcaggcggcctccagccgagccttggcggcgtcgatgacctcgaagccgcgtaggctcgggttgttgatcggcgagtccctctccgcgacgttgtccgacgtcgactccagcagcaccgacccgtcgcacccctgcatgcatggatggataatccattttgcatgatgcattgcatggtgaattaattcgcgtgcgtgcgtaccctgacgaagcagtcgtggaagtgcatgcggacgaggccggcagcgaagccgatgttggtgtagagggcccgggtgacctcctggcgaacgatggtctccgcctgcgggcacgtcgccgcgtagaagttggggtgcagtgacccatcgttggcagggaaaccggcacacacgattgccatggtgcataaccacaagaccgacactgctgctgattccgccgtcatgatcaaccgcatcattagtacacaattagccacccgttcgagctagtacagtggtcacttaattggtgagctgacacaagctagcttaattaactggcaattaagtcgtcgaggttaacacacatatatagcccgcggccaggcattgcacattgttaggtgaagtgccacgtactcgcgtgatttgcaatgtgggatactgggattgtggccaacctgcagatcgaccatggaaagtgtatttgggtgggtgggggcgtgtgtgattggatagcgccgggtaattgggttattggggcacactgaagcataaattagctccaggttgagtaggatttggccacgaattacatgtgtgtccggcatcaacttgagagagaggccattactgagttcatgggtcactacatcatgcacgttcccattgaactcgggttggtggtaagcagatttggtggactgtgttccaatgggcgtcacgaccggatggccatattttagatttcttcaaatatgtacgtgccacggcggcacggccgtagtgactggtgatccttgaatccatgagcaacgaatgtgccactaccgagttgtgactgtgagggtatatatgtaatatttaaaaaagaattgacggcaacaacaataggatcctcccccggccccctccattgtgttttttcttttacttttgaacctttttattttaaaaataaacttttcaaaaccttattttcggatctaaacctttagccatgccagccagttggctggcaaaacaatactatgacggcggtctcgctggtgtgatagcgttatttggtcatgccagtctcgctagcgtggcaacgttatttagtcacgccgctcttactgatgtggctggataaaactgtcacgtccattgcatatggcatgttagtgttgttttatcacgtcaggcgggatagtgtgaccaaaaggttcaaattttgagaataagtttttagaagcatttattttaaaactaaaaattaaaaaggttcaaaaagtttaaaaactttcctccagttccacctatctccttatctattggtgtggagaagctccatctctacgccacccatgccattggcggtaatggaacgtgctcttgacacaacaccacaacgatgccgcctacacactatgtcgagcagatccaatgtagagacgtggtgccacttagttggagggagacatcggccaccgtggtgttaagagctaatgacgcgatcaaggcaactctgctgatagcagggagtagggggatcatatgttagtgtcaacccatcttcgtgctcgatggtgccagtgtcgttctccaccaccatcacctccctccgtccaatccgctctaggacacgggcacctagtaaaaaaacgagatttggagaaagagatgtgcctccaaatatttcttgataagaaattatgagcgcattgaaaattgaacacgagacctcgacattgaaaccacacatcccttgtcactgcactatcaagtgcatctcctcgtgggcagccagtaataagagctcgataggcgagaagtgccctatagtaggacattaacttgtttggagatttttgatgatttcttttcaattcattatgcatattgtcgcacattgttgttttagtctattcgatcagatatgctacacatgatgcacactccttcgccatcttaatgcgcccggcaacaatgtagtatttttttttatgttgcagtgcagtcggtatgcactttgcgtggacttaaacatgcgtcaacacgtgtgtatatacagcatagttgtgtacatgttggctgtagctacagaaaaatagtggttctataacttttggtagcggccttaattagttccagatctcccaagtgctccactacatattcgtgcatgagtttgggcgacacgcaagcatgtatgtgtggatatcacccttcagccaccgtgttgcaaaatattactaagagacactccatacgcaggtactcctcctactaattagtagtgctgtgcataagctcagactcagggagaagcctaggaaggcaaagagaggaaaaaatttcggcacgtacactgtcccggtcgagattggcgcatgaatcctcgtgatgcaggtctccggtacccgactgcggtgcgcccgttcgcacaccatcatgctctgttgcacggttgaacctgtcgtcgaccacgctgagccgcgtgccgtatgcctcgcttgccggccgcgcggcgcgggccacgactccatccgcacgagacgggctacccacccatgggccgcgtgctctcctgcgttggcgtccggcacccaagacaccagcaccccgcgcggcccagcaagttaagggataagtcgccgccgcgcgaggacgcgggcgcggactcggctctggtccctccccttatcctgaggcgaccctcctggtgcgcgcgccaccaccgcaagtcgttgttgcaaccgcgagcctcgctcgtctcctcttcctcctcctcctcctcgacatggtcagcgagcaaacggcgccggtggcgaccgccgaggcggagctggagagcagcgccgcgccgcccgtcaagcccgacgaggccgcggccaaggcgcagccggaggacgacgcccccgttgtggaggatgccaaggatgatgacgacgacgaagaagacgacgatgacgacgaggatgaggatgaagacggttaactctcttcctcctcttctccttcttcttctcgtttcgtcttcgttaatactgcaatctttccatgtgaaatgcagcgtgtgtggtagttgggttttactactgtttagaaacgtattagtgcgtcggggtgcttggatttcgttaatggtgtctctttcggttcttgtagcaattactaatgtactactctagatagcaagatttatagcctgacttgcagttttaaatgaccttgaattgaaggtgaacaaggtgcaatcggaaacgagggctccaagcagagcaggagcgagaagaagagccgcaaggccatgatgaagctcggaatgaaacccgtcacgggagtcagcaggattaccatcaagagagccaagaatgtaagaaactgtgcagctgctgcaaacaatctattcattcgaatggaagacagaattaatgttttctctgaatcccgtgtgtttcagatactgttcgtggtgtccaagcctgacgtcttcaagagcccgacgtcggagacgtacgtcatattcggggaggccaagatcgaggacctgagctcccagctgcaggcgcaggccgcgcagcagttcaggatgcaagacctgagcaaggtgatgtccaagccggacgcggcggcggcggcgccggccgacgaggaggaagaggtggacgagacagggatagagccccgcgacatcgacctcgtcatgacgcaggccagcgtgtcgcgggccaaggccgtcaaggcgctcaaggcgcacgacggcgacattgtgagcgccatcatggagctcacggcctgaagccccctcctgctgctgcattggcaccacctctcttcccccatttcagtatcgtgtttttttttatggcgtttcgtcgtgggtttgcataagatgccctgtttgttcagctgctggactttgcatcaaacttttcatagcatgttcccatattagtgtcatcttaaatggagttttcagacttgtttgaacggcaacaccaatagagttcgatattttgagtcaattaagaggagaaataagatgttcaccaaatccatagcatgccagcgcaatggtaatataaatttattggattaatgcattgttttgtttacacattgcacgacagaattatgaggccccgcgcctatcctatgctatcaagctatcctttttctatcgcggctcctatttatcacatctcaccactataatcgccagcgcaggtaaaaataatcctctactctcactcaccagctctggttatgtccttattagccaaagctgaggagcactgaatgggtaattaattttgtgtttgtgtaagaatgctgaatgcctaacaccacaaatgcccacaatgccaccaccaataacaaccacagtgcctacggctgcttaccgtcaggcttgtcagggaaatctctattcagaagctcgaggagaagaactgcagcagagtctttagccttcttcacactaggcattggctctccaatgcattcatccgtccatccacgatcagaagtgttcaccctcaccgaatagacgaatcttttagcatgggcagggccaccctcgtttacgcacctgtactgaggcattggccactgccttctcaagcagatgtcgttcagggtctgcctggtgaacatctgagcaccatttttcttctcgccatccctttcatcttctttctttgttgcggtttccttctccttcaggaccacaagtgcattcctcgctgccaacttctgtgccatcttcttctgagggttctgagctacaccgatctgaacaccatcaacaaatacttcaacagtagctatgttgcctgctcgggatgctttgtattccaggccttcagcctgctgttggcagcgttcttggagctccctaactggatgcatcggaagggtctctggcgtcaccattggatgaaggagtggctgaaaaacctggtgcagaatagttttatttagagaacttatatcgaatgagcacttcaacaaagatccctttcaaacagtccagaaatgattaccttccagacaactgaggtatcatatccactatccaggaatatcgcgccagcaatcgactcaacaatgtcaccaagaactttaggagccttacaatccccaagcccaaaagaattgaaacctggtttcaaaagctcctcttggacatctttcacaaactctcgaatctacggaagattgaattaagagtcagcattgctttcagaaaagaagaggaaaaaggttcttcctaatcaaacaagacctaccaacaatgtctagtttgtcaccacaaagaaaaatacctacctgtgtttctaatgcagatgatccatggcgaagatgtacatgcagcttatgcttaactgcaacccttgcaaaattctcattattaacagctgcagctctcaaatcagtcaagcggccaggaggtaggtcagtatatgtaaaaaacaaatgcctggttatgagatgatccaacacagcatcaccaacaaattccaaacgctggtaacaggaaacaccagaagatggtctcgatgcatgtgttatggcctcaacaagtaaacctttattctggaattcgatacccaagacacctttcaacgtgtcaaagttgatgcttctcattatgctctcaggaatgtcatatggctttggaggtgggatctcttcaggatccaactctgcatgaattccaatccatttcatcaggtggtttgcagcgattttccctcctgctacataatacaccccaataagtgcctcaacaacatccgctaaagttttgctcgacagaacccgatagcagctagagtctccttcaatttcaccatcttcttgcatgttatctgcatagtcatcataggattccttctgtaactcgcaaccagttgattcctcgtcaaagatggaaggttcatactctctagactcttcatcgaatacaggtagcactcctggagctgcccatcttgatggagcaaaccggtctgcttgaatatatgattggagggttttattcagagcatattggtacaggaccatgttactaaccatctgctgccgcatccttgtaagctgtccctcatgcttttgaggatattttaggaagaggaatctactcacgacccatttcaggtatgcatcacccagcagctctgctctttcatagcataatgtctcctggcatgatgcagcagtcaaggcttctagtatctgccatgaaccccaacaagcacttgtgaatttatgaatcaacaagcatatataagcatttttttcaaaaataaaattatatttttggcccacatgcaacgagtcaaaaagagtagaggaaaatattaggtgagcactccagggaggcactgaaatgcaaaatagggagcagatagaaaattaaaaataccatgtaccccctatatgatacatggcatacagttaatcagcaacctcccaaaattaatcattcttttggaaatatagtccttacaagcaccctttagtttaggatgattacctgttatttcaaaactaacataaattatggatgctgagtgaatccttgtttatcacttgcctaccaacactaatcaaaattcaagatttcaagataattgtgggcctcctgtggtaatatgccacatttgacattcggtgtgaagtcatgtcacatgtgctactgtcttctagctaacaagcagaacccactaaagctagatgccctatttaacacatagtcactagatgagaatggtgtgttataaaaaggtaagaaaatgcaagggactaccaggggggacataagatgcttttcctaaaaatgaccatttgggtagtcaaggatgctgagattaccttagttgcaggaacagggtaatcaattatgtccttcaattgaactgcaagaagcatgctctccacccttctcattattgagggcaacctctgagctccacgaactagtgatccaggaagtgggtgcacaaggcacaactcaggtggcaaatacacgtagtatgttttgtcaaggttctcagagaagtcaccttctctagctgttgaacaaatggtagcataataatcacataagactttagtttattttccttcaaaatattgtcatataccactgctcagaatgaaatattaaataataaaacaaaatgactgcataactttaccgtcagaatgctcaaatctaggagaaagaagattcttgcaatatgaaacaccacgggcccgtataagaggctgtttcctatagattaactccacaccgtacctgagaacaagacagtgaatcatgctgtatttctctaaagttgtaaagccataaaagggaaggaaaatggggaactcaagagtaaaaaaaactaaagcgccactctccttgatttcagaattaaataaaaggtcatcttacttctgcttgtagtaatcagcatatgaactatactccaatggccccaggtagccttctttcctagggaatgaattttctgcattcatgttatagcaaatgcagtccacataaaacctcttccctgagtgggcagcagtgacaaccattccagcaagatctttagcattccaacatgaatctgccatgaacaacttgccttggttctgataatcactaaaatgtcctctatcacgagcaggaactaatccagatgctttcacaatgtcaaattcagcaatagctcccctaataccataagtaggatgggccttttgtccaaaagcagtcccatggcgcaatttcccaaacccgtattccctcctatccccaccaagtgttcgttcattggtgcctagatagacatctgggcgtgccctctgaagtggattgttccaggcatcagtgttaacaatgttgttaaccaaagtccaatcaatctctcttaaaggatctgtacacttctcagctcctacagggacaaagaggtatgcttttgcgggatcccaaggtgtagttgagggatcaacatcaacatcaagtactatgctcatgagcctaacatgaaagctcttcagcaacaccagctggaatcacaatattaggtattagctacattaatgtaaaaccatgaaaatggaagttcttcatttgccaagaaggtcaacctgactttctgtaatttcaattcgtccacggaatacgagagatgcctttgttatcattgtccttgcaacaaagagatccatcgtcgtcgataaaacctgaaaagaaaagaacaagtgcttatgttacagttttagactattttattcaagtttcaggacatgcattatgcatatgatggaacatacctctgcatccagctcattgccaaaaataattgcaaaatttgaaagttgtgtaacgaaagggtccttagaagtcccaacgtttacacagttcacagaatacatatataacttaataaattgagagttttggtagccatctctgccagataaaatccattctccctgttggaatccattgaaaaaaattcaagataatggttagttgcactggaaagtgcacagaaataaatgagtgagaatgaaatttctcacccgtagaatatcagcaacaccttcaggataaaactctctatggcgagctgttccaggaagtggttcaccttcatcattctgctcagttttttccccttccccgcttcctctgtcaggtaagagcgtatctgtgaaggcacccatctcatgcagcttcttacaagcagccaaacaaacagcctgcacaaagagaacaagtgtggtttcatgttagtgatggccaaaagggctacaggactggtattattatggtttttttaactcaaacaaaagcatcatattacctgctgtgccagtcgtattgaactgcatataggaccctcaagtttttcgaacggggcattacaagggagctgaagcttgcaagaatattccgatgaaccacctggctgctcatacttttgcatagatgaattccggatgaagaattgagtttctgagaataggaaaatcagggtgaatctgacaccatgatattctaaataagctttgtacactaaaaatacattaaataatttacctgtcacttggcaactgtgaacagtaaaaatgtatgagtccaactgctgagttcaagctgacaacagcacctgttgattcaacctgatacattgaaccaggtgatgtatcaacaggactcaacacagaagtaccatccaaatgactaagatcggttctttccatagcttcctttctcaacgtctcctcactattccgagcattcctcaaaaaagtttcatgtgatatattgcccctgtgcatttacaaatttacaagccaattgagtaaaaataaccactatatcaaatccaaaggcttaatcgttcaattttgtgtctatatttgctaatcgagtaaaattaacctttcaagcattaatatataatcagatccaggctttcttgcacgaccacgtgactgtatgtaggctaagacggtctttgcaaggtcaaatcgaatgacaacattgcactgtcgaatatcaagcccttcctctgcaacgcttgttgcgactaaaagtgtaacctgcaaggcatgtcaaaaacatttatgagaaatcatctggcattgagtaataaatgagctgcaactgacaggtggttatcacttatcgttgacaaatgaaataaattaacattgtcaagaaacatacacggccatcacgaaattttgaaattgtatcctgcatctggcacgcgcgcatctcttgattattgttatggcctatcaagcttgcacatcgaataaaacttagagatggaagttctgccaatacctatcaggttaaaaaaagaaaaagaaaaacaaagagcattaacaaaaggatataaagggaatacatgtacagaaataaaacttcaacagcacttcaccttaggaagaactaatgctgtcacaactctctccacaaagattatggcacgaaaatcctcagtatgctgatatttgagaagtattttgatcaaagcctgcaccctaggagtaactttaccatctgctacggcagcaccgataacttcatctacatgctcacctacagaaacagctggtgggaaaaatgatatcattagaaagagactgagctagactcacaagtcaaataatcaaatattaaaagcaaagtaggcatcaaaatggcatggagaagttaagtcacataatgataaagattaacgaaaaaggggcatcaaaatgatggaaggttaaaaggaaaatctaaaggaacaacaactacataacacacttaaaattaagacaaaataataccatgactgtcaggcagctccccctcctcaaggtcatttgtgttgtgtttttcagtattttgcatttcaacatcactggtctcacttttcattgcagccccttcagtcaactggcagtgtaacagatcaacaaccttttttaaataagactcttgaaacttgacatcaacctgatagtttgccctttcatcattttgtaatgcagtcaaaaaggactgtgcaacctgaaattaggagaagaacaattaaaaatgcacaatgattaatgagacgctaatgttcaacatgaaagaaataccttatatgcacaccattgtccaagttcacctaaagcataatttatagctctcaacttctggattaaattagccgcaccatcactctctgtacgctctgaaacaccatagacaagacgcagctcatctctagacccagcatccctagcccccatgaactgccatttagttctcttagagctagagagtgcagcttcttcaaccgtgctttccatttgtttgatttgctcatgcaaggaccaaagagtggctgctttgtcatattggacaacaacttccaaaggcatggggacatgcttctcaagctctttacgatctttgatggtacaaactactgaatctagtttgctctcaagatttcttatcttgatggcacagtcctcttgactcgtcactcctatccacataatagtattaacaaacatatgaaaaccaacggcgaatctacgtatgaaacagcgattgatcatgaaagatggaaacggtggcaggaacagggcagggaaataccttttagattgacaggagaagccgtcataccgaaaactgctggcctcttctccttcggagtcgtgtgataaaattctgacatcactagagaatatggatgttttttcactgcatgatggcactcatctaaaatcaaaagatgtatcgcatccattttaataatactgtgcctgaggatgtttaacaaaatttgggctgtcataactagtacctgcgtgaaaaggaatgcatctaatgtgagcaaatcacaaaagatatttaattcaatgcaaatacgcctttccttttgtaatagaaaaacataaataatttccacagatggatgcgcatccagccatcgatatacaggcatacagcacgtgataaattgagatattttcaacttccacacgagcaaaacgtgccaagtatgggacgtgcaagaaaacgaaaggctgtggttaattagaatataaagatggttatcaatatatcccaaaattacgagaatatatatcaggtagccgatcccttttaccatcccaatttttctttcatgcatggcaagtcggctacactatgtcttgattgataccaaaagccatgatcacgaatgaaggatgcacaggtcacgttcacaaaatgatgtactatatatgaaggatttttttagaaatctgctatctaggtcttgagtattatcattgataatatatagcaatgccattcacgcaattgctccattataatacaatttaatatccgagggaattgcacaaacaagtgttggtcaaataagagcgattttaggaaaaggtacagctcagagttaggccatgaaacatcctcaataataatggtgtaaaattagaaatgcaaaagcaaattgaagaaataaatttgcctgtttcgactcgaattcgcgctgccactttctagcatcccagaaatcctgtcccatctctccacaataatgcccaacacgatagccggttctgtcacgaatcacctcagcttgctgcaatttcagtaacacagttattcctcccaaaacttccaacctttacagattgaaagcacactcgtttatctgtacctgatacacaagaggcaccttgggaaccaagaagacagcaagcatcttcttgttctccttgagcattttatcgcacacacttttgatgagaagcacggcgatgagagtcttccctgcgccagtctccaggaaggctattgtgttcctgctcttagcttgctcaagcacctctagctggtattgccttgcacgctcctccgcgacaggcttctcccgctgcgcagcccccatcctatctgcctctgccttcttctccatggagcctccatcttgcgtcctggcacgctttgcctcgcggtcagactcctgctcccaggtgcctgagcggaacaccatcttgccgccgcggtcacgctcccagaaaccccgggcctcgcgccgatggtgctcgtgcttgcggaccctgtcgaaatcgcgccttccacgcctgtcatcccacccacgcgagggcggtggtggcagcatcggcctccgccgccactcctgacgcggtcccccgacaccaccggaggcgaggcgcgggcgcttcccgtccctccactccccaccgccgccgccatttgcagcacagccatgcgactccctcctcggctccttcctcgccaccacgcctttacttctctgcacaacgcccaccaccgccacggcattgttggccacgggcgcagaggccacctgtaattgcttttcctgaatcggtagctccggcggagccacaggcacgggctcaggtagcggcggcggcggcgggggtgggggcgcaggggagctctccgcgttgatgctctcgagtatcctgtcgatctcggcgacgaagccgtcgtcggcgccggtgtccatcgcgggtatgaggccggggtcgaagtccgcggacgcggcgaagtcgatgccgcacagcagcgacgcgccgtcctcgcacgcgtcgtaccagtacgccgccgccgcgtgctcgccagcgcctcctccaactcctcctcctcccgccatcgctcccgccgtcaacagcagctgcaagcaagcagtcacacagcaccacaccaacacccgaccacttcactcctccattaatcagaagcagcagaatacaaaagacgagagatgaggaggggaaaacgaatgttggtactactactgctgctgctgctgctactacttccggtgggcgtgggcgttgcggcgcgcgcggcggtgacgacgatgcgacggggagagtggaagagaaagaggcggtgataaaccgtacgaatcacgcaaacgcaagagggaaaggaaagggaagggatgcgatgctccccattccgattccgatatggggagaggggaggcgatggtgggggtccggcacgattcgattcgattcgacggtgtatcaacgctactctttctcttcactctctctctcttctctctctctctctcttcctctttcctctgatctcttctccctcctccgcttccctctctctctctctcgtgtgctcgctctctcgattgagatggcggacgaggaggaggaaggagaggagggggaagggacgcagcggcgcgtggagttcccgattaatggacgcccacctgaggggcagtgcgggggctctcccactggcgtgtggggacacgggcgcaacgcggtggaccgggcctacgcccgatctcgaggcgcgaacgcacggcggggatgggctccggtctatgggcgggttgcaggcggcggcggcgcggcggtacgggcccaactgctcctggactggggcgtttgttacttgtcgtgtgggtatgacctgatgggcccacctctcagtgagagcccccgcgtggggaggacggtgtcgagtgcgatgcgatggcgtgagccgtgaggaccgggtcgtaccgcgcgagtgactcgtgtgtcaggggcggttgttcgcccccacgagccgcggagcggaatggccggcttcgtacggcggaccccgtgtcagtctcatcagcggtggcccatgcttgggcccgttcggtaacagagaagatcaagggcatattcagattaaaaattttacttggcaagataataatattgttaaaattttggcaagattttttatatatttatcaaatttgacaaccaactaaacacagatatttttttggcaactttaccaaaaaatggtacgattgaaaatagcatcaaattgaataggccctaatttataagaaagtcatgtaggattgtttatattatagctaaaataaaccttatcaaattttggcattgtcaacattttagcacgttgataatattaccaaaattttttggaaggatatcttatgccaaaatttgataaaaaaaactaaatatatgcacatctttagcaatttcaccaaaaaaatggtatggttaaaaatatcatcaatctgaaccgcctcataattcatttttttatgaaaggaaaataatgatttgtttaagaaatagatatattgcagttccaaacgataattttgtaatggccccaaatttgccctaaacttaaccttcacaggcaatcccatcaaaccatacgctaatcaaggaataacgctccattttgacttgccctctctcccgacatacttgcgtattcatcagctaattgatgaggatttatagggactcgttcactattgtgttcagttagaagaatttgaggtacatcatttcatggcggtctcgtttttaattcatatgttttgtttgggaattgagcgtagccgactagataggtcctttgtggtggaacaaggccatccatgtttaattcctaaa

SEQ ID NO: 77721 - DNA, 505 bp, Oryza sativa
tgggattcaatatgttcaaggatgatgtgacttgccttgctcagagataacggccttccgaaccttcggcgacgaccacgaaccacgcttcgggaacctccggaacgacagaagctacgcgaagcacacaagcaaagctaaaagcctataaagaagcaataacacacataaaaagaaagcacagggttctttaggttataacaaacattaggagacttgaacgggtcgattcagagttcgtatgaccaacatatgatcatccgaagtttaatgctgttatatggagatttgcaaattattataattaaactttgcaattataaaacatgtgtaaacgctagcctgtaaaagacaggaaggctgcgccgttgacatgcggaccccacatgtcaacctaaaggaccacggtagaccgggtacacagagacggtccacgggccacggaagcggaccccgtgtgtcaaccgaggcgagtggccgataaacggactccactagacaccac

SEQ ID NO: 77722 - DNA, 10150 bp, Oryza sativa
tttgtacattttatcctctttttagttgttttctttcaccttttcttttgagaaaaagaccaacttgaataaaccaaaattattgaaggttatataagttatccaatcgtcgatagtattatttgcgaaaatttcatatttcaactttctattttctaaaattcaaatgcataacccatggatgaaattacatttgattttaaaaattaataatttacctaaaaatattttaaaaaatcagcatttgggtatattaaacccaaataaatcatgcttattccaaaataaatattattgcaagcataaaaggtgattttaaccatattatggaactaccttacacaacctactaaaaatgatatattaaacatttttttcatgtactagttttaaaatttcaaaagtcttttcaaccttaaatcataaggacatgtcatacaaaactattttaaattggccaaaggatgaaatgtgaatggtttgtaaagcttaggacggttgatgtccagttttagaatttaaggatgctaaaagataggaaaagtccactgttttccgtgcatgcttcccaatttgctaaaatatgttttttttaaaaaaatatgtctaatagtttcttgaaaattgtaataatctacttctaagtttgaaataattaatatttgcactaatagtttatctcgttttacatatcttttcaaaaaaaatttacatttctcttctatccagcacaccctagagagagtattgtagacttctgtataagttcaaggaagtaaagagaggttttgtccgattatattttgggaccttttttttttgccttgagaaaatgattggccacgacagtagcttatgatcggccagtgtgattgctgctcctcctaattagaggtgaaaacggagcgagtatttcccaactgcctgcccgaccaagaaccgcagaaagaatatgggggagaaaatgggatgccagttcgaatccgaatccgtacaaaaaaaaagggttggttacgggaagagttgtagctgcttgtatgtcctatataatacgaaatatatatgaaaatctattataagtccacctacaaagtagaaatattgattaatcactattttacaagctcacatgtaatattctatatttttcccccttgttgtatctcttttagcactttaattgcatccttatattttatatctatgaattagagacacaaataaatatgcattcctaagtccgattcaaaggaaataacatggattaggatacatatagataatatattacccggtatccagtttcagttttttaaaaaaatagaaaaaatatccgtgcgttgcaatgggtgaatactattttaatcttattattattatactgtttagctaggatgaaatttaacgcgagaattcttttgcatatttttttttagaaaatcatgaactgcaattaggagttggactttcatctcaagttaacatgcaagcttttttatagagatttcttatatgacttcttttgtatttctaaaagcaaacgaacttaaaatcggactcaaacatggatctctattttcaaaagtgaacgaacttaaaaaatgcccaaatacggataacgtaccaaaataccgacaaaaacattttaatttttcgggaaggctaaatggttgtcgaatgatttttgataactaaatcattcatgttttaatatattcagaactgttgtttaatacgttatagcaaaatgttttatgagatgatttggttgtgtttcgattttttaaaagattgaaaccttctcaatttacttggtgaaacattttcaatatgggttagtatatgaaacgccgggattcgtctgaacccgtccattttacccctacccctgatccaccgctccggcgagtccactagagaggacgaaaaggcattaatcctgaaaaaaccacattgttcttcgaaccccactgaaccctaaccattcctatggcccttggggaaaaaggaagagaaaacacgtccaagttcgttttgacaatacgctcctttcagaaaatcgaacaaaatccatcccctgaagcagatatgctacacgaatactacacgatggacgagcacacgggacaaggacagtgagccccaaaatgggcgagaaaagctgtcacttctcctggagaagaatctctgcctttccaccccccaaatttacgacgttcgtcagcggctcgcagtacagtggagtgatggctagccttgctcctcgaccttctcctctgacaaaagtggctcaagtgagcaatagtgtgtgtgtgtgtgagtactgatagagatatttatgggcgccccgacaggggatcctctgcccgggaatcctgtatgattgttgctctgcctttaaggcgttaccagctcggatccagtgtcgtgtgcctaacacaggacattgctcttgacatttccaatcgaccattcagagcaagtagagcaggcatattataaaccagtataaacatattttaaagagataaaagaatatagataagagtagcgggctacagatctatagccagctgtagcacggacttcaagacgtaatatgtgtatgatagatgtgaccaagtattaatagtatagtaaataactattgtatgaattgactattacattgactatagatgatttgaagttagtagtgggctatactattaaacttgatcgtatagtagtaagctagccagctaaatactgaggttgagagagaggagaagcgggctgtaaacttacagccggcttgagcacaagaatcaagaaactatgtgagagaaacaggtgggccctgtattaaattgtaaagagcaaactattactacctccgccccaaaatatagcaatttttagttatgaatctgaacacagttatccagattcatagctaaaaatacttatattttaggacggagggagtatatgggtaggctaaaagaagactaaaaaaaccttatagtcaacaggtcagctgtattattaggcttgctctcaagccaaaagaaaagcctttcttcaactttttgagcattcatgtttgtctgacaactctattcatgttttccaacagtcagaagatttgcttttcgcaaatattatgcgccattcatatgtgtccgacaactccattggttttttccaacaaccacaagcatactcagttatgtaaaaaaaaaaatttcatccagtttcatagtactagaaattatcataatatatactatatatatttactttagtgtgaatgaagtatgcggcagtgtgaagcaactaaatggaactcgtttcaataatttagcatgacattaggtacaggcgtccaacatagcgaatatgccaggaacagtgtttagttaatgcaatgattggttcagcatagatcgacattagtcactacaacagcttcaatccatctgaaaatgtttttgaatgaaaaacccaactccacgacatccctcacttgtagaaaacgaggagcaccgagctacaccgatcgcatagtccgcgagaacatcgatcgacaagtggaggagacaaaggaacaatgagcatccagtgcagggaacatctgatccagcacaatcgtagtcaatgttagagcttgatcattttgatgccattttcaaccttaccaaattttaataaaattgataaaaaatggctgcatttagtttgctgccaaattttagtaactatataagaaattctgtcaaaattttgataactataccaaaattttagcaatgccaaaatttagtaaggtttttttttaacatcagagtgaacaggtcgttagtatcagagtgaacaggtcgttagcaccaacaaaggttcatcgcgagctgatactgagaacctgataccgcgaacgtcctggctgcagaaagatgagaaaattcggcggcccagtagtcaacgacaaaaaagataaacctggcccactcgaaaagcccaccttttctcacagcccaagcaaagtgcaaggccttttttctccacggacggcctctgttggaccacgtgcgcgcgagcccgattccccgcggtagcagcatcccacacgacacctgtcgcgtcaacgcggcagtagtggttcctttcccgggaacaacaccttctaccacacgaaacacatccgcagaagaattcgcaatagttggatggggaagttcttaggcactgtcacatagtatgtttatactaattagaattattaaacgtagactaattagaattattaaacgtagactaatgataaaacccattttaaaactcttgactaattcacgagatgaatatattgagcctaattaattcatgattagcctacataatactacagtaagcattctctaataatagattaattagacttaaaaaatttgtctcgcgaattacctatcatttatatgtaactagttttgtaaatagtctaagtttaatactttatactagttcaacattcgatttgacatggcttaatccctgtatccaaaccccacctataaacgaccccattgcgggcccggcccatataacctgaaacgtacttgtgccgtataaaaagggagaagatacagcccatagtctcactgacactaggggctccacggagagtgggcccatcgtgtcagtgtcgtacaagcgtatctccctttgaccgggggatattcgaaacgtattccgtttcgagtgactgacgtgtgggctcggtggtagataaactcggagacgaattcaccgccacaaatatccccaacccaccaccgggggcccccctaatccaaactgtttctcggcttccgctacacgcctcgccgaccaccatgacgatggctgcggcgccggcgaggtcggcgggggcggcggcggagaagaggatggtggatccgccgcgggtggtcggggagtacaagctgctggaggagattggggtgggctcgttcgcgaaggtgtacctcgcgacgcacctccgcaccggcgatgtcgtggcggtgaaggagatcgaccccaggaggatcgacgagcgcgtccgcggcggaatcctcgaggagaaggccatcctctccaccctttcccaccccaacatccttcgcctcatcgacaccatccaggtagtaacccctaaaccttccaacccaggcacccaaccgccatcgcaatcgcaactgaactccgagcgagtagtaaggttaacgatgtgaaattagtaaaatgacttgtggttttcaaaggaggagaatctgtacctgattctggagtactgcaatggaggcgacctcgaggggtacaggacgaagggcggcgaggacgcccggttgccggacgccaccgcgagggacttcatgcggcagctcggtatggcctcaatcgagatttgaatggagttccttgtcctttagttgttgtcttagttacattttctaggtttttggaacggtgtagttatgcgtcttttgcccctcttttttatttgtagcggaagggctcaagatgctgaggggaagatcaatcgtgcaccgcgacctcaagcctcaggttagatcttacatgcggagctattaaatttttgctgtttgagtcggtttgcaatttttagatgttttgtttggataccatatgcaaactaactgtaatgattatgtctgaagttaagacgttttgtaatttcttgtactgttgtgcaaatgggctccatatttagcatctaaagtgatcaatacctaacaactaatattgacttgattgggctgaccccagtcattattagttcaccaccaaatgtcaaaaagttgcatgtacgatttctctatacgttcatgctattatccactcagtaactcaatatatgtttgaggaaaaaaaacccaaaaaggtgtacattgtaatagtgtccatgtgtttatttttggctattgatttgttttatcctttgagataatatatttttacccataccgaccaatatgtgaaacttgcagaatcttctgctatcaactaatggtgatgccatcacactgaaaattggagattttgggtttgctaggtgtgggctctatttcccttctgttgtatatatatttgtaggcttatatattttttctcctttacttgaattaccgggggccaatccccaaatatctacagctgttacccattttccaatttctacagtttcttccctttttccgaaggttactatgaactttttgttagtaaacaatgtgtgaatgatattttggaattgttcccaggtctcttgtgcaagaaaatttagctgctacaatgtgtggatctccatcctatatggcgccagaaattatgcgatgtgaggattacgatgcaaaggtttgttcattcacctatgcttttgggtgttttaatatagctagacaataatcccaaccatatgttctttcaggcagacttgtggagtgttggtgttattctttttcagctagtcacagggaaattgcctttttatggggctaatctattcaaggtttgctcttatgcataattagatgtatgtggaccataaaaatacatatatcctgtaatattgttcttgattgttgttctttgaatatagctgaggcaaaacatccatgaatctaacggcgttaagttccctaaagaaatcaaggatgatttacatcctgatttcattgacctgtgccgagggctcctacgtcttgatccaagtaagtttgtatttctcttcatttttgtttgtgcaaagcagtgtgtattaactactccctccgtcccataatataagggattttgagtttttgtttgcactgtttgaccactcgtcttattcaaaaaaaataaacttgaatagttatgcactgtagtagattttttaggcatattcactctgaattaaaaaagtcttcaacattaaactttgacaatcaatttctcataaatataagtatttttttccatagcttatgaaattaagataatgcggaagcaactctgggatatgaatttattggtattattcttgtactgcattgcttagaccacttgttctaagctacgtagtatttgttaagtttatttctcaaaatgtttaatttatccttataatgaagtatataatctgcggtcaataatctatctcaattctcaaatggagcctacacttgtaattggactaactgtttgtcaaaacgaacacagtttgatttttttaaaataaaaatatgccttataaaaattaatggaaggaacaatttctttcaagtttcaactgtcatctgtgtaatttcgttaatcattggtcttgatcttattattccttactaattactaattggtgaatcatattaaaacacaatttctattttgcagagaagagaatttcttttgaggaattcttcaatcacaagtttttgtcaacaactgggtcgaccctttactctggtggaagcattcaaaggtctatctggctatgttgcaaaatgtgcattgttatcataatccatgtccatacctaatcttcaatttaacttaaccaaatactactctgctgctgccaatacggcattcatcctcacttgtaggcagcccaaaaaatgtacataaagagacatacatgcattgccttcaacataatataaacctctaaaatttcaagatgaattgaacatatgatatttggaatggtacattgtacatttctcaagttctcatgaatggtgaattactcaatatacagcatacttgcagtcttttcccatactctccatgtatttgtggaatagttgccataataatgtggacatgggtttgattgtgtcatatttgtctcctgtgttgaagttttctgattctttttccaggaaaagagagattagcagtgagcccaatcatcctgctgatttattaagggatacatgccagatcatttcttcggatgtcctgaaagataagtctgaaagcgtggattctagaaatttgcaaggtaaattagactcccaactagtattcagatttcatacgtccctgctctggcattaactctgtatatttttgcagcatttgattcatgggaatggattgaacgagaatatgtacttgttcaggcgaactctacttccacggaaattttgtcttcacttgaaaagtcaatgaaggatggtacaggtgcaaaacctgccagctatgataggtccactgttaaacggtctgcttggaaccaaaacagaaattcagtcagtagaggggttgctataaaaagcaatggatgcaccccattgtctacttcccatgaatcaacagctgcagaaaatctgctaaatccaccttattgttacacaaggcttcaactccttaaccagtatattgttgttcttacagaacttgcagaggagaaggtattactactgcttttactgggatataacactatgtccattgaatgccatctgtgttttgtagttgtgtgcagtctgtagctccttatgtttgttatgatgaaacagtggttttttgttgctaagcttcatctgctcatatacttactatgttccttgctagaatgcttgttgagttctttgaccagatgaatgtttgtagagttatccctagtaatttaaatcatgcaggtgatgtctaggtttaaatgattttcatcagatgtagaggtcacagccttccacatgccatttttcattgatatacccgtgtatcaacacattaagcaatactcttagtctccaagtcatgatatttctggcatatctcttcttctcagttttttttaacataaagctttgtccatatatatattgtatagcatcaaatagatgaatcttttgtgcacttctcttcagaatgtcgatgccagacaaaattctccttttgtattgatgctcatagcatagctatgatattttgagaattgagaacctattagtccagtttgatctaagaattatgttttgttgtttttcatattggcatttctgtgtggatgcagctttttaaagggctggacttggaggcactatctgttgaacttataatattagctatttggaacgaggcccttaatgcatgtagtttatccacggatgctacacatgatggattttttttgacccaagctcatgtcaatttcctgcctaagaatgaccatcgtccatctcgaaatgtagtacaaggattggatttcaccaggctcgtttctgtctgttcctgggctgaaagtggctttatcaaggcatatgaccgtgcagagaagatatcacataggttgcgggacaacaatggttagaacattggtatcttcatgtcctagtatagttttgtttttgttttttgctataacccttgtttgtttccagataacaccgagatgccagatgcagtggagatcatattccagacagctttaatatatggaacaactggtgctgtaagtatcagtattctaggttcttgtatggtttctttacagctttcgtttttccttgcacttcatggatttggggggaaagtgggggagtggtgtatgcatttcacgattttgggtaacaagcaatgatgctacaacggaaaggaaacctgtagacttgtagttaatgtgtaccagcccaggatccaccgctgtgcactggttgtccaggcggttggttagttattatcactccatattctgttagaccacgaacaaggggcagaaatgaatactattgttttaggctgtgtttgagggagagggaattgagaagattgggaagatacgcaaaacgaggtgagccattagcacatgattaattgagtattaactattttaaacttcaaaaatggactaatatgattttttaaagcaacttttctatagaaaatttttgcaaaaaatacaccgtttagtagtttgaaaagcgtgcgcgcgaaaaacgagatacaatctcccctttctcatgtgaacaaacgcagccttagactgcagtgggaaagaaaaacaactttcttttacaaatgagcaaaaatgtttatagccagccagtctctgctctctacttctattaaagcgctattcatgggggaaagcggtattcatggggaaaaaacttttatgaaa

SEQ ID NO: 77723 - DNA, 2602 bp, Oryza sativa
cgctccgctcctcctcccgactcggcgacacctccctcggcatcgcggcatcgccgtcgacctcgtccgcgcctccgtttcgctcgccgaccgtcggagcaccgtcgtcatcgtcatcccgagccgcgccgccgtctccctccgctccggccgccgttctcgtcgtcgtagttgtcccggggtgagccgaggaccgtcgttcgccttcccccttccctcctctctctcgggcgccgctccgccgcgccgatggtcgccggcggtgaccatcggggcgcgggcgcgtcgctcccgtcggccgcgccggagaggccgccctcgggcgcgccctcgcggctgccaagtgggcccggccgtcagccgcccgcgcccgcgggtgcggctgacgcgtgggacccacggcgccgaccgccgccagccgcgtgcgcccggtccaccgtggaccgtggggctgacgcgtgggccccactccccgtggacccggtccgcgcgtcccctccctcggctgacgcaataaatcggttttttaattaaaatttaaatgaagaaattcgtaaatatccatttaaagagcatataaacttcaaatggccatatcttggccatttgaactcggaattggaccgttcaagtctctaatttttccttaagatgtaaagaacccatttttgtgctttgtttctgcttgttatatggagtttattagagtaaaagccttttcttttccgttggtcgtgtagacgctgcagcttcggaagatccgctcttcgtggaagtcgaagccgtcgtttgggaaagcaagcaaggcaagtcacatcatccttgaacatattgaatcccagtttataaaattatgttgatttaaattattgcattaccgctttatttaaattcccgcgttatcactgttttatttagccatgcctatttacctttgttatgaccttattattgttattgttatgattattaccttgttcaccctagagtaaacaaaacctcaactagtggacactctactcgtggtatccctagtttaaatttaggtagatgcttcgcaatttaataggacaacattagttggatttcataactttagacttgggaaattctcatatcatttggacaccatggaatggttggcttatgttggaattggacatacacctctcttcctctttcaaaacccctaaaacctgttttcggtggggtttgggtgcatgccagttatgggaagtagcaccccggccactataaggattaagctcgggcctctgttgcaaagcactaccgtactaaccacatgtctaatgggtaaggcttaactcggtgctcagtctagtcctgaacaaaaggacacggattggagatggatgaagtcgggcgtcgatggacattctccagggcaaatgaaggctacacgagctgcggcccggtagtcgagatgtcatacggcggagggttggtgcccaatgctaggggctcatttctacctgcctgtcccgggtatcccggccgtaggtaggattgggtcggtacttttgttcacggctaggatgggtgaagggttatgtcacatgtttacgatgggtttcaaggccatggaatgcggagtaaagatgtgttttgtgggtaaagatgtacacttctgatcagagtaaatctatttgaatagccgagccctcggatatgggcaagcctagcaatgtacccaagttagtggtttaattcttaaaatttgcttaacaactaaaatgtggaaaggttggcctgggttggcttgggacgagctgggacccaggtcgggttgccagttcggtccgaatcatcgtaggccttgggttaaggcaggttcgtgtgggtccacggccttgtttaataatactgtgtagctctaggatcgtctttataaaatagctttgggcaactaagtgacttttaaatgctgtttactgcaaaacttaacccctattattatccccttgtactcccttgcattaatcatgcatctgccggtgtggcttgctgagtactgtggttgtactcattcttgctcaatcttttcccccttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaattcctcttttttctccttcccccaatgctatttgcaaagggtttacccttttcttccttcttcaaatttcaactagtactaggtggtcagctttgcgaagaagaagatgtcgtcagttgtttgccgaagctccggaagactgcaggatccgctagcgaagcgaaggaagcagtg

SEQ ID NO: 77724 - DNA, 7673 bp, Oryza sativa
agggggagatgggccgagagaaattcggcccatcgaacccgggggaggcaaaatagacttttgcggaggaattgatttggaaggatttggattcggaattgaactcgacgatagatcggggatttgagatctgagaagacacggacgctagacgacaagcaaagaaacaaatttcgcaattagggtttttaagagataattttcccgctaggcgccacgatggaacgggcgctacagaggcgggggatggagttatagagagggaggcaaagcggcgacaagggtggaggtggtagatctggcgatgtccactctcccactccaacacctctctcatcggccggagaagaaggaggatgcagggacctcgaggagatgatgatggaggtagagcacggtgagacccacatggaggtagatcttgccgcagggcagggacccaacgctcaggacaatgcaactgacaatagtgacatgacgtggatatgaaactcgaggcgatgctgctgcatcttctatccagcaagatagggaggaggaggtgagacgctggcaggcaaggtcacggaggaggtggagcttggtgctggagacaacggtgttgatctctaccaccgaggtcgagcctagggccaagcgagagatgttagtggtgggtggctatcaatgtagctgttgttcgattggagattaaggacgagggagagaaaagaggaagaggggataatatgtacactgataggcgagccctaccaattttattgttattacttcttccgtttcataatgtaagactttatagcgttgcccatatttatatatatatattaatgaatctagacatatatgtgtttctagattcattaatatctatatgaatgcaggaaatgctataatgtcttgcattatgaaacggagggagcattagctaacatgactatcacatatcagtcaaactactgccacgtggcaccaaagtcgctctggatttagttaagggataattcattgggaatgaaagaagagtatatgataacaaatgtatggtgtatggtgttagagtgagtgtgcatattggaggggtgggggtttgtttaaactgtactatgccaaaagtttaggtggtaaattagattttttttcctctctttttattttacagttgaggtgcttcaactgcattgatatggagaaaactttgcttcaatttaattactcactctgtcccattttaagtgcaaccatgagtttccatgtccaactttgatcgtctgttttatttgaattttttttataattagtatttttgttgttatgagatgataaaatatgaataatactttattcatgacttatgtttttaaatttttttaaataagacggacgattaaaattgggcacggaaaattaaggctacacttaaaatgggacggagggagtatctagctaggatgcagtaagcaattagtagggtaaaatctgaagcaaactgactccataatatcctaggtgacaggtaaaacaacaatacaattgatcaattaaggtgaacacatgtgaaagggcctgtagcctagtggttacaagagcctcagtagcacataaggtcctgggtttgactcctcatgagagcgaatttttcaggatttaacggcgttgtgctttcagtggtagacgacatacccgtcaacaacgaggcgcctgtggtgactgtcaatctcgaggatttgccagcccagtcttcgaagatacttatagggtagggtttgtgtgcgtgcgttgataagggtgagtgcacgtgcgttgtgagtgtctacgtcagcgaggtgtctgtggtgacttcgtcaatctcgaggatttgccgtgcgttgagtgtctacgttatactgtgtacagggccagctctacatattttagggccctaggccaactccatgacatgggcccttaggcatacactctctctctatatacacatatgcactttggatttttaaagtatacttttgaagcattcatccgctaatcatgctgaaaataaatattgataatatcctctatatatgttgctaaaaataccaaaagagcattaaaatggaattactatggttaccttgaattcttgacttaggatcaagctctagggacttcattaataatacttgacaaaagataaaatgacagatatccatttgcttctcataaaaaaatactccttcgggcatttcttgatgcaaaatcattaatgacggtatcgagatcaatattttccaagacattcttctcaatgcagcacatagccaagccatttaatctttcttgtgacatggttgatctcaaatagtttttcaataactttaattttgagaagcttctttcagttgaggctactgtcacaggcacagttaagaggattcgataggcaactaaaacatttggatagcaatctgcagctgtaatgaattcaagaatctcaggtgctgacttcaaagcatctggcaaagtcgcttgcaacacttttaattcagaaaagaagtcatttagctcaacatcggatgagttattatgtgaaaatgtctctacaaaattagtgcagcactgccatagatcagtatcatccaaggatttcaaattctttgaggtgaacaagaaaccaaacacattttcaaatgccttcaactgctcaaatcgactagtcaatgaggcaattgcaacatcaatcatgactaggaagtaattaactctaaaggactccacaactgattgttgttcttcattttggtcattttgttcatcaaaatgtttctttcttttagcttgacgttttgtaggaaattttggttctatatccatgtcagatgcaatgacttttgcaatatctatactagaagtgaagccttcatttctgtacctctggaaaaatgatatgacaccttcgatttgcttgagagtagcatccatgcacacaatctcagactgcaacttcttgctgaccatatttatagaaaataatatatcatgccaaataaccattccaactaaatattcaaaattctctagtgcagtgaccaaagattgagcatcactcacagcttttgggtcatcggtagaagctttctctagttccaacaaagctgaccttatttggggagtttggtatctaatagcttggacactttttattcgactctcccatcgtgtattacacactgatttgacagtcaagtgtggaacattctcaagaaaaatcttccatctttttgtcgagcatgaaaatagtgtatatattcgttgtataacaccaaagaacgaaatagctttattgcacgattttgccatatcacatagagttaaatttagactatgacatgcacatggcatgtataatgctcttggattaatttcaagcaaacgtttctgaactccttggtgtttccccttcatattagaaccattgtcataaccttgtcctctcacatcactgacattcaattcaagggagtccaatgccttcatcagttcattaaaaagccccaatcccgatgtatcatccaccttcaaaaactctagaaagaactcctcgactcttggaatattactcgataaattgacacaacgcacaattaaagtcatttgttcttcatggctgacatccggggtacaatctaatattacagagaaatacttagcatccttgataaccctcataatataaactttcacagcctgagcaagaagggaaattagctcgttctgaatattgtggccgagatagtgatggtgaacttcatgattttgaatgcgtctaatgtggtcttgcatcacagaatcaaactcagcaaccatttcaattgtgcccagaaaattgccattgttatcttgataaagtttctcattggatcctcgaaaggccaaattatgtttagcaagaaacttcactgcagcaactattcttatcaaaacttgtctccaacgctctttctcctttgaaattccccgttgcaaatcatcatcaattgtctgattttggcttaacctcaacctaagttcattccaagtattcatgttttttatatgctccacactgttctcatgctgtttgagtcttccactgagatgcttccagtccttcaatccatcagaagctaacaaacttttgctctgatttgatttgaacagtttacagcaaaaacaatatactttgtccacatgcttagagtaaaccaaccattttctatcaatcacctcaccattgctcagctttctagagtagtaagcatacgaaaaatgtctaccactactatctgaagggaacagtagattgaattctctgataggccccttttcaattaatatatctctccccctgttgtcaagattttcccaagtcctaggatcatagatattctcatgtacatcaacatttgcattctcagtacaaggtgaacgctgcaaattttcatgttctgaatcatcatgattagcgtcatcttcagtatttacaaaaagaacaagttgctgctcttgttcttcagtactaggataatctgcctcaggattttcatcaggaacagcactacttgatgccgaaaagaactttatgtatagcacccttctgtgattcaataaactgatctcctcgttttctttttttccttttcttagcaccagataaatgctttttaggtaacattgcaaactaaacgtacaaaggaaactgatctttagtatttactaattactaatgactgattaagtgattagtacttcactagttcaattcaatggacaatatggttacagcacagtagtatgcaagtacctgtaaattgaaacctgcagacactctggaagttgaggcagattcacgttgtgttgtgtcggcggtcgccggtcggccggtgtccaaggcgaacagtcgacagacaaaggcacaaagctgtgaagggctgaatgctgaagggatcgccggcggctcggcgtggggcgaacttgcgcaggcgccgtggagggcgctggaggcggattggcggagactgccgccggtagaggagaggagacgagaagacaaaagtttggaacttggacggtcgtgtatgcccaatgattcgatcagaaacttgtatacgtgcatatggtatacctaatacatacctaggtctgggcccctactttttctgggccctaggccatcgcacttcttgccgtggcccagagccggtcctgactatgtaattctaaaaaaaaaattaaggtgaacacacaccctcaaaattaacatgaaagggagtgcttggcagcctctacggacaccacacacgcatgcatgtgcaagttggttatctatcacatttggtgtgataagagtcaacttcatattagacgtacacattaaacatgcctatatgcctatatcagcagagaccatcgtaaaagctttatcaatcatagttaagcttaaaccgatatgcatatatccgaaaaaagaaaagccggcgatcgatcgagaaactagcagtgctaatcaccggaaaggtggtaaattaaagcagcaaagctagcctaataaagcgggacagatgcgcctgatgatgcgatgatttagcagtactagaattaagctagattgatctcttgctcctaataacaacagctcacatgggggatatgggagaggatgatagcgcagctcaacctctaccggcgccgtcccggccgtagagcgaaggaagaagaagaaggaggagaagaatcgtattgtgtgccaatcatgcgccgatggatgcgggggtttactacggtccccgacgagtaccttggtcagccagctctttttctctcttgtatcccccatccatcggcagcatcatgcagtcaggcagggaagtatccaaaagtgaacatttggagtaggccaagcacacacccacctacctacctagctaccaacctgcctgcctacttcagcactatagctaccttagctagcgatagaaagatcacactgatcatctccaggaatgcatgtactcctcctgtcatactgtcctaggttttaaaatatggagtaagtgttttttatttaaaaattatactacactaaaaacctatttttaacatgccatattttacttcatcgaaagcccgaaagaattattacccgcgtgtaaaaataagttgggggggggggggggcttgcgaggcacaacgatgatggcggcggctttggttttttagtgtttattaaacgattattaacacgcaagcagatctttacgtggaccgattgtgacaatgtgtttgcacatacggctgcggttatgcatgtggaaatgcaatactattgtgggcatttgattagagatggtcgaccgaaccatctgtgcaaacccattttgaccgtttacaaaaatacattttgtcatagtgctataatataattatttatttgcttattttctcatctcattcgatcacaaccatacaaatctcttattcaattattttcatctactttttttatctcaatcaatcacaaccatatatcttaattactgctaaaacttctagagatgctcgtaattttgaactaggggagctgaggatagatttgggatgttttagtgagttaaacgtgttcacattttagactattgatggagaactaatgaaaccactttgtttttagccaacaaactccatattctgcgatagtctatgacttggagctttgtcgaatggatcctacacgtctatcattcatgggatcgaaagcgaatggaaggccaaataaaacaagaacatgctgtgattaattagaaacctgtgactccatagtgcggtgtagggaaaaaaaaagggaagttactagggcataagtttcttcctcatctgtaaggctgtaaccggttccaattccaaatcatttgtcaatacgtggacactcacatgcaccatgcatgtcctttctagctaggataaacaccattatcatccgagctaattgtcactttattttttgtcagatgaaatatagtcgaaaatcaaagttagagcttgtgatgctatagtgaagcattagtcattatttttcatctaaaggcgaagagagatcatgacaggtgactttactggtaacagaaatctattttcattgacaactccattgctggtatggtcgtactggcccaaacgattgctacagcttattgggttgctaatataatatcaacatgctacttttcttgtcatttgcctactgattagaggtgtgagctagacaaagttttatcataagaaaatccagaaaatatcatcggcaaatgccctaatataagaaatgtcattgatagacccaacttcagtgaaataccatcatacaagtgcctttgtcccagaaatatactatcgccgttaggtttccgttaagtcctataaaaagactattttacccctagtaactgttaagagctgattaaaacttttgctctttctaccagcttacgctaatttgtaggttgctttccatactaaattattgtaagttgacagaaagaacaaacattttaatcaactttcaacaattcgtaggggtgaaatggtctttttatagtagttaacggagggttgctaaccaaaacctaacaatgatagcatttctggaaaaaaaaagt

SEQ ID NO: 77725 - DNA, 1609 bp, Oryza sativa
  unsure (1)..(1609): unsure at all n locations
caaagaatatgaactagtctctgttttgctatgttttggaatccaggagcacatcaattgctaattggaagtagtctctgttttgctatgttctgtttctgggattgttttttttttggctattgtgaactgttttttgtgaactgaaacgtgtcaatggaatgtgaactgatgggtcattgcaatgtgaactgatatgatgtgaaatggaatgtgaaatgataaggcaatgccgtgtatgcatttgtatataaaatcaactgctctgtgacttgtatgcatcacaattgtggcgatggaggcctctggtgcctctggtggcgagcatcctggtggcgacgatgaggggtctggtggcgagttcttcgcctctggtggagatggaggcgatgaagatactgtccttgaagaaatcgatccagcggaagtatatacacttgaagattttctcgccgaagatgaaataatggaatcatttcgaaggaagattggcgataaattgaaggccaaaatcgaaggatcttcttctggtccacctcgtcgtcgccagcgtcaaagtggacctagaaggtacatacctaggccaagagaaaagggacatgaagatttagttgctaattatttttcagcaaatcctatctatactgatgagcagtttcggaggaggtttcggatgaataagcctttgtttcttcgaattgtcaatgccctgtctaactgggatcaattttttacccaaagagttgatgcaacaggtcgagatagccactcacctctccaaaagtgcaccgctgctattcgaatgctaggatatggcacaccagcggacgcactagatgaggtactcaagattgcagcgagcacttctttggaatgtttgggaaaatttgccgtaggaataatngaaatgtttggtagcgagtacttgcgttcttcgacaagtgatgaactagaaaaaattttacaagagaatgaagcttcggggcttccagggcatgataggaagtattgattgtatgcattgcaaatgaagaattgtcaaaaaggttggcaagaaatgtttatcaaaggtttcaaaaggtaaacctacaatgatccttgaacgggtagcatctcggggcccttcgtatatggcatgctttttttgccaacgccgggtctcaaaatgatatccagttgttaaccaagtcaccattgttcattcatgcgattaaaggagaagccccccgagtgagttatactgtaaatggaacgcagtatgacacggggtattatcttgccgatggaatatatcccgagtgggctgccttcgtgaagacaataagaaaacctcaaacggagaaacataaattatatgcacaacgacaagaaggggccagaaaggatgtcgagtgtgcatttggcgtgttgcaatcccgttttgatattgtcaaccgtccagcacggttgtggaaaaggaatgatgttgttaatataatgcaagcttgcgttatcctccataatatgatagtggaagatgaaaaggatttggttaaaatcccattggatttgaatgaaaatccaagtgcaaccattgtcctaccaccggaagtgcaaacaaatgacaatc

SEQ ID NO: 77726 - DNA, 631 bp, Oryza sativa
ctttgttacctgcggagaggcttcaatgcgctaccagcgagaagaaaccggcgcatgtccgccatgaatgatggcaagctagtagagtagatagatgggacggacaggtcggaaggagatggagctgacaagtgggtcccacatgtcggtgacccgagcatagaggtaggccgctcaggttcgcgatggctcgataggcatcctgtcttactataaagttatcccccactaactccttaagcttaacatgcaaagatgccacatcatcatccactgacaagatgccacatcatcattcactaattaacaagatgccacatcatcatccactaacaatcatcacatttaaacatcatgcaaacatgctatatcttcatagtttttataatttaaaagcttttcaaatataaacatattaaattatcatccaacataattcacataatgttttaatgtatatctttattatattttatgatatcctatatacttatataagtcatcctcacttagttagtgcttaaatgaataatctatgggccaaattatctctctcctttttttctctaattaagtcatatcacatcaattatttttagccttttagatgattaatctgcggtccaaacta

SEQ ID NO: 77727 - DNA, 1772 bp, Oryza sativa
aggtcacccccagtctgcatcttttccacaaaagctgcaaaaatttcaaggaattggtatcactcaagtttaagttaaatggcacttggtaaaattctctttacaaacaaatagataatactaaagttttagcaagagaatacacataactttaagagaaatcagtacaaaggagtaatacctgaagttccagatttggcaatggtcccaaggttcttaatgagatcttccttggtcataccaatacccctatcccgaatggagagaatcttcttctccttatccagcttaatctacacgtgcccacagcagatgccatgaagtcaatttccaaaacaagatataccacacaaaaaagactatcagctacgaagtttaatatacctggatttcaagcttagcagtgtcaccttcgcccaaaacctccttatcagtgagagccaggaacctaatcttgtccaaagcctacacataaaaaaaaagcacacattaaattcctagcatctactaataaccttaagggctcatttggattggaggcttttcccgggaatttcataggaatactgttcacatgggattttttcctatcctatcgttcggatcataaaaagtggttatgggaaaactgtaggaaaaaatcctttgctgctgattccacaggaaaaacggaggaaaattccatccactccaatctcttgtttcattccctttgacagaatcaagccaatcaagcaataaaacagccactagataataagcaagacagacgggataagcaagatagcggtagataataaatacagtatacagattactcctcgattactttttatttcctttcctgtaaaccgaatgctctcaacttttatattcctgcgtttttcaatcctatgttttcaacgtgatttcctttcatattcctacgtttttcctatcctgtgtttttccttttcctgtgttctgaataggccctaaaaagggagtcaaaatgcaatacaactacatacatcagaagcattggagatgagctccctcaggaaaatgtccttgttgctgtagagtgagttgatgatgatgtccatgagtctggacacctcagcctggaactcaaatttctccgctgagctcctgagggtcttcctcgagattgactcagcctccctgcacacattccatattgctcatacagatatcaacaacacaataagatggaaacgatcagcattgatcagaagatcgtgcacacctctgaacaacctcagagtccgtggacaggccatggggaacaccaccaatcttctcctctaccttcggcggatcaactaactcatcagtgctgtcatcagcattgacttggagcttcttagctgcagtacaggaagggtcagaaccgaataataatttgaatcatgtgttgacttgcggtagagcaatgtgtgtgaattagacttgagaagcctttaaaaatcactaagatcagtaagttgggggcgctagatcaacaacaatcagcactagatttacactgaactgacttgatacagatgtattattactctcaggactaaaccctatttaaaccccgcatataatgagccctattgcggacaaaattacggtgcgcaatagcagattacggatctagaactagctaaatctcgaaatcgcaataaaccctaccattacaacagatcgaagtggccgcgaacccaacaagcgagatctaaaacaaaaatcagactagaatcaccaccagagatcgcacaaag

SEQ ID NO: 77728 - DNA, 32539 bp, Oryza sativa
  unsure (1)..(32539): unsure at all n locations
ccgcctgcaaatgggcggcgagggggggcatggaattttgcaggcggcccccttgccgccctccgctagggcgattttgcactgtgcggggggccgcctgcaaatgggcggcgagggggcatgaaattttgcaggcggcccccttgccgccctgggggagggcgattttgtaccgtgctctatattttttttatataaatatcaatagttatcaaatctttttatattgaaaactatacaagattaaaatctccaagactggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaatcttaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcatacgaggtcctgcgatgaggaaacgtgcagttaaaaaatggtgacacattcgtgcaaaagctgaaacaaaaaagaactaatatctaggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctactcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtatggctcgatgatgtaattatcataaaaatttagaaatgaacaatccgaactcacgagtggtcggcaggggggacggtcggctgcacgttgcccggaaacacctgcctaagtccgaactgtctcatcacacgctgcgggcagtgaggctcaacgaaaatgtcgaacaccatcgccaggatggtgagccagtaagcctggtcgcgtgtgcacaaggacgaaagtcctagcggtgctctcgcagcgacggctttttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaaggaaaaaaaaagaagaggactgataaacttataacgcagcgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacataggacagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtacaaaacactcatccggtcgcaaataagcatgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtcgacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtgcaaaacaaagcaaagttgagttcaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaatattagttcaacataagtaataatgttcataagcgaattactaacacatattaaccaagagtccaaccaacaaaaagtgtttagtccgaccactcatcccgataccattatgatacaacnccgaatagttcgcaatactactagtacaccaatagtcggaggtactcattacaacaagattgaattgtaattacacgatagaagtatttagtccgaacactcattacatcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtacccgaactcctcgcattacccagttgtacacctctgccaaattggttgtcattatgccataccgagatccatcggtgtcgaacaatagagcccacttctccttaggctcattctcaatccactgagagaaatttctgatggccgaccctgacctccttctcattgttggtgggtcatcatgtaatgcaccaagaggtatgggaggctcgtcaccttcaacttgtggtctgcgagattgctcatctgtttgcttcgttgtcaactcatccaactggtcccacaactcattaaatttcttctcttggttctgtgcacagagcctcttaaagagatccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcgaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacattcttccttcatgcacctcacttcatacacataatttgttgacttgaccaccctaaactctctctgcaatgaaactgcccaatgcttcaccgcctccttcatctcatccttatgagcataccttgcaccctcaattacctcgttctccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactcaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactattgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctttcgtttttttggatttttagtgaatataatgaaatttcacaggggaggggctgggctttataggggggaggcaaaaatcgccctcccccagggcggcaagggggccgcctgcaaaattccatgccccctcgccgcccatttgcaggcggccccccgcacagtgcaaaatcgccctagcggagggcggcaagggggccgcctgcaaaatttcattgccccccctcgcccgagagcgaacggccgtctgccacgtcattttcgccgccctctgggagggcgatttggcggtaggcgactataaccgtcaattttcaaaatggaaaattatttttgtaaaacttttaataaaaaaaattataaataaaaaaaattcctcgttaagagcccgccatggtaatggaaagagagattatagcaagtctagtagtacaacccaccgcttactccaaaaattttatattagcaaaaatcattgtttaatcaatgcaaatgcattgttagttaaactattgtttttctccttgttccgtactctctctcctgacacaagttgcagtgcatggaagttaattggttgaattgctcatgtctgtgttggagcgcgagtgcaggtagcgcttaaatagtcgcccggtgatatactctctcacctccaactcactgtaaaagttgatgtggcaggtttatcgctagttattgtacctgttattaatggcttgatgtggaaaaatgaatggtaatggaaagagagattaatggcttgatgtggaaaagggaagaaatgtccacccctggaaaaattgcctttcttcttctgtttttctattcaactttctctgtttttcgattgaaccctttgttctgaaaaaaaaatgcctttgttcttcctctgtttttcgactgaactctttgctttacctttctcctacttttctatttgtgtttcaattgaactctttgtcttgcctttctcctaccttttctgtttttcaatcgaactgtttgttttttttttttgttaatctttcttcaatacgatagccaagacaaccacctaaaccccaatcatggggctagtattgcgtatctgcataagagcacacgattgtcgtcaaggaaaaaagaactaatagcctatattaaccatcacaatctatataaccaaacaaagcaagcacagcagagtagcagacagctctgaaagatttactccacctcaggacgcagaaacaaattttgcaacaccacagatttccgtacattgcatcattcagcacaaaagtggtagtacatcatcagcgttcaggagttgcttttggtttttcagcacatatattacaagcaacagtagcagtagtgcagcacacccatgactcgtgaaaaaaagaaaacaagagaagacatctgcaaaaactagctgggatggattggggcagagcttctattagtcaggaacgttccaacactgggttgatcgttgaggacgaactatttcttttgctttgcacgatagtcagcagctgctgctttgatggtagacttggcgagtgaggttggctttaggacgctcttcgggttcaaggcctgccgaatcttgaacactgcccatgctgtcccgattgcgtggcctgctgcatccatcccttcattggtcgcagccgcggctttctccccatatctgcagagcagacccaatgtaagagcttaagaagaatctctattgatcatttgatcaattccactacataaggaagaattagagaaaaaggatgtgcatatgatgtgcttcagatatggatgtaggacacgtaagaagtagtagaaatctacatataaagagaggagaaatgagtggaaaggagaataactcgtacttgtgggatacaagaccggtagtcacagttgatgatgtggacagaacattcgttccagccacttcgactgcgtcgcaaatcttccctgttggcatgaattaacgatatgtaagaaagacaatgttaccataatccaaagtgattagctccaacgagccaaattaccataagaaattactgcttcaaagaatgtgttcgggtaaatctgtatattttgttaactgttatactgaagtagatatatcgcataagagatataaagtactatttcatcggaaagcatggcggcaaacagaatatgtccctaaatgtatctaacatgttgagctaaggtcaaccagcatcagaaatgaaaaatagcataatcagtggttggaagtacaaagtggcagcagctgatttaatatgagctgatccagaaggagcatgccaaattaaacagaggaaatggagagccaagaaaaagaattgtatttcattccaaatttaagtcaccagagtacatgcttcttatgctaacttcagatttggcaaaaatttgtatccatcaagttatgcaaattcacaggatatatgcgaccaaaaaacccaagcaaagccttacctacgtcagataattatgacttatataatgcaacccacagggatattcaaattagaaacagaaaaaaaatctgctcatgagtcatgacacaggtgttgtctaggtgagtttaagaataacataaatttattaaattatgaaaccaggtttcatgtctgaataaagcaaacatatcaacactcattataccattaaaaaaaacaataatgcaaagcagacccattatgtaacactaaccagatacaatagaaaagttaaagaatcataccgaatccatcaagcgaagcaagaacaatctctccaggtaacaaattaaagaacttcttgccagcttttgagttagctattgagtttgtaaaatagccagtaacctttacaactccggatagtattccagttgccactttctcagacatttttgtcaccatcttgaccctggcaacaatcacaagcatgaattccttgaagcggaaaattgttaatgcttgatttaacacaatatctccctgcaacgtctattctcatagacactaaaaccatccaaatctaacatgatgtcggtgtgatggcaataataataagcagggagcatacctatttatttaaatggttttgtaacccagcaaaaatctttaaataaaagagaaacacaatgaaggcacattgtatcatcctttttggatagacatacagaaatggtaatactatcacactttagcaatgtaaagttgtaaactaatgaaccatggagaactgaaagcctgaaactgcattcatgccctgataactaaatcccaaatcatactggataaatttggttgacatcggttaattcaaatcacaattacaactaaaatgtgagatagagttactaccttttgatccgcctcaacatctcggggctgacctcggcgtcggcgtcgccgggctgcatcctcctcttgaggacctcgtttccccaccggagcctgtccaccgtcagttcactgcaccacagaatccccttggccaggtgcccggcccccgtcgcgatcgcatttgccaccttcccgccgtactcctccacattgggcgccaccgccgtccagtacgccgccgcctccacctcgtcgcgaaccttgctcgccaacgcctcgccgccgaccacggactggacggagaagctggtgtacgtggcgaggatgccatcgaggcgcgggtcggggtgggagagcgtgaggccgtaatggagagggccggggttggggtcgtcggcggagggcggcacggtgagggagaaggaatagtggcaggggtcgagcttcaccgaggcgacgtcgcgcgcgagcggccactggatggggtggaggagcgcgatggcggcgagggaggtgtcgccggagcggatgcggagcagcgagaggtcgccggcggcgagcgggtagctgcggtggcggtcgatgaggtggagctgcgcccccgggatccggagcaggacgtcctccgacggtggcggggcattggcgtaggcgtcgacgggggtggccggagacgccggggacatcggcgacgagggggaggaggggcctatctggacgggcgcgagatcggccatgctgagcgtggggtagagcggcggagcggagggagcagggctagggttagggttagggttagggttggaggtgttgccgtagtagcagtaggaagccatgggagcgcgccacgggggggaatatacgccgccggggacggtggaggggcggcggctcgccggcgacgtggcgcttgtatagggagagccggccgcgtacgtggcgacggagcccggtgggacccacgcggtttgggggaggtgggtcccgcatggctgtgtttaactaattgggtggttagttttcccatttatggcgatgcttctcgtcaatgacttgtggggtccgttgaaagtgttaactggtggaccatgttttcctggacccacctgtcggtgggtagctttgggtgaagagtaaccggcccacgaggaggtcacgctacccgatgccgatatcggcggagggagctgacgagaagctacgctatttatctttctgacgtgtgggcccatattggccgtcctatccacagcagctttcctccatgagtaagcaacctcgcggccatagcaacagcatccaatccatccatgcccaatgcggtaagtaatctggttaatgatctagtagtaggcttcgtttggaatatgattactacgtgtaacaacttttagttggatggaatgtatcccaataatataaatctggatataccatgtctagatttacagtaatacgttccatccaagcaaaatttactatattttgatatggagggagtagcttttttaatgtaattttcagcttccatatagttcaaattcagaaaataagctaccctttagaaccggaggactgaaaatctagctttttgcatattctcatgccagtcgcccaccaatttgttagaatcttagactgaatttgaaacagattattgacagtgacggagctaaaaatttacaaatagtaagggcctgtttggtacagttccaactcctaaatttaactccaggagttgagtctggagtggagttgtgnagctgtctaaacccagctccacaactctagttcattttgtgagagagctccacccagctccactcccagttttggtggagccgaaactgtttggctgagctccagctctagaaggggtgaagctggagctggagctgtgccaaacaggccctaaggctcaaccaacaaagtctaccgcttaattaatagaatttgttgaatcttcagactttccatgaattcttagatggatttataagggattaaggagataagcttagggcatattcaatggtagagacgagtatggtctcttgaacaatacatgattatttagagaccatgtctttacaataattaagacgataaaggctctaatcattaactcaaaaatattccgttcattaatattctttccttttttttttacccccatgcaaccatatttccatattatagtgattaagagtcgttgttaagccgttgttatgcataataacgatgttttgtctatcctctttcgctttcctccatgtcaacaagtattcctaattaacaacactaagagtccactattgataaccattgtacatgcccttagggctcaagcccatttttttgtctgggaaatgaacaaggcgcagcccgatatccactaggacttttacttgccctgatgtagttgatgcccagcccaacttcacatcatcatcacctattcacactctctaatattctgattcctgcagctttacatatatctacatccactaatcaactttcacaagcaactatctgagaaaacaaaggcctttcagcaatgcaatgctcaaagcagggtctaccatatctatcctgcatctgcatgcaaggaatatgtgccatctacttgcatgagcaacaaacaaaatgcagtgactcaggaatatatcctcctgagtcaaatccaagatgagtaatgaaaagaagaataaaggctcaaaggcaggttaggtgttgtgtgttctttctttcgcatgctttggattcgattctgcactgacggatacgtatactgatttacacatatcgcactatcatacctaaattcgttccccttttaggattcccatctcatatttagcgtcaaattcttcgatcctagatatggaaaaatagacagaaaaaaaaaacatgacaatgaaataacgaatagaactgctagttcagatcattagccccggagataagacatttcaacttcaactttactaatatgcacatattcatttagctattacgcatagcagaaaagcagtagtaatccgcctgttattgtacacgtcaaccacacgcggcaaaagtaccagctaagccaaaattaattagccgctaattaagcgcacacattaacagcaaacaataccgttaagtttggggttcagaaggtgacgaggaggtcaccactattgggctgggccgagtttgggttggagagcatgtggacgacctcgcgcatggtgggccgggccgtgctcgcctcctccacgcacgccatggccaccttgtacaggttcaccatcagcgccaccggctccggcgtcaggcggcggtcggccacggcgaggacggccgccgtgtcggagttgtccggcagctcggcggtcaccttgcggacccagtgcacgatgtccacgccgtcaccgaacccgcccacggggcggcgtccggtgatgagctccaatagcaccacaccgaagctatacacgtcgctcttctcgtccactcgcagcgtgtatgcgtactctgcaaacacaaatagtacataggattgatgaatcagttagatgatacctaacataccatttttagattatcaatcaaaaagatattagtgtaccgatcctttcccaacgcgcataactgaatgtaactacagccattagagctgcacatttgcataactgaatgtaaccacagccactagacagaattttcatttttcagggtagtgcatcacactcgaatcgtttgaaagacaggttatcctgaagctacgtacttcaccaacaacaccatttaagagtggactgacaagtcaataaggagcagatctaccatggagatacagccaagatacgaacgtgatacagctacagtagaacagtatctcctccaattatccaagagagtgccagtgtgccacacacgaggcaacaagacgacacaatatgaatgctagtactccaaaggcaggagactatccattaatccaaaggtagccaaattgccttgcctgccattgaccatacatatggctgcaagatctgcttctgtagaatccaaagaaacagagcagaaaactgaactgaccattaatcacaatcactgctacagccatgcaacggcaagaactgtagctgtaacttttgtttgctgtctgcagaaaaaaaaaagttcacactttggcccaaaggtaacatttgtcctctccccagttgaccgtgcacaaggcaacaaggattgtgctcagaggaaagcacaagctgcagtacagtactagtgcagttccagtggatggaacgtggctgcatctccatgcaggggccccctctattattgcctctacgtaaagtttacaatttttcaatgacacttcgtataatcgtatcagatcatttcaattatattagttatagttagaaccattatttattttaagcacattaaaagtttgttctttgtcatggtccagatataaagtttgttccttgtcatggttaaacagaaaaggtttgttcattcaacacatggatcagaaaaaaaaagtttgttctttcaacacatggatcaggataaacttgttgggtcttggaattcaatatttttcaaacagattcatttcggtaaatttagtactacagtactgtagtggttcgcattgaaaaagaatagtaataagaaataggctaaaaataatatggagaaattattttgggtggttacctggcgcgatgtagccgtaggagccagcaatggcggacatgcactcggaggtggcgccgccgaggaacttggcgaggccgaagtcggcgacgtgcgcctcgaaggcggagtcgaggaggatgttgttggacttgacgtcgcggtggatgatcctcggggcgcagtcatggtggaggtagcagaggccgcacgccgccttcgccgccacccgcgccctcgcctcccacccgaggtgcccccccttcccgccatggagcatctcccccagcgacccattcggcatgtactcgtacagcagcaggttcgtctccctgttcgacacgaaccccagcagcctcacgatgttccggtgcctgatcctccccagcgtcgtcacctccgccgagaacccccggtcgtgctcgccgccgccgcgccccaccaaccgcttgatcgccagctccgccccgcgcgtcacgccgtggtacacgatccccgcgccgcccttcccgatgatgttgtcctccttcacgcactccaccacgtcctccgccgagaactccagcttctggaacgccgtcatcttccacgcccccgaccgccgccgcgccgccgaccgccacgccgagcaccccttcctcgcgcccaggaacgccaccgccaccgccgcgaacgccgccaccagcgccaccagcatcttcttcgagtcccaccgcagccgcagctgggaccccgcgccgccgccgccgccggccatggacggagggcacgcgtcggccacggggccgccgcacagccccgggttgccgacgaacgagctctcgttgaacaccaagaactgcccctgcatcggcacggggcccgagaggctgttgtacgacacgtcgagcgtcgtgaggctcgtcatgttggacatctccggcgggagctcgccggtgagcctgttcctggacacgttcagcgtgcacagtatcttgagcgacgtgatgctctccggtatctcgccggagaagccgttacggctgaggtcgacggcggcgagggaggcgcagcggatgagctcgtctggaatggcgccggtgagcgcgttgccgctgacgttgagcctggacaggttcttgagattgccgatctccggtggcagcgctccggagaagttgttggactccagcgacagcgtctgcagcgccgggaggttgccgatggccggagggatgcggccaccgatcccattgttccccagcagcagcatgccgatcttgtcgccgccgatcacgtccgggagctcgccggtgagcaggttgtcggtgagctccaccatgttggcctgcgggaggttgaagagcccggcgggaaccgggccggtcaagaagttcttggcgaggcggacgcgcgtgagcgtcttgcagtcgccgagcgagtccgggatggggccgaacaggccgttctccatgagcacgagcatctccagccgccggccggcgcagaggtccgccgggatggggccggtgaggtggttggtggccaggtcgagcgtcttgaggcggccgttcttcccgagcccggcggggatgttgccggtgaggttgttgtcccacagctgcagcacctcgagctgcgcgaagccggcgacgaagtccggtatgctgccgcggaggtggttccggaagaggttgaggagcttgaggttggagaggttggcgaggctgggagggatctcgccggcgaggtcgttgacggagaggtcgagcgacgcgaggctgctgagatcgccgagctgcggcggtatctcgccggagaggcggttccactgcaggaagagcgtgtcgaggcgctggagtcggccgagctccggcgggacggggccggtgaggttgcagctgctcatgtcgaggcggaggagcgcgccgaggtcgccgaactccggcgggacgccgccgtcgtactggttgtagtatccgatgtacatctcgcggaggcgggtgaggcgggagagggagacggggacatggccggagagcgtgttgccgttgagtccaaggtactcgagcgcggcgaggtcgccatagctgtccgggattgcgccggtgaagtagttgccgccgaggtggaggtagcggaggcgagcgtgtgaagcggagaagggaggaagcaaccctgagaggttgttgttgtaagcgtcgatgagctcgagcgaggggaagtagggggaggcgccaccgccggagtcggggacggggaagtggccggaaaggttgttgttggagaggttgaggtggcggagagaggggagggtggggagctcgagggggacgtggccggggaggcagcaggcggcgatggtgaggttggcgagggagtcaaggagggcgatctcgggcgggaggtacccggagtggagcgggagggcggtgaggttgatggcgacgacgcgggagcggccgtcgcaggtgacgccggagaaggtgcagtgcgcgggggaggtcgcggccgggtcccagtcggcgaacggcggtggggcggtgccggagggggatggaacgagcgccgccttgagcttggcgagcgcgtagatgtcgcggtcgggggaggcgagggagggtgggaggaggaggaggaggaggaggagagtaggaggcattgtgaaatgcgatggtgagagggggaggggaagaaggcggggtggtggcgggaataaaaggaaggcgggcgcgcggcctgcaggctgcaaggaatggagcagaagcagaagcagaagcagaagctgtgggagtcactgacggcgttaggttggcgtggtcaatgcggcatgtacagataccagaggacgacgacgacgaggcggagactgacagaccgggcgcggagacgatgggacgggacgagatggccggagacgtgtgtggcagacacacacacacacagagccttcccttcttcccttcctccattgattgatcgcgggctgctgggctgctgccaccaggggcggctactagcctttctgctgtttaccaggagtacgtttgaactagtaggggtgtatagttcataccaaaattaaaagtttagttgaaattaaaacaatgtgatgaaaaatttgaaagtttatgtatataggtaagtttttatgtgatggaaaagttgaaagtttgaagaaaaactttggatctaaacttggcttagtattagtctagcacggagatcatcttcgcccttggttaggtggtgtttggatctagggatttaacttcagtctatgtatttagacactaattcatagtgttaaatatagactatttacaaaactaattacataaaatgaaagataatttgcgagacaaattttttaagcttaattaatctataattagagaatgtttactgtagcatcacataggctaactatggattaattaggctcaatagattcgtctcgtgaattagtctaagattatggatggtttttattaatagtctacgtttaatatttataattagtgtccaaacatccgatgttatagggacttaaaagttttagtcccatctaaatagggtctagtttccaactttttcttcagactttcaaatttttcatcacatcaaaactttcctacacacataagctttcaattttaatcaaactttattaaactttcgtttgattttgagcaaatttttagctaaaccgaaattgtttggtcaaaactatcagggtcttttttttaatttgaggaaaaacaaaaggattgaagatcctggggattaccgactacaggagtcgatcgtaggaaacctggtttagtttccaactttttaaaaaaaatttctaacttttatatcacatcaaaactttcttacacatataaacttttaacttttctgtcacaccgttctaatttcaaccaaacttctaattttgacgtgaattaaacacaccccaaattttcatatccaacccatagaaaaaaaaataccaactcactctaaactgttttcttttttccttcgagttggaacgagacaaccaattcatcgagcaaccataataaccagatcaaaagaattaaaagtatacttcctccttcactaatatatggtgttggttagttcatttttgaattaaaatgaaatgtgggaggacttatttttcactaattttacttaaaatatacaggtttaaaaagaatggattgttgtcttcaaaagcgcgcgaattggctctcccctagcaagcgagttcgcaatgccatcctacgaactttacacgagcaattcaatcgtatttacgtgttcttttttctgtttctatgtgttttataatcacgtgtttcaatggaaccctaacttttgctatggagtacaaatttaactaggtgtttcacaaaactgcattaatagcaaaaaattttatcccttacgtgtagatgacatgtgggcttgttttacaacgacttgggtatttgttgggttgggttggtaacttaggcatgaacttatctgagaaataaaaattacagctttttataaatttatatgctactgtagttatctttttataaagatgcatactacagtttttaaaaggaaaaatagtttttaaaattgaatgtgcttcttggtactggcaagcctttctgtcgccctgccacaaaagttgtggcttgtctagcttgtggatcatccaacggccagcaacgtaccagcaccaatccgtcagcggtccagcttaactgacacggtactacgtacaactccctgcaactcgtgtgatccggatctcatctcactgcactgcactgtcaatggcgattttctgctgtccaaaacaattctgaaaccgctttccttttctttttcttctagaactgtaatccaactccctggagtagtattgaattacaactccacacatattgaaatggacatatccggacaagtttggattgtgatccattgaaaaggtactagtaggacacaatttaagatgaggaaaaatatggaaattttggaggatttcaattctataggaaaattttctttgaagccctttaaaacaaaaggattgaatcatatccaatcctttaaaattcctatggaatgagtaattttatagagattttggagaaaatttagcaagagcttcaacctcttggtaacttttctttgagtctatctctcttatccaattcctatgtttttcttgcagttcaatcaaacgattattgatgtgtttttcctcctgcgttttacgatcctctattttcctatcaaaattgtacgttttttttttctgttcataagttttttcaatcgtgccattcaaagggcccttatatctgaactcaatgcatggtttgctttgccactggcactggaactgtagcctactccaagcatcagcagaaagggaagggaagcaaggctaatcaagtcgtcttctttccgagcaaggcctggtttagttctaaattttttcttcaaacttttaatttttctatcatattaaaatttttctacacatataaatttttaatttttttatcacattatttcaattttaaccaaacttttaattttagcatgaactagtagtagtacagcaccatctgcagctgcagccagtgttcatgtgtgctactgctacagctaacaggcagcagctgtgctgtgctgtgctgtgctacggctgctgctactcgcctgcctctggtcgtctatcatctgcccatcaactgattgatgctcaagtcttcgcgtaaagccaaagcaagaagctcacacaaaagcctctccagtacactctgctcatcactcgtcagggtgctcgatctctgctggaagatttgcttgggcatttgaatgcttttggacaagtcaagtgaagtactatatatctcccctattccaatataaggccgtgtttagtttttccgtattctcaactttccaccacatcatattacatcaaaaactttcctacacacataaacttttaatttttttttcaaactcataactttttataaagtttcaacttttttttaagaactaaacacaccctaagtgcagttgtaaatttttatatttttgcaacccagtattttcaaaacatgaaacgaaacgtagacctcgagcgtcttgacatttttaaatccgatggatagaaaataccgaaaaacctacatgaacgactgtttggatagaacgcgagaaaacattagaattagaattttaggaaaacataaatcaaaagagagatcctagacgtaaagaattttttttcaaaagattaaatcttatattattgaaaatccaatccttcaaaattcctgttacaaaaaaagcaatagcttgttcagctctcttgttgttcaaggcgttttggtctatggcatcggcagtaacagcgacgagtcttaatgacaaaataggcacatatcgactagtagctagtctctgttggctggcacctgatgctgcctaacctgtctgccaacattacaattttgttggcgttgacacttgagtttactaccagtagtatcaacaataaagtggactaatacagagataaagcgaagagaaaacaacaaactaaaagtaattagaatctactactactccacttcactatggaatcaattatcagtgaagagcacaaagtccagcttcatgacatgtcagggcatccacacacggtcgacagcataatgctaccgcccactaaactagacttacctgcatgattaatcattcaataatcagatcagtggaggaaagaaagaaagaaagaaagcagtagttctaatggcagtggtagagagtagagaggtgtaggttgatgataaggattggctgcacgtacagcagcatctcacaacagaaactgagaaaagagagagagagtttaccatcaagaacatatatattccattaacctgctctttttttgtgttttgtcatttaacaagcagtgttaggagatgttctagctactccagcccctacaagtgtcaatcagtgtgtgcaagatcgatccacaggacaagaaagctagagctgcagccagtacacgaaaaggctcgatatctcaccacgagcgaaccttcagttgctttaaaattctttttatcatgcatggtgccggcctggttaaattagtggaggaatagaatcacactaagttagatgtttaatcgcaagaaaatggcgtccatccatgcccgacctgacctgacctgggggtggtgaatggaatggaaagaaagcctagctactagtactagtgattccatgggtgacacagaatcgatgcgagtcttgtctgaatccttcgctttgctctgcatttcattgttaggcaggatgcagaggaagaagaagaagagggctccttgtcaatgtcaactcctccctcttcttttaactttttttttgctttgcatcttgtcgccaactcaattcgccatggccgatgacgacgatgaccaagatgaggtgaggcccattcacttagcgggccgaaacacgggccggcccagcacgagaatcaaagcagagacagaccgagctgtgccctagcacaaagccggccgccgccgccgcgcgctcgtctcgttcgcctctcctctgcgtcgccgccgccgtcccgacgattcaaggtatcctactctccctattactctggttcggtagaattaatcttggtggtcagcacttggttggttggtcgaatatgaattagcgtatgagcagctaacctttttgattcatgtggtgcccaattgtttcttgtgaaatcgcaagaaaaaaatatttgtttcttgtgatgtatagggttcgttcctctggttgatttgatttggttatggcaaacggcagcttctgcaaagaattttactactcttgtcctgtttgtgcaagcttaaggcttctgtgtaactgtatagaatgcaacaacagtgtgttcttttgggaagatttggtcgtaatgtgagaggtcaatgggtcatagctctgcatcactctagatcaagtttggtgaatctttatcggacattttacctgtcaagaagtgtgtaagaagaacaactaagaaaggcaatcaccttctttgcactagaactgataggcaagatagaactcatttaactgtagctgcaaaacatcagaactttaactcgtgtgtttttaaattccatggacaatggtctgcttgtactaggatcttaaatagaaacgtctgattctacatatcttcacaaaatgcttagtacttgctgctctcaagcacttaattatgttcaacccttcttttgccactgctgctggtttcacaccttccaattgttgcgatgatttccctatctatattacacatacaaattccagcaaaacctgttctcacattcagctgcgaattatgttggcaggttcaagagtcgatggaagaccaaacagctgctgcagcaggtcttgattcaagagtgaaagccagcttggttcttggaacagaatcatttgcaatcagttcagagtccggtattctatcggagcagctggctgctatgaaggagaagagcatggagatcctgaagggctacatcaccaagcataatgctcccgctgatgtccctgatgaacccatcgagggattatctgatgatgaaggagacgcacctgctaagaacccaccaaagaaacctaagaagcagaagtgatcatccaattgtaatggaaaaggttgatctggaaaagatgtgatcgtcctatcgttggattcatgatgcttagaatttgtaagaaattagctgctcgtacaatagtttgctcaaaggctgaacacactgtatttctccagctagatgcagatctgcccattaacttgtatgagtaagatatatcaacttgaggggtacatgtaaactgcagcataagaaattctggcaattgcatatgctatcatgagtattcaatcacttgttcgagctcctcagcaaaattctgagcccagcgaccaacacaggcctgagttacagacttacggcctgatttggccgttcagtcaagtaggaaattatagtatataaaggtaaggtttaaagaaagcaaaagggcagataacattcttccttccgcacagcagatttgttttggcgttttttagttatctgtacattcaacagagcgaactgtgctagaatacttttaggaatcacattcttttcctacatcaggtgtacaccgagtgctaaagctctgtttcttggtcttgtaaaagaaaaaaaaatcctcaaagcatcttccttgttaagtttaacttgttcatcatcttggtgtagtcctggtcactcgttgaagatatggagagcacaaggacctactgattaagaacattttggcccctcccttcggagtatgaaacaagggaagctagctttataatcagttccaattctgtatctgcagtcttgccccttgatcagagtgcagaagtcagataaaaaggcaggcataccatttcctcggcaacattttcgtggatttctgccttgcactaatcacaaatgcgggcaacaccgccaccactattaccattacttgccagtgtaacctgatgaagttcattgagtacctcagtaaaatcatctggtggggggcatgagaattcaaggatctttcctgagtgaggatgcttaaatctgaaaaaggaacaatgtcacactcaaatggcagaaaaatatgaatcgaaatgcatttgggataatacctacccaagcaacgcggcatggagacatggcctgtctatctttgatatcatatttgaaagatcacaatgatatcttgaaggagttctgggtctcaaaagtgacaatgccatgcttttggtacctccgtatgtttcatccccaagaaggggaatccctaggtactttgcatgtgctcgaatctaaaaatttaaagttgcatgttcatcaataagataaaaaaaggtatccttgaatagaattttccaatattaaggagtactatagcatatatagatcaaatttcaactgttgctcataatcctttgtacctctatttcaagccatacaatagatatgtaaccaagcactacctatgcaagatgcaaattttcttaataaaataaaataatatgaaagtattttactaaggattggtgcatcctttcttaaagaactgggatattgtggggggtctaataacctggtgagttcgtcctgtctccaatctccactctactagtgctgatccaccaccagcaaagacctctcttactttatacctgtagaatctcttgagattagaaggccatctactaagaactaacatagctacttgacagatttttatttaaaagccaagctcttgtataaaaataagattgtcgccatatctacaaatataatcacctaccagtatgaagtgctaacctaatttctgtgatcagttgaaattcatattttttcaaattcaggctgtaaccagtaaagctagtgtatacaaggaaccccctctcttttttttttctttttctttttcgaaattcaggtggttatgactggagttaacacatctgctatatttgaaatgttttgacccaattttccctttatcattccttagtcctagcattaactggggggcaaagaaaagttgaacctttatgtttcctgtaatccatacacagctcaacataatagacatctccacgtaaataacactgctcctagtggcataacttctaaagtttgatgcttgattagttagctatttagcttagtcagttcttgagattaattatattcaagcaaattaaaagggaaaagtgaaaaagcattaaatcccctactagcggcatgtcgtgcatatctatggcctgatccaggagtggcaatcatacggatccggttgttaggatcacgagctataggaacttcaatcctgccagaattcggattcggtgcaccacaagtaagactgatgtacactctgcgtattgtatgcagcttgaattgttctgctaattgtgcatgagaatgctcatcctgttaacaaggggagagtacaaaaggtcttaatgctaacttggtagcaataaaagaatctacattcaatgcagtaacccttgaaattccataaattatgtgctagtttacaaaaggaaaagagtgttctgttttgggttagaacaaaccagtcagtaccttggctacaacaagtagtccacttgtacccttatcaagcctatgcacgataccaggacgcacaagagcttcacggacttctgaacttacttcgccagtagtaaattgatcgatgtcaaacacatcaatatcatcatctgaagaatcagggcattcatcatcaattgaattacgtgctaaacaggtaaatgttgaaatcttgcagtggtgaagtatagcattgactaaggtgccatttgcatttcctggtgctgggtgaacaacctaaaagtcacaacaaacaaatatcaccatgcaggaacaactgtttcgtccatgaattgaaaattcaaaacaagagtttaaggattaaagtgaaaatgcatcgataaagaaagacaggatgtaggagcaaccccaaaaaaatctcttattggttgtaaaggcatattatcagcaaatatacaagactagaatatacaactctaaatatttgcagctgtgacttgtgggacctgcaattgctggaatggtaagactgtttctcatagaagaaagcagactagagggctccagagtcgtgtaaagtacagcttctgattgatgctcggagcaaagcaaacaaaatgccaaagacatcaagcaacaaactagcagaagctgtcaccttaatggcttgttttgtttagaaatggtgattggtgagatagaatgtgcaacctctagcccttgtggcagtgcttttgaatgttttttttggtggtgtggctccactcagttttatttcgactgagcaattcattagaatgaaagagtttaatgtcctttagagtctttaaaaaacctattcagacaagtgttgctttggcatccagagaaaataagaaccaggaaaccaaagcttgctccagtatcactgaaattctgcaaatatggcaaaaatcaaatgttagaaaaaatggcgcataccatatgagccggtttgttcacaacgagaagatggtcatcctcataaacaatgtccagtgggatgtcctctggctctgctctcagtggctgcagctccaacaccgtgcagctgacaatgtctccaccttttaccatatgtgaaacctacatttcgcaatgaatagaaaatcggcttaagaatactatcaatgagaaccaaacagatagttattgacatgtagttacaactgctactacttcatggtctgatatttgcaattggaaagatttgtgccatgttctgtacaaatctttactctacgggagatagagaacaataactctaggaaatttactttgggccacctttaattgctggtgtttcgctttggaccatccttcaacaaatgtttttattttggaccggataattttacctttgtggcacttttgactaccctcaactcttttatccatctacatctaatttgttgtatgccaattgtcaaagaaatggactacatacagctcagcgagtttattgacgaacaggagccggcgtactcaaggtcattcatatgcttgagaagagagtcgaggtgctctaaagtgaaacaaatgcaaagattacacggcgcaatgtgaaaatatcggttaaagagtggtccaaagcgaaacatcggtaagaaaagatggccaaaagtgaaatttacttgtaactaacctaacaatatagtgatctttgctctaaaaaacatctttactgtacggtcttcagaatgagaacacaaacttaggttgagttaagacagcaaattagcaactataaattgtaatttgctcaagacatcgcttattgttgaactaatagaaagatgaaagcttaactggaagcaaatgaggtttcggggaaatcgtgtcaccttggagacgggacggccattgacgacgacgaggccggcgcggatgctcgcctggatacgcgcgcggctgacgcctccgcccccgagcctcgcggagatccacgcgtcgatcctcgagcgcccctcgccggccggcacggcctcctcaaggcgcgtcccaccgtggcctcccctccggctcggcgccaccgcctcagcattcgcgtcggcggcgaggcatctggcgtgcgatgcccccacgcaacggctgcttctcctcctctgtcgccgcagcagggcggagagcgcggtcgcgatcgccggcggcgacgccgccgccgtggttgccatgggagatgggagggggaagtgaagtgggcgaggtggataatgttttggttaatgggccacatttagtttgaaatgggccgggccggcctccatttaccccccacacaaaaagggccggagctctcttttttttttctttttcttttcattttttaaaaaacaacaatacatgctgcagtctaaccatggaatggctacaaaataaaattgcgctattcctttttttatgtgatggcatgggagaaagagacgtcaacaaatacacatgcacaccacacctcacacacctataaatggaataattaattatctgacattcatacgagtggtgataaaaaatttatcattggacccatatattatagaaagcgagtgttaaataattaattgtcacgtcttaaaataggtaaaaagttaaatgtccccctgtaaaagtaccttactataacacacgctcgtataaacggagtcatggagagaccaacgataaattcccggcagatccatttaaaagtggagtcatggagagaccaacaatagattcccggcagatcctattaaaaatgtgctattctggattgtaagggatatgattttctagtgcacatttatggtgctaaataaaaagcaaacaatttgtcagttttttggtgggctgaatttaaaactcgatattttatatacatattaaatgtgaactagtaataaattagatgtatttcatgttgatttaggtgccgtagaaaattgattactccaacataagcacaaccaaaattaaaaacaattgcatagtccaagttgtcaacacccatgtatttattctagtatagtatatctacacactatggttatgaatgacttgtgcaccctcctgattctcttgttaggcatcaatcacaccatgatactgctgtgacatttaatttgtagtgatccattttggaaaagaaaattgataattaaaataaatgtgatggggcccacaagaagcattaggacggtggccccctcaccataactggctggctctgatgtaaatggaaaacttagtgcttggcactgtggatatatgaattggccatgctttcttttatgggacaatagtggatgtgatctctcaaagatatatttttttctaaaaaaattatatacacggtaattaagtctcagaactttataattattattttctatattcttatggaatttattttttctagtgatcattaatttcttcagatgtttttttaaatgtaaattgactactgtaaatgtaaacatatatacaactgaatttataaccgatttaactacgtgatccatcacttattgcatgtgatatttctttatgttattttgagaggcagattgcacgtgacgtgatttttaattcatatacgtgaataattcacgcaccactcgtacgttctgatctttatttatttcagttcacggggtgtgcgtaatgggtgggtcaaatcatagttctcattgatcccacatattaaaacataagcatattaatttatttatgttttttcaggcaaagaaaatgataagaaagttttacgccagcctagctgttcagtactacgtactcctactagatattttagcttaagataaaaggagattttacaagatgataattagaacctctctgttgagacaacttttacccaaaaaaaaaagtgtcgtttgaccgcatatatatgacctgtgctgtcagatactcaaacagaaactttaatttggggagttgcacagtaaaactaattatcaacggccatttcaagcaatagttgattgtgatattctttaaatatggtcaaaattgacggcgtagctggttgcctaactctggttgaagggttttagccatcatcgaattaaagtagttagttctttttcctactaaaacgcatgctaaaaaaacagggctcaaatggcaataaatacatgatgctcactaaattctattaaaaagctagcataatctcgtgtttaatacatatatatgaactaaaatttaatttttaagggatgaagtagcgcactcacgacgtcatctctgtatctttattgtgtttttaccggtagtacttaattagttgcattctgttaaaaagaatttttttttcttttttgtggggaagagagaatatgttaatttggattttgcagttttcacacgctagctagcagcagcttttacttaaaaacagcagcaatttgaaaccttcgttgatcgaactgcctatatctaatatgtaaattagccatggttcttttaagcacaaattttacttattttctgagaagtttacaagtattttattctgaagtttatgacaaattattcagttcttcgagtgtgtgttaatgcccccttgagttgctgtatagaaaaccattattagaaaaacgattttcgaccataggacccatttcactatacaggaactctaaaaacccgcctgtataggggtgtgcgagaggatttgaatatttgatggtcgaccgcttatgaagattcattatcatatacgatcacttaagaggtttatatgcgaactgcgaacgtagatatgtatgctatatattgtgttgtggatttgggaactttgggattttgtgtgtgtggatttgtgaattactgtgaatgtgaattggagttgagtctgggaagctgtcgccgctgagaaacgacgtctgtggaattttttttcgccgaaaatgtgtatttcaggcggatggctcaacttggccgtctacgaaaatcatgcaaaaatagattttttaaggagtgaaccctacgtgtacatccaagatctgggtttgcacagtgcatgtgcccacaaggatatcgatctcactgtgtgagcaactgcgtgtacatatgtgtaccccagttgccgacaatgcaatgtactggctactaaaacacgcgatgccacagtaaacagtgtcattatttatgctgtagttataaacagtgtcattattggatctatcaatttgagaagtattctttttatgctagtagtcgatcgcataaaaaaatgtcatgtcaaaatttatgctagtatggataaaaatagcatcattattggatctatcaaactgagaagtattttttttctaagaaattataaacatgtacttattaaaaaagaaggaacatatactatgaacacataatcttatggtacacactccgtacacaccaactaacaaagttcacccaagtttataaaaaaaaagtagtgcacatattttcaataatattacacccatatggaaattttggcctaaaaatgacaattatgacatatagttttaaaactatcactttttatagctaaaatataatgaatttgaagttgatactttatagatatatgcaatactgctgttggaaatacgtgtatgcttgttagttggtgtgtatagaatacggtcctataaaaacatattctctttttaaaatgcttgggcaataaactggcgatggatttaatatcttacatgtggtacatgtggacaggtcactctagatatatacatcattgcaattttctgatcaatttacgttgtgctggtagtactatatgtattatgtatactatatgcctatatacacgggtggagaaacccttttcagtcccagtttgcaactcctttagtcccaggttgtaaatcgggaccgcgaatctggaactaaagatgggtatctttagtcccaggtgaaataactgggactaatttcacctgggactaaatataaatctttggtccagttggtgttttcaaccgggactaaaaagtttttttccattgttttctgctttttgcatattgattttaaaccgaactcaacaaaaaaaatcatctacattcacaaaatcatccataaattcatagaatgaacatagtcaaattcacatcacaaatttataaatccatatacatcacctacaaatcaagaaattcacatagaaatcaataaaacag

SEQ ID NO: 77729 - DNA, 4818 bp, Oryza sativa
atgtagctttggttgaggacttaaagtataatttgctttcagtttcacaaattgttgatgaaaattttgaggttcactttaagaaaactagaagtaaagtttttgattcttgtggtgattctgtgttgaatatttctcactatggaagagtgtttaaagctgattttgaaaatcctgtttcacctgtgataacatgtttggttactaagtttgataaagatgtgatgttttggcatcacagacttggacattttggttttgatcatctcactaggttaagtggtttggatcttgttcgtggtttgtctaaatttaagaaagatcttgatttggtttgtacgccatgtcgtcatgctaagatggtttctacttcacatgctcctattgtttctgtgatgacggttgcaccggacagctattacatatggacactgttggtccagctagagtgcaatctgttggaggaaagtggtatgtgttggatattgttgacgatttttctcgatattcttgggttttctttatggcaactaaggacgaagcttttcaacactttcgtggtttgtttcttcgattggatcttgaatttcctgattctttgaaaagaattcgaagtgataatggtggtgaatttaaaaatgcttcatttgaacaattttgcaacgaaagaggtcttgaacatgaattttcttctcctcgtgttcctcaacgaaacgttgttgttgaaaagaaaaacgtgttttggttgagatggctagaacgatgttggatgaatataaaactcctagaaaattttgggccgagacgattaacactgcttgttatatttcaaatcgagttttcttgcgatctaaacttcgaaaaacttcttatgaacttcgatttggtcatcaacccaaagtttcacatttgcgtgtttttggttgcaactgctttgtcttgaaaactggaaatttggataagtttgaggcacgctctaccgatggattgtttcttggttaccccgcacatactcgtggctatcgtgtacttattttggggactaacaaaatcgttgagacttgtgaagtttcgtttgatgaggctagtccaagtactagacccgatattgcaggtacactgtcacaagttaagggggaggatgccgtatttttgaagacgagagcgactacgacgacgacgatgaggtcggctcggccggtcagaccgggcgccaggccggtcagaccgccggcacacctccggtcaaaccggcgcaagacgtgcggtcagaccggccagggttgtcggctgagggttccggtactgttgatgctgatcgagatggtccttcggaaactactacttcgaccagtaataatacaaaacgtggatcaacttcagaagtcactgctcctttgcacattcaatgacgacatccgccggaacaaattattggtaatataggtgagcggactataaagtctaaggtaacgactcatgatgtttgtgcaaattctgtatttgttgcttcttttgaacccaaagatgtgtcacatgcattaactgataaatcgtggattaacgccatgcatgaggaacttgaaaattttgagagaaacaaagtttggactttagttgaaccaccttctggacataatattattggaaccaagtgggttttcaaaaataaacaaaatgaggatggtttgattgtgagaaataaagctagacttgttgctcaaggttttactcaaattgagggtttggattttgatgaaacttttgctcctgttgctagaattgagttaattagacttttgttggcttttgctgcttcaaaaggttttaaattgtatcaaatggatgtgaaaagtgcttttctaaatggttttatataggaggaagtttatgtcaaacaaccaccaggttttgaaaatcctgattttcccagccatgtttttaaattgtctaaagctttgtatggtttgaaacaagctcctagggcatggtatgataggcttaagaactttttgcttgcgaaaggttttacgatgggaaaggttgacaaaacgctttttgttcttaagcatggtgataatcaacttttcgttcagatttatgtggatgatatcatctttggttgttcgactcacgccttggttgtagattttgctgagactatgcgcagggaatttgagatgagcatgatgggtgagttatcgtactttttgggattgcaaattaagcaaacacctcaaggtacttttgtgcatcaaacgaagtatacgaaggatcttttgagacggttcaagatggagaattgcaagccaatttcaacaccaattggttctatagctgtgttggatcctgatgaagatggtgaagctgttgatcaaaaggagtatagaagtatgattggatctttattgtatctaactgcttctaggccagacatacaatttgctgtgtgtttgagtgcgcgctttcaagcttctcctcgtgcttcacatcgtcaagcggtcaaatgaataatgaggtatttgaatcatacacttgagtttggaatttggtattctacttcatcttcgatatgctgtcgcgaccgagaaagttgccttttcccgaacgctagtgtattaatccccgtcccaggaaaagccggggtacaccaaacaaacatgatataaaagacacatctttattatatcgacaatatttacattattacaaaggcgcttcaagcctgacaatcaaaaataaacagcagcggactagcgagcctacggctccatcttcacaggcgctcaactggggtataagccaagactccacctaagacttcttctctaaagcttctcttactgaaggggggagaaagatagagcaagaatgagtacaaccacagtactcagcaagccacaccggcggatgcacgattaatgcaaggggggtacaggggtaatgatataggggttaagttttgcagaaaacaacatttaaaagtcacttagttgccccaagccattttataaagacgatcctagagtcacacagtgttattaatcaaggccgtgaaccctcacgaacctgccttaacccaaggcctacgatgattcagaccgaactggcaacccgaccttgggtcccagctcgtcccaagccaacccaggccaaccattccacattttagttgttgagcaaattttaagaattaaaacactaacttgggtacattgctcggcttgcccataaccgagggcgcggctattcgaatagattttactctgatcagaggtgtacatctttacccacaagacacatcttcctcacgtgtaaccacgtgccacataccaccacggtatacagacggaagacgtgacatagttcccaacccatcctagccataaacaagagtaccgacccaaccccacctacggccggaacccccgggacaggcaggcaggattgagccccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccagtagacatgtggaagtacagtagtgctttgcaacagaggcccgagcttaatccttatagtaaccgaggtacgactaaccaaacctaaccacgcacctcgagcccagcctaaaaccattttgggggttttgaatagagggggaggtgtgtgtccaattccaacaaaagccaactatttcatagtgtccaagtgatatgagaattcccaaagtctaaagttataaaaccacctaatgttgcctaattaatcagcgaagcatctacctaaattcatactagtggaaccatgaatagagtacccactagttggggttttgtttatcctagggtgaacaaggtaataataacaatagcaataataatgtcttaacaaaggtaaataggcatggctaaataaaacagtgataacgcgggaatttaaataaagcggtaatgcattaatttaaattaaaataattttataaactgggattcaatatgctcaaggatgatgtgacttgccttgctcactttcccaaacgtcggcttcaacttccacgaagagcggatcttccgaagctgcagcgtctacacgaccaacggaaaagaaacggcttttactctaataaactccatataacaagcagaaacaaagcacaaaaatgggttcttgacttcttaaggaaaaattagagacttgaacggtccaattccgagttcaaatggccaagttatggccatttgaggtttatatgcgctttaaatggatatttgcgaatttcttcatttaaattttaatttaaaatcggatttattgcgtcagccgggagagaggagcgcgcggaccgggtccacgggagtggggcccacacggcagcctctcgatccacggtggaccgggagcacgcggcttacgccggccggcgccgtgggtccctcgtgtcagccgcacctaagggcgcgggcggctgacagccgggccccacacggcagccgcggggcgcgcccgaaggcggccacgccggcacagccgacgggaggcggcgcgcccgcgcccttatggtcgccggcggcggccataggcacggcggagcggtggccgagagaggggagggaaagggggaaatgaagcggcggttcacggctcaccccgggtcgacggcgacgacggaaacggcgaccgaagcggagagaggcggcggcgcggctcgggtcgacg

SEQ ID NO: 77730 - DNA, 801 bp, Oryza sativa
ttgtgacaccatttgcattcagctttccacgcaccatttattttcttcttaacaaaatcttgccatgctgcagatttcagtctcttattatcatgttctacttctgtaccttgtgaatcatttatttcgacgcttggagcattggttggagtgggagtggaagtggaagatggtgtcaatgcaacttgtgactcaacggtggcagcagggttcgacattctgtccacaaataacataattcaataatagatcacaatctgctgctatgtgctatgtactaccaaatctaccaaatatacactgaaatatacactgaaatagatcacaatcttctgtttcataatttcattcacaaatcacaaggcacatttggagtattggagatggagcaatacctctcactctttgtgatgtgctgcaacctcgccgccggccgcgccctgtgcgccgccgccgccgccctgtgcgccgccggccgcgcccttgctgccggtgtcgcctccccgccgcgcctgtgcgccgccgccggcccgccgtggcgccgccccgtgtgccgccgccgctgactccggagggagaggacgagctcgagccgccggacgccggaggggagactggagaggaggggagaggagatggtggcctggcggctggcaggcgccggcgacgccgagagggcgagatccagaggcgagccggcgagccgcccacgagcgcgcgccgccgcctaggtcacgcggctcacgccacagccgcacgggatgagtggatgaccggaaggggaggggaatgggctgcagg

SEQ ID NO: 77731 - DNA, 1825 bp, Oryza sativa
ggcggcggcgctagggcgcagcctgggcggcaggagcggcgggaggatagagatgacaggtgggccccacccgtcagcgagggtggcgggcgggcccgcccgtcagcggcgcgcgcacggggagaggccgagtgggccgcggggagaggagggagaggggagggagatgggccgggccggccagagagagagagggaaggaaaaagagagggagggagagagaactttggccgcgggccgagagagagagagggaggtctttgggccagacttggcccaaagggaggagggggattatttttagctttttctttttataaaatcattttaactttgattatttcttcttaattgttatttgtgctctgaaaattccactaaaatttatttacgcattttaggcttttaggaaatatacaaaaatcctctaggccttatttgacttttaacttagcacattttaattgttggaggctttcacatggattttaattattctaggcataattttgaggatgtattttagagtcgttttgggacgcgacatatgcttaggtggatattcaaatgctgattttgcaggttgtggaattgataggaaaagtactagtggaacatgtcattttcttggtacatcattgattgcatggtcttctaggaaacaatctagtgttgctcaatcaatatgttgctgctgctagttgttgttcacagattctttggcttttatctatgttggcggatggcatgaggcccttcgaccaaatctgccgaaacccatgacgaaggctatggagcaagaacggcgtgaggcgaagagtcgtacgagtgccttgccaggccaaaggagtctcaggtgaagggtgcaaggcaaagactatctgccgaaggaagacgacttcgccttggcaagttcgcccatacgagggccgaagaagcctttccggcccatcaagcctaggggcaatagggccggcgatcaccagacggcccatcaggggcccatgaacccctatatcatcatgtacccctgtaaatgtccctttcataagggtaatcatgtaaattcccctgtataacctaaaccctagaagtaagaacctgtaatggggctataaatagtcccctagggccatgtaatgggaaaaaaggaaagaagggaaactcaaaatttaatacactttgttttcttcctaccactgttgagtaaccacgtctttcgacgtatgcggttgtcatttcgacaacagctggcgccgaccgtggggacctccgagcgaaaccactgaaagcgaatgccaccgaagaaggtcgtgaaggagaaggttgcaaggcggaaggaaagcaacgccggaccggacatggctgtcgcgaccgagaaaattgccttttccccaacgctagtgtattaatccccgtcccaggaaaagccggggtacaccaaacaaacatgatataaaagacacatctttattatatcgataatatttacattattacaaaggcgcttcaagcctgacaatcaaaaataaacagcagcggactagcgggcctacggctccatcttcacaggcgctcaactggggtataagccaggactccacctaggaaatcttctccgaagcttctcttactgaaggggggaaagattgagcaagaatgagtacgaccacagtactcagcaagccacaccggcagatgcatgattaatgcaagggggtacaaggggataataatataggggttaagttttgcagtaaacagcatttaaaagtcacttagttgcccaaagccattttataaagacgatcctggagttacacag

SEQ ID NO: 77732 - DNA, 7424 bp, Oryza sativa
cgggggtctccgcgggaaacggagggcaagccggggaaagagaggccactgcgatgctggaggaggcgacggcgcgaccggatggcgctccggtgaggagggagaggcggctggaggcggccggcggcacgggagagagaggaggacggcggggagagggctagggaccacgggagatcgcgggagggggctaaaacgatagaacggagcgagggggttgcattttatagcggagggaagcgagccgagcacgggagagggcggaacggcgacgggaatggcggccgtcggccatggaaagcggccggagaaaacgcgggcgttcccggcgattgggggcacgatccaagggggaaattgggggggaattgaagaggaatcaatgggatttaaaaccccccaattaattttggaatctatggtttgatttgcgcggatttggaggaggaacggctctaggttttcccggagagggagaggaggctgagcgggaggaggaagaagatgacggccggcctggcgcgtgggccccacgcgggcgcgcggcgtcagcgcgcgtgcggcgcgcgtgcccacgcggctggctcaggcagggggggcgccgctcgggttgggcccggaggcggcctaggtgggagggggcggaacggcttgggccgagaggcggcccaggaggagaggagggcgagggagcccgggagagagagggaggagggagtgggccgggaggggaggaggcccaagaggaggagggagagaaggagagggagagaaagagagggaggagagggagactttgggctgggcttggcccaaaggaggaagaggattttttttttagctttttctttttaataaactttgataattgtttttgttgcttaataattatttccggtgctctgaaaattcaagtaaaatttgagggctcctttttgaccaaggagaatttaacaaaaattctccgggccacattcgaatttttcttgtgcgtattttagtgtttgcagatttctttccgaattttaattaattctattattccttttagaaaatgatttttatttcgggatgaatttatcaggacgtgacaaatccaccccccttacaagaatctcgtccccgagattcgaggaggctagcaagaagataggttgggcggtcttctcttcttatctgacttcttccgtcgcgtcttctataacaaacttgcctagcaaaacttctccactctgtactgcttgtctcgatctcctgttgcagatggaatcttctcttcacctgacttgtccctggttgaacctttagctgacttcgtctgggttgcggcacttgaagatggggcttcagttccagaacttcgtatagttcatatttttggcgtcaacctcatagaagttacccatttcacgttatgcgtcgagatcagctcgtcattactaggataccatgcttgtcatcatgagaatatcatgcttgtcatttacttctaagttgccacaaactgcctcatattagctttcctggtctccgggtgctagctacttctgttattcgatgcgagggtcgataattttcgcctttcaattatgtttctcaacagagtcaacttatcccacttgacatgctttgacgcctttccagatgacttcactgctggacttgttatggtttgatcgttaccctgccaaatctgaagcttcgctgttacatgtgattttaatctgacctctgtaaactatcttcgaacatatcacttggttcataactgggaatagctcccatgaacaagcaactcggattcactttctttacattcagtttacttcccactattctcttcatgttgtcctcagttagcattcaacgtattcctttacacctttgaccttgatcacctttcgacctttgtcaactaagtacttttcactccgagagttgtggatgcttctggtgacgatgtggtacttgagcctgctgcctttcagagaaaccttcaagtggttcgtcaaaagctagactagcggttgttgcctttgatccaaaaaagacacatctgaaactcttagtccaaacaaatgtctctttggttaatcgcttgattttcttttccatcatcaggttggttattaactcgaggttagaacatagttcctctgaaatgagaccctaggtctcctttgacagtaaacaattatacacataatcccatatcagcatcttccgaaataatcctcatagaacttgtttttattacacatgtctcccttattacatgaatacaaggccttgccttaaacaaaaagggaaggtgcttaacatcggtacattgcatcctcaacatgaatcatccataagcatagcaagctcactgtttatagacatgaatatatttatgtattacatgattgctgcaaactttcgattacacaatgataagtagcgaactgaaaaccacaaacatggctgctcattttgattctggagagatatagctggcattgttctagtgactgcatccttgattggttctgtgatgatgtgataggactgcatattgctatcattcacaggagaagcttccttctgattgctggttgaagcgaataacggtcttctgcttggtatcatcctcctgaggttgattgcccttcgctcggcctggagtaggtcggggagagacacaacttcttccatcgacgacaattctttgctgaggccgtcggtgcagagaatggttggtgctgaaggtattattgctatgatttattgcagagtcaggtgcagcaagaggagcattggtgctgtggatgatatcgtcgatgttgctgttggagctgactaactgacgagacaatcgtagggttgttcgttggatttctgcggtcttggtcaacaacacactgagttggcaatccttgggcacatggtttgtaccttcgcacagaaaacatgtgaccttgcgggtgggacattcacctggtggatggtcttcctcacaatgagggcagagtgtgaaacacatgctagcaacgtgtccaatttctccacaacgggggcatgcttttgattccatctcttcctcgccgagatgtcggagagactcatcttcataatccgaggagacttgatctgacccttcactatcagatactctgccgccatggcttaggaggtgctgggtcaactgtcgtgcacctcggaaggtatttcctctttgacgtctaggaatagttatccctgcgggaggccattcggtgctgctaatagccatcttacatacttctccttcagttcgcatcggcgcttttctcttctgattcttactcttcttgcctttggcttgcttagtacgtgaccccacgtggtacgaaaggctaggaggaaagcatttcccgggattcaatggattctctccattgggctctctactttgcacaataggctgcaagcttgacttggtgcgaggaggctggtttagcgatgtctgccctgttaaaccaaaggaaggggcttctttggcatatacccatggacaattcagggcatagtgtccttgttctctacaatcatgacaaaaggggacatcctcttctggcattggaagctcattgacatgggtggcaaatgctcgatcaaacatatactgattttggtcttgacttccaaccaatggtagctgtgaactaagcagcatgcttggaatggaccaagggtgtgccctggttaactctcttgaggccagtggttgatcgagttgaaaacttgagttacttggggcatacccgctgacattctttcctttttctctgttaaacatctgttacagggattgaggtgagagaggaaacaagctaggaaagaatagaccagaactagagacaggaccttaaaggaactactcttcttgatgatgtgttgtttgtttcacttattctgcaagttgattaagcaaacaacctagcatggttacatcacaacccaccgatgccaaccacgcgctacacacacaagcaaggaacacacgactaacaacactaccctacagggtggcttaggttctgcgacgggttcccaagatcttcactccttcacagctggcttcactgcttcctccacttcgctagcggatcctgcagtcttccggagcttcggcaaacaattggcgacatcttcttcttcgcaaaactaaccatctagtactagtggaaatccgaagagggaagaagggagtaaaccttttgcaaatagcattaggggaaggagaaaaaaggaactttcgcaaatagttttatttataaaatatgtccttaggttttatccacttggcttatcctacagtcgagatggctctgataccagcttgtcgcgaccgagaaaattgccttttcccgaacgctagtgtattaatccccgtcccaggaaaagccggggtacaccaaacaaacatgatataaaagacacatctttattatatcgataatatttacattattacaaaggcgcttcaagcctgacaataaaaaataaacagcagcggactagcgggcctacggctccatcttcacaggcgctcaactggggtataagccaggactccacctaggacatcttctccgaagcttctcttactgaaggggggaaagattgagcaagaatgagtacgaccacagtactcagcaagccacaccggcagatgcatgattaatgcaagggggtacaaggggataataatataggggttaagttttgcagtaaacagcatttaaaagtcacttagttgcccaaagccattttataaagacgatcctagagttacacagtattattaatcaaggccgtgaacccacacgaacctgccttaacccaaggcctacgatgattcagaccgaactggcaacccgaccctgggtcctagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccctgggataggtaggcaggactgagcccccagcagcaggacaccggccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtggccggggtgctacttcccacaactagcatgcacccaaaccccaccgaaaaacaggttttaggggctttgaaagaggaagagaggggtatgtccaattccacaataagccaaccattccatagtatccaagtgatatgagaattccccaagtctaaagttataaaaccacctaatgttgcctaattaaacagcgaagcatctacctaaattcatactagtggaaccatgaatagagtgtccgctagttggggttttgtttattctagggtgaacaaggtaataataacaatagcaataataataaggtcataacaaaggtaaatagacatggctaaataaaacagtgataacacaggaatttaaataaagcgataatgcattaatttaaatcaaaataattttataaactgggattcaatatgctcaaggatgatgtgacttgccttgctcagagagaacggacttccgaaccttcggcgacgaccacgaaccacgcttcgggaacctccagaacgacgaagactacgcgaagcacacaagcaaagctacaagcctataaagaagcaataacaatacataaaaagaaagcacagggttctttaggttataacaaacattaagagacttgaacgggtcgattcggagctcgtatgaccaagacaaggtcatccgaagtttaatgctgtcatatggagatttgtggattattataattaagctttgcaactataaaacatgtgtaagcgctagcctggaaaagacaggaaggctgcgccgttgacatgcggaccccacatgtcaacaaaaaggaccgcggaagaccgagtacacagagacggtccacgggtcgatggaagcggatcctgtgtgtcaaccgaggcgagtggccgacaaacggagtccactagacaccacacgggctgcacacgtggaaaccacgcggctaccgagcgggcacactaacacggtcaccacacgcacaagcgaacgactaccgacaccggtacacgggtaccggggtcgacaactgcacaacgagcacgggcgacaacgaaaggacgaggacggggcagcaagaggggagaccttaccaccacgcgacgaggcgtgggaacgacaacgacgaacgggcgcggcggacagacggcgagggaacgacttcggcggcgatccttggacgaaggtgagacgcggctggcacgaggcttgacgacgcggaggcgaggacgaagacgacgatggggctgcagcggcacacttgatggatgcggacgacggacaagaacggcttgacggagggacgaacgccccaacgagcgaaaccgggaatgacgagaggacgacgacgacgacgaccggagccggcgaggaggcgatgagggcagccggcagcggctgcacggagacgaggacggcgtgttccacgccgctgcaatgccgacgacggaggcggcgccgcgagatgacgagccggcgaggaggaacgatgacgacgacgacgaacaccggcggggttcggtcgaaggggaggcgaggccgagggcggcgtcgcggctgcgatgccgaagatggtggaggtgcggccgaccggtgcacgggtgaggagggacgggcggccgaacaactccggcgaggcggatggagaggttcgcggcgatgtgcggcggcttccgggcgaaaccgaggggtggacgaggtggagggctacgtcaccatgccgagggggttgcattttatagcggagggaagcgagccgagcacgggagaggacggaacggcgacgggaatggcggccgtcagccatggaaagcggccggagaaaacgcgggcgttcccggcgattgggggcacgatccaagggggaaattgggggggaattgaagaggaatcaatgggatttaaaaccccccaattaattttggaatccatggtatgatttgcgcggatttggaggag

SEQ ID NO: 77733 - DNA, 651 bp, Oryza sativa
ttggttagttcctaaatagcatacaggattattgttcactataaccaactaaaatatagtgattgctttagtgagttataaaaacaaagtagatattaattgcttagacgtggtgtttaggtagttgttatccagtaattactgcgtatcccacagtacgtttgagtggtgtagaggtggtgacagccctcgagatcacttaagtcctccctatccgggtacgtagtagagcgatatctgggaacaacgggtttccagtgcctgaagtattgcgttacgattaaaattaagctttccctagatgtttctcactactaaatcctctctatcctagcctatcatctgcttggtgtccttggatgaactgaaggaagatctgatcacacacgttcccttggattcaatacccttggaatactccatagggaaagtactgcatcggtatatccgtgcgcttgcggattttatctgtgatcataagaactaccaacaagcatttctggcaccatcaccaaagaacggttgctgatcatttccaaacctagttcatcctcgtatcatttttaagttttttattatacctttacccctactatcctatagaagtattcctatcaaactcttctcaaccatgaaacaacctctttttta

SEQ ID NO: 77734 - DNA, 2095 bp, Oryza sativa
gttgatggaaaagaaaaccaattaaactgtgttgggttaaaaagccaatgagacagtagttggggaataggagtttggatacgccttttacagatcaagataaggattgttggatgaaacccataagggtacccgccatgcctctacattgataagttcggatatacctgcaaacagttaagaagatccaggagacatcaatatttgagaacataatagtcgatggttggtaattagtcgatcaggtatcagaaaagggtcaaaggtgatatggcagaagaacaatatggatgtccccatcccaaggaagcactaaaccctagtggcatagatacagatagcaagcaatgtatttccctgaaggtagtcagtgcagctttttgacgaaccacatcaaggtttcaccgaaaggcagcaagccaaaggacctcatcgtccccagaagcgtccgcaatccacattaaagaataccacctgttagagataagccgaaagatgattgataaaagagattggcaaagatgttctctagcatgaaagaagtaggccgaaaggtgattgataaacagaaacatgtctgcatcgctcaaggaagacccctgatagtaattgcctcccccacaacagtcacctttcattaagtaagcaagatgacctaggtaaaagtgtttctatgaaggcaaggagtgaaatcttcaactcggtatcagatgctacacggagtgaaaagtgcaagcgcaggttaacaggcgacgccatgtcttgggagatgatccaatgggaaagaacacatcaaggctgaaggtgcacaggaatacgttgaatgctaaatgatgacaacatgaagagaatagcggaaagtaaactgaacataaagaaagtgaatctgagttgcttgttcgtgggagctattcccagttatgaaccaagtgatatgatcgaagatagtctacagaggtcagagtaaaatcacatctaacaacgaagcttcaaatttggccggataacgatcagacaataagaagtccagcagtaaaactatttgggaagacgtcaaagtatatcaagtgggataagttggttcccttgggaagcataattcaaaggcaaagtatcgacccttgcatcaaatagcagaagtagctatcacccggagaccaggaaagctaatatgaggcagttggtggcgagttagaagcaaatgacaagcatggtatcttagtaatgacgagctgatctcgacgcatgacatgaagtgggtaacttgtatgaggttgactccaaagatatgaactatgcaagttctggaactgaatccccatcttcaagtgccgcaacccagtcgaagtcagctaaaggttcaaccagggataagtcaggtgcaagaagattccatctgcaataggagatcgagccaagcatccatatgaagaattttatttatcaatttttttatacaaaactgatcggaagaagtcagacaagaagagaagaccgcccaacctatcttcttgctagcctcctcgaatctcggggacgagattcttgtaaggggggtggatttgtcacgtcctgataaattcatcccaaaattaaaattcattcgctaaaaggaataatagaattaattaaaattcgaaaaagaaattggcaaacactaaaatacgtgcaagaaaaattcaaatgtggcccggagaatttttgttaaattctccttggtctaaaaggagccctcaaattttactggaattttcagagcaccggaaataattattaagcaacaaaaacaattatcaaagtttatttaaaaaaagaaaacctaaaaataatctctcttcctcctttgggccaagcccagcccaaaaatctccctttcctccctctttttctctccctctccttctctccctccttctctggggctcccctttccctcggcccactccctcctccctctctctcccgggctgcctttcccccccctcttccctcccggcctgctcggcccaggccgctgtcacgtcctgataaattcatcccgaaaataaaaatcatcttctaaaaggaataatagaattaattaaaattcgaaaag

SEQ ID NO: 77735 - DNA, 7098 bp, Oryza sativa
atcggacaaaagatagctgatgcagccgatatcacgaagatggttatataatcgtatacgggattgatcgacgtgctgtgcaaggattgccatgatagagataagctcacggataggcaattgtatctattaattagggtattttaaatagtttctttaaagatatgtttcggcaagagtctgcttaaaagacttgtttgtatcttaacgattgtacccattttagagtcgtgtccggtaaggactagtcatgtatctcgagtataaatataacccgatcctatgtaattagacacacacagttcaataacactttcggcgcatcgccaccttttctcttttcgttactttcgacgagttcttgcttcgagttgggctgcatcggtttcgatctccagtaagaggtaaaacttgttatggcgacttgtgttctcgggattagtgcttacatcttcatgacactctaatcttgtttatgtaaatcgtcaagttatcatatatgttatataatctctatcaatattgttatctaaccctgaatcggttgccatctactattagaaagtagccgatagggttagatgccaacgttgatctaggttatatagcatatccatcatctctaagaggttttcactgacttgtttagatcttttgttactctttctgcttaatgctgcatcagttacgttcgatctattaagtaatatctagaaccttaatatctaacctgttttatgattatcgatagagatagaatcggggttttagccgatcttacttgatttagttatcttgttatctttatatttacttgatatactaaatctgccctttatattaagatcttagcgcgttaaaatatattaagcttactgtttagtacattttgcttgttttaatatcttagtataaagtggtatcggagtactagccgatacatattagatctagtttcatcggctaagctatgagtatatataatctttatcttgagatacttttagatattaagtgatttatactgtctcggcatgctgtccgatctatcccaatcacatgatttaaacatgcttcaagatatagattatatattactgatatctatagccgatcggatagatttaatcttatcttgcttttattattcattgccgatcgatctcaagatgacatcggctcaaggataaacgatatgtcatactctgtttatggatttaaccctgtttatttctttctttgtttcttgttggttacaagattaaaccaactgggatgcctttgaacccaagagcaagacataggacctgcactggagttaagcagatctcccagccagtgtgtgtttttcgcatcaacaaatatatagcatatgcgatgtgaatcccgaataacatgatccgagtgatatatcgactgctttgtaaaatatgatgcgagcaacttaaagttgtgtacatcatggaaaattcacatagcaaaacaactataaaagaagcttgtatgccggaataaagaaattttcaaagtatacatacaccatgcgtacactgctttaacaaatatgcttaagtccctaaaagacacatggtttcaccacacccagaaatatacgacatacgtggtgtaaaatccgagtaaataaactcataaagaatttaccaactgcttggaaaatgaccaaatgtataatcagcctaagccataatattggtcaataaatatgcacacttccgtggcaaaaaagcaacgatattgtatccaaccgattgctttataaatccaaacagtcccttgactatataaaaaaaattagctggacgactatataaagcttcactatttagcaccttttaaaatgcattgtaccaactcctaaaaagttaagtaacagcggtataaaaggattttaaggtattgggcacttgatcacgtgcacttttgcctaagcaaaaaatgcctaagtccctaaaagaacgtgataggccacacctgaaaatatgggctgcagacatattaggcctagacccaaatatgcccaccgatacccttgaataagacgtgtatagcacgcctattaatatgctcccgagtgacaaatctcccgggtgatgtagatcaagtacatatcatctgagtatcttctgaaccaagcagctatccctcatggagagtaccaaagtagatgtgataatcaaatcccgactagcgcaagtactcagctgatggccttcgcggggaatgatgaataatccagtctgtgagcataagaaattagctcatgaccatgaatccatgttgaatgtgttcggaattaatccaaattgaagatataatcctcgcacttgcgttgatgagcccctaagcatgtagcttatccttctgttatagtcacaattgtctattggtggtagctgacgtagtcaacatggagacgaaatgaccaacatgaagatgatatcacccatcagagccgatgaagatgtcagtggtggtaaagacaatgacaccaatcaaaggtgatgaagtcgcatagccgtggagacgaagaaaccagtcggcagcagacaagtcagccaacagtgaagacgaaggcgcccaacgacggcgacaaagttgtgcagcgatggtggcaaaataatcagtcagtgatagatgaggcgaccggtgaagaaaacgaagacgcccattagcagtaacacaataagccaatcatgaaggcgatgacaccaatcggtggcaacgaaggcaagccaacggtgaagacgtagatgctcatcaacgatgatggcaaaatccaccgatcatggagatgacaaaaacagtcggcaacggtagatgcaatagacggtaatgacaattggcagcagtagagatggccggttatgatgacgaagttgcctatcaatggaagcaaaataggctaaatcgaagaagcatgacaggatattgatgatgacgacgatgtcggtgatccagtcaatagcagagtaatagctgatgatgacgacgaggtcacctatcagcaattgcgtagtaggccaaccgtgaaggtgaaataataagtcggcaatgaaagtcggcgatgacggaagaaatcgaaggcaaagatgtagtcacccattaccaacagcggagatgtctgggccgatgaagtagagttgctggtgatgatgtcagtgataataattcatcaaattgttgagaagatatccatgctcgagtagttttcttgatgttggcatctgcataactaagattgatgcaacgcctcttgatttatgaagataatagtagaacttggtgttgaagctgttggagatgcttctcttggaggaaaatagatgttgttgttcaactcgtcaaatctgagttgattgtttgataactctaaactcccttagctcgaacttgggaagttgagaaacttgaagtagattgtggcaacgtccagaagctaaaattgtcggtaaaataattggagttgctgaagtaaaacgcctattctgaagcgtagacgaagataatgactcccgaagttgactcgttggctaattgattgattgcttcatcttgacataaaacttgtcaaattttgagccttctatttgtgtagcccccgactatttggttagttggaaaacaactgaacatagagttaagaactgtagctttttgtctagtactcatcatttgattgaagatatacgttgaggatgtctgagtagaaatattgaagattggaacaccacttgttgtagtaaaataacacggcatcatatttggtgaaacatgccgagatgtcgaggcacttgtagacgtcgtggttggtgaactagcaaggcttgcgaagtagaggcaatagagtttgccagtgccaaagataatgaagatgaagtcgctcaaccatggtgacaaagttgcatagccatgatgacgtgaacacgagtcggcggcaaccgaagcaaaccggtggcgaagacgcgtagtcgtgaagataaaaaccccagtcggcggcagcataatcagtcggtgatggaagaagcaaaatgatgatgaaaacgaagatgtccttgagtggcggcataaaaggccagcgtgaaagcgaagacaccatggacggcggtggagatgagccggcggtgatgacgatgacgcccatcgtcggtggtgtgaccaaccagccgtggaggcaaggacaccagtcggcggcgacgacgacaggccaacggcgaagacgtagaagcccatcgacgatagtgtgaccaactagccgtgtaggcaaagacacaccagtcggcggcagcggaagcaagctggcggtgaagacgatgacgcccatcgacggtggtgtgaccaaccaaccgtggaggcgaggaaacaccagtcggcggcagctgaggcaagccggtgatgaagacgtagacgttcaacaatagtggtgtgacaatttacccgtatagctcgaggacaccagtcagcggcgaacgaggcgcccggtcagtgaagacaatgacgcccaccaacgccggtgtgaccacccaccggaataggcaaggccattattcgccgccgaacaagccgcccggttggtaaagacaataacgccgaacgacgccggtgtgcccacccaccggaataggcaagacctccattggccgttgaagccaacccaccgttaaaaataaaattcattgacggttggttgtaaccaaccaaccgtggaggcgaggaaacatcagttggcgacagctgaagcagccggtcggtaaagacacagacgcccaacaacggtggtgtgacgaaccaaccgtgtaggcggagacactagtcggtggcgacagaggcaagccggcagtgaagacgtagacgcccaacaacggtggtgtgaccacccaaccgtataggcgaggacactagtcggcggcggatgaggcggccggtcggtgaagacgatgatgcccaacaaagtcggtgtgaccacccaaccgtataggcgaggacaccaatcggcgtcgacggaggcaagccgacggtgaagacgatgacgcccaacaacggtggtgtaaccaaccaaccgtataggcagaaacaccagtcggcgtcggcgatggcaggccggcggtgaagatgtagatgtccaatcaacgatggtgtgaccaaacaaccgtgtaggcggagacaccagtcggcggcgacgacggcaagccggtggtgaagacataaacgcccaacaacggtggtgtgaccatccaaccatgtaggcgaggacatcaatcggcagcggcgatggcaggccggcggtgaagacgtagacgcccaacaacggtggtgtgaccatccgaccgtataggcgaaggcaccagtcggcgacggtaaaggcaagccggtggtgatgttctgaccgatcccttcttgaagcgtaggagataagctaatagccatgaatccctattttgcatatccggatctggatcctgcataacaaacatataggatgagtagtatctgatgtaaatacagtacttgaggaaaatttaagtattttaaaatatctataaatatgtatttctcctcttgtcaattttgatttccccgagcagatgattccttacgtttaaacactctgcccgattactcattgacatgagttcgtcattaatgaaacaaagtttcacacatcagaatttactactcgggtacttttgcaattgttaagagcagaaaacaaattatcttatccctatgcttttgatttcttccgagtaatgcttagaaccttgcgttactcggtctatccaatgagcccccgggttctaggaatcggcccaaaggcaactatccatcaacaaactaaacataaagcataggaagatagaactctataacttgataggcactttatttttactcggattattcacaagcaatcaagataaatattgtgaaaattattgaaaaaatatgatataacatctatagcccccgactcactactcaatagagaaccaattgatgtagtgaggcagaggaaaagaaaaatatcatataaaaatgatgacttagctttttggtattccccttggtgacgacagagatggctgatgtgggaaaaaggtcgtccatcaatagcgactaaaacaccagccatggaggcagctgaggcgactggcgatgaagatgaggacgcccatcaacggtggtgtgaccaatcggcggtgtgaccagctaaccgtataggcaaaagcaccagtcagcggcggcgaaagcaggccggcggtgaagacgtagatgcccatcaacggcagtgtgaccaaccaactgtgtaggcagagacaccagtcaatggcggtgaaggcaagccggtggtgaagacgtagatgcccatcgacggcggtgtgaccaaccaaccttgtaggcgaggacaccagtcggcggcggcgaaggcagaccgacggtgaagacgtagacacccatcgacggtgatgtgaccaaccaaccgtataggcacaaacactagtcggcggcggcgaaggcgtacaaccgtggtggcgaaaaccacccgtaggcgatgacaaaggcagccgttggtgaagaagaaggtgtatatgtgtcatcagcggagtatggcatgcttgattgaatcagagacgatatctcccgatgatctcagccaatatgttatatatcctgatgtatgttgtgtggattccataaaaaaggttgctgtgtgcatgtatctgtctaggtaggtagatcacgcacgtgcatgtatagcatggacagaagtggctttgatcgatgccattaaggggtgaaaacggtacagaatatttccggattccgggcaggttttcgaaaacggaatcggtcggttggaatttttttggaatttttcggaaacggaaacgaatacggaaatattttctcggaaacggaatcgaaaatgataagagcagtttccgacggaactcggaatcggtcgaaaactttccgaaaactctctcggaatttccgaagttacaaagtccataatacctcccgcttgcccagcccaacccactacagctaaccctaccctatttgaagaaagtgaga

SEQ ID NO: 77736 - DNA, 14599 bp, Oryza sativa
aaaagaaccatattacttatcaaatgagaccattagatccgttatgaaagaaatatattttcatagatattggttttatgtgtaggtagatatagaattatcttattttaagaagcccctttcgaacctgctaagatgaagattaaatactattagcgtatgattaattgacttttatttattttaaattttaaaatatatctatttgatattttaaaataatttatatttattaatttttttatataagtacactgtttagccatttaaaaacgtgataattaacagaaaccaggataaatctgtaccttaattaatcaacagaacctagacgatcacaaagtctttgaaaaaggagggaataaagttatactactcttgattatatttctgttaggataaggttacacttgagtattatatcatctagctaggagtactagattaggttctccaacagggccatacgatcgaaaataatgagaacagaccggcgagcgagcgatcgaacggacctgcacacacgatggatgctcatttatacgcatatacacatggaaactattttaaactcttgagattcccttgtttatataaaaattagctaaatagttatgaaaaattttgaaaaaaaatgaacgttcatataacatatatgtaccactccacaaaaatttagatccaaactcaactcacatattgagatatataaaaaaacaaattcggatataaatagtagtggtataatttacccaaatttatctttttttttctcaatatacagatcaaatttgaaattaagtgttactcctagatgtcactacccactatactctaaattcacattttttttctattttttttctaaaactatttgcattgaatttgaaaaaggagatacacaaggggacatcccttaagggatatattagaatacacctgcataatacgagtacattccttaagtactaaaaccggattaatgaatcaataatcttgatgcatatatgtatatgtgcatgttaattaattggcaacagcaaagataggcatctcgtccctatcacaattcatcgatcacacgtacctgatcgagccccacgtcgtacagtgctgtagctcagtcaatatcagatcgaccgcccggtcggtcgcttcaaaccagtgttatgtacgtacatacgtatatgcaatgcatatacgtgatctcactcctacgcgtatacatacgcgtgctagctagctggagtagttcaacggcagagcagtgctaacttgaatgaattccttattgcatatatgtgatgagatgatgactgttaggagcttgtatggcttcgtccttgggcattatatgaattgttgcggtgatcattaagggtcaaatggagcttgtatgtcagagttggtaaacaatggttatatataaatttttgtcaaccatgaatgtggaggttcagtataataggattaggttccagtttaaatttctctatgtatatttgttcttttttactttttttttggaggaggggggcagtggtctttctggcagttgtgttgtgtatttgaaactctactttcttctaatatattgacgtgtaatccttttatgtgtttggagaaaaaaattattcttctggtattagagtacttcttgccgtatcttgtaatatatactttataaaccatctataatctaaaatgacacaaaaacaagtaataacatgatatacatctaaacttatgaagtaaattaaacaacaagaacaaaacaaaattctaacctattttttggactaaataaatgcaaaaatgagaagagcaaggtcttaccctaaaccctagtcacgataagataaagtatagctgcgtgggagtcgaacatgagacaatgacattctgccgactggattggttgatgatgggcatctggccgaactggggcttaggcggtctcacaaccggtctaggctcttcagccagccttgagttcagcccaagtagtaaataaatgtatcaatggatcctcgcaaaaaaaaagtatcaatagaataacggtttgatattgaaacaaaaatactcctcgtaaatttttttatatttggcactattgatgttttaacataaatttgaccattcattttattattaaaaatatgtaattatcatttaatttatcgtgatttattttaaaaaaattaaataagataaataatggacaatgtagtaaaaaaaatgaaaggaaatatcaatgtaggacagtacagtaaaggtacgtcggtcggtcggtgcagagtataaagcaaggagcgaaaatatctgtgtggcttcgtacctgcaggggacgggcttctgccgtgtctggacacgatgggcctcccctgcattgcatgatttatttatttattgatccattaaattttaccccactcttccacttgctatttatattaatttactccaatttatatactccacgacaggagcgagctgagaaccctaattactactgcatccgttccagaaaaaaaaataattttacatcgttcatcttcaacatttgatcattcttttatttaaaaaaaattatgattaatattttctattgtagatgatgaaatataaagggtactttatgtgtcaataatttttaaaaaaaattataaattttttaaataatacggacgactaattgttggatataaaacttacaactacatttaaaatgtgggggaggtagtacttaattactgcccggaagatccacgatgcacattgcgaatatctagctattccagctgatgaatgcgtgatacatattgtatctgatgagactgttgagtgatgaagctgaagctagctgatgccgatgctgatgctgagcaatctccaatctccccacggggagagattagcccaaccaaacctaaccatgctcttcttcttctcctcctcgtcgatgagtatttagtccatctccttaaatgcagcggtgcgagttagttggcgccataaattccttcacttcaatttcttcctagctcagctttcccctcttctccttctcctcctactacccaatacgactactactagttttctttcttggccatcatcatttgttcctcatcttactctagcttctccattccaaaattcaccaccgccggcgccgccatctccattccaaaatttgctctgcgtcgagtcgtgtgatcgatcgatcgatcgaggtgtacgtgtgcgctgctggggaaaagggaaatggatccgtcgggcgccttcttccacgcggctccccggagcggctcgaatgtgtcgctggcgtcgctggcgaggacggccggagggaggaggatgatgcacagggtcttccgcggcgtcatcaccttcatcttcgccataggtcgctaattaatctctctcttgctattcaatttgcttcttctgaatcttctttccaatctcccttgtttgctttctgctgcctgctctgatagcctgatctacaccgtcttggtgtgggtctgtgtgatccagcttcatttctgcttaatttcatcttgtttatgtgtttcagtgtctcgcatgcatatatatatggcacgagctacttcagatatatattttcccctttttctttttcttgccctccttttcttgtcctgcttcatttccatttcttggtccaagaagaaaaattaagggggacattttttatgcatgtttcatcaccaatactcaactcattttcacattttcccttttcaattcccttctatgatgggttctctctttctttgtggatgaatctgtgtgaagagagaggacatgacatccatgcatcggctgatggagctcaagctgctcaatcagcgctttgtatcatcttggtgtatttgagtcttaataaagcttccattatcttaaaaaaatcagcactttgtatggatggattttacagtgctcaatcttcagagcactgtctgtatttcctttttcaaggcagcatatactgatacttgcttaattggttctcccaacgaaaatacagattttttttgtcggcactgttaatttgcatactgttttatttccttctgagcaagtgcaaagtaatagatactaatattgtttggtcatatacgtgcagaatgggttcttgcacagcttaaaaccacaacttcttttctctgaacaatgcttttcagagtgtgacatttgtctcgttttttttttgttcaatcttgaagcctgaatcttgaaccggaaagctgtggtggtagctatgaatgttaattaacatggatgtgtttgtgtgtgtgcagctggactgtttcttggagcggtgactggcgggctgatcgggctggccaccgagagcggcctcttccgcggcaccggcatcggcgccatcaccggcgccctcgtctccatcgaggtcgtcgactcctccatccgcgtctggcgatcccgccgatccgggatctccagcatctgctatgtggtaagaacgaacacacacatttcttcttcatcatgccgacaggtatagtagattagtagtagctttggagtaggagagcaacctcatagctgcacgcttgcttgcttgcttacctcaactactgaacttccttgtctgtaccagtcatcagtgtgtgttgcttaatttatttatatgaactagtacttgcttaattcatataacctgtttgtgtttattttaaaacaaagggtcaaagctaactgcctcttttatgagatgatacaacttgtcaaaccttgctgtcttgaaagttcagatgattatttcgtacaaaaaagaatagttcagatgatgttttccaaagcaatttgtgcattctttacaatctaattaacctgctcatgtattctcagtaccacttttaggggggggggggggggggaagctccctaggtagattgtgcaacaaatatctgcacaaacgggatctctgaacatctcttctgcttcatctgtcatatatacgtgctcacagccttacattttgctaatttttttttgttggcttgttaaacctaacacaaatctctctgcacaaaatgcagcttaatgtgatctacagcctcctgaccggcaggcttgtccgcgagaaggtcgatccggcggtgcagcgggtggtccggagccaggtcagtttggtcgtctcatgaatctgcccctgcatacatggttgcgtctgattcagaaatatgcagtagcagcttcagttacagatttgtctgacgagattgcctctgaattcagatgaatgcagtggattcatcgcccttcagggagtcccctgacctgttcgagatcgagggcaccaacggcatgccacgggcatccatcgacaagctcccggaggtcaggatcactgaggagtacaggaggaacgccattggtgacctctcgggatgttcagtttgcctccaggtctgaaacttttaccatttctcaaactcactgtacctaaattgaacatctctgcattattgcttgcacattaccttgcaaccaattgatgagagtacattgcatccatatttaatttatcactgtctcgtatcaaaaccgtgtgcttctcattgatgtgccagatctttgcatgaattctcactgattactgaatcctgtgaattctgaaacatttggctcctcttactactgcaggatttccagacaggtgagaaggtgaggagcttgccggattgctggcacgtgttccatgtgccgtgcatcgacggctggttgatcaagcatggatcctgcccgttgtgccggaggaagctgtgagatcgacgacgacgacggccatggtgatcactgctatagttgtagcagaaggaggaggaggctgctctgctttcttgctgtgtgctgcgatcgagttgtccatcagtgttgctgttcttagagaagaagactgacatctctctctctctctatatatatagaaaacccttaatctatagagcattttgtttctgcttatattgctacatgctctatctttttggttgaactatctacatatatatctatatttctatctactcactcctttctccttatgtaacatacctctcaaaactctgaactggcttgtgctgatcatctgatgtataatatataatatataaatatatatcgccccttggacaccatcgcatatcaatctcctggatatacttggtagactggcttaaatcatttctgctcttctgggtcattacagcttgattataattggataattatcaaagagctgagtagctgacacagtttttgcattgagctgtcccagtccagagtctacttcgaagtttagaacaccagtatcactgcatctgcatatgcctgatgcgaggaaagccaataaatatggatctgatgagcatgccatgcagaaaggataagatacagacggcacgcatgcatgcccacatacacgtgctgtatcaatcaagagaacatcatccaaatatccaaaccaaaatgcaaaggatcaacatcatcatcaatgaccagtgccacactgcacaagttaaagaggcacagcggatgagatctggttcagttcaggtacccttgttgagagttggcagagttcttgctgtatccaaagtgaatcttccccaaggggaaagcaacaatttacacggtggtcaataaataagagtgcatgtacaagtcaaaaatatagtagtagtatacataaggtccacaacatcagctaattaagttactccttttttggcttattatttcatatgcactggtgttaaaattcctgcggcggaacaagacttttgctttttcggctggaaagattgagctttccatggagcatcagcagcacaacacaattgaacagctagctattctttttaagtcgatcttgaaacatacattactatgatgctgggattaaagagctggagaagagcttctgtgtctctccatttttttttacatcatggagggaatgatcttggccgaaatgaccggcttttactttaccacaggggaagaaaaccttcttcagtcaggtgtgttgcctccaccatgcattcagggtcacatttgagatgcataaggtgcaagtgtgttgctgcgcagattcacgccgccgccttttaaagaaacagaagggcccctgtaggtgctcgccctgctgacaaggctggagtcgaggaagactactatgacggttatgtcatcatggaagtggcggcgaacaccacggtcaatcttcttgagatctgagtacctcatttctcttttcttggctgcttcttgcaaagctgcctttatgagcctcctagcacttccctgaaagatcaaagagcacaaatcatcagattctttcacttcacaatcaacacttagcgtgtccattttgttttcatgcatgttgccttccactgagggctgaacaataacaaggtaaatgatgctaagcttctgtgccagcaagtagctacaaatttcagctctacttgatcatagatttatatatccacatgagtctattttctattgtatatgcagccatgccaggactatgtacataaaccaatgccatgcaacaaattgttgtactgaagggaaccatccatattcatattttgtattgctgttttggtgacaggctaatatttcattccaagaggcaatattgcttaagctatgtgcatgggtttttctgaaaccttcagaataacatcttgggcttttacgcaatttagtcttaatgctgctatacaaaaggattttggattggctgcaataagaaatcatgtcactgagactacaaaatttattagctatgtggtagtaactcaaggaaatatggtagtagtaaactaccactaattcttatgttggcatttggcaatatatgtcaaccaatgacatgcatggttgcaatggaaaatgccaaccaatgtatctgtatgtttcatgttaatttatttgtgcaggagcaagcacttacattgcgagggctactgtgaacaatgtcaacggcctcttgattggttaagtgctcccatagaccatcagatgcaaatatgagaaattgatcatgtggttgtaggggttgcacactaatcgatggttctgaacttagtatgggcttgtgaaaaggttcccggaggcggaattttgcatacaaaggttcccggttgaactctgatcttttgagataggcatcaccaattgatctgcagacctgcaaaatatataacaaattaaaggaaaacccaacaatcttcacttagaccttggaagaaacataaataaagcagcaagtattgccagatttgtaaactgtacaataaaaactcatcaaacatttggatgccttatcatggtagcctagtgaagggtgtatcaagctctgaagagtggagattggagggatattcataaaatgtttttcactaacaaatggttatttgagggatggcatgaacctaacagataaatagcaaacaaagtatttcttcaaccagcagctatctgtaccacgaaaaaaaaaatctctcaattaagtagatgaacatgcaattaaacaacagacaatgcaaaaccttcgattattctcaagctcctcactggcacaaaatataggagtgatatcacaatcatcaatcacagatgacatctctcatccatgagcagaagaagactttattgcatttatttccaatggtgtaaccacctcgaatctacttggttttgtcttaacattacaaatgcagatgagtttaataagccgattaccatccggaaggtgatgatgggaataatggcagatgcaggaggcaatatgaaatgatccttcaatcaaacttcttcaaagctaaaactgtgttcatagtgatagagaactcacctgaattagaccttttacacgccaaacgttgtgcttgagaacaacaatatgcctatcttccgggtgcattgactgcaattcttttctcactgactcaatgcttacgttatgctctgctgagagttggacagccagaacttctcccgtggctttgacatgtctgcctaaaacaacacgggaatccccaacattagcaacataaagaatgccaccacagattacaccaaccaggcagcacgagccaacagcagctatttgaggcttcacaggccattgcttggtgacaacagagaagaacccatcttctgtagcttcatatgctttcttcagcacatcagcagatatcgaattctgttcagatgcaaaccctgcaatataagccatggaagaatgaaatggtcatggaattgctctaaaacacagtatggaagtagtgcaaaacaacactagtgcatactgtcagtatcaattacttttcagatggtggaataggtgatcgttgatatagcaagccgtctctgggccaccatgtccatcataaaccccgacgaaagttccgtatggaccagagtcaagaaagctcaatggacccgattcaatctggcactgatcctcaagtaagttgttggcctggaccacagccatagagaattccccatttacatgctgaccagtgtccttgtaccatagaagtccatcctgcctgccggcaacatctgagcctgcccgggcatgctggttggatgatggtctccagcatgcccgtaacaagttcatcaatgtcactatcatccctcatcagtcatcccaccacagacgccttcgaggccgcttcatctgagctctaagaaaatgcagcttcacttgttgatacgccgatgttttcctttattctggaaaaaagcatgcatacatatatgaaacagaagtatggattattaatggaactcaagaccattgtatgtgcctagtttggaagcattttaaaggatatcatcttttatttttcattcatttcctttggtgtgtatgctttctataacatctagtgttatacaaattgaagttaataaagttgctttttctacaacaggaaagccaaaatatcaaagaaatatccttcccgataacaataagaccaatgataactttaagtccaagcaaacttgtcttgtgtaacaaatatccttgctgtggggtatagcaaaacaatataccacattctgtagcattctataacgccttagtatgcaacttttatatcaaagagaaagggagaaggcagcagaagacccaactgatcatcgttttttcactatatctcttattactcgagaaacatagcatggccaacacttttttttttccatctcccatcctcacagcaaccaaccgatcaaagctaaaacttagtacaatattctgaaaaaacttactcctactttgcaaatacagtttttctccccccctactatccttcacttggataaacagaaagtgtgaattggtggaatcaaaatcaaacaccttcccccaacctaagaacaagcggacacactcacaccttatcctcgagctaacgagtagaattgcacaccatgatcctcacattaattcccccaatcatatccgcaattcctccctccaattagcgcgggcgcctcttctccccccaagtcgcaagcgaaggacagtccaccaaatcaaaagactcgctcggaattaccatttcataccccccgatccacgaactccacacccgcatacagaaccaaacgatcccccccccccccccaaacgcccaagaacgccaaaatcactaggcataaatcacactaaattcggatcaataaagggagagggaaagccccctcccaaatccaaaagcgagaaattcgcacctcttggcgtggcggacgcggccaattggcggatttcggataggggatttgagggaattggggagggttgcctcgatcgaatcgcgcgatttgggcgtcgccacgctgcttgctctcaatctgtgtccaaaccaagggaggaaaattagtcgcggaagtgaggggaaaaaataccggaggaggagggtagggtaagcggatcgggttttttttccctacccgcctccgatccgacccgaatccgcctcctctcggatcgtatcgacgcggagccaaggggaaatccctctctctctctctctctccgaccagcaccgccggggacgaacgaaccggcggccggcgtgaggcggcgctgactcgtcggcggatcaccggcggcggattcgcggctcgcgctggcgttggatgtcataaatgaagggagaaaaagttgtgggaagtttcataaatgaccctggataaaaatttaattacatattagtccctacaaagactacgtgtagtagtacctagaccaggtttggtttgatgattcagaatctcggatcatcagattagtactaatcaaagattacatacagcttttgtgcttggaagaacttggtattggacacacaccgattttgaaccatctcctgcaaatgttcatacgcagtcacacattgatgatgactttgctactacatataaacttcaactaactgtatgtatgtcaatgctacggtcgtcagtttcacctaatttgatgaaaaaactagaagcttctacgagctttgcttaacaagaaccctattctgctttggacaaacttaacttgatgacatactgacaacttaattttgattcctcaactctgaacatttgcaaccaaagtctgaatatatatatacctgcattcctgcaacaacaagtatatgtgtgctttttcatcttcatctgcctcttgtcaagcaaagttgtcgagttatggtgttattaagtgctactattaagactgatagagatgtatcggcatggtgttgatagagagaagagaaggtagaagcctgcaccagcaaacgcccagcatcatgtcacaccaaccaaacacttgatgatcttcgtcactttcagagtctgaactcaactgaacgtactacgcaggtgtagttactgtttaaacgcttatttacagtacttctacagtttcgactgcagtgcataattcaggcgttcatactactggtggccaataagtatttttaatgaaatatgtccatctctaactggaaaagggaaagaaagcagccatgaaatgtgttaatttcagtcaggtctcaggacagcagcaactctgacgagatggaatgatgaaaacagtgcaaaggatgtccagtacttcttctctggatatacactgcagaaaaagtgaagagatgatgttaattgctgattaatgcatggttttgcagtggtgctttatctaccttgatggcgtgttagcatcaaacaatgactcgtcgttgactcactaaacctttactagcctgatactttagctaaatattggtctgaagaaaaagatcaagttcttgtggccttgtgggaaaggtatatccttttctgacccggttggtttggtttagcctctgccccgttgtttatttgtgttcatcctatggagaaaattaagtcaggctttagtgccaattgccatttgtatatgcagttttgtggtgtcatccaggaagaatgttgccacagatatgtgcaagagaattaagaaataattaggggagtaaccatgcatcgtatcttctcttctcaccacatgaccatagattctccttttctttatcatggtccaagttttcgttccggcgtaatttcagcaagaagcaatggtcttcagaacgactaggaaatgaattagccttttttgcaaattgtcatgttgtcatgcacattataattcatatttaattatgcctgaacatgagatgactgcatgaagaggaaagaaatccagaaaccgtaaattaattatagtagaggtccatttagcttgcaagcaagttgctatcagatgttggtggtcacattctcaagcctctgaaacgtacatgatccaagaattgacaaccaataattcatatatgcgatatatatccaaaacagagtttgggttataaatatacatatcggcttaattatttcctgacaaaatatttgactaactttaatatcaagctcataccggatacattatccatttccagtgataaataattaatgagatgcgatccattatctaaacaaaaataatgagagatggatcggatagcgcacttttggaagtacaaatcgtactcgaataacgaatttgccgtttattctcttgttattctctgagggcatattggctgctaatggggctagctatatattcgatcaagaatataagtttttctgtgttggcttttcagtgttgtctccaaactaagcttgaagtgactaaccgagtatatatacggattactgatactcccatttgcttttgccgaagaatggagggtggagaagaaacataattaataaaagaaagagttaactgataagcagcaattgcaggtaacctgtcaagaatctggcctgaagtcgatcaacacgtaagagaaatcgagtgacagaggaggaaggagaagaagatttggagactaatataagcaaatcattcagacaaggtgattataatatcacggtccccagctagctgagactgagactgatgagacagatctttggagatgatcagaggctgaggcacgagagaatcgatcggcagcttcgcagctgcctctgcgcacgagggccacatcagatagataccccatccgttctaaaatataaacatttttaagattcaaaatttataccaatgatattactgttcttgaaatcaaagcattttcaaccgattaggagcttcagaagggaatgtaagcaattcaaaattttaaaatttgattaatgaggtgactgaaaagaaatattcttcatcgatttttttactagaccacgtagaaatgtttatatgagagaagagattccatgagatggttgtgtctccgtcagtgcagacgcaagtgttggttggtttcaacctttcaggtcagaacaccatgcaggttacagactagcagaaagccacggattgaccaaaggagagccacagatagatagctgcagtaatcaacgaaacactccctggattgctaagttgtatagtaaatcgcatgcatggatggatcgatctctatcagtcagcgattgacgacaaaacgcaggcaggcaggcaggcattttctgaccaaaggaaaatgacctaatagacgctatgtacgtacagtatgtggaattgacgctggttaaagcttctatctccatcgcttacactgtttttttccttcctgatgctgtttagcagtaaaaggtaagctttgcattcaaacagatttttacgcggattgtttacttgattaatttaataaattaatgttttgataaataaacttcaaaattagttttaagaaagtggtctaaataatatagtgtttttttaaaaaaacaacgtttctttaaatgcaaagcaaataatccatgtcaaaaatctaaaaaagaaaagctaaaagaacagtgcctaaagcccaatagacaagacactaaaagtagtatggtagtggagagggatttttatcgcatgtcaattaaataattatgaaa

SEQ ID NO: 77737 - DNA, 5444 bp, Oryza sativa
  unsure (1)..(5444): unsure at all n locations
ttgaaattttcaaacttaattctagagtcggcttacgcttttcgtcgtaacctatattttaatattggcttttaaatgacagatagcatatgtttgctttgtctatttctctacgtgcttaccgatgattgctcaaaccatcgaaatcttattgttattttagaagcatgatacaaacacaggtgctcttaacgcgtgcacactcaccctattaacacatacacacactccatctctataagtatattcggaagactgagttggcatatcaatcttagcctttccttttaaaataacttattttcgccttgtctaagtacgtaaccagaaattaaatgttcttggacggaggggtgtaattaacagcgagtgaaagtcaagtgttttaattaggcaagaaacaatcacaatcgaaacctgactcctgtttggagttagcgcgtttctgccaggtaccatgagaaataaaccagaccattagccacacaaataaaatactggtccgtacacgaaatgcgtggtcatggccgccatggctgacggaagaagcaagcgagtgagctgccaaaatttctgtgtttcccctttctctttcacccgattgtttactgtctacggagtagtccagtttttacacctgctgagctcacacctgacctgacctgacctgaatacatacctaaccgtgaccgatgaggcaatgactgctaattatgttgttgttagtttaattaatctcaaccttaaaacttannaaatttaaaatttaattttgttggttagtttctgatggttttcaattatgggtttttttctatatattaactcgctatatataaaaattttacctgtaaaatattattttaagttgttaataagttttgtgatttataatctatagtctattggttacaagagtctcagtagcatcttaggtcctgggttcgacttcccgtgagagtgaattttccaggatttaacggctttgtgcttttagtcacgcttatagtgacttcgttaatctccattatggatttgccgtctcagtcttcaaagatgctcatggggtagggtttgcgtgcgtgcgcttatatagtgagcgtacgtatgtgagtgtctatattgtactgtgtaattaaagaaaaaactccatcgccagccggcaggcgcagtccatacgtttgtttaattcgtcaatcatctctctcaagtttcaattagtgtgagtcactatcagagtttcagtacttcactattcttcctgtagaatttgggacatccaatggagagctcccagcaatcaacgaagattccacggagttgacacaggtgcactgatctcacgggagaagaataacagtacgtgtttcttctctgtccaacgaaacgcccacttaactacctgacagcatacgtcttgaggatcactgcactattattattaactgatgtttcagctaattaataacaacgaacaaatccgtcgaacaagtcaagcaaatcatctaccttaattagctgttgttagctgagcatttttgttctgcctaaaactatatttgtcggaagttgtgggctgcatgaataattcggtcgaagagagaacactttccgctgctgtattctgttgccacaagaaaaaataacaattctcacggtcaacacgacaccaagtattaagaaaacggcttagcaaaaatcaagtttatcacaggcgacgatctctcgtaatttgtcgagttgacgtgcatattgtccaaatgaatatccaagatctcctcccattagtacatgcctgcatgtgcaactaactgcattacattattacaggataattcagttgatcaggtactgatgattatgtgtcaatcagaagaaactgctctaacgtgcacaaatcattttctgcaacataatctctttcttattccgacttccctacagcttgcagatagcataacctcggaacctttttctttattattcttgatggctggaaactatgatattgtttttttcttctaaagtgttgaccactggaataaattaaaatgtctggtatttcttttacatatatatgagaattgcaacattatatatgttgttagaaatgccttgataataccaggtcttatttctatattttaatacaaggttataaaaatataacggccgcaatcccattttatttaaagactctgtcaaaaacagcgcgcacaaaaaatgcagttattaactagttgttggaaaattttgcagattatcaggttcactgaatgccccgtaataagttgaactgcacaaaagtgctgtggtacagtcaagtcatgatgcataaacatgagtccatgtatattaattaattaatttcaagttttggtctgcctagattaattactttttgagtgccatggccatgggttaagttgaatggtaacgtggccttgtaggtcagttccaaccacaaaagactgagcaatcaacatcaagctggcgacagtcaatccgtgttggtcctgattcatgaacaaaacacaaaaagtaacatgatttgctcgtacgaaccactgagcttgaaaaaagaagaatattatattaaattgatatatatggaaatcatttttgacggattcctaagacttgtttggttggagactaatgatgccacaactttttgactaaagtggctaagattagtcttgtcatacttttgtggcaaactaagggcttatttagtttggagaaatttaaactcataggaataggaaaatggaggactaggaatttttccaagatctttgagtggatggaaaaattcatatgttttctctatacaccttgtagaaaaggaaattttactttgattttcctatagttcaatcctacaaaccgaatgacatctataggcattaatccttaggaatccaaatcctttgtttttcatcaaaaacaaacaagccctaagcttaggcagagttagagagtataatatgtgggccagatgactaagagataggtaaaatagagttgtggtagaaatcaaatattgtctacaaaatagaggtatgataaatttagttgataaccaaacatgcccatcaggatacaatgcattttctattgttagtcaagtacagaacaaatgtttcttattttttgtacggttaaattgatttcagcatgaaaacatagaacaacgacgtagaaaattgtaacccaattcaacaagaatcaagagagcacaatttgggtatggtgagtgaattttggatgaattactttatccaataaacttcaagcatcttggttaatattcatgcacaatgaggtgtgttttaatacttttttttttgaggttcaaagagcaatataatgctgcatgccatcaattcagtgcctgttatcatggattatatatttgattgtagagattttctatacttgattatagagatagatcaaatattttcaggaataaacttaaaaaatactacatacgtaatctgtagcaatatagtacttcagaacacaattttttttgaacgtttagaagtgctataccttcatagtataagctgaaaaagacatggcctaagtacatagttgcgcccatatttcatatatctgaaaaaatcgaacaaaactctaaaacatttctctttctctttagagaatgataatgatttacatctctaaccttttccattaagcatacaactaatccaatactctctttagggagattctagcaattgcaacatcttccagaatctacaactcttctaaacagtccaaattcttacttagggtgtgtttagttcacgccaaaattaaaagtttagttgaaattgaaacgatgtgacggaaaaattgaaagtttgaagaaaaagtttgaaactaaacttggccttgagtagattttaagaacagtcatagaatatagagaataaattagaaaccagaaatttaaaagcgcaacctttttctaattgttatcaggcggttactctgctcattaaatgtttattagaatattaatctcccctaaaaaggattatttccctttacacaaaagtatgttgtgcattcctatcctaattaatccctcacccccacaggttagcaaaaaaagatatactccagggacctaggcgtaaaaagccccctgcctgcctgccgtcccacacgggcacgccgcggcggccacgttctcttcccgctccgacgaattctgctctccattctcctcgccgttgacgaaaaccaaactaagccaagactttgactcgctcgtcacctcgacctcaccatgcgcgtcgctctcctcctcctcctcttaaaatcgatgtcgatggcgcgcaccaaccttcatcttgctgcccccgcgcgcacgccacctcgccccgtccccaccccaccatgcctcactcctcctacctcgccctcgccctcgccgttgcggcggttcttgctatggccgccgtcgaggtgtccggcctcggcttcgacctccaccaccggtactcccccatcgtccagcggtgggcggaggagcgtggccacgctggcgtgtcctggcctgccggcgccgaggtgatcggctcgcccgagtactactccgcgctgtcccgacacgaccacgccctgttcgcgcgacgcgggctcgcccagggcgacggcctcgtcaccttcgccgacggcaacatcaccctgcggctcgacggatcgtacggacaccttctcgccgccgcgcgcccccctgctcttgctccctcctgcgcgccggcgagttgacctgatcgagtttttgcaggctgcactacgcggaggtggcggtgggcacgccgaacacgacgttcctggtggcgctcgacaccggcagcgacctcttctgggtgccctgcgactgaagcagtgcgctcccctcggcaacctcacggcggtggacggcggcggcggcccggagctcaggcagtacagcccgagcaagtcgtcgacgagcaagacggtcacctgcgccagcaacctctgcgaccagcccaacgcctgcgccacggccaccagcagctgcccctacgccgtccgctacgccatggccaacacctcctcctccggcgagctcgtcgaggacgtgctctacctcaccagggagaagggcgccgccgccgccgccgccggagccgccgtgcgaactcccgtggtgttcgggtgcgggcaggtgcagacgggctcgttcctcgacggcgccgccgccgacggcctcatgggtctcggcatggagaaggtgtccgtgcccagcatcctcgccagcaccggcgtcgtcaagtcgaacagcttctccatgtgcttcagcaaagacggcctcggccggatcaacttcggcgacaccggcagcgccgaccagtccgagacgccgttcatcgtcaaatccacacagtaattaa

SEQ ID NO: 77738 - DNA, 10272 bp, Oryza sativa
tcctgcagcccaacaattattatatgtgctctgaaaattccactaaaattttagggctccttttagaccaaggagaatttaacaaaaattctccgggccacattcgaatttttcttgtgcgtattttagtgtttgccaatttctttccgaattttaattaattctattattccttttagaaaatgatttttatttcgggatgaatttatcaggacgtgacaatggccgccgaggagggagcagagccttcggcgcccgtggccgaagatggaggagcaccattcgcttccacatgtgcgccatcacaaccgccttcggcccccgccacctctctgcaagtgccgaacgcggccgacatggcgaaggcggctgcggtggcaagggcactccagaccagggcgaagatcctttcgacaagccaactggtggtgccccaagccgctccatcgcagccggcagcggccccgactgcgctcgccgctgtgcaggcccaagtcagccctgaccccgaaacacaagccgaagccgacatggaagccatgcgacagaacatgacacggttccaagacatgcttcgccaaatgcaagaacaacaacaagcatacgaggcggcaaggcggaccaaggtcacgtcggctccaatccttcagtattcggcaggttatgtcccaccacaagtccatccgcaagtgacgacccagccctttccgcctcaagtcgcacaagcgccaatgtacttcgccgggcagcaatcggccgcagtcgctgcccaagtacaccatcaaccacccggccaagcgccacaaacagtggcggaaggggcttcggctctgcaggcgcaactccaagctttccttcagcaacttaaccaaccccacggcatttcaactacaaccccatcggcccacccagaggggactacaagtcaaggtgcgcctaattggttgccaccgattcagccgggcctgggagtttcgctgtgcaatcaaggaccgcaattcgacttcgtcaacgctgctcaggcgccaaccgttcggcagcaagctccaactccaggcttcggaacaaaccaagcaccaatccaagctgccatgacgtggtcacaaccaatttttgacccatccatggcggctcagcaagtacctccagttggagccgggcagccgaatgccatggcccaacctcgcgcacaagctgcgatttcgcccttcgccacaccgtacctgcagcagggtgcggtaaacagggcgggaggcgaaaaggggctaccgttgagtgggggaatcaagactcgtccaatcccaccccagttcaagttcccacccgtcccgcgctattcaggcaaaactgacccgaaggagttcctctccatctacgagtcagcgatcgaagcggctcatggtgacgaaaataccaaagcgaaggtaatacatctcgctctagacggcatcgcccattcttggtatttcaatttaccagccaatagcatttactcatgggagcaattgcgcgatgtttttgtccttaactttcgaggcacctacgaggagccgaagacgcaacaacacctactcggcattcgccaaaggcagggggagtcaataagggagtacatgcgtcgcttcttgcaagcccggtgccaagttcaagacataaccgaggcgtcggttataaacgccgcttcggccggtctgctcgagggcgaactcacaagaaaaatcgccaacaaggagcctcagatgctcgagcacctacttcgcatcattgacgggtttgcaaggggcgaggaggattccaagcgacggcaagctatacaagctgagtacgacaaagcctccgtcgccgctgctgaagctcaagcacacgttcaagttgccgaaccacctcccctcttcgttcgctagtctcagccggcgatccaaggacagccgccatggcaaagccaagctcccataacttggagaaagttcagaacagaccgtgcgggcaaagctgtgatggcggtcgaagaagtgcaagccctccgcaaggagttcgatgcccagcaagcgagcaaccatcagcagccagcccgcaagaaggtccgaaaaaacctctactgcgcctttcacggacgttcttcgcacaccacggagcaatgccgaaacattaggcaacgcacaagacccaaggccgcagcagggaacaactgtcgaacaacgccagatatacagcgaagggtaatccaagtgattacaaggctgacccaccaagccagttgtccaaacggcagaagaagatgcagatccgtatggtccacagcatcacttcggtgggtgaaggggcgccgcagtatctgaaccagctaatttcttttgggccggaagacgcagaaggagttatgttcccgcatcaagatcccctggtaatctcagctgagatagctggtttcgaagtccgacgaatcctggtcgacggagggagttcggccgatgttatcttcgccgaagcatatgccaagatggggttgcctacccaagcccttaccccagcaccagcatcgctccgcggtttcggcggagaagcagttcaagttctcggccaagcacttttgctgatagcctttggctcgggggagaacagacgcgaagagcaaatactgtttgacgtcgtcgacatcccatacaactacaacgccatcttcggccatgcaaccctgaacaagttcgaagccatttcccaccacaattatctcaagctcaaaatgcccggcccgacaggggtgatagtagtcaaggggcttcagccttcggccgcttcaaaaggcgatctagctataatcaacagagaagtgcacagtgttgagaccgaaccgcatgaacggctgaagcacacggcaagataacaaaagtgcagattgatgatgccgaccccacaaagctcgtatcactggggagcgacatgggcgaagaagaagttgagagtatcctagaggtgctcaaaaagaacatcgatatcttcgcctggagccctgacgaggtcgggggtgtcgcggcggatctcatcatgcatcacctagcagtcaagccggacattaagccaagaaaacaaaagttgcgcaagatgtctgccgatcgccaagaagcggcgaaagccgaagtacaaaaattgctcagggcgggggttatccaagagattgaccatccggagtggttggcgaatccagtgctggtgcggaagtcaaacggcaaatggcgcatctgtgtcgatttcacagacctgaacaaagcgtgtccgaaagacgacttccccttgccgcgaatcaaccagctcgtggattcaacagctggatgcgagctcatgagtttcctagatgcatattccggttaccaccagatccacatgaacccgctcgacatccccaaaacatccttcatcactccattcggcacatattgtcacctcaggatgccttttggcttaaggaatgcaggagcaactttcgccaggctggtgtacaaggtccttggcaagcagttggggcggaatgtggaagcttacgtcgacgacatcgtcataaaaagccgcaaggctttcgaccatgcgatcgacctgcaggagacattcgacagcttgcgcacagcaggcataaggctgaatccggagaagtgcgttttcggcgtccgtgcaggcaagttgttgggtttccttgtttccgaaagaggcatcgaggcgaatcccgagaaaatcgatgccatccagcaaatgaagcctccgtcaagcgtacatgaagtacaaaagattgcaagccgaattgcggcactcagtcgattcctctcaaaggcagccgaaagaggtttgcccttcttcaagaccctccggggcacaggaaagtttaattggacaccagagttccaagcagcattcgacgagctaaagcaatacttgcaaagcttgccagctctgataagcccacccccaggaagcgaactgctattatacttagcagcttcgccggtagcagtgagtgctgccctcgtccaagaaacaaagttcggacaaaaactggtctacttcgtctccgaagcactgcaaggagcgaagacaaggtacattgaaatggaaaagctcgcttacgccctagtgatggcttcgcgcaagcttaagcactacttccagacccacaaagtcatagtgccatcacagtaccccttgggcggaatactccgaggcaaggaagtcactggccggctcagcaagtgggcggcagagctatccccgttcgacttacattttgttgcacgctttgctatcaagtctcaagtgctagccaacttcgtagctgaatggacaacggtacttgcccccgaccccgagcccgccgaacaattctgggtgatgtgctctgacggctcgtggtcgcacaggggagcaggcattgcggcagtcctatttttgccgaatggtgtgccgattcggtacgcagcaagactgcagttcgacacaaccaacaataaagcagaatacgaagccgttctcctgggcctaagaaaggcgaaagcactgggagttcggcgcctgctaattcgaactgactccaagttggtagcaggccatgttgacaaatcctacgaggcaaaagaagagggaatgaagaggtatctggaggctgttcggtccatggaaaaatgcttcaccggcataacagtcaaacacttgcctagagaccagaacgaggaagcagacgccttggtgaaatccgctgcttgtggtggcccacattcgcctggcatcttttttgaagtcctacatgctccaagtgtgcccatggacagctctgaagttatggcaatcgactaggagaaactgggcgaagacccatatgactggcgaaccccatttgtgaaacaccttgaaactggctggcttccggtagacgaagcagaagtgaagcgtttgcaactcagagccacgaagtataagatagtctcgggtcagctttaccgctccggggtacttcaacccttacttcgtttgccgtttcggagtgccaaaagagttcattactgacaacggcaagcagtttgactctgataagttcaaagaaatgtgcgaagggcttaacctggaaatcaggttcgcgttggtcgcacacccacagtcaaatggggcggccgaacgtacaaatggcaagatcctagaagcactaaagaaaagactcgagggggcagcgaaaggcaaatggccagaggaattgctatcggttctctgggcccttcggacgacccccacaagaccaaccaagtttagcccgtttatgcttctttatggcgatgaggcaatgaccccagcagagttaggggctaactcaccaagggtgatgttctctgggggcgaagagggacgcgaagtatcgctcgaactcttggaaggagtaagagtcgaagcgctcgagcacatgcacaagtacgccacaagcacttcggcaacttacaacaaaaaagtttgacccacggagctgatgcctggtcatctcgtcctaaggaagaaggcgaacccagtagcggttggcaagcttgaatcaaagtgggaaggaccatacctcatcaaacacaagtccaggacagatcttttcgcctagcgacactcgaaggcgaggagttcgaccattcctggaacgccacctctctcaagcgcttcggccctactagccttcaggcgaagagcctccatcttcggctcagtaaggttgtagtagtcaatcagcaccgccgaatgggccttctccttctccagttcggccttgaggcgatcaacctcgcccctggcctctttccccttatccagctcagactgaaggcgtttgacttcagttttcgcctccttgagggtgttggccagggcctccacctccaggttcttgcggcttatttcgtcgtccttggcccgaagacggctcttaaaaccgtcaaaacgggcccatacggttcgctccgtcgaacagtgagccgcaataatctagatgaaagataggagcgggcgaaaagaacaaaagaacaaaaggttaattgtcagacgtaaaaaaaaaagggacgacgaggaaaacgaagaaggaagaaaaggcatacccgaaccgccaggcttttaatggcggaacactcctcgtcgaactcattaagttcggtgaacaagctcggggtgccggcaggcaagataaggttgctcaccccctccacaaagggattaaggtctacccgagtctcgaaatcaccagggacgaagtggggcgccgcaagggaatactccgaggcaaatgcttcggcggccgcacacttccccttcgccttgactagcggcaaaatagctggctcacgcagagggctcccgaaaaccctcgacgtagccgacacgatccgttcggcagagtccttttgttttagagatcttctgcaccggacctcccttcgccgccttgcccgaggagaacgcaactagggccttcgccccttccaaatccttccgtcgaaggagggagctgttcgactccaccccggtcttgttgtgaccgggacttggggtaggagtgtagccggacgcggtcttcgatcgcctcattcgcggccttatcggccacggcctcctcctcttcctcctctccttcctccttgccgtcgcgttcttcggcatcgtcctcgtcgtcggcgtcggagtccgacgaagcaggaacccttcgcttcctcggggcaagcttcacttgtcctcgcattcgctttcgcgaaggccctgcatcattgtcagctttgtgggggtttgcctgaggaggcaattcgccgttgtaaacccggttcgcccgcccagccgcttgtcgtgttagcaactggctatactcgacgaccgacatatcgccgatcatcctacgggcctcgttttcagcctggtcaagggtcaacgctgcaaaagtaaagtgtgtagctatgttaacagtcagacaaggcaagataacaaagcacagcagtgtatagcaagagaaccgtcttactgtccgtcccctcaggaagaaccaggttcggcaaaccgtcaacctcttcgtcttgatcaactgtgacttgccatgactgggagaggggaaagatgcgaagcatacagaattcctccaccaagtcacggcagctaaggcgggagcaaaccttccgcagcagaatgaaccgcgcctccatagcgccgtccacggcgatcttgggtttctggctaggcgcgatcgccctacgccggcaacggagggctttctccgagtcagtgccagcctcgaaggggatggtgtgatagaatcacctagccatccaatggcagtcccacttcgacatggcagcgttcaccggctagagatcggaccgctcgggacaaacgttaaagttcacgctcccgaacactgtctactttgttccagccggggtaatcaccgtcttcgagttcacggtggcgaaaatatggcactgaagagcttggcgttaggctcaaacccggaagtccggcacgcctagtcaaagatagcgatccgaacaagcaccgacgggctcagctatggaagttccacctagaagaggcgaaggatctccggcaacaacacgttgcagggaaaccgtagccctgcctcaaaaaagacggcgaataccaccgtccgattgtcgataggtttcggcaccacggccttccctggggcgaaagcctgcccctcgaccaatgccccagagctgaccagcttcgccagctcgacgtcgtccacaagagagacccccaaaaaggcggtgctgtcgtcatcgactcggctgggatccagccctttcgctgaagcagggtttggcttgcgaggggccatggcgaacggtgcgtttgtggtggcgaagaaagagaatgggcgaaacgcttgaggggtcaagagatgctgtggaagaaagaaacggaggaagagagcgcatgcggtaaaatggcaagtgtggcggtgaaaatgaaaggtcggtgggaatatatagctcgcccgggcgaccgttcgcctacccaccagcaataaagcgccacgtgtcgcaagggtaggtgaaacggtaacttcccaccattcgagcggcacattgaaaagcccacgaagggaaagcccaatactgttcctttcggctcgggaaaagaaaatatataaaaaatgtatataatatatatatatatatgaatatgccaccaaacgcaggaggcgaagcgcggcaaaataataccagccgcacaaataacaaacttcattcgcagaaataatgtaggtttcggcaggagcatcggtcgaaagggggtgccgcataccataccacacagtttgcacggtctcggccgaagctccaatctcacccttgcccgtgaggggcttgttggcggatggcatgaggcccttcgaccaaatctgccgaaacccatggcgaaggctatggagcaagaacggcgtgaggcgaagagtcgtacaagtgccttgccaggccagaggcgtctcaggcgaagggtgcaaggcgaagactatctaccgaaggaagacgacttcgccttggtaagttcgcccccgcgagggccgaagaaacctttctggcccatcaagcctaggggcaatagggccggcaatcgccagacggccaatcaggggcccatgagcccctatatcatcatgtacccctgtaaatgtccctttcataagggtaatcatgtaaattcccctgtataacctaaaccctagtagtaagaacctgtaatggggctataaatagtcccctagggccatgtaatgggaaaaaaggaaagaagggaaactcaaaatttaattcatccttttggcatggtttgagggggagtttatagctcatggttttatcaagcaataatatgacaatgaaaaaaattgagaaaagagagcttcgtttatgcatatggtattttcttgtgcatgccagcaatactttgaaggtttatttgtctctagcatagcttgtatgtgtcacaccctaaaaattcaaaatttataaatttttgtttaattggaatttttagaaatgattttaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggttttaaaaagtcttttttggctttgggccgaaagtcggcccaaaaccctctttctctctccccggcccaagtcggcccagtccgcagccgcagccgcccgcgcgagcgcgctgtcgctgacaggtggggcccgcctgtcggagtcgtcgtcaaccttcggccgccgccgcccgaaaccctagcgtcgagccgccgccgtttccttccaaatccggccgctcctttcccgatccgatgaaattgaaagaggggaaacaatctttgggatctcctccacctttttccgtctggaaacttcggctaaatcggtttggaaatcgttgtctcggattcgttcttcccgaagtttccttcgccgtcgccagccgccgtgggcctttgccgccgcctccgagcccctttaaaaggttccccgagctctgtcacgaccggaaataacccaacgggcattccttacgtgcgtgcattaatccttgtcccaggaggcaaggtacaccaaaagttgatacaattcagagtttaacaagcggaagcgtaattagataacttattacatgggcaacgaaggcccagcacacacagagacaaacgagaaacagcggaagactagggcgacgaccacaggcgcttgacggcaggcacgagctagacaccgaagccttcatcctcctggaactcctcttctggggttgggaaaaattgagcaagactgagtacaaccaccgtactcaacaagacacacccacaagtgcggaataaatgcaagggagtacaaaggagttatactataaaggggttagggttgcagtaaacagcatttaaagatatttagttgctcagggctattttgtaaacacgattctagaactaaacaatattatttatcaaggccgtgaacccacacgaacctgccttaacccaaggcctacgatgattcggaccgaactggcaacccgaccctgggtcccagctcgtcccaagccaacccaggccaaccattccacattttagttgttaagc

SEQ ID NO: 77739 - DNA, 8430 bp, Oryza sativa
tccctccgttttctaaatatttgacaccgttaactttttaaatacgtttgaccgttcgttttattaaaaaaaattaaaatttaagtaattattaattcttttcctatcattgattcattgttaaatatacttatatgtatacatatagtttaacatatttcataaaagtttctgaataagatgaacggtcaaacatgtgctaaaaagtcaacggtgtcaaatatttaaaaacggagtgagtatttagttggcatgccacttcttatatttagttggcatatgccgctttgccaaagaaactccgcacattggaaggaatggcagcaaccagacctcaaatgtactatggtgaattctttctattttcccaaacttaaaagtgctatttataaacactccagataaaatgagccgtatgacatttcaggaataaatgctcaattctttcatcttctgagcaaaacaaacaacttttctctttacctttccatcctctcttttatcaagttatctctaagttaggatgcaataatttccatcctctccttaagtagtagcggcatgaacactttgattttaacaggaattttgaacttccaaaacttttttaaaaggaaaccgtaagttatgaatttgtaaatatctataaaaggagcttacagaggagcccaccatcacagaacaatgagttgtaggttttgaacttccatgttttcattaagatcaccaaattctgtccctttcactagtcagaacaacgttctgggacctactattcagtaatttccattggattagtttgtcaccagagatgcttcttctgaacttaagcactccaaaatcagtattagaaccttaacaaccatcacatttcttgtgtgatatgttaaataaggaagggagttgatcacctagggattgactacgcacccagatatcttcccagaatagagttcgttgaccatttccaggcttccttgtgcaatttttttttgtgaacccaaataaggaaactagctttgaatcttctttgactaagatttttattgttcaaatatatgttccccaagttaccattctctttattctcaccatagccatttaccttacaaggctttgttcatgatttctaaatcaagtatccccaagtcaccacgaacttttggtctgcatacaacagaccatctcaccatatatatgatatttcctggcttccaagtcttcctgccacaagtcctaaagtactccatttctttttaacctcttgaggcatgaaataaaatggcatcatataaatatgtattgaagcaaaaaaaaaatgtatgctgctgagagcctgagactagagttaacaagggtcaatctccccacaactacgcagcattccttgccaacataggcttagcgtctatgtttctgcagcttaatttccaatacttattacaagtcctttatttcatcaataggaatccccaggaagacctgtccctgagcacgtacgagctatgccaccgtacaaggctcaaaaaattatgtgtgtttcaatttaaaacaatacgttccgatatatatataaaatctctcgattcctttgtttccttcaaatttcactttttatgttccattgaatcagcgagaatgagttgttttcttctcaactccacgaagtgttcgatggcaatcataactacatccaagaagtgtatttcatgacaacgatgtgaacgcacgttctagtcattgaggattcatttttctatttagtaagaaaaaaatgaattgttgcaattattctttttctgcttagctggaacgccactacatatgtacgtgggtgggcttgttttcattggttgaaaacaattcttgcttgtttgatagcagggcatagttaaagaaaggagtaccggacttatgctacctttcgtaacatggttggaaggcagttgagatatagaataaagcagagtgacaatagagacccaccccatgtattataaacaatacgcatatcccttatctattatgcaattagctagtatatttttaaagataaggactcgtttatttcgcacgagactcccaaattgttaaggtaagccgtgtccccggatatttcatagtaaagtaaccaatcttacaagttagtatcttgctatacactagttctttaattttttctttgcagccacaacaagttagtatctggctatacactagttcttttttcttggcaaccccagatagtacaagtcacttttatgaaagttgtttttcagccctaacttctgctaaaaaaattaaaataatatattgaggtttttaactacataaaaagtcattttagagtagaaaaataattaatgtaatctgcatgttagaggattggtatgctttgttttaagaatcctggtccgaactgcactaaattagtgtatttggaccaagctgcaccgattgattcgttttttatctgctgaaaactgagaatttctacccgaagagcagtaatacgagtaactgggaagaaggcaagacagaatctgtctcgcaacttttcccaactaccgtttatacatccaacggtagaggtgtaccattgcttcgctctctcttgaagagagaatggaaacaatctccaccgtacagtctcctgtctcatgccacgaatcttaaggcatgagcagatttgctcaaagtctcacatatgatggtaggtattttctagatcaaagccagaaaaaggattttccttaaccatgctgattagttcagggcaaattttatagccagttgtataaatgggctccgatgaaggaggtggctcatagaattcgcccctaggagcagatagctcaaaaagaggttgctccatagtcgagaagaatttaacaggaatacttctctggttagcaggggtaaaggaagaataaaaaaatgaaaaagagatacgaggatgatctgggttcggaaatgatcagcaactgttccccggcaacagcgctagaaatgcttgttggtattccttacgatcacagatgaaatccacaagcgcacggatataccgatgtagcacttcctctacggagtattccaagggtatcgaatccaagggaacgtgtgtggtcaggtcttcttccggttcatccaaggacactaagcagatgataggccaggatagagaggatttactagcgagaaacagtgtctatggaaagcttaactttaatcctaacgcaatacttcaggcactggcaacccgctgttcccagatatcgctctactacgcacccggacagggaggacttaagtgctcttgaggactatcaccacctctacacctacctcaaacatactgtgggatacacagcaatcactagagattaattaccaagacaccgcgtctacgcaattaataactactctagtgccgatcaagcactaaagcaatcactataaataaatggactatagtgaacaatgatcccgtatgctatttaggaactaaccaagagataattctcacgagataaatctaaattactcaggaagaatattatattgaattcagagtaataaacagaataaaataaatgaaagaagattaccgacaacttcagaattcttccgacttcttctactctactctcttcctattctaatatacaatatagtacaatagagcctcttataattcagctcaagcttggaagtgtgtgttgaagtgaggtctttatatagaggtagatatgatggttagcgaagcggaaatgtccgaactgccccgcaaccgccatcagggagtgatctggagcgtccaagccaaaacctaggatcaacggtgatcaccagggttcggccgaacctgggctgggcccccctggcctgacctttggcctggctcctcttctggtacttctctatccattccttagtattttgggctgattctatggtattttgatgaagttcacaacccatccttgtatggatatatatttctcctcactttagtctagatttcctcccaacctcagggtttatcaccagcatacaaatatacaccaacacttgtggaatatgtgagattaagcacctatcactatgtttggatattttattatctgaactttatgcagatgttggcggtatagaattggcatttaacaaccgccaacactcatagggtctaacaaatttcttactatccttaacccggctttcctgagccagagctttttgcaagagttgactaacatcaagaaattgttggctttctaatctttctttaataggagcaattaaaccattaaaagcaagatcagccaaatctctatcaattatattcaagctataacatcggtttctaatatccctaaatctcttaatataatcaatgatagattcattgtacttttgcctaaccgatgtcaaatcacttagcctaagttcagtttcaccagtatagaaataatcatgaaatctttgctctaattgaggccaagtatgaatagaatttgtcggtagagaagtaaaccatgtaaaagcagtaccagacaaagataaagaaaacaagcgcaatttaaaagtatcaaaactactagcctcaccacattgctctaagaacggacccacatgctcccatgtgatcctactatcctcaccactaaatttggtaaatccgagaactctataaccacgatgatatgggatattgtcatagtaatcaggatacggcttttgataaaccttagcacgatttcctagcttcaatcccgaacttatccctaataataccactaatcaattcctccatattctcaggcctatgttgatttggtggtgggtttggtggcctaagaggtggttgttgcggcgcaataaaattatattggccatacctagtatcgggatgatatcccctagtagtatcattgtaaacattagggacatgtgggagagcttggggattaacagtagatacaaggggatcatgtgctcgaacatggtataaaagcccgttatttgtcattggatctaccgccctgtattgggataattgcaccggtctgaccggtccagggcccggtctgaccggcatccaaaggcgcagtcagaccggtttggggtccggtctgaccgccgggagaaaacccggtctgaccggccatctggctggtctgaccggcggaaaacttgcggtctgaccggccatctggcccggtcgaaccagctgagtgcgcagcccatccctcaccggttgtttgcatattcgctccatcggttttgctatatatttgatctataggaggtttgctagcactggtagaggctttatctttagattagaaatcggctaaaaaagaaccgagcttattcctcaagaaatcatcaaaacgagattcaaaagatgcatctatcttactatttaaagcagcaatggatgaatctattgtacttgctacatgttgttggatagggattgatacctcttcggtacttaccacatcaaaaataggtttaggcaacggtccaggcttgagaaccacaccttgacgggtcctagtgcatgttctcatcagtgcctcatgcgtgatcgccttaatctactcctccatggccttgcgtgcttccccatcaagattctccaatgagattggcatgatattggatggttccacctccgacttggttgatggcggctttgtcatggcggcatcgaagttgagatggtgttgagcagatttccccagtggagtcgccaaaaatcgtgttggcgactttttgtgacaagttgacaagcacgatcacagcacctaaagctttgcggtgatcctagagtcgccaaccacctcaatctagcaaaagctaaatcaagatgggttttgataagctaaaccggctagcggagccgatctaaatagaacgatagataactatccgtctcgtgggcaaaacggaaggttttcaggacaaacctacaaagaggtgttgcactctcacagtggcggcggacgatttacggcgcaaatcgacaaagatagacaaactaaactagaactagaagcaaaagtaaaagaacgatacgattgattgatagttgattgattttacaatgaaccggccttaccccttatatagggattggtcttgccctctacaggccctcctccacgtccaactcgggatataatccaaaggaaacctgaaacatgacttcctgagcaaggaaacctcgagacccgacgaaacagactcgggtttggactctgccagtcagaccggccacacaccaccggtctgaccggccctgcatcggcggtctgaccagcctatacacggcggtcagaccggcccaatcagagaaaaaccggcagatttccaaactttggtaatttttcctattttatccctaggtgccaaatttgggtgtaaacaatatctataagttggaataaccttgaaagccattaaggaaaggtcaaattccacttggcactccacgatataagacgctccattagaaacctcgtgtagctatgattgcaatttgtactgcaattcagcaaatgcatatgtaaatgatgctggactgtactgttttatgatattgcctctgtgtgattaatgtatgtatctactggcccattaaggattgctgatcatacatatccaccatttgaacagatatcattgcataatcttctttatgtgagtctttcacccaacctgaaaaacacaacatgtaatatttgtgatttgttgtaatttgtgaagttatatcgtgtcagctttgtgcacactctctaagtttgtttttttttgttgtctttgtatttgtatttgtctttgttagatttttatattttcatttgctccaagacagttattgacatgatacatcagtgggcattgttagatcaagaggtatctatttcttctctacagattatatgtaaagtgtcatggacatcatgcaaacttggtaatgagtactaactgaatagacaagcatattcacactgttgtgctgctactgccgctttcatggctcaactttctgctttttgtttttgctgctacttcatattgtgcaaagtgcaaaggcaggaattgtttcaattcttatgttcagatatacctgatcattgtgcaaactactattttgttctatgtttttgcggtgagcatttgtaagcatcttgtattttgtcttatttgtctttgactttgtctttgtccctgcattttttaagtcaataggttggtcttggcactgggttggttttgtctttgtctttgtcaacttttataaaatttagctacatatttctattgtttttctctgcaggagttcagagcaagaggagcctagggggccatggccgatgatgcctatctggagacccaagcaattccaaatgtgccaaagtgagcaattcctatgtgctacttcacattgtgcaaactacaaaggcaagactgttgttcaaactatttttgttcaaatgtttctgttcagactgtatctttcagttttccgatatgcctgaccatttctagtagaatctagagttctacacactttcggttctgctgtaattagcgttcaacaaattgactcaagattgtctttgtctttgtctttgtccctattaagctactaaaaatctgaaactaacatgacctatagaaataacaatctaactcatgtgacactctgctctccagacaactaatggaattatatagtttgcaattttcagttgttttcattgagaaactgaacatctcagaggctctaagaactagtttgtgtcttgatctatgttctgatctagtgatgggtcttgaataatgagaggattggaacaacaaatacacattagcccccaatgcatctacagaagtgtttttatcccagtaacaaacagccgatggtcagactactgtatggagtctttttgagtatgtatttgatgtatgcatactatatgtaagtttcatcaacttaattagttgttaaaagctggcatggattcaagttcttctttgctttattatggttgtgcacttttttgatttcccaggggaggtctcttcaaagtggcaaccgcagcaaatttcttgaaccaacaagcaaggaatcagggaggtggatctttgtgttttgctcatcacgtgaaatcaaaaaaaatttgttgaagcagcacacgcaagaaaccaaagagaagcaccaaaaagttgaattcaaagaaaactaaatgggatttttcgtcatagtgatttgtgttcatcttcggctcatctccctgaatctcctcatcgtccatctatttgattctctcctcttcttttctctttgatctggattttgatctggtttgttctcctttctcctttattcttggttactaagcccttttctat

SEQ ID NO: 77740 - DNA, 10392 bp, Oryza sativa
tgctgcacgtgatttcttcgtatttgggctttttaatcccatcatgggctgcgggctgtgggctgtgggccatgtgaactagtgggcttttttgtttgtatttttttgcacaaattgtgacgggctttttgtttcttcaaagaaaagaggatgtgggctgtggcctaacaaaaaaacagaaatggactgtggcctaaaaaaaaattagtaaacagagtcacgctactttttttctgcgcgcatcaattgtctgtgcgcggatcgcacggccagcggaaaaaaaaggctgacaaaccaaaaaatttcagccccatgttacatacacaatccctattatactagaaaaaaaatacacgtacgttacaacggataaaatatttttagatcgttatatatgttactctttcattttataccaaaagcttattccttccttcattttcagtcctagcttagcccgctaccttcctttgtcgaccgccgtactcaacctccggaagaccgtaattgaaagtgaaaaccatgaggaaaattaggaagaaacacatgccggagaaaaggtgatgaaaaaaaagtaaagtacaaacagcggagggagataaaccgaaaaaaaaacgaagaaaaaatcagacagaaaaaaaaagccaaaaataaaaaggaaaaaagggtgaaaaaaacagagggaaacaatcggaaaaaagggaaaagagaaagcggacagaaagaaagaaaaagaaaaaggaaaaaacgaacgggaaaaaagaaaaaggaaaaagcaacggaaaataaaaaagacggaggaatttttagcggaagccttacgcattttttaattgagtagatagatatagatataggtacacgtatagttttttatgagtaaatttcataaaactccatctattacggttaaatcacagggattgtgacacatgacacataactctacatattatggttctaagggcccctttgaaacaatggataggaaaaacacaggaataggaaaaatgtaggaattgaagttgtatgtttttccagtcctataggaattgaaaacacaggaaataaagagaagagccctttgattatagggtaaattggaaccatgccattataattttgtaaagtttgagatatgccatcggtatctcagtgacatgtaggacacacatgagtcaatgacatgtgggtcaggatgacatatcttaaattttgcaaaattataatggcatggttccaattttctcttgattataccacaggatacactcaacaaaggaaagcttcacaagaggtctaacctcttgcttattttcctatggaattgatcataggaatgcaatcctatggaagttttcctatctcttcctatgaatcaaatagctctataggaaaaaatccttaggaaaatgaatcctccaaaattcctttgctaatcctccatttcaaaggggccctaaatttggaccataattagtggggttatgtactctaatggtggtctatcagtttaaataaaaatcagtgattgagtttttttttcttttcaattgaaatttcaaggattttatctaataatttattagagtaccatgtgaacgtttataagagtaccttgtgaaggcttaggggcgtttgtacaatctttactgggcttttagtatataatagatagataattgatttccatttgatttgcttgtcaacatggatgcttcttctgaacttaagcactccaaagttacttagaaccgtagcaagaactttgtcatgtattccctccttttcaaaaatataacatctacaatgcattctgctactataattctaaacaccctaatacagtatgacttgataaactttagttatataaaggaaaaagtacgaattacccccaaactatcgcggttgactaaattatccccttgaacccgaaaaccagacaatgctcaccctgaactttcaaaactagacgaattatccccctcgactcaatccagaacggttttgtcctatgtggcatacatatggcaatccagtcagcattctctttaaaaacaaaacaaatggtgggacctgttgtaaaccaacgcgcctattagcggatcaccggatccgttccttgtccctcccacagcagtagagacgtgagatgatgtagaacacccgcgcccatcccgttgccctcaagaacattgcagaagtagacaatgaacacaaatatagggtggagctctctcttcattatagatctcatctgtagtacaagccagccattagccattagatgtcacaccctgcccctgtatatataggggtcttaggaggagatagatcttatctctactccggtttggattggcccacaagaaacttatctccaagagatttatttcacaacactcccccttgggctaatccgcgactaactcatgcctcgtcaaaactcctaccaaaacccagtgggaaaaaggctaggagaaagagtgcatagttatcgctcatgcattgcacattgttgcctcgttaaaaactttatgtgaggaacaacagctccactcactcaagggaaaaagagtacaacactaaggactacacagtccatattgtgggtcatgttcttgggtgctctccccctgaacctagcaaacatcaaagtcttctcatcccaattctccggaaaagcttccgagaactaacagttgggagagactaggtgatcaatcctctagattatcactaaacttgaattgctactcacctcacctcacctcaggagtctgtgaggtagcccacttgtatttggtgtcggtcaataaagacagatcttattatgataggaccttaggaacaggtctaagtgatcgtcatcgagtcaatgccctgggcatactctaagacatttcaatgtcttgcaaatgacaatcaacacatagcacatactccccctgatgacaacctttgtcacagaccatgttcccatagcattaaacatctctcagatgtatgcgtaggcaagaatccttcagatcctcaaaccattagtcttaaaagacttgtctcatttcaccgctaaaacgagaatagggaacacagagagtaatgcattccatcactatcatataccataataccatactgctgtgcaacgcaatctgtttcatccttcagaaggattatggggataaataagtcgcaacggcacgcacctcctcgacgtgactccatcaagaactagatcttgatcattgcaactttctcagacgatgtcaacaacaatgggggatccacaagatcaaccacaagccttccaaagacatgttgtaacgatcagagtaactagctagtctgaaaatttaagcactgtgggggataacacacggccaacaacaccaagtataccttaataggtattagaggacaccaccgttcctaccatcgggtagaacagatatcacgagtgtacatactccagtgataatcgcgagatgcacatgtgcctacagacctcgtctgtgatctcatcaggttcctcattgcaatcttaccgggtcataaatgggccatcattcctccaagggattatacaatatggtgtgttcaaacttactaattattttgtatctcagaggaaaattcatcaatgaggtctccccctcagagaaaattccgtcaatgagattttctcccaacgggagatggtactcttaccggaatacctattggtacgagatttgcatgctgcaacttcactaccgagtctattcaagacctcacggatttcctaaatccgttaactgcatatttaatttcatgctattttgccaatacctttatttagcggaacattcagctcatgtgggagaggtcacgtcaaggacctacttgaaccatcgcacatcaccacctcattatctcaataatgacccataagaatccgaacaacgttcgcgattttcaattggcgattcaattccgcctcaattgcatttccatttgacccgatttgagcaccgcatgctcatgccatggacttgttccggatccgggttctctctaagagaatcattagcaagaggcaacatagtgtcgacacatttattcccacttacacatttaagcagatcttcgttatttcccaaaacgatcgatcaatggttgttccgtattcctagcaccatatatgcgcgcattgctaggaatgtcgtctccacgacgaacatcattatgaggtatatcaccttccaaaggtgaattctccaccaggagaatcagaggagtatgctcacatccagtgagaactcttatgctctgactaaggcctacgaatcgtgttagcaggcgtccccgcacaacatgatcaaatgccataagtcttatgtggatacgatattattcccgggtctatccacatttaccacaattgggagcattactctttttaacaaatatctagttgttcctcatatgattttgttggcaaaaactccgtgcaccaagcaaccaggagtatgaactaaacatgcaagttcagctcatttagtgcgttcactcaaagaaatctccaggcattccaaaatgggcgattctctccccttaatgccgagatatcttacaatagcatactaccaatccccatatcgtggcacaagattaaggcatttcacctcaaacacatgtgttctcccacgattgtatgctacggtggtgatatatttgggaaatattacgcactttaataggagagatttttccattatatgcagtgagcctggacatataccaatacagtggcatgaatactgtattcttccttctcccgaagggttatccttaacctcccagttaggatatacaggtttgcaaaaaccaccattgctatcaaatgtatatgcaaccaacatgcaaatactttagccaaatgcactctccatggattaatgctcacctagtgccattcaaactcacaatcgattccgggtcgacgtgcattagacatcgcatgtcatatgcttaagaaggcaacctatgatggcataacgcattccgatgcgctcaacaaggagtatgatagaaaaatgcgcggccactagcctgcgctgccaagcagatttttgtggtgcagagttgttttaaagtccatctcgtttaatgcccaagtttgaccccaattactcataccaaactctagaattgggtcatagttaagcagcatgtattaggtacgatccacgagcgaattatcaaaccacatttgctaatgtcccctggacatagccatcgagagataatccatacctccgacaatggtaatattcacaataaaaccattatattcagacatatccacaaaaatagtggaatgtgtcggtgcaaccgtcattggcataacgagctcaatgcatgcaacatgacgaacctttgcacggcttgcacacgtccacacgcgaaaaacgccagtgtgtgacaagcatggtcattaacccatggatgaccaaccaacacaaccagggaatagtcatcgactacgagagtgcgataaaacgcaatagtgcatagccaacatttgtctgaaatacagttacgtcgaactgtgtgagtggttgtaactcctcagattatacactaattgttcttctaaactaaagcattttatcaattccagcatgaagataagctttagaatagaacaggaaagaccaagaacgttatttatctgagaaatatcaatctaatgcaaagttccaaactaagcaaaagataaactgcttggcaacagtatagtcgaccaatgtcctcctaggacatgctctaaactagccatataactcccattgtcaaaacaactttattagacaaacactaccaacaattggtcaacaaccataggtggccatttagctagatccacacgaggaccgagactgagtcaacacccaagtcaagctgttggcgctatagtgaagtgggaatcatgcctattcacagcatctacccttgggcttattcctctagatttgcctcctcttttctggtgtccttgcaagacatcaggttccaaataatattgagaagatatgtgcacaccaagggcaaccatacgaacaatgtcattccaccacatggaaaacactttacatctttcaccgggccaggtgaaaaatatctcaaattattgaacctcgcaactccacgttgccaaaaaattgaggtataatcatttatctccaaatcagaaaagcgtgctctcaaccattgggaaagcaaaaaaaatgtcaaccgtagtccgaccatactctgattgagatgttaagccactagggaaaaaggcacaatgaatcccaaacacattgtctaattccatacatttcaatgacttagaatcccattcttgagtgtgatcatagggatagagtgatctacattaatgcccaaagccatataatagtcattgaaggcctttacgtgaaatcacccgcactatctatccgaatcgtttcatgcggttctcagagaacgcaacatgcaaacggacgatatgtgcaatgaattcggcaaaagtatggatctcatacaacaagtatacatgactccatcttgtagacacatcgatatcaccatttatgtatagaggagtgtaccagtaaagagtggtcttatccatagccatggatatttaatttcccagaatttccatgcattaggtgattttctgttatttacttggtcttatttggcattatattcccaatatttatgccacacagaaaaccatcacacataaatgcaggaaaataaacccatcataatgcttccaaggggggattctacactatgtgaacacaatttatggaagcatcataacctagaaaaccatctctagattatttagttggaattgcatcaattttaaaagcaaagcaatgcttaaaaaacaccattacatagttatttacgagtccggagacccacacgcaaaaccaaactatacagggcctaagcaacgagacatagccacacaaagaaaattaatataattcttgttaattataaggttcaaactgtaaaattgcattaaacagtgaactatagcataaaaacccaacactccgggggcttaaacacaagttgtcaataaaccgaaattaatcgggccgaattaccgttcaggccacgatcttatttgggctagcaagcacagtgtagcccaaaatgcctaatgggccgaatttccaaaactctaggcccatgaggatttccaggtttattatttttattaatttgtttgggctgtctcgttactgttgggctttattcggtcgggcggaggcagaccagcccagccggttcgcctaagtgaccgagagaggtaaggggggaattagagtttctcctttcccattcattgtccgcaacggcgtccaccgcccggtgcaccggcccctcgggcacggcggcagcgttggaggccgtcgactgttgactttgaagggatttagggcggtgcacggcgaggaggtcatcgacgacccatccactaccctgattggcaggacggcggtgacgacatcactcccgtgtggcaatttggtgcggtggcggctcggtggcacacgacggagctccgcgtcgacccgcgcatcctcatgacggcggcgaggcgaactcaacgacggcaactgagaccctaacaatggcaaccaaattgcatctggccatatcgtctcggcggaggttaatccggtagtggacagccgacgacccatcatcctcccaccacggctcgacggcagcgtcgatgggaggtcaacggcggtggcgcctcgcttcggcattaactccagcggcaacggcgatatgggtttagggctttctccaagacggcggtttcctgcgatggcatcgacgcaaggccgacggcgtacccaacagcgacggcgaatgatggccaatatgtctctaagtccgactacacagactgagaatatgtcaccgcgttcccggcatggcatcatcagagaaagagagaaatagagagatgcgagggaggtgggcgagtcggccaattcggcccagccgaattaggcacttctccaatccagggtttcccatcaattttaatgatttctctcacacggttttcttcagttttcatcaaataaaatagatgcatatatatatagatcaaaagcaggaaattaatctactgctagatcaagagcaggatcaaggctactgcaaataaagcatctataatatgataaaaacgagaaaatataatctatctataaaaacatatagatttcatacctgaatagatacatggatgtatctatgaattagtaaattagtttaggaactaatcatactaattaccgtgattagtgtgcttgatgaggatggttgcacactttaatctccagggatctgtgcacgtggccatctggtcaggtgcatgcaacatatctctacaacttaaaagtttcgtagcggtggcggtgactccaaccttaacagacacgtgaaatatagaacgtgggatcgcctaatcgaacggctcagattgcctttctcttcctacgcatccagcgcacgcgtctccctcgaatctcgatcgctctctcctctcccctaccctcaaccccccgatccacgccgccgcaaccccctcaaccgcccgcatccccgatccgttctctccccctttcctccttccccaccgtcgctgccgtcctccccggcactcccatccctttctcctccatgccgcacccctccccatcgtcgcagccgccccgtcgcccctgctcgcctgcatccaccacaccgcctccctccccagtcgagacggtgtcgcctcctcgccccctccgcagctagattgacactgcgccattcaatccaccgcctcaagcaccatgcatcgtcgtcgttgcaggcgtcggcacgggcgcgggcactgccgatcccgagtcgagacgacgtcgtccgctgctgcttctccaccactgacggttgccctgcgtatatcctccctattatcgcggtccccatctgctcctgaatcctgatccacaaaaacagcggagcgccgtcggcctctctgcctccctgcgaccaccagtggcatctgccccgccgtcggctctccctcacccgcgactcgccgacatggtgctccacaaaccattcaggccgtcactggtctccggagcgcccgaggccgacgtgtctcgcactccctataatcttgctttgctgcagcagtaacaacatcataacatatcgtggttcatacaatggatcaggctggtaattcgattccaattcttgctcctgaacttttttattggtgattccctctaatgttcagcagattgggtttggtggtggcagtgcggcaccactgatttgtgttagacattggtccttatccaaccctctaatctcttgattatgctcacttacgatgacttcagctcaggtggttgcaagaaacactcctagactgctatttagttttacgttacagggatttggctacagatagttgcaagctgcaatgttctgatatttgttatgttttagagcaagatctgccttatatataatgatataattaggcttcgaatttcttgcttatgttctttaaaaattccaagtaaccttttcagttctttatgtcaggttaattgacagatcgagttgcacttacacatatcttgttttaggaaatgctccaatggcccttgaatccagcaaagtaagtatttttttatgcttgatctgtgactgatctcaaacagataaattgaaatgagtaacttgtacacagataaaaaagtgacatgggacttgattagagttacggtatttttatcttacgaggcgccagcattatttgagttttatgagtcaaatattcttccattttttcctgtcatttggttgtgtcatgtcattatttgagttttattgggtaaattgtgtcctgactggccctgagctggatgcagtgcttaattggtgcaaaaactgggcttaatgcagtcaatttccagtcatgtgtttgaaaccattgttttctgattactttaattaaataatccatgatcacaatataaaccatatgtgcaaatatccagtcatgtgtcatgtgcatgatcagatgactgctattggctataatgcagtgattctgaaattgctatttgccaaggcttcctatttttgctgaactgctgcagcagaatagtgccaccaaatgaaagtgaacacgtaagcatattgtttgggagaagatcacagttcggaatttcagattataaccaagataaagaatcactcaactttatgatcgacttgctattcatgtttattactccctca

SEQ ID NO: 77741 - DNA, 1930 bp, Oryza sativa
gattaatattgtttattacttaactgttttatcaaattctcaaatgtttgctaaatgctgcttttgcaaatgaaaccctactatgccatactttgttatcctgtgcacttgcatatttgctgcgtggcttgctgagtatgtcatatactcaccttgcaatcattcatcagaggaagagttctacaatgatgctgatggtgtggaggattaggtgtagccctggtcaagctgcctgtggagtggagtcgtctgcgccgtttatctttttttccgctgcttagatctttattgtttgagaggaactatctacctctgtaatgacattttatacgcttattaattagagtaataattgtactctattatcaatttgttattgtgtgcctcggctgattcctggacgagggttcacacacatgtaagcgtttggaattttggatagaaattccgggcgtgacaccgacttccgtcgatttcgagggtaacttttatttccgctaaaagtttttggtttttgggtataccaaccattcaccccccctctggttggcttagttcttgtgattcgatcctacatggtcagttgtttttattttatttttaggaaagattgtttacagtctgatcaggacttatatcttttactttatctttaggaaagtgttaatagtgaaatttcgcaagatagatttggatttggagttggatatcgaagtggaatcaaaggaaattggatcttgacaaaacggactgcacatcagctggaaacaaagtcactgtttgatcgagccgatatggcaagaagccaatacagcttggcttgggttcagtttgggcctcgatttagataatcgtcattgccgcatagagatagagcttatttaaagcaattgtatctattaattaggatattaatgtcagtttaaattagagatatgttaagagtctgccatgtggacttatttgttattttatctttagaaaagtttgagacgtgttcataatggacaagttttatactcaacgtataaatataacaacaacaatccaatcaatacaactttcggcacatcgcaacttttggcgtgttgccacccttttcttttttacttttcgatgagttcttgcttcaagtcggggcatcggctgcgatctcttgacaagtggtcacttatctcgatagcttgcgctatcaaggctattatgtcgctttagatgcattagtccttttaatgtaaaaatgaaatgaaataaccaaaatccttttatgtaaaatttgagatatgccaccctatatttgcaaaatttgagatatgtcatccgtatctcaataacatgtaggacccacatgagtcaatgacatgtgggtcagggtggcatatcacaaattttgcaaaatttgcatggcatggttcaaattgtcccttaatttaggagtgtatatgtcacgcccggaatttctatccaaaattccaaatgcttacatgtgtgtgaaccctcgtccaggaatcagccgaggcacacaataacaaattgataatagagtacaattattactctaattaataagcgtataaaatgtcattacagaggtagatagttcctctcaatcaataaagatctaagcagtggaaaataagataaacggcgcagacggctccactccacaggcagcttgaccaaggctacacctaatcctccacaccatcagcttcactgtagaactcttcctctgatgaatgattgcaaggtgagtatatgacatactcagcaagccacgcagcaaatatgcaagtgcacaggataacaaaggatggcatagtagggtttcatttgcaaaagcagcatttagcaaacatttgagaatttaataaaacagttaagtaattaaacaatattaatccaacgctatacaacataccctgttgta

SEQ ID NO: 77742 - DNA, 8387 bp, Oryza sativa
tcatcggatgtggcattaaaagcagcaagaaaagacgacttagatgaagaagcatcaacatccaaagaggaagaagaagaaaccaaagcactcgatttagaatcaactttgcgagaaagaacattcatctcatgtgttttcaatttagtataaagtgaatccaaagtcaaagtagacatgttaacagactcctgaatagatgtaactttcatctcccaaatagacatgtcgagaccattcaaaaagtgacgagaaatctcagattgtggataattagcatcgtaagaagaatcaacagatctaagatcactcaaaattttattaaattgagaaagatagtcatccaaagcttctctaggtttcatctcaaatttaatgtactcctttttaaaaagatctcgacgaagctctttaatgttatttgtttcttgatgaaaattactcaaagcaacccaaatctcatgagcagtttgaagattagcaacacaatcataatccgaacgagaaataccactcaaaagaatgttgcgagctttgcaattttgttcaaaagcagttttttcagcagcagtattaatagcttcaggaatcacataagcatgagaaatttttctccaaatatcataatcttaagccataatgtaagattgcatcctactacaccaatgagaaaaatctgttccatcgaaaacatgaggcttaattgaaaacctagcgggagtagccatggcaaaagctctagatcgataaaaatccaaagaagaaaacaaggctctgatatctcttgtaggatcgaatcacaagaactaagccaaccagaggggggtgaatggttggtatacccaaaaaccgaaaacttttagcggaaataaaagttaccctctaaatcgacggaagtcggtctgaccgagattgatctgccggtctgaccgagtagatgctgccggtctgaccggtgttgaacctccgatctgaccgccgaagtcgcctgccgcgcctgtcgccgctgccggtctgaccgcccctatgccgtcggtctgaccgccgcgtgtcgccggtctgaccgctagtgcgccgccggtctgaccaccactcttaaagtggatgacgactttattacttctctctatgttcacaaagtgcaccaacaacactccttacaaaaatttcgacaaaactcgaaaccctaactcaaaactcaattcaattgctctctaaagcgataccgggaagcctcatgcttcccctctatttatacatgaggtaggcagcctaaagccacgaaccaaactcatactaggagtcctaaacaccttaggaaacccactagtacaagaacgaaactttacataaccaatcgtaccaaatttggactccttccaaattcaactccgcatcccatacgcacataataactccatcgtatgccatatggaatctccatcaaccatgtgcatcaactctagccttagtatcccgcatgatctctgaccaccacggacgtcgtcttatcccaagccgactcctggtccatcaccgcaaatactctcccgagacatcgagtcacctacacatggaacaaacaaagaaatcatattccgagaccaagctatcttcaacttgactcattagcagcaaacaatagtattacatacgtatagtatctatctagaagtcataatcatgaaataaactcggatatccaaataaacaacccgaaaccgaaaccgacacagtgtcggccggtcagaccgtgggctggccggtccgaccgctcgatcaccgccgatctgaccggcaaatacagcccggtctgaccggtcacataaaatgacaatcctgcgattcacctgtaattccaatcatctccaaaaccacttcgtgaataaattccaaataacaaaaccaataatctccaatgcccaattgttcatcacagaataataatcaaaagcacctttgattttacagaccctacctaattaacatattaattgcatgtcacatctttcttgaatctggcccactctatataagcttcacttaattgattaatttccttaaccgaatccatcaagaatcaaacggttggcggctgataatttccatcaactaactccaggactctgaagccgatactaactctaggccgatgaagacttgtgggtttatcaaattttgacattaatagtggcatatagtataaagttctctaacagatacactggtggagaaatcgtttgtagtcccggttcgtaacccccctttagtcccggttgtccaaccgggactacgaatccgggactaaagatagcgatctttagtcccgggtgaaataaccgggactaaagatctatgtaccatttttttttatttgcatggccctgtttgctgcatggttgattttatatatatatttatatacatatatatatacatatatatatatatatacatatatatatatatatgcgtatgtatatatgtataaatacatatattacacacatatttataatttaaagcacttaacattttatgtacatatatgttaccagaatatatattaacactaaagtaaatgtacgtatatatataaatatatatatatatatatacatgcatgtatagtacaattcatttgctcgctagctatagctacgacttccacccctggcttaccttcaaaaaaggaaggacccgcgtttccgaaattggtccaatcccgtccgtagtagaattcaccatcgggattaaggacttcttcattgatgaaccccatcagttgttcttgaacagccatgataaaatccttgtgtgggagtttttccctcatgtgaatacgctatcattcgaaaaataatgacatatcaatatatgaaattaataaacaacttaacaaatcgatacgcaatgaaattttgaatggtttatgtatacgtacatcgagctctcgtgtggtgtatatttggtttgataggcagtgggaaaactcgcatatgtagtagccgcataagttagttcccttgtcctgctttgcacactacatgagaaacgatgagagatttaatatactctttatattaactgtaactagagattcaattcaatataattttggatcatgcatgtactcactggaaaatgaaacctccgtccaagtttttatttccaagtcccgcggaccaattgacggaaccgatcccaagccctacatgtgcagttgcaagctatgattaattaaatattacccgagatcaacataatagcaacagagtcccgcgactttggaatagatggcattatattacctgtctatcagttggaagaccttgtcaaaaaccttctcctctttattcattgagtcgtatacagtgactctgcatgcgtccaagtcgaaaaagaacaggacccagtagaatctggaatatgcgtgagatgagataaatattagaatgtacatgtgatatgtatgggaatgaaatttgttcgaacgacaatagaaactcactctgtgttgtacggcaatagtatgaacgtcttgtaatgctgctgcgttaggagatggacgagattgtcctctgtgtctttctcgtacttgtcgagcatttcggtgttgattttccgagggtcgatgaacccagtatcgtaaaccctccgccgtcgggccctttgaatctccattctacaacaatgaaaggaaattattattgcttacatatatgccaggagctaattattgaacgaaacaaatcgaactcaaagatacttacaaaatccatgcgctcagaagagagacgtcgagggcgtcccgatggtacagatcgaagacatccttgaaatggatccatagaacatcttctccttgcaagaagtcggggtttctgatcctcgcgccgaacatctctctaccattggcgctcatttctatgtaccgttcatagaatttgtacatttgtgtcggtagggactgcagctgctcagggctgacaaacggtttaccgagttcaaacttgtatgccacttccgccttcgggattggtgcgcgtccaaccaactgagccatggttagaccggtgtccgaaatgaaatccgttatgccaaagtcttcgccagtcaccaacggctcgaccacttggtgtggttgttctccaagctgaggaactggtttggacttcttgtaataggctttcctaagtgttcggtcatagtccgatagctttaaggcctccttgtttgcggtggacattcccttgaagaaattcttcacgctcgggtcaataggtatcttcttttcaggactccgaggcttgagttgcctcttcacttctcctgccacataagcgtcaagctcctcttgactgcaaccgtacggcggctccttgtttttggtggtgtcaactttggccttcttcgttgcccttgtgctggcaggaggtggagcttggcgagaccttgtcttgggaggtgcaggcggacacggaggaggaggaggcggaggaggcggaggagccggaggagatggtgcaggaggagacggcggagccggaggagatggtgcacgagactccgcttgtcgcctagggaggatgatgtaccgcttgcgccatagtataatggcgtggcttgtgtctcgtagatgcgtctcaccgtctcctccttggtagtccaactcgaggtcctcgtacacggcttccaccagctcaacttcgaccctcgagtatactgctggaatcggcctgcagtggtaagtccctgaaatgtccgttgggatggccattcccgacgccaccttcacgtgatgagaggttatctattagtaatcaacctaagcagcaacttgcggaacgtacgagtcaaaaatcatatattacatcgagcataccttgattgataagttcttgaagggaatatgcagctcacatggtgtccaatgagtgatctcatcaacggggcaggtggtttcgtcctgggtttgcatggcgtccatgctatgtgatactacctgccccgttgaggcgcagctgctacgattgcctgatgggctgaccattggaggaggtatgtacggctggggatcgtgtgaccgatctgctgccatgcgttcatccaccttccgggccacctcctcttgcatgctgagctcgtagctcgataccctgtactcaagatctgcaatcttcgcctcggtatctctcttgctcctcatccgactcctatacgtgtggatgtcctccttgaatcccatcttccagggaatcacgcctttccctcgtgttcgtcctggatgctcaggagtctgtagggcgagtgatagctcgtccttctctctgtcgggtcggaacgtgtcctgagaagaggcttccactgcgtccgttagtcgattcacagcctcgcgtatctgatcgctgaagaccaaggagccatcaactgggctgagcgttccaccgtgagcatagtaccagaacttcgatcgatcaggccacttagcggtggccggatcgatacccctctcaagcaagcttgcctccatctcctcccacttcggcatcgcgacgctatagccgcctgaccccaagtggtgatggtacttcttcttggcggcattttctttgtttctttccatcatcgcctgcccttgttgacctgtcttgtaagcaacaaactcgtcccagtgatcccttagcttcgggaatacgtcgaagttccgtgtctgccccttcaggatgtatttccggtacagatctcccttgcaggtctggaactgttctgccattttcttaagagtccactgtttcactatgttctctgtacccgcagggagtgtgaacgtctcgagcattgtggtccacagcatctctttctctgattccgggacgaagctgtcatcacccccgcgtgcccttgttctgcgccagtacaccttgctgacaggcacgttatccctcacaacccaaccactgtggcgtacaaaattcttggctgcttgtgccggggcactaggtcggccgtctgcgtccacctcagttatgatgtgccgaccctctatcttcttcacggcacctcgttgtccgcgtgccctcttctatccagcggagggatgacttccactagcctcctcctcgttcccctccgcatccctctccacgttcccctcctcgttcccctctgcatccctctccgcgttcccctcctcgttcaagtactgatttggatcctcgttcccctcttcttcgttccagtactggctgcttcccgatgcgattgtatcgtacaatatctgttcctcatcgcgatcagccatctgttcatagaagaaatatttgctaagcgtaatattaacactctactaatcatatatgctaagtctaagtgtcgtgtatttgtacggtatataatcatatatgctaagtctaattaagtttcgaatattacatctctaataatcttatattaaatctctaacactcacatatgctaagtctaattaagtttcgtatattaaacctctaataatcttatattaaatctctaactatctctaacactcaaatatgctaagtctaataatctaataatctctaacactcacatatgctaactctaataatctaataatcttatattagaaatctaacaatcttatattatatctctaacaatcacatctttacatcacttgcctgcgcgaattccttcgagggctagctaccacttcggtttgagggacgacgacgacgacgtcttctctgcaacatgcaaaaaaatgtattagtctaaatgcaaaggaacatataatgtatttcacgtttccaagtatatataatcatatatatatatgctaagttcaacaatagtttaattatctcgttcgtacacatttcgctcgcgttcgttctcacacttttagttcaagtgcattcatgttcattaacgtttcaatcacgttcgtttgcgtttcattcacgttcgttcgcgttcattcactaacactcacgttcgttcacgtttcagtcacgttcgttcacgtttcagttacgttcgttcgcgttcgttaagcgttcgttcgcattcgttcatgttcgttcgcgttcgttcgcatttggtcacgttcgttaagcgttcgttcgcggcggtgggggcacggtccggcgccgtgggccggccccgcggcgtgggggcggcggctgcgtggcagcagcggcatcgtctcgcggcagtgggggcgcggtccggcggcgtgggagcctggcggcgtgggggcgcggcggcagcatgggggcccggcggcgtacatcggcgtcggcttcgtcggcgttcgtcggcgaaagagagagaggcagagagctacatcgagatagagagagagagagagggcgggggctctcacccaagagacgcggtggcggcgtctgcggcggaggcggcgaggaccgccaggcgacggtgagagatgacggcggcgtcggcgcgtggttgccctaggcagtggcggcgaaggagaagccgatgctcgatctcgatggaaaaacgtctaagtgttggtggagaagacgagggcgcaccgggaatatatatacccccggatctttactcccggttcttctcaccaaccgggagtaaagatattttcccgctatttccaaattcttttttaaacccggttagggttaagaaccgggactaaagttaatagcactgaatattgaatttcgttgcatatatgtttctaaaatagtaaataatgctttaaaaattctaatcaagatatgtaaatcccacatgcatgatttaaaacttttaaaaattataataatcatatataattagcatatgcatgatattaaattgttaaaaattgtaactaacatatgtaaatcccacatgcatgattcaaaacttttaaaaattctaataatcgtatataattagtatatgcatgatattaaattgttaaaaattgtaattaatcatatataactagcatattcaatacatccaaaatagtttacaacaattacggcaatagatcggcggtgacggttgtccgcacgtactttctcctcactattgttccttccttgtgatcgctacgtaagtaaggggtgtcttcgtttgataggaggatgctagggtcaaccgtcaccgtgaaagggggttgcccattgtcacaccctgaaaattcaaaatatataaattgttgtttaaatggaatttttagaatttattttaaaagcctagaagagaagatctaacttttaattaataaattccaatataaaatggggccagataaaatttcattaaatactttgcttaattctataattcctagatttttctgggatttatttgagctaaggaagtatttttaataaatggaattg

SEQ ID NO: 77743 - DNA, 4864 bp, Oryza sativa
aaatattactatatttatctacaaacctagttaaacttgaagtagcttgattttaaccaaagttgaaatgacttataatctaaaacgatggagtacctgtatattaattattactatcatgcgtgcatcacaaagagtttgtgttatcgttgactgtcaaaataaagcaaaaatttcagatagaggtcccaggacaatgcctacaaatgtagaaacttataatttcagtaatcggagtactaaattgagtaattaacaagatatataggtgtctctttcaatctatgcattttgttgccatgtgagagatgatgtgctttgcctaattttctggtgatgtgaaagtgtgttgcaccggggagcaagcaagtaccaggagatcgctctcattgatacaaagcattttggcaaggtatctgtccatttctgcctctcttttttctttcttttttttaaaaaaaaagaaacacagaagtcctatatatcatttctattcttgtttcgtaacaccaacttgtgtggtgtaatttagtactcccttcgttttaaaatatattaacctaatactagttagaaaaatatattttagtactagtttgctatttttaaaaatgaagagagtaagtaactagaacactgatatgacaccctttttctaccaggctctaataatcgatgggaacaccctttttctaccaggctctaataatcgatgggaagatgcagagtacagaggtggacgagttcatctaccatgagtccctcatacaccctcccctcctcttccatcccaagtacgttaaattaccatcgcgcaatcaatgatctcacagctgcttccttcatctcgaaatatattaacgactacctcctattctagtcaaacactaatccagattctttagacatgtaagtatatataataaaatagattctaatctctcgaggtgagtacgtgcagcccaaagacggtgttcatcatgggaggcggcgagggttccgcggcgagggaggtgctccggcacaacaccgtccacagggtcgtcatgtgcgacatcgaccaggtactcgatgatcgatctagattgcaccgttgattgatatatatgcagtactacctccgtttcagattataagattttatatgtctagattcattaacatatatatatatatatatatatatatatatatatatatatatatatatatatatatatatatatatatatatatatatatatatatatgaatgtgaacaatactagaaagtcttataatataaaaacggaggaagtaatagattcttaaattaaactgttgttttgtttctctgaatgaacgcatatgcgtgggtgcgtgatgataattatattaagcaggaggtggtggacttctgccggacgtacctgaccgtcaactgggacgccttcgccagcgacaagctctgcctcatcatcaacgacgccaggtatgtaccaaatcatatatagaaggtggtcaggtggacatactagtgttctctattaaagatgacgataaaattagagtatgaaacaaactattaacatgtgattaattgagttttaaatattataaagttgaaaaatagatttatctgatattttaaaataatttctacgtataaagttttcgtacaaaatataccacttaacaatttaaaagcgtgttaatgaaaatcgagataaaatctgtatcttaatctggaaaaaagaacgaccatattaatgctgcaaactgaaaatgaatcagcatcatgtattcatgtgtatgtatgttttcttgatcggtgtgtgcttatatgcatttgcatgcagggcggagctggagaagagtagggagaagttcgacgtgatagtgggagacttggctgacccagtggaggggggcccctgctaccagctctacaccaagtcattctaccaacacatcgtcaagcccaagctcaacgaccgcggcgtcttcgtcacccaggtacgtatataatttttcatcaactctttgcctagttatttgactgaactctgaacttctctgaaattttagcgtttttactgacagttgttttggctgttgacaggcagggcagccggcgttctgacccacaaggaggtcttctcctccatctacaacaccctcaggcatgtcttcaagtgtgagtagcccagcaattaaagactcccttaattatattttttgctatatgcatggggtgattttgtttttgtgattctgatgatgcatttgttaatcatatcataccacagatgtcaaagcatacactgctcatgtgccatcctttgctgacacctggggctgggtcatggtatgtagctagccaccttattacaatattacttactgaaaagttcagttccctttctattctttttagatggttttcctttctgctagcatcaattaattaatccgttgctattcttcttcctattattccttttgtatgtaggcatcagattatccatttagcatgaatgctcagcaaatcaatgagaggatcaaggagaggatagatggggagctggtgtacttgagtggggagtccctcatttcctctaccatattgaacaagagcgtttaccagtcgtaagtaactatcagtaaagatcactgtaaaaaaaaactactatacttattttcagcaacacgtgaaagatgcaggtggcatcgatgcttaagtgaaaagatattcagaacattgcactgactgaactgtaatttcttttctttttccttgaaaaaataatactcgcaggctgttgaatgagacgcatgtgtacaccgaggatgatgcaaggttcatctacggacatggaagggcacgttgtgcttgaatcccatatcttacacgcataaacacctgagcaaaatggtgataaattagtagctattttccaacttaagaggtcgagatgcacaagtgtggatagcaagtctgaaattgatcagttagctactagatctccagatcaaccgatcgagaacagaaaaaagaacaagtgatcgatgcaactttgtgaagaacttttttcgcctttgttttcctacgtgaggcgaggaaagaactgaaaaagaactagaatggaataaaaactatataatgctctccatgcatgtgcatgtttcactctttttgttcagcgtaaatgaatggtagctctcttgacaagcagaccgcatatatctatctggtggcatgattgttaacttttgggaattgggagaagagatgactttttggagattgaacctgttcactgctaggctgtacaagagggtaagaaaagactgaaaaggtcttgatacattaacacacatatatattaggctgcgtttggcagggcagagagaaatggagccatcgtttcgcttattcgcggaataagcgaaacgacatatttgcaaacgaaaaataatttgtgaataaaacttttatatacgtgttcttagcgatctaaaagcgaaggctgaaaaataaacttcgataaaaaaaaaccttaaaatcagcttcgtatttaaggttgaaaatttaagatttggctgataagtataagaataagcgaaaatatgaggcccaaaaactcttttgtatttcacgcacacactacctgaactgttaaatgatatttttaaaaaatatatacatataaaagatgttttgagaaatcacattaatctatttttcaagttaaaaatagttaatactcaattaatcacaataatggttcatcttgttttacctatcttctcaagcttcttctttcccccactctcaaacacacacacccaaatacaatgtacttaaatacaatgtgtgtacagtaacattgcatttgaagctacaactatataaatccaaactcgttccttttgcacgattttaatagtgaatcagatttggctcctatatgaattcaaaatggactttttcttccaagcaagaaactccctgaccgggccgtacaaaccccaacctattttgatccagccgcgcgcgtactcccccttcacgcggttttcccttgccgaggccgaccgacctcaacccctcccaccgcccagccgcccgcacccgcgacagccgtgtgatgcgatgcgatgcgctgcgagcctgcgacacgggccacgacgtacgtgtgtctccgtgatgccatgcagatcgatgcattcccccgtacgccgccgacattagctgtccgcgagccgcaacgcgcgaccctgtagtagtggtacgtgtctaattgcagaatgcagacccaagctttggccccccacgcgaccgacgcgtcccgatcaaaagttgatgtcaagtacaaacaacaaatcaacagaatatatataaatttacgtatacaaattaacgacgaactatatgtttgtagtatatatatatatatatatatatatatatatatatatatatatatatatatatatatatatatatatatatggtttaatttaatcgtaaccatgtcctagtgtactgtttagttacatgtaattagtgtgtgtctagttgggcttccggcagttgagcctgacctccaccggcgtcccggcggccggcgcgaggttccccatcttcaccatcgccttggcgaagtccctcgcgaacttcgccccgttgccggcgtacttccgcaccagcgcgtcctgcgacgacgacctgccgccgccgccggcggcgaacagctcctggtccgagtgcagcagcccgcgctgcttcgtcagctcgcggaagtagccgttgtcgaacacgtcgggcgtctcggcgtccagcggcgcgaggttgccgtctccgcccgtgcccgcggggcac

SEQ ID NO: 77744 - DNA, 7967 bp, Oryza sativa
tcgcttgtacagaggagtggttcctggagcaagatctatccggaactcaatctctcgcttgggtggcataccgggtagttcttccggaaacacgtctccgaattctctgacgatggggatttctgacagtcctatctgatgaagttctgagctactgacagaggttgggggtgcaaagaaaacaaccggttgttccggccctcggtacagagtgacagtgcgtctcacgcaatccactactccttggaattgagccaaccaattcatcccaaggatcacatccaagttcttggtgtctagaagaatcagatccgagggaaaaaggaatcccctgaatttctatagggacggcaggactataatactttgctgtcataacccctccaggggtggtgatgaggagagggttcctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacgtcctcggccgtcacgtcgttcacccgaccccgaatgacatccttaccactgttgctggagcggggaggcgcttggccttgctggcgccgcggttttgggcatttgtccgcaaagtgccccagctcgaagcagttgaagcacagacgctgcggaccttgaacgtccttgcggccttgaccagactgcgcggctggcgtaggaggacggggcgcacgggtcccttgctggctctgctgttgctgcggctgtgggacgcgcaccacgaattgaggtcagggcgcggagcgtggttgctgctgctgttgttgctgctgcaaggaggatccccctgaatagggattggtgtagcggatcctttggttagctccctgttgattgcggaaattcgccaagcggcgcttgtgcgactccagttccttgtgcttggcttccaagcggatgctcttgtccaccagacgttggaaatccggatagtcaccggagactagacggacggacagctcaggatccattcctgccaagaacttctcctgcttttcctcatcttcccgtacatcctccggggcgtaccgggccaggttgttgaactcatgcaaatactccatcacggagcggttcccttgcttcaactctcggaattcccttttctcaagggccatgactccggcgggcacatgggtccttcggaaagcggcggtgaagcgggcccaagtaataggctgcccctctggctgcgtagcctggaaatggtcccaccatagagatgcgggcccctgcagttggtgggcggcgaagacgactttctcctcatcgctgcactgcacggtgtctagctttttccccacagcatgcaaccaatccaacgcatccacggggttgttggagctagagaaggtaggtggacggatgcggaggaactcggcgagtttagagtgttgtgggggtggtggtggagcattctgttgtggcggattttggatgtggtggaggaaagcagccatcatgttggcctgctgggcaaggatttgggtgagaatggcgttggtgtctggtggtggtggtggaggcggaggaggaggtggaggtgggctgccatggttgttgtggttgctgccctctggttggttgccatcaccgatattagcacttctcctggtcgtcaccatctgaaaaccccacacagaaccagcaaacagagagagctgactattaaaactaaccacccacgactaccataattcttgaatttattactgctattaaattggttcattaaagtttaagttgcttaagcaaataaaataaagacaggctccgacacagttataccacacaccggcataaccatgccccacacgactccaacaagaagacaaacgagaaagaacacacgcgcaagcctactaactgctcgtctaccgctgcgacgggccaggacggaaggtgagcaacagcgcatcctccgtgctaccaacgccggaggcttccccctcctgaggaaccacgggcgcgggcttggcacgaggggtctcaacgaagcaagtacacgccagggactgacgaacaagctcgggcctggaggtgctcttgcgggcggtgatcttctggctgcggcagacgcggcggcgcttggggcgacagacctctccctaggcgatcttgagctgatgcagttgcgcctccactgcgtctaggtcctttttcagctgcagattctcttgacgcagctccaggatcttcatgttgttctcgaccatcccacggcgcaccatctgatggaagtcgatacgagccgcgtcgtatggctccaccatgcgcgccaggtgcatgatggtagcgtcatcctccgagctagcatcccggaaggtggcgtagtcgcgggctcctccgcgacgagggtggtagcggtagggcgagtgctgcaactcgtccgggtaacgctggtgaagagtgccgatagcgaggagagcggcgttctggcaagcggcggaaaaagaatctccacccgcggtgactgccaacgaagtcctctcgggtgagccggtgaggatcactgcagtaacctcccaagcagcgtggggctctgcatcgtcaccctcctgctctgggagcggcctgccctggtagtccactccatgcggataccccaggacaacgcacatgccccgcagctccaagacgaaaccagtcaggtccagaccacgacggctgatgctgccggccatctacaaacaaaaacaaaaagagaagcaacatttaaatctggaccacgacggctgatgctgccggccatctacaaacaaaaacaaaaagagaagcaacatttaaaagtcagattttggcgataaatgaagcagcaggacagagagagactagaggattttcacaaataagaaaggatttttatttttgaaaatattgctaaggcttgggatctaaggctcgtactagggtcaagggggctctgataccaacttgtcacgaccggaattaacccaacgggcgttccttacgtgcgtgtgttattccttgtcccaggaggcaaggtacaccaagagttgatacatttcagagtttatcaagcggaagcgtaaatagataatttattacatgggcagcgaaggcccagcacacacaaagacaaacgagaaacagcggaagactagggcgacgaccacaggcgcttgacggcaggcacgagctagacaccaaagccttcatcttccagagactcctcttctgggtttgggaagaattgagcaagactgagtacaaccaccgtactcaacaagacacacccacaagtgcataataaatgcaagggagtacaagggagttgtaatataaagggttagggttgcagtaaacagcatttaaagatacttagttgctcaaagctattttgtaaacacgattctagaactatacaatattatttatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattttactctgatcagaggtgtacatctttacccacaagacacatctccctcacgtgtaaccacgtgccacataccaccacggtatacagacggaagacgtgacatagtttccaacccatcctagccatagacaagagtaccgacccaatcccgcctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccacctccatccgtgtacttttgtttataactagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagagggggcggtgtgaatccaattccacaatactccaacaactccacagtgtccaggtgatatgaacattcccaaagtctagagttgtaaaaccgcctaatgttacctaattaaaagcgaagcatctacctataatcgtactagtggtaccatgagtagagtgtccactagttggggttttgtttattctagggtgaacaaggtaataataacaataacaataataaggtcataacaaaggtaaataggcatggctaaataaaacagtgataacgcgggaatttaaataaagcgataatgcaataatttaaatcaacataattttacaaactgggattcaatatgttcaaagatgatgtgacttgccttgctcgctttcccaaacgccggcttcaacttccacgaagagcggatcttccgaagctgcagcgtctacacgaccaacagaaaagaaaaggcttttactctaataaactccatataacaagcagaacaaagcataaaaatgggttcttgacttcttaaggaaaaattagagacttgaacggtccaattccgagttcaaatggccaagttatggccatttgaaggttatatgctctttaaatgaatatttgcgaatttcttcatttaaattttaatttaaaatggatttattgcgtcagccgaggggaggggcgcgcggaccgggtccacgggggtggggcccacgtggcagccccacggcccacggtggaccgggcgcacccgggctcgcaccggccggcgccgtgggtcccacgcgtcagccgcacctaagggcgcgggcggctgacagccgggccccacacggcagccgcggggcgcgcccgaaggcggccacgccggcacagccgacgggaggcggcgcgcccgcgcccctatggtcgccggcggcggccataggcacggcggagcggcggccgagagaggggagggaagggggaaacgaatcggcggtccacggctcaccccggttcgacggcgacgacgggaacggcgaccggagcggaggaaggcggcggcgcggctcgggtggacgaggtcgccggggatgcggtgaagccgaaggtggcgacgccgaggcgggaggtggtccggggcgacgacggcggcggaccggagctcggcggtgacggcggagagagagagcgacggcgcgagctcgattccgacggggagagagggcggcgagtggcggaaacggtggagggaggcacggggagggtttatatagggttaagaaagggagggggtggccggaggagggggaaatgggcgcgggagatccggccgccattgatggcgccggcgaggttaggggagaggtttccaaacgaatccgagggagagagggagggaaaaatggggggaaagatggagggaatcacggggaatatttccccccactttattgcgcgcgtggacggcgggaggcggcgggatttgcggcggcggcggcgctagggcacgggcgaggcggcgggagcggcgggaggaaggggatgacgggtgggccccacccgtcagcgagggtggcgggcgggcccgcccgtcagcggcgcgcgctggggaggccggatgggccgtgggggagaggagagagagggagagagatgggccgagccggcccaagagggggaggggggaaaaggactttttagggtttttctttttataaaatcattttaactttgtttatttcttcttaattattatttgtgctctgaaaattccactaaaatttatttacgcattttaggcttttaggaaatatacaaaaatcctccaagccttatttgacttttaactttgcacattttaattgttggaggctttcacatggattttaattattctaggcataattttgaggatgtattttagagtcattttgggacgcgacacgtggcatataacactatttaatgacatctaataatctaagcgcctctcttaattacattactaaatactactccagagtgctgcagctgacatagagcaatcatggaaatgattattaaacccacaccattgcatatctctggtaagctagctacataataatatcgagacaagtacaagctaaagtctgcactcgaataattatataaatgaagtaagggaccgaaactatataaataagaatatttaattaatgtgtaaagtcttacaaaagatggaaaatctactagccatacccgaaatctcctagagacttgaagaactgaagaaactattctactcctccactagtgctagaacaacgtaaataaactagagagctcttggaatgatccttcttggtgtactttggaatggagggagtgaagtccttaaatatgctgccaaagacggttatggcagctgaaaatgtcagaaatgccccgcaactgtcattggggaatgatcaggagtgtccatgtggaaggccaggatgagaggccgcagtcagggttcggcggaacctgggctggccactgccctctagcctgctgcttcctcctgggcctcctctgatgactccttagcacagtgatatagttgttgggcccttttgcagatgtttaatatagtttataggcccatccagccacaagtctgccacttgacggacgccgattgattgttcggttattttccatctattctcctccatttatgtgaagatctatgtattcaaaattcctagtacaagtggagatagattatttctaataaaatgtgcattgcaagtatctcctttattctggataaattgacggtcgaaattggtctataacatctgtcaacacctatacatgccccttatggtctatttataggctcaggactggatcacgtaaccttaggatttctatgctcaagggaatttacatgactacccatgtgatagggacatatacatgggtaaggaataagttcaccgaaggtccctcaacataacagtgaaattttttaaggtcccttaaccccaaaaccagaaatggatgcacctaaactcacacaaaccgtgcataaaaggtccgaaggtagtatatatgggtggtttcgctgacgtggcatcctagtcagcaaaaaaaattaaaaaatttacatgggcccacatgtcagctgcacatattttttcttctcttttcttctcctctcttctcttttctctcttctcttcttcagggcaatggcgggtggagagacgatgggcatgcgcagatgcaggcggtgggcgagcgctgtggcggagcatggcgacagagcagcgaagcggtggcaggctgcggcggagtagacggcgggcgagcgccgcggcagaacgcagcggcagagcagcgaagcggcgccgggctgcgggcagagccgacagcgggcgaggcggtggaggaggcggcgctgggcaggggtgcctggggtggcagagtcgagggcggagtcgtcagagtcgatgtgggagaagagggcgtgggagatggcgatgtccgatgtggacgtggaagaggagggagagcgggaggacgaaggcggcggcaatgcgggcgaagagcggcaagtgggcgcacatgatggacgctgcatcccggtagatccccaccacgcccaggaactagagcactgtcacaccctgaaaattcaaaatatataaattgttgtttaaatggaatttttagaatttattttaaaagcctagaagggaagatctaatttttaataataaattccaatataaaatggggccagccaaaatttcatt

SEQ ID NO: 77745 - DNA, 25093 bp, Oryza sativa
aaaccgaacttgggccttggaccttgtaataaactaagcccatctcggaagtgttttcccttcaccttcacgccttaacacttaaccctagatttattttcctctataaatgtctatatacaccctctagaacaattgggttttgtttaattgaattttgctaagtaccattcaccttgtctctagtcctcgctcgattagccgacgactatagattcaaagcccccaatagttggtgtgttgatttgccaggttgattagatctaccacttcaatcgcaactattactttatgcttcatcacctattcgcaatatttatattgcatttatcttgttcttacagtgttctctcgtttgcattgcagggatcatcaaccgcgcatcacggttggtacaatatcatttgtggtgtagcgattgcacggtgtcctggacttgttctggttagtagcaacgtctcaaacgtcacactcgatcaaagcgagagttattctcctcaccagaagatcgggccacgagtcagagcgtcatcactgcgaaaattgttttttatagtagtttgttaaaagttgatttattttgggatgtaaagagtataacattgttaacttttaaaatttatcttattaaagaaaaatatataaatattatttgtttttttcagatgaaagttttttttaattattttgatgtaacttgctttattattaatggtactataagtctaatttaactatgccatgcacatttgcactaaatcttagagaagatgtacgaatattttaatgttatgtttaaaagtcaaaattgttgtatatgcattcaaaaacagatggagcttgtctatctgtcaagcttatccgtttagtttgttgccggtatatatggggaaatgctgccgatcggtcgaccggcgcccggtgtccaggatcggtcgctcccccccccccttcccacgtgtccatgtccacctgcttgtcaccaccacatactccattgcaacaaatcacttatatattctggaaaccctctattaaaaaattcgttttattttttttccaaaaaaagttttacctagtgtagtcataatgttttactatgtgtatagatctaatgttgtagtgaattgaaacattcttttgcaacaaatcacccacgtattccaatattaaaaaaattcgtttaattttttgttccaccaaaaatatttcacttagtgtactcacaatgtttcactatgtatggatctaatattgtagtgaattgaaacattctttcgctatttgctgaaacattattttcatataaggtgaaacagtgtccgatttaaacgattgaaacattttcaatctacttagtgaaacaattctgatatacttagtggaacaacgtataatatttaaaaataatttaataataagctaaatttttttcatcagaatatatacatgtgtgatcttgttttaaaaatttaattgcaacgaatttaataatacaatcatatcataatttggataaataatttaagagaaaaaatagtttacgttagcggccgatttttccacggctgatcgagcgcccatcggtagtatcgtccgtatatatgtcgccacaacgtaacaacaatgttaatgtctggatagttagctatacgtgcacgtgtactaaatatacagtattactttacttgcctcaattagtggcatttatatacatacaccagtatatacgtatgcatcaaatgaatgcgtatatatcgaactaatctacgtaccaattttaaatcgtcctagctatattctttttttttttgggaaacctcaccgggggccaggtgcagctatattcgtatattaaatatgtggatgtgactgtgcgtggcctacatgagcgaattttgttccttgccaccgcgtatattccaacgcgatgtgccgttgaatttgcgaattcatatgtgatattctttttccgcaaacacggaaaaaaagaattatacgttaatatattaaaaaaatcatattttctgttacacaacacaaatgacaagagaaccattgccggaggacaaagaaagaaaaaaccagcaaataaaccgaaatgcaaaatataggacttctaaggtaaaaaaaatgttgctcctatatagagggagggtgatggcgtaagaacctccctacactttcaataggcccccaaaagcaacagtgccagtagaagaaaagctgaaaagctttgtaatagatacaatcgcaaacacaaagtgaccctacgttaggcgcaacatgtaaggatgaaaactgaaagagaaacaaatattattttttagaagatgattattggttggtcaaaaatttacatacttatctatttatttatttaatgttgactgtaatacaatgttaaaagaaattagaaagctcaaaatttatatttagataaataaaaacgatgataggtcgattaggaatttcgctgttttcacgtttgtaggaggccttgacctgagcaagttgagcttgagcccttcacagcaaagaggaggagcagcgcattcctggtgggcctactcatgggcctactggccaacctcctatggaccacaaactgaaaagaccggcccatcatctccgctacggatcgtcccaaactcatcccgcccgtaaactcaagcccctcccttttaaagggaataagttcactttaggtccctctatttgtcggtcagtctgattttcgtccctcgaccgcaaaactgggtatgacccgtcccccaacttacgaaaaccgggcaaacgaggtccctcggcagtatgaagggcgcttttggccgacgtggcgcctaagtgcctcctttgactaggtcttcgtcccacgtggcattgacgtggcgattacgtggcattgacgtggcactttcgtggcaattttatccgaaaaaataataaaaatagtgggacccatatgtcagctaaaaaataattaaaaaaaggtggggcccatgtggtcctacctgtcagcctccctcctctctatccccctctttgtcccttatactacacgaaggcgagcggcggcggcgcagagggggtgacggcggcgggcggtggacggagcgacggcgggcggagcagaggggtggcgggagcggcggcgagcgatgggcggagcggtgacaggcggagcggtggcaggcgtgctcaccggccgaggtcgccgcccgcctcgctccctcgttctcgacatgaactcgagggggatcaacgtcgaggcacgaagagggcgagcaaggtccgtgggtagtggtcggcgaggacgggcgggtaggatggtgagctcgagctcgccggctcccctctcctctccctctccactctcagatcttcctcttcttcctctcagctctccctcgtcctcgcggcggagcggcggcggcggcaggccgcgggcagagtggaagggcggacgcgaccacgccaaggacgctgtgcgcaccttcgacgcgagaggagcggcggtgcgcaccggccggcgggagagagggagagaagcggcggtgtgtttggatcggcgccggcgggagggcgagaaaggaacggcggcgcgcggctgccggcgggagagggtcggcggcgcaagccggctaacgtgtgagagggagagaagcggcggcacgcgcagcgccggcggagaaggcagccaacgggagggtggaagaggagcggcggctcgccggcctctccagtctccacccttgttgctctgtccaccgcccttgtaggggagagagagaaggggatagagaggagggaggctgacaggtgggaccacatgggccccacctttttttaattatttttttgtgtagctgacatatgggtcccactatttttattattttttcggataaaattgccacgtaatcaccacattaatgccacgtgggacgaagacctagtcaaaggagccacgtaggcgctacgtcggctaaaaccgccctacatactgccgagggacctcgtttgccctgttttcgtaagttggggatgggtcatacccggttttgcggtcaagggacgaaaatcagactaaccgacaaatagagggacctaaagtaaacttattcccttttaaagaggacgccgctgcagcgacactgttctagggctctcccctttctctcctgctcatcgcatccgcggcggccggctgcggcgacggcggcttggatgggtcgccttcctcccttgctgctcggatgaaccctcgccgcatgcatcgcgatcttgatattcttggcatggaattaatagcgtctcttttttatcccccttacggttcttgatctccagcgcttctctgaattctctggttcttcttgctcgctcaatttacttgttttgttttctcgattgattggttgcctgatcagctgtgctgtggatgcatgcgatgttgcaaaaccgagcgcgctgttgattaatcttatctccctcgggcacggttgatcatgtgcttggagggggctcgatggagctcggatatgaacccttccatggagtttgtcaggcttcctgcgtcctcccttgtacgcttggagtttagaatactctccaacatttcttcctccctttatttctatgttttttattctcctttcaaatgtattattatattgtgtgtttgaggaagtaagaacactgcctcgatcagggaggagcagatcttcaggttaacagattactgaatgagttaggtttgtgaacatatttggtttcagctaaattttatccaaaaccatgcaagttcaatcgaatattagtacctcgcaatgttctttgtccacgatgtcgttatcttgatcaacaaatctgataacattgcaagaaaatagctttacactttttgcagaagaactgaacgatggatgcacgtccgtggactgaaatagacattcagtttcagtatgctgaatgtaagatggcatgtttagtcagtttccactgtcaaattaaccgatcgatcgagcagacttgattcgattttaagcgattccgtttcgagctggacaacccatcgctctcgcttttggcgatctgcacttttgcagttcttgcacagcttcgctttgcctttggtgatctgcagctctgcacgtttatttatttcttacagattattgctagtcaagcagcagcatatttcagcaccgaattttaagcgaggcaccattctttttctttcctgcgttgattcccgccaccttctcgttgcacacaaattgtacatgtgacatgtccatcagtccatgtctccaactctgattgcaactcatatatgtggcccaaagagaccatgaacatgcttaataatctaggaaagcatttggcactgcatatggcacgttctaaacagctaatggaaggtatggattattcatggcctgttttcaggagtactttctcaaaaaactttttatgtcagtattgcttagtttttttgggggggtaagctgtcggcagctttatatatttattctacatatatgccatttaacagaacaaatactttggaatcttacaaattttagatcggccgatagctttaagattcgtgccaacaccaaacccattcttcctctctccctagtctggtgcccccagtagaccagccgcgagtcacaattgatccttgcctccttcgtcgccactgcgtcattgcctggcctcaacagttggccaaacagcgccaacgagccccctgctggcttcctcccccttcccccccacacccttcccccttcactttcccaagctggtgctagcaagtgccccgctcgccaacttctccgtctttggtagccccccgctattggatctaccaccaccgaccggtacatcctaaccacaagccttgactttgccctcgttgccagcacccgcccaccaccttcctccatctccatagctctggcaccaccaccgcctcaccgcccgcccatgttcaccacctatcatggggccacctatatctctaagcctgacgatctcccctctattccagctctcctcacccccaccacaacttagcactctaaactgtaaatcgtcggaccgcccttagttgctagagctggaggaggagaaaaagctaggattatcgaatcacgaaacaaagcttaaggtcagaaatttacaagattttggacttaatattttgttgaatgtgatttatcaattccaatatttattaattcattcatcgttttctttgtctgtaattgtcggagatatgggcccgggggtatgtgaggtagaggagaattactcttcctccggccacgtggcttggccagatagccccactcacacgccacacgtatcatagaagcagcgggagggggggggctcggggtacgacgtcaccccctcggggtatcacatcgccccctcggggtatggcatcgcccccttgagccctaccgcaccttcgccccgaggccctcgccacccccttaaaactataaaaggaggaccctgcccacagtgcaagggtgtggaaccagagaaaacccaaacttcggaagagaggaggcaagagtgctctccaaagaaaaggaacccttgtaacttcatccataatcccaaacacaggagtagggtgttacgctctattgcggcccgaacctgtataatctgtttgtgtactagctcactgagagtcttagggacgacaaacgaattctgagggacgagcctccgcccccggccgaactcacgaaaggggggtctcacgactccctgttattgagggttctccctcgacaggtggagcgccaggtagggggcggttgtgcgtcccgggagaaagttgttttcttccgtcctaaggttttccaggacttggccgactatggtcgaggtcctggaaatggaggaggaggtggtggcattcacccccaccccatcggggagtgaggattccggcgagagccgaggtcctcgtcaccgtcgccatggatctccaactcctccccgccgcgaaccttcgcggagggagaatgccgctcgttcgggtggttcggcaccctctcctctccaaggcggagtgaggccgcgacgcgccggggtacgccgctgtctcgattatggagacggcgattcgccccaaggcgcgcttcaagcagtaggcgcccttctacgacatcccccggtgaacccggagctggagactcctgttcagcgttggctggacgatgtgaccaacttggtcactgctgctcaacggcagttggccataggtggtcgatccgctgccgccggtacatcacgtacctcagtcaccctctcctcgtcggcgaggagaagggctcatcgatcggccacgatctcgaggcggtctatggtcccaacatcatcaggggcctctggaagccggaggcgtcacaaaggcctctacggtacacaggacgctcgaatcaacatcgagcgacgccgggatgagcgccgagctgcccgtatgggcgaaggcgcctcctcgtctggagcgccacattcttcctcacgaggcggtcctcctcccacactcacccctggggggacaggttgtagggccttcgtggcgagtctctggaatgttcggtggcccctgaagtttcgccctaaccttacggagaagtatgatggtaacatcaatccctccgagttcctccagatctataccacggtcatcgtggctgcagggggtgacgaccgggtcatggcgaattactttcccatggccctcaagggtcaggcgtgtggctggttaatgacccagccccccgactccattcactcctgggaggacttgtcccagcagttcatcacaaacttccaaggcacatatcctcgcccaggggaagaggcggacctgcatgctgtgcggcagaaggatgatgaatccctccgttcgtacatacaacgcttttgtcaggtccgtaacaccattccgtgcattccagcccacgcggttgtatatgcgttccgaaacagcgtgcgacataatcgcatgttggagaagatcacctccaaggagcccaagaccaccactgagctcttcgagctggcagacaaggtggccaggaaggaggaagcgtgggcctggaactctcctggcaccggtgcagcggccgcagccacccccgagtctgccccccgctctaagcggtgagataggagaggcaaaaggaaatcagtccgttccgatgacaagagacatgtccttgcggcggatgggcccacatgggccccacgcaaagggaaagctgccggcgacaagccgaaccctactgttccctccggagaggcccggtcggcggacaagtggtgctcggtgcacaacaccgaccgccacagtctcgccgactgccgctcggttaaaaatttggccgagcggttctgaaaggctgatgaggagaagcggcagggtcgacgggagggcaaagcccccacgacctcgaccggtgatcggcaagaggaagccaagaacaaggcccccgccgatgatggcggagacagtgaggatctggatttccagatacctcaaggggtcgtcgccacgcttgacgagggagcttgccctcacacctctcgccgaagcttcaaggccatgaggcgagagcttctggccgctgtccccacgcatgaggtggtccggaaggcacgttggtcggaggtgaagctcacattcgaccagaatgaccatcccacggtgctcgctcggcagggggggggagttggccctggtggtctccccaaccatccacaacgtcaagatgaagcgtgtgctggtggatggctgggccagtctgagcatcatctccccggctgcttttgacgcgctcaaagccccggggatgaagctccagccgtcgctcccgatcattggcgttactccggggcacacgtggccgcttggtcacgtagagtttccggtaacttttggcgattccgccaacttccgcaccgagcggatcgacttcaatgtggcagatctcaatccgccctacaacgcggttctgggtaggcctgcgttgctgaagttcatggccgccacccattacgcctatctccagatgaagatgccaggtcccgctggccccatcaccatttttggtgatgtcaaggttgctctcacctacgcagagcagcgtgcggacaacctggcggtggccacgggaccacaggcccctgaggcatctgcgtctcacgcttctaagaagcgcatcacctcggctgacgaggtgcccgtcaaggaaatcccccttcgcgacgacccgtccaagaccgccaagatcagcgggaccttggacgctaaataggaaggcgcgttcgtctccttcctgcgggcaaattctgtcgtttttgcatggaaaccgtcggatatgcccggggtccccagggaggtgatcgagcaccgccttgccgtgtggccggatgtgcgacctgtccggcagaaggtgcggtgtcaagccccggagcggcaggccttcatcagggaggaagtggcgcggctcttggaggctgacttcattcgtgaggtgatccacccggaatggctggcgaacccggtggtcgtcccgaaggccaacggcaagctacggatgtgcatcgactacaccgacctcagcaaggcatgccctaaagatcccttccctctgccacgcatagatcaaatagtcgactccaccgcggggtgcgaccttttgtgttttctagatgcatactctgggtatcatcagattcgtatggctagggaagatgaggaaaaaactgcttttattactcctgtgggtgctttttgttatacaaccatgccttttgggttgaagaatgcaggccctacttttcagcgcatgactcgtattactttaagtaatcagatagggcgcaatgtagaggcgtatgtcgatgacctagtgataaagacgtgccaccagaacacgttgctgcaggacctggctgaaacttttgatagcctcaggtccacgcacgtaaagctgaaccccgataagtgtgtgttcggcgtgccggcgggcaaacttctcagttttctagtctcttcccaaggcatagaagcaaattctgagaaaatacgtgcaatagagaggatgcgcccccccagcaagcttagggatgtgcagtgcgtcactggatgcatggccgccctgagtcggtttatattgaggctgggtgagagggcgctgcccctgttcaaactcctcaagcgctccgagccgtttgtatggacagaggaagctgagcaagctctcgatcagctgaaggcttacctcacttcccctcccatctaggtagccccagggctagaggaacccttgctactctacttggcagcgactccccatgtggtgagtgccgccctagtggttgagcgtagggaaggcgaacaggagggccctccgacttgcgatggccccttgactctcgaggaaatagcaaccgaactctcctgcatccgggagggccccgaggcacccaagggaggagtgcagactttgatagatggccttaggctcgatgaccccgaggcggtccggggtcccctcgggacctccgaacaggtgcgccccgaatcaccagcccctgacagcacgatccggccccaccgaaaggtgcagcggcccatctacttcgtcagtgaggcactacgagatgcgaaaacccggtatccgcaggctcagaaaatgctttatgctgtcttgatggcctcgaggaagctacggcattactttcaagcacatcgggtttccgtagtgacgtcataccctcttggccagattttgcgcaaccgagagggtactggacgggtggtgaaatgggctatcgagctggctgagttcgatctgcacttcgaaccgtggcatgcgatcaagagtcaaatcctggctgacttcattgcggaatggaccccggtggacgaatcgattccatctaataccctcttcttccccggagaagaagaggatccaaacgccgacattcgtggcgggcactgggtgatgcatttcgacggctctctcaaccttcaaggtgtgggtgccggagtcacgctgacctcgccgaacggggatgtcctcaaatacgtcgtacgtctcgacttccgagccacgaacaacatggcaaaatatgaagggctcctcgcaggattgagggcggcggccggaatgggcatccgccgtctcctggttttaggcgactcccagctggtcgtaaatcaagtatccaaagaatatcagtgcaccgacccgcaaatggaagcatacgttcgagaggtacggcgcatggaacgccacttcaacggagtagagctccagcacgtgccccgacgcaacaacacagttgctaacgagttgtcgcgtgttgcgtcggcacgaaccccactccccccaggaactttcgaggaaaggctcgcacagccctcagcacgacccagccctttgaaggaccccaatgatgcgcccttcgacccaacctctggcgacccgcgtcaggtcacgtggatgaccgacatccgggcgtatctcgatggtaatactcttcccgaggaccgcgcagaagctgaaaagctcgcgcgtatctctaagaggtacatccttgtagagggggccctctaccggcgtgccgccaacgggatactcctgaagtgcattcctcgagagcggggcatcgagctcatagctgacgcccattagggtgagtacggagcccactcggcctcacgaactttggtcggaaaagcattccagcaaggtttttattggccgaccgcattgcaagacgtccaagaatgagtccagcggtgcaaggcatgccagttccatgccaagcagacccaccagccggcccaggccctacaggtcattccgttatcttggcctttcgcagtctgggggctagatatccttggaccgttcaaggcggctcgaggtgggtaccagcacttgtacgtcgccattgacaaatcactaagtggcccgaagcctacccagtcgtcaaaatcgacaagcattctgctcttaagttcatcaggggcatcacgtctcgattcggagtgcctaaccgtatcattacagacaacggtacccagttcaccaatgaggtgtttggcgattactgtgatgacatgggcatcaaattgtgcgttgcctcacccgcccaccccaagagcaacggctaagtcgagcgagccaacgccaaaatcctcaaaggactcaagaccaagacgtacaacgtcctcaagaagcacggggattcatggcttgaggagttgcccgccgtgttgtgggcaaatcggaccactccaagccgtgctacaggggaaacaccttttttcctggtgtacggcgccgaagcggtcctaccctccgagctttccctgggttcgcctcgtgtcgctctgtacaacgaggccaaccaagatgactttcgccgcgacgatctcgattctcttgaagaacggagaaggcgggtggccttgcgcgccgcccgctaccaacaaagcctgcgacgctaccatcagcgccatgtccgggcccgatcactataagttggcgacctcgtcctacgccgtgttcagtcgcgtctagggctgagcaagctctcgccaatgtgggaaggaccatacaaagtgatcggcgtgccccgaccaggttgcgttcggttaaccacggaggacggcacagagctgcccaacccctggaatatcgaacacctccgtcgcttctatccatgaaatcgagattttttttttcctggagctcaggccagcacccgcacaatccctcggtttgtacggaactggccgggggctgccactatgtatcatgttttcctttgaaagcaataaccttctttctatttcttcgcaaagactgctttttcccctttccctctggcttgtcccaactcaaaaattaatctgcgtttgttctaaaacctaagtgctataaagcgaccgggacaccccggaaagggagcacgaacgcgggccatgccccggactgtgccgaaccccgcggggccggaagggcctacacacgatcatccccgacccccggtcgtcgcagcctcggtccggccagtcccgctgggcgactccctcagagcgatggtcttgcttatcgctacttaggttccgtggaccgaacgcgggtctaccttcttgatggaacaagcccgagggggggatggagtcaaacgatatatcaatcgcagactgtctaattatccctttctgccttggctttttctttttactatgtaacaggtattcgatggaaaaggcaaaaaagtgaaagggtttaaagagttttcaattgcagaacaagacaggatgacctaaatacaagaagtgcttgttataggcacacagcaaaaaggaataaaaggtgtgagcaatcacggagtgcccggtcccccgagactggcgccgctaacaatgtcgtcccagtcgtcgccaccgtcgtcgttctcgcttccgctctcctcgtccgaaatgtgtccggaggtgaaccggggggccgacccctcgaagcttgaaacgatagcgtcggccgcctcccggacttgctcccgggcccgtgcttcggtccctgggggaaaatcctcaagcgcacgccacggcatgaagtcagggtcacgcgcttggtggctcgcaaggaccagctccactgcagcccgcgccaaagaggccgacgaagtctttatggtttcaccgacctcctcctctaacctctccaggtttgcagccagcccgtctagccgaagcgcgagtgccggctatgtgggcgggagtttgctgtcccggcgcacggagatgccgactcgacggcccgcgcgctccagccgatcgagtgcgtcagagagctccccgggcccaagctcgttggtgaggcggagagccgcgatctccctagcctgatcctacgccaggcactccaagtcggcgagggtgctctgagccgtggcaagttggctggccaactccgcgccaccggacggcccgctcgctgccaagtctttctcccgggcctccagttcagaggtctttgccgctatcgccgcgcgctcggcgcgggcgctctctagatgacgagcttcgcgcccggcaacagcctcctcgcatctcgcgagttgctcgctcagccagcgcgaggctatctcgcggcggctcacttcagcttcacgctcggcaagcgcggcatcccgttcccggcatgcctcctctcgcagccgtagttcttccgcgtggcgatctgcgtaagctttcgcggcaagggtgatctggtcacgctcggacgcggcctcttcacagaggcgaagggaagcctcgacctccatcgctgttctctcgtgagcggccagggtggactcccactggtctagcaggcgtgctcgctcctccagctcctgggcccgccgtgcctgttctgcaccgcgcgcattttgctcgcgctgatttcgatcgagaacttcgatccgccgacggatcgtggcttcaaactactgcgcggagcgagcacgatcatccaaggctttgcgctcagcctcgagcgccatcgtccgagcctgcagagaggcattagcctctgacacccgccgctcttgggcggcagctgagtcgaggatgccacgggcgtcccggatcctcttctccagtggagtcggcggcggcgagtacctgcagaagcggatccatgctcgccggagtcggggaggaaaaggccgcggtccgcccccgggacaacggggtactgctagatcctccacgagaccgggggctgctctcggccccccttccgcgagaccagccccgagggtgccccaagcgccaggaggaacggctgttcctcttaccccccgcttcggggcctcgggtggattcggcctcggcctcagcctctggttccgggccgccctcggcctcagcctcggcctcggactcaggaccgccctcagcctcagcctcgggctcgaggccactcctggtttcagcgcttgggccacgtcctccttcgccccctgattttaggggacgctccacgtgggctccggtcccggggccgccctcgggaggagcgtcaccacccctatcgcccacggcagattgggtcccgcctgagggccgctcggggtcgggcccagggtgtgacttctaggccccaccgcgaggctgcgaagaccccgcggccttagattggccgagcccagactgcccgtgcgaggggttagaccctgggattccctgggaaggaatctcactacaaaggaacccagatcatgttagcaaaagaaaatgaagagacaagagcaccaaggtgagcgccaacgttcgtacctacggggagggcggttgaaggtccacttcgggggctcgatgaagcttccccggcatggctccgtctaccctatcttccagagccgcttctttttccgaccagcatcaggctcggctagtcgcttgtggcatgatcgcgaacggtctattgcacgctcagcgcccccccctcccccgcgcgggggagagggcggacgggagtaggccaccttccgcttcccctttgggtcgctggcgggatcgcctccaggtccgcggctcgatccgggcgcccttgagtcaccgccaactaggccgctggcccgcccccccccctgctgacggcgctgccaccggcaccgcctcggctggaccggctcctgccggcaccaatggcggacatcacagccaggatgctctcccggtcgcggtcgcagcagaggggaagaatcccgtcagggattagtgttggctcggcggagtccaggcccagcaccccccgaatcaccctctttgcgtcttcctcgccccagtcccagcgctcgcccacatgggtccgcatggggtcgttgggaccggtgtattcccacgctccacgggatcgttcctgaagaggtgcgatgcggcgacggaagtaatcgccaaagaccatcgcccctgtgaggcccaggctccacaggcccctaaggcgatcccacactgcgtcatattcctcacctagctccgacgttgccagccatgcggcagacctttcgggagggccagcgggaactcgaagtcgcggatggtccggcaaggcggtgtagaaccagtccttcttccaatcctcccatttcttgcggaggtggctctcgatgtattggcccgctgtgcccggtcggggctggaaatagcatccccccaccactacgccttgcagcagctgcgggatgaagaaggcttggaacagccgcatcgtcggtcgcaccccaatgaacatctcgtacaaatgcgtgaagatggccagcgtcatcacggcattaggcgcgagatgcaaggcgtgaatctcgtagaaatccaggacttcatggaagaatttggagaacggcgggatcaagcccaccatggcaaaggacaagaggtgtacggatcgctccaaatatcgcggccgtggcagcgactctccctcccgcacgacggcctcttccggcataatcttgcgaggaaggctaaggtgcttgtctaccgtgatgcgggaggaaaggagcactgcgtcgccggcgtcttgggccatagcaactggcggagagatggcacaggatgaggggtctaagacaatgtgaggaggcgggagtgttagggctcgagaggcgaaaggatgagtgagcaattggcgaaaggaagaaggcagagtttccttctccgcccccttctatcctcgcctcatccgcgttcgcctcctcgtttcgtgcccccataactgccctcacgatcttcgcgcccgcgtctgcctctccgcatctcgcgcccaatcattgcgtcgcccgttgcgtccacctccgccttttgtgcgcctgtcagtgacgcgctcgaggtggagtgtgcaacggccataagcgcaattggacaaactgtcaccacttccgtcgcgggtgtagcgggcgagagaatcaaggcgcggtttgagtgatcccccggttatcgcgccccaagcatctttgtcatgagcgcagtctaaggcggtcaaattactgccgtggtaagtgcgctaacctagccaccccaaaatttctttcaaaatccctggcgggcccacaaccccaatttgaagaatcatgaagcgccatgtcaggacaatcctgggaagatcaacacctgatacggcgccaggggctactgtcggagatatgggcccgggggtatgtgaggtaaaggagaattactcttcctccgaccacgtggcttggccggatagccccactcacacgccacgcgtatcataaaagcagcagggggggcctcggggtacgatgtcgccccctcggggtatggcatcgccccctggagccctaccgcaccttcgccccgaggccctcgcctggccgccacgcggcagaggggagcataggctgaacagccgtaaatgcacagcgccccaactgtccctcgcagggcagacgtgcggcgcgtctggctaacccctgctagtcggatgtgactggtctgtaaccggcccgtttccgtcacatccgatggatagggtaatcatatcatcacgtcacccttgaccccggcggagtgggggtaggtgtgacccgtcacatccgggtgatgctcgaggaagggctgttgcatgtcttcgatcatttatgagggaatgaccgggctgaccaccgtgtcaggcgggggacggcgccgggttccactcaaggatcggttatggcttagcttccgagagaaggcacgtcttgaaggccaaaaaggtgaagtggggtctttcccccccccccctttccccggtgagagtaggtagaatcggcgcatgtggtatccccttaaaactataaaaggaggaccctgcccacagtgcaagggtgtggaaccagagaaaacccaaacttcggaagagaggaggcaagagtgctctccgaagaaaaggaacccttgtaacttcatccataatcccaaacacaggagtagggtgttaagctctattgcggcccgaacctgtataatccgtttgtgtactagctcactgagtcttagggacgagcaaacgaattccgagggacgagcctccgcccccggccgaactcacgaaaggggggtctcacgactccctgttattgagggttctccctcgacagtaatctatccattcaaccagttaaaaacctctaaatttttctattaagcatggctttttatcctctattttttttctattaagcattgactttgatgtatgacagtatgaggtggtgacggatcaactcaattccattctacaaaccaaataaaaccaatatacaatcgagcaatcaattcacccatcctatttctcaacccaaacataatctataagtgataatgtcctaagatcaagaatgtatttcagttgcagactttcagtacaccacaaagtgctgcgaaaataatggggccagcactgggggcatgtacaatacaactaccttcatgtatatatgcagagagatctgaagtggtgtggagtaatgtgtgggttaaaagtggcggccgggcgcatatatcataccgggcgtgcatgcgcaaaactgaaagtatgcatactcttgcatatatgctgcaccttcttcccaattgctgccaaattgcatgcatgccgacatcgagcaattctttctcttttcttttcttttcttttttccctctctgcatcttcctctttccaatacgccgaggattgtctttctaggcgtgcactagtgcgtccatggaagcactatctactgtgcctggtatatactagtacaataatgtgctaccacaggagatccaactccaactacaactggtggaactttcattcattcatatctgcatgcatcttcatgcttagctttcttgtgaatttttgagcatatatattcaggcatttatccattgcttgggcatgcaattggcaattgggatagaaggtggttgcttgatgctaattggcatcatagcccagtgcccccagtggtgccagccatggtggtggtggtgcccatcgattaggagagaaaagaaaatggaagagaaaggatacatagttgtttttgtttgttgcaagtacctgacaggcagggcacaatgagtactgatgagcccatgatgcagggcctggattggccagttcctgcaaaatcaacatagaaaaatgcaacatccaacagcataggccgtgtttatttccttctccaaaaattttttatgtatacggacacatattttaagtattaaacatagactaataacaaaacaaattataaattcctcctgtaaactgcgcagataaatttattaagcctaattaatccgtcattagcaaatgttagctgtagcatcacattgtcaaatcatggcgtaattaggctcaaaagattcgtctcacaatttacatgtaaactgtacaattagttttttttcatatttaatgctctatgtatgtgcctaaatattttatgtgacgaaatttttagatgtttgaagggaacacatccatatagcgcctctctgcagcaatctctgcatgcgaactttcaaaggcaggagacgtgctcacctgccattatgctacgagacaaactcaacaagcagagcaggagaggatagctaggttaggtgcccactagatagattttcgatcgaaaaggcgatggatgcatgattgcggcgagtggcagcgactgttggtgcctctgccatctggagcggcaaggcggcgacacaggggtgaggcggcgatcattgtggctctccccggagggggcagcccacgcataatccaaaatcctctcttgatctcatgtcactagctaacctaagtttttttttggatttgcacaacccccctagtgctagttatctcctttctttggagaaaaaatgaaaagaaggttgcacggcactagatacattttgaggtgctgtttggaacatagtcatccaatccatatcttcaatatagatgttcttagagattgaaaactggtgcatacattgcgttgttcttgtcttcgatgagattttaagtgaaattgttgctatggctataatgactcaggtcatgatattaatgggttctgatgaaaaaaatatgaccaaacaactgcatggtgatcaatacaaagagtcaatctaacttacagtgctgcggcatatgtagcacaagccattaaatggttttgtccgatatcatggatgttttgtccttttaaagtattaattactatacgcatgagaatcgattaaaatatgagcatcattgatttttttttttttttgtttgtgatgttaatatggtattttactgaagcactcgatgtgggttgtttcagttggggtgactcaccatcatgatgctaagaggaaaatgctttgacctgattgggggttaatgatggctattattaaagagataataaggtcttggtcagaagggcttagtggaaatgggaagccaatggataggggttaactcagaagtgggagttgtgcccaagtttggctctgccaatgtggccaagaacggctatatgtgctataacattgctttttcactttaatttcttttagttgacacgagatcatgggctgtagggtagtctcatggaaagagctagtgtatgtcttcatttcactgaacaatttggcatgtgcacttatatgtaatcttaactttagaacaaaatcaatggcatatataacctgttacacaacacacgcaacccatcagtatggtcttttgactagtcattggatgaatattacaggtgacagatgcaatagccacaataatgcaattaatatgtccaagaattgcctatatctaacaaattctactttgggttaagccaataattattcatattagcgatattaagatccatagcatatacaaataattgtaatagagggcttggatatttcaatacagggcatatgttgtgtggtgtgttttgttttgacgatgataaactgcctatggaaaatgcactatcaatttcagaaagtatgttttctacacctagctatatgcatgtgattcaaattattgcatagaaattcgaccaaatttctggtaagaaatgaaaacccaaaactattatcaggtgcatatattatcttaaaagcttcctgtatattctgacatactattctttttcttttgcaatagctttgttatatatctagaaataaaaatatatgtatatatgattgattgtaccttaaaaagagacaatctgttttctacaatactctcctagtctcctccatatactctctttgaactaatatatggcgccattgactttttaacaaacatttgactattcatcttatttaatttttttgcaaatataaaaatatttaagtcatgcttgaaaaatatttgatgataaatcaagtcaaaataaaataaataataattacatttttttaataagagaaatggttagaaaaacagagtatgttcagggaaggaggcagtgtatataccttcacctggagatagagatgaagagctagtaggagcgtatagtacggatctttttgcatgtgtatacatggtgatgtgttaattaatcgaaagaaaaaccacacgttgggagtggattggccttgtgtgcacattccattcgcagagacggcagcggccggtgcagcactgggatggatggatcgacctggtggtggctgctgggtgcttctgttatgcgcgcgcgtgctcaagtgcatgaaacccccgcactcgcgccgcgatcgacttggatttacacaacatctgcacgcgcgcgcggaggtgctcatccagccggtgatactctgcgacctgccctgcatgtgttccctagctgtcactactagaaaaatcattttaccagatggtcaaaaacagttttcacaagtgaaggaaaggactgcctagacgcaaaggcctgcaaaaatagttgaattttgcaggcggcatcaccatcttcgcagacggtagattcacccgccatcaaaaacacatttcagcgaataaaaaaaagccgtaccacccacgagcgccaccgcgggcctccccctccgaccgatggctctcctccatccgccaccgcccctacaggcgtcatccttgtcgcagcatttttcgttgtcgtcgtcgcgtcagcgctgtcgtcgtcgcgttgatgccatcgtcgcggcggttgttgtcgtcattgtcgtcgcgtcggcgccaccgtcgtcgcgcgtctcctccccctacccacaggcggcgccgtcgtcgtcacacgtcgccgggagaggaaggagccaagtcgccgtcgctgagagaggccggatccgcgcgcccgggctagctggcggcggatccataggcgtcggtgccatccgttacagctggtggcggaggcggcgagctgcaggggatccacactcccagggcgagccagcggtggatccccaggcatcggcgccatcatggccggcagcggaggcggcgccgcggccggcaactgaggcagcgacgagctgagcctgcggtggatttgtgctatgaacaaatgagagagagatagagaggatggggagggaaatgagtggtggggagagaataaggatggtggagaagaagataaggatgaaacttagatatttttcttggtagcatgatttttgcaggcgcactatataaggtaatccctcatgtcataaatatttaacatttagggtaaaatttctgtcaagctttcaaggctttatctgttaattttatgtaagaacaaatttaaaaaaaatagtaagtttacgatattatcacctcggatgttgtggaacttgactcccatgtcactctctagagagatttaggagaggcaactgcccctaaactcccacactccaccccaagacctccacaacttgacacttctagtgatgggcgatggtgccttccaccctcctccatcttcaccttattgttttctctttcctcctccatttcccttcctcattttttaccccgctctagaatcaagtagggtgttggcggtcgaagtacaattcgttgcacaagggcttcccagcaaagctacatgaagaggttggacaaacgatggttgttcggcggtactgacagtactacgcggaatcacagaaacactctatgtgggataacaccatgtggtggcatgggctagtgggatgacactctatgccggggttgttgccactcttcgctcattccacttcctccatgaagctcttcctcttctaaggttggtctgcttccagcagggttggaaatttctgtcatttcggtcccctccgatacgatattacttcggccgaaatttttcaattttttcatgaatttgggtaatatttgttcaaattcaactaaattttgttcaaattttcgaaaattttggaccgaaattttcaaaatttcgggatttcggtgacccccgatcaaaagccctaagccgatatagtgaaccctggcttccagatctggatgtggggagctccgtgacatggtacggtggtggatgtcagcttggacaagaatagtcaaacatttacatcagtggtttagcgactagtggctaggaacaaacctggcccctagtgcgcaaatagtgtcaagtggtgtggctacacaacaattagtaagggatatgttgtttcattctatgattgtgcatggttgcaaatgatgccttgtgttgggtgtgacctgctacgaggagtcggagttgttgcattggtcattgagcttggcaacaatgacatttgtgaagccaatgttgttgtggtgatatagaagctgtggtcgtggttgttaatgctcttctagcatggtgttgacagtggtggccatgttaaccaacatggggtgtgagacaaaaaattggtgactttcctcatgggtttggtggttgggtaagcgttttagacaaaagcattgtttggcttgttggtaccagtatgatttttgtaggcactgttcatctcattggacacgttgctatggcgtttttacctccttccgacttaggggagttgtttgggtgtgtacctagatctattttagatcacaaaatgtcattttgttggagttttctacttacatgtatcaccttggcccatcccgattcgcttgcttagggtatttggtgatgtgcgggagaaacccgtgacatcttttgatggagttggtgttttcatttgttggtggaggttttcgttaattaatcatgctactagtaagttttttttcctaattttccttatgaactctatagtgaaatgcattaactttctgcccttttataaaagattctttgataaagataataactttccaggcaaatatatgcatgatgtttttgttttatgaaaaattagcatttgagaggctactgatggtcaaaggcttgaaaagtttaaccgaatcatttgtgaacgccaaatatttacgaccaaggagatcagcagttaccaaaagttaagaaacaatttgagagagagagagagagtgtgtgtgtataaccaagacaatctttcatctgatgttaatgccataatgtagctaagagcaaggttaacagtatagccaactactagctccaaaccatttatagccaatttaatagccaactcatacaatagttgtttactatactattaatacatggtcccacctgtcatacacacattacgtcttagagtccgtgctgcagctgactacatatctgttgcctactgctcttctctctcctattttaactttttaaaatatatttacagctggcttatagtctgcttattgtacctgctctaaggagctcttcagttaatccgagacgcagaagcagaagctggtcaggtcagaaaagaagctctatgggactgggctactcaaccttgagtaagctaagagatttcgaggcagaggatctgaacactgcggtcgccatcatgccgcatgcgactccttta

SEQ ID NO: 77746 - DNA, 3484 bp, Oryza sativa
tttgtaaacatgtttgaccgttcgtcttattcaaaaacttttatgaaatgtgtaaaactatatgtatacataaaagtatatttaacaataaatcaaatgataggaaaagaattaataattactaaatttttttaataagacgaacggtcaaacatttttaaaaaagtcaacggcgtcaaatattttgggatggagggagtataaaatagttcctactgaacattgtcggctacttgttgattctttttaggtggtgtttgttcctgtgcacaaataggtctacacatgcacatgcgatttctcttacagttattttggtgctttaaaatgctttacgtattggtaatattagagcctagaggtcaaaaactattttgtatagagaaaattatcccacatagccatctgttgtttattcaagaaaatattctatgtatcttcagggaaccatatgtgatacacaaattcaattttatgtccattgttagagaatccatttgcttgaatcaaaattagagaatcatatatctgatggaaaattgtctttttaccaatatgtttgccttgcagattggtagttcctctcgtcctccaggcaccagctatggacaatatctatacctcaaggaagcctcttcatgttcccctcaatatttctttctgggtgcatgcactctatgcttgctatgcaaaacccaatgtatgtgaatgtgatccttatgctgcaaaggtgctactataaacacttcgttcttttatctatttatttaaacattctttgttggtgtcggtgcattgcctctgaattttagatccttttttagtgcaaaatgcatatgaatgtgtggcattgatattcccttggagatgaaacaaggtattcagtgtttgcaaattaacatttacgagtaggatttacctagctagcatggcctctttcatagccacttttgcatgtatgaatctttgtgaattgtggtcctataggcaaatagaaaggtaaaattacgtgatcaactcgagctctttttcatatttgtgccactcatatttgtcctaagttttaactgtattttaatttaatcttaaattcaggccaactactcttgcggatgttatttaatgaatttggatgtgattgtactgcaagttaatctagaaattcatttccctgttttcataacaacaaaacttttaaagatgatatccctttattgtcattcaagtcagcattaagcttgctggttgaaaatttgaagtttttttaattcattctgaagtatgaagtagtatagaactttctgattttctattggtgtttagctcttaattgttgttttatctgagaattcactgctgactgctagcttaaccatctcaataaagctgatgaagacaaggtgctcgatattcagacgatattggtcaagtataacatatttcatattgaccagtgagaagcatccagaagaagtaaacgaatgagcattgagttccagaaaatggtgtatagtatagatggaattatgaaaagcaatcaacctcatgttttatgtatagtttttattattttgtgaaaggatggtagtgtcaatatgtagagtttttattaatttgtgaaaggatggtagtgtcaatatttagttccagaaaatggtgtattgtatagttggagttagcaagagtaatcgtctagctcatggttttgggaaaggattttggtgttaactattttttcgatcagattatcaaattcaaaactgcaagtattttcacccgaatgttgttcgtgaacccgtgaactttattagcttcaaatgtttttattttctgatacaactcacatgctattttattcaccaactttcgttgtttgtagatttgtattactaccatatgaaaactataaacatgtgatataattattattcgtgctatattaaagtttttattataaaggaattacacttaataattatttaacattatcttactgtgtgcttttaaattggtttataacttttacccgttgtaacgcacgggcatctatctagtgtgtgcatgttttcactattcgttccatcaatccaaggcgtgtgatcccggcggcacgccggcacagccgatgacccgcgcacatgcgggtagatgcacgtggtttggccaccagacagaagcgaacggcatcgctgcgtcgtggcgccgtgcggtagccattgcccatcggccaaatcgcgcaggaccgaaacaggcgctcggcatggcccgacctatccggagcggctgtgctcccgcagggcgcgccgcacatatgcgcgacagcaggggccagcgggcatcgaagcgcttcaagcgcacacgggtacgccgcgtctctgcggtcgctcgacttcccggcacttgtgtatggacgccatgcttgctggcgtagtgtcgtcccaccggacgatggccaagtccaagctcgggtcgacgctcggccacttgatccgatcttgtgcgcatgcatgttgccgcggccacatgtccggccggcgtacatgcaaaacaaacaaatccaattagattagcatcaaggagttagatatgtatatcgacacaatgatgcatattaaatccatccatccacttgtccaacgacatgcatgcatgccgatccatgcatggttgtagcgatcaatacatctcgtcgtgcggctgacacaccggcatctcgatcaccagcggtatatgcaaacaaaagcaataccggaacagatcaatctgtgaatagaaattaatctaataataaaaacagattggaacgacaaaccggtgatggaagagctgctgataacgtgttgtaaaccaacgcgcctattagcggatcaccggatccgttccctgtcccttccacagcagtagagacatgagatgatgtagaacacccgcgcccatcccgttgccatcaagaatattgcagaagtagacaatgaacgcagatataggatggagctctctcttcattatagatctcatctgtagtataagccagccattagccattagatgtcacaccctgcccctgtatatataggggtcttaggagaagatagatcttatctctactccggttcggattggcctacaagaaacttatctccaagagatttgtttcacaacaggacccacctatcatacctcctttccccttttcctctctttttctctctcttgggcaaaaggcatgcactgcagtgctggaacgggcagtggacgggcggcagcgcgcggggatggtcggctcggggatgggcgatggatggcggtgcgcggggatggtcggcgcggggatgggcgatgggtggcggtgcgtggggacggacagtgagcggcgacacgcatagcagcgcgcggacgtggagaggatgggggagggagagtggagatggatggggaaggggaggtcagcgcacatggtggcgtcaccgggatccgccatttg

SEQ ID NO: 77747 - DNA, 6340 bp, Oryza sativa
aatggtcccaccatagagatgcgggtccctgtagctggtgggccggcgaagatgactttctcctcatcgctgcactgcacagtgtctactttttccccacggcatgcaaccaatccaacgcatccacggggttgttggagctagagaaggtaggtgggcggatgcggagaaactcggcgagtttagagtgttggggaggtggtggtggagcattaagttgtggcggattttggaggtggtggaggaaagcagtcatcatgttggcctgctgggcgaggatttgggtgagaatggcgttggtgtctggtggtggtggtggaggcggaggaggaggtatttgtcacatcctgattttcgtttcaggatttataaattatttaataaattaataatagaatttatattaaatgttcattaatttacaagtgaagttaaatgtgggaaataaaatttcctaaatataaagcatggatggatttaatttttattaaattctccatgattaagtcaactctctggaattttctcagattttttcggagctcaattcctaatttttaatcatacaaagagcatttcagtaattacccacatattaaattaatcattaaatggtctaattataattttgttaagtactttgagtgtccaagtatgttcaagatttttcttggaattatttgagcattggaagtatttttaacaattcaaagatcatttcattgattaatttaattggaaaagtaataataatcctcttcctagtcttgggccctttccggcccatcccccctcttttgtgtgcacagccgtgcagccctagtcggcccagccgagtttcccccttctctttctttctttgctttgttttcagccagcccaagacgaaaagtctaatttgcctccctcaacactgtttatcttctacctctagcagccgaactgagaccgatttggctcggtttttctcctccaaatctgatctttccccttgtgtttttctaaaattagttgaggggaaatattcctcttatcctcctctatctttacccccaaaaatcggagcaagttgagtatcttatccgaatcgaactcgttttcgagtttatctccaaaaccgagtttttgatttttccggatcgatttcttgtgggaggagtccgatctcttcaatccaaggctataaataggaccccctagtcctcctctttcgtttgccccctctcccgtggtctcccgtgcctcgtagcgccgccgccacgtgctccaccccgccgtcgtcgccggccgagctccatccgcgtcgcgccgccgcctccgtcgtcgccgccggtcgctgtcaccgccgtaaggtgcgccgaggtgtggagaagcccggccgcctgacccccgaagccgcaggtcaccggagccccgtcaccgccgtcgaccgaagccgcgccgccaacagacctcgtcgccggccgtcgtcgttcgtcgttttgttcgagggtgagtaccgttgggttcgtctcgtcgtcctctacgtgttcatgtcctccaaagtcgcagccgaccatccaatctccggcgaggtcgccatcttggtccggccattgatgaggtcatcatgacgtcatcatcgtttttctttttcctgtttttctaatagattaaatcttcgaaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcaggagtgttcagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggttaatcgtgattggttaattaattacttgccaactaaaacttgataatggtgggttgtgagcacatggttttgagagtcgtgctcatgacaattaaggaccggttcgcgagctactgttgtgaaacatttatcgtgccaaccacaagccagcgtgggcaacggctttatcttttgtgtagcgtgattcattatagtgcgccagactgagaagtggcgagaagtccacgggggtcgctggggagtccatgccttgtttataagggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacatctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagcatgagtgtgctgttcagtgttgattaaaatttttaattaattactctactgttttactactcttaactctttgctaaatgctgctttcgcaaatgagcctatattatgccatcctttggtatccttgtgcacttgcatatttgctgtgtggcttgttgagtatgtcatatgctcattcttgcaataatcaatcaaacctcagttgaagataaaggatccagaaggagaagacgtttggcttataccccagttgagctgcctgtgggagtggagctgaagccatcgctagaccgttaattccgccgctgttttcttttctttgtaagtatgtaacgttattattaagatggatttgtatattaaaattgtcagtttgtgtacctcggctgattcctggacgaggattttatgcacaaataagttcggaaattactagtgaatttccgggcgtgacagtggaggtgggttgccctgatggttgtggttgctgccttcaggttggttgccatcaccggtggcagcatttctcctggtcgtcaccatctgaaaaccccacacagaaccaacaaacagagagagctgacaattaaagctaaccacccacgactaccataattcttaaatttattactgctattaaattggttcattaaggttcaagttgcttaggcgaataaataaagacaggctccgacacagttacaccacacaccagcataactgtgccctacacaacccaacaagaagacaaacgagaaagaacacacgcgcaagcctactaactgctcgtctactgctgcgacgggccaggacggaaggtgagcaacagcgcatcctccgtgctaccaacgccggaggcttccccctcctggggaaccacgggcgcaggctcggcacgaggggcctccacgaagcaagtccacgccagggactgacgaacaagctcgggcctggaggtgctcttgcgggcagtgatcttcagactgcggcagacacggcggcgcttggggcggcagatctctccctgggcgatcttgagctgatgcagctgcgcctccactgcgtccaggtccttcttgagctgcaggttctcttgacgcagctccaggatcttcaggttgttctcgaccatcccacggcgcaccatctgatggaagtcgatacgagccgcgtcgtacgcctccaccatacgcgccaagtgcacgatggtagcgtcatcctccgagctagcatcccggaaggtggcgtggtcgcgggctcctccgcgacgagggtggtagcggtagggcgagtgctgcaactcgtccgggtagcgctggtgaagagtgccgatggcgaggagagcggcgctctggcaagcggcggggaaggagtctccaccagcggtgactgtcagcgaagtccgctcgggagagccagcgaggatcactgcagtgacctcccaagcagcgtggggctccgcatcgtcaccctcctgctccggaagcggcctggcctggtagtccactccgtgtggataccccagggccacgcacatgccccgcagctccaagaagaaaccagtcatgtccaaaccacgacgggtgacgctgccggccatctacaaacaaaaacaaaaagaaaagcaacattttaaaggtcagattttggcgataaatgaagcagcaagacagagagagactagaggattttcacaaatacaaaggatttttatttcgaaaatattgctaaggcttgggatctacggctcgtcctagggtcaagggggctctgataccaacttgtcacgaccggaaataacccaacgggcattccttacgtgcgtgcattaatccttgtcccaggaggcaaggtacaccaaaagttgatacaattcagagtttaacaagcggaagcgtaattagataacttattacatgggcaacgaaggcccagcacacacagagacaaacgagaaacagcggaagactagggcgacgaccacaggcgcttgacggcaggcacgagctagacaccgaagccttcatcctcctggaactcctcttctggggttgggaaaaattgagcaagactgagtacaaccaccgtactcaacaagacacacccacaagtgcggaataaatgcaagggagtacaaaggagttatactataaaggggttagggttgcagtaaacagcatttaaagatatttagttgctcagggctattttgtaaacacgattctagaactaaacaatattatttatcaaggccgtgaacccacacgaacctgccttaacccaaggcctacgatgattcggaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattttactctgatcagaggtgtacatctttactcacaagacacatctccctcacgtgtaaccacgtgccacataccaccacggtatacagacggaagacgtgacatagtttccaacccatcctagccatagacaagagtaccgacccaatcccgcctatggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccacctccatccgtgtacttttgtttataactagactgagccacaaactaagccttacccactagacatgtggaagtacggtagtgctttgcaacagaggcccgaagaccggtccttatatggccgaggtgctactatcaaaaccatttttggggattttgaatagagggggcggtgtgaatccaattccacaatactccaacaactccacagtgtccaggtgatatgaacattcccaaagtctagagttgtaaaaccgcctaatgttacctaattaaaagcgaagcatctacctataatcgtactagtggtaccatgagtagagtgcccactagttggggttttgtttattctagggtgaacaaggtaataataacaataacaataataaggtcataacaaaggtaaataggcatggctaaataaaacagtgataacgcgggaatttaaataaagcgataatgcaataatttaaatcaacataattttacaaactgggattcaatatgttcaaagatgatgtgacttgccttgcttgctttcccaaacaccggcttcaacttccacgaagagcggatcttccgaagctgcagcgtctacacgaccaacggaaaagaaaaggcttttactctactaaactccatataaccagcagaaacaaagcacaaaaatgggttcttgacttcttaaggaaaaattagagacttgaacggtccaattccgagttcaaatggccaagttatggccatttgaagtttatatgctctt

SEQ ID NO: 77748 - DNA, 4783 bp, Oryza sativa
ccatcccttccacctcccagcgcgctgccgttcatgtcgtctgcctgcccgtccatgggcgccgccacccaccgcccctccccttccatctccatctcctccccttccccatcgacctctccctcccccatccctccacctccccgcacgtgaccgcgcacccgtccacgagcgccacaatgtgcccactgcctgttcccgtgccgactgcccgcccgtccccgcgtaccaccgtcggccaaccacccgtctccgtgccgccgtgcactccttgcaactaagagaaagagaaagagagaggaagaggggaagatgaggtatgacaggtgggtcccaacatttttttaaaaaaaaagaagtgctggttggattgccacacgcacaccacgtagggcaaaactattctagattgagccgagtgtggtaattcgtccagtattaaaagttcaaggttaaaatttggtcgaccgcgatagttctgcgagtaattcataatttttccttactagaaaaaaatacccgtgtgttgcaacaggtgaagactaatttaaacttattatttttatatggtttaattaagattaaattcacagtgggaattcgcttgtatatatatatatatatatatatatatatatatatatatatatatatatatatatatatatatatatatatatatatatatatatatatatatagaaaaccatgagctgcagttaagagcccgatcatctcaagttagcatgcgagtttttttaagagatttcttatacgactcctatatttccaaaagcgaacgaacttaaaaactgactcatataagaatatataaggatgacgatccaaagtaccggtaaaaacatctttaatttttataataaggatagatttaaatttagactaaaatattttcttatggaatgatgattcgcaggatcaggacaaaacgaggcatctcttctgttgtgctttcttggaaataaattccaatgattggccttgtgatgccatataattggattcgtcctttgtcatggtaaccgatatatagtactcccttcgtttccattctagcttattcattttgtgacgagtgggtaagcgttaattttggtagcaatggatgacaagacgagaagattgaaaaactatgcagaaattttgagagattgtcgattgataaaggaacacggcattggcatacatgaaggaacacggctcgttacaagatactttgttttgtttttttttttctaaaagatgtactacctttgtcttagacttagagtatagcaatctaaaattagacataactcaatccggtactacaaaactaaacaagtcacctgtccagatttataattctaggttaattctctattttagcttattatattctaggatgaagaaattagtatagttataaatccaagaaacatcctagcctccgccttcttaaaatatgtacatagctacattattacgagataggaacatttattcgacagaagaactaaatttcatggtaccattattacacggcttctatagattaattaatcaatacgtggatatatagggaactcgaggtattgcgtgcaaccaaagcttggacttccttcttaccgtgataccaaatacctctgtcatgtctagctcctcagatttgatgccgtcgggaagctcccaatcaaagtggtaaagaaggctagcaagagcaagctccatattagctaaacctagcgctataccaggacacatcctccgcccagctccaaacgggatgaactcaaagtccgcccctctaaaatcaactgtactattctcaaatctctctggcctaaatatctcgccatcgccccaatattcgccttccctgcctatcttccacacgttgacaaagaccttggtgccctttggcacatcatagcccatgacctggcacgtctcgcggcactccctggggatcaggagtggcgctggcgggtgtagccgtagggtctccttgatcaccagctgcaggtagctcagcttggcgacatcatcctcggttagcttgtcttgtcccttgaacgtctccctcacctctgattgcgccttccgcaagatccgcgggttcttcatcagctccgacatggtccagtctagcgtcgtcgacgacgtctcgctcccggccgagaagatgtcctgcagccatgagatcgaccagacacgcatcatatatcatgcatgatgcatgccgctgtcacgctaaaagattttctgtttgtacttgggatttattgcaattaagcaggtgttaattactggagtacggtgtgagatggcttacgaaaatgacggtgctgatgatctcggtggtgagtgcgaacttgaggccgccgctcctctgcagccggagaaggacgctgagcaggtcctcctcgtctcgctccggcggcggcgcgccgtcgcgatcgcggatgatgctctcggcgatgcggtagatgttcctctggcaacgcgccatgtcccgcgtggccgcgctgagccggcgcaccagccgtgaggacgggtacaggtcggccaagttgatcccgccggtgagccgcaccgccttgtcgagctcgtgcaggaactcgtcccggtggtcgcaccgcgcgccgaacgcggcgcgcaccacggagtcgttggtcatgcggcagatcctctcactgaggttgaagcaggcggcgccgccctcggcggaggcggcggagacggagcggaggagtcgccccacctcgtcctccctgacggggcggaaggagagcacgcggcggtggttgaagagctcgagcgcgcacaccttgcggagctcgcgccaccgctcggtgtagggcccgaagatgatgtccttgccgccgcagctgaggatgtcgatggtggcgctgaggtggcggccggcgaaggcggcgtcgtgcgccctcatgacctccgccgcggcctcggcggaggagacgaccagcgtgggcacggcgccgaggcggaggagcatgagggggccgtaggtcagggacagctcgcgcatggcccggtgcggcaggtcgccgtaccgtgacaggaggaggtggtgcaggctgccgatgagcggcagctgcgacggcccgggcggcagccgcagcgcactctccctgccggacggcgaggcatagcgggcgatgagctcgacgaggaagaagaaggatatcaaggccagaagcagcagtgtcgtcagctccattggtgctagtttgcaagtgagcgtgcagctgtactgacaaaagccagatcatattcatatgggtccctttatattggagcggtaggtggtcagtgatcattggatacaggatacttttacagtgacggagcttgagctaaatatgtgtgtggctagtgctaattgacacaggaatcactgatgttaaccaatatagcaaaatatctctcttgagctaaatatgtgtggggctagtactaaatttgcatatatcaaatactaatattttttaggttaattggattcataccattacaaatatgtcattttagataaatgccattactatggttgcgttcttctccctccttttccaactcacctctcttttttttccgcgcgcacatttttcaaacggctaaacgatgtatttttttaaaaaaaaattatatacgaaatttactttaaaaaaatatattaatctactccctctgttttttaatagataacgccgttgactttttctcatatgtttgaccattcgtcttattcaaaaaatttacgtaattataatttgtttttttatgagttgttttatcacttatagtactttaagtgtgatttatatattatacatttgcataaaatttttgaataagacgaatggtcaaacatgtaagaaaaagtcaacggcgtcatctattaaaaaacggaggtaatatttttttagaaaagagctaatacttaattacgtgcttatagagaaaggctattggcacatccatgtctcctaaaatcctgttgagagtacatccacatgggccgatattcgtgggcaccctatagtggatagaacgatgcacctataatttcaccatcatatgaccggtgcatctaattctattatttgaccatcatattagcggttcttctctaaattctaacactttcatcccgtagtgattcaagatactgtttgcttgcacgtattatatgacattaaccaaaaacagagtggtacaaaaagagtagatggatgcatagacgatagatgtatggctccgtgaaggccgtaaccaagtggcgtgaaaagaaaagttggatacacgtatctcctatcaccatacatatattttttaaggggaaactattttgatcccttaagaggatgtccccttgctatttacatcactactacaaaaacccttatagggactggccttataggtgccggttcatttataaccggcacctatgaaacttttcccacatccgcacattgaaaaatatacaaccgacacctttaaggattataggtgccggttcattagaaaaaccggcaccaatactatatgtaccggtttttaaaaagaaccgacacctataatatataataggtgccggttaattaaaaaaccggcacccataccaaaccgagccgaactgggcgagccgagccggcctcatctccggacttatctgcgcgtaggtccctgcttctcttccttatccgcgcatcttctcctccggccttatccacgcgcgagagagaagtctcga

SEQ ID NO: 77749 - DNA, 3839 bp, Oryza sativa
cgcgtccaccacctcgaacccgcgcgcggagccggcgttcgcgccggcgcccttctccccggtgaaccccggcggcgcgtcgtcgagcaggacggacccgtcgcagccgttcacgaagcagtcgtggaagaagagcctgagcacggacgcgcccatgcgccggtccgccgccaccgcccgcgccatcaccgaccgaacgacggactccacggcggggcacgtcttagcatagtacctcgtcgacaaaccctccgccacgccgacgccgccaaagccgccatggcaggagacggcgacgagcagaagggcaccgagcaagaagaccctccggcccgaagcagacattgccgccattgtcgcggagaacttggcgtgccgcgtcggggtggcgcgcggcggcgacgatcgaggtggtggtatttgtagtggcgggaaagcatttattgtaggggggcatgggaggagggaaggaggcagctggccatggctgcggtcggttgaccgcacgcggaatgggtcgcgtcgtgggctgctcttgtgctcggtttatcgatggatggatcgatctggcgtccgacgcgagcgagccaagctgctgacctacataggagtgtacatgttgatgaggtgtggtgtagtaatgacttggggttgggacgtgaacgtgacgagctgagctaaggctaagagatcgggtggtgttttctttgcttctactccatttccggctctatctgcttttgtcgtagtagtaacaagttagcactagtgctgctgttgcgttttccttgtggcgactcatcaagtgtaggttcgagcgaacacatgccgtgtgccagtgccaatcaactatgtttgagcatctccatctgacttcttcaaatatctatttaactagcttgctaaaaaatagagagttaaatttacctttcacgtcaacaacctttctattacacttttcaatttaacaacatctatgtgcttcttcctccttctctccctacccatcccatccacctctctccacgtttgggcaggcacagcgacgacgacagacactagggtactagccaagaggtggggcgattgcaacaccggcgagccgactaatgggggtcaccaccgttggtggatgggccatcctcatcaaacagttagatcctcgcctccccccccctagggttgccgatttggcaccttgcgccaactgctactccgttatcgtcctttgctccgcatttgaatatgggcaccgcgtcaatgggaaggtgaggcagacgcgccagagagtgaggtgtagttgatgaatggcgctagaggtatgttggtcgatgctaaaggtcaacaacaatgaaggattctggaggagagagagaaggaattaggaacgaagatgtatggggccacctgttactcagcgagtgtgcaattgtcagatttggccagccgaatggcttggccaaccggttggaggggctgttaaaggatttttttttgtacttattaaaatttagcttagagagctatttaactactcttttgaagatactctaacctccaaggcaacctcatttcaaaaaaaaaaacatccaaggcaaccgtggtctcttgcactagagatgaggcttagagcctatttgaggagcttaagattatgagatgtgagatgcagttggttggtagccaccttctgagaatcagcttatgagaatatggaaaagctgggtttcccagcttctgtcttctaatttattttctggattttataactacagcttcttaaaatttggaccaaaagctgaaccgtttagaggagcttttgatttttaggagaagctgcaccggctaaaagctctcaaaaggcccttaaatatggtcatggcatcgtcacgccatgtccaggtaaagtgggcttgtttggaccataaaactcgatcagtatttgggcctttggtcacggcctcatggagttacgtcatgggtcagccggtgcagaacggcaacatatgtagttggcagtttggcattcacaattgcacaagcccctgataatgtaggcgcaaacagagggtttgtttgtttgttgcagcagcctgtgaccgtgacgatcgatctcatattctcattattgcgttgcgcatgggattcgctcatgaacgaaccgatgaaccgtcgtggctggctgcgcagccgcagcgcgagcaagttccggcacgtacgacgcgccgacgtcgcgagaggctgcgcgcgagcgaaggtttcctcctcatccaccgatccacgacgacgactgtgctgctgtgcgcgcacgagacgagatggccggaaggcggccgatcgagctgtggctacgcgccgcgcagggggatggatggatggatgcctggatggtggcgttggcgcgccgaggcggagatatcccaagagttgatcatggcgtccgtattccgttggggctcgctcggtagtcgagacgcggtttacgcgcgcgaagctgttgcgccaaccgccaatatgcatcaatccgggcagccgcatacccgcgccggttttgctatcccggcccataaggcccacgcacgcgcgctagaattttttttccgctggcgccggtttttccgttttctcttctgttttttcttttcgtgttttcttttcttttttttgcgcttttttcatattatactttctttaatcttttagcacacgtgttttttatatgtattgagttgaaagttttaaaatattgacttgaaaattttcaaatctagcaaatttttaaatctcgagtgaaaattttcgaatctaagtcgaaaattttcaattttttcaaatctagacttgaaagttttcgaatctgctcatgggctttgcttggtcgactgcccgatctgctcatacctctctgattctcagtttgggtttgccctggctagctcgatacaattgggtctgtttggctgtccgtacctagatcaaccaagaccagactgaatagcatgagacgtccgttggctggtatagtgtaaattttttttagataatagaaatatataaaacccggcttctacaccgtgtatacagccacagtggtatagtgtaaatgctcctatgtatataaggtattatttggttggttctgaatcatatgtgtagttactttttcatttgattgtgaggttacctctttgacgtataatactattgttaagttttaagcattttaaattatagtaaccagtatagtggcccgcgctaacatcattatattttctcttatataataacatatatgttttctcaacgtattattccaatatattaaatgacaacataattttaaattttgtactaactttacgaaactactaatgtgtaatattcatattgtattttatatacgtgttggttattaattatttttaatatcaaattttagttatttgtaaattatattcctatattcctatatgttctttttttaattccaaattttcgttagctgtaaattgtatttctatatagactctaggctcttcttccaatattatttatttttaattctgaatttttattatttctaattggatttctatgtagactccaaactcatctttcaatattctttaatttttaattttgaatttcagttacttctaaattgtattcctatattgactttagacacttctttccatgtattttttttatttcaaattttagttatttgtaaattgtatttttatacgaactctaaactttacttttaattttattatgtttattccgaattttagttagttttaaattcatatatagactctatactctacttctaa

SEQ ID NO: 77750 - DNA, 1270 bp, Oryza sativa
attttcaaaatggaaaattatttttgtaaaacttttaataaaaaaaattataaataaaaaaaattccttgacgagaagggcaccatcgtgatcaatcatctgtctggtgggcccaccacaatagactcgggaggcccaagttgatcccaagccgcacgatcaaagccgatgcgcgtcatgattggatttttgccctttgcccctgccccctcgctcctcgtggtggggtgcacatgacacgactgcttccgcgtttcttctcggcgacgcaccccacacacgcacacacacacctccattcgctccccgccacacaacacgagaaaccccccacccttcgctcgccgccgccgccgccgccttccgccgcctcgaaccggaccaaccaacgacggctcgcttccctccgaggcggtaggccacctcctcccggcggctcccccatctggccgcccggcgccgagctggggatccatccgcccgcgattcctctcgccggtaacgactccctatcttcgctgcttggatttgcgaacgacagaatcgaatccagatatatctctctcggttgaatccccgtcgcgttttagtcatcatcattcgtatcgtaggtagggaggatttaggaggagtaggggttccgagtcaacaatttttggtgtgtaatcgtggtgactttgtgaccaggtttgctctccattgccagctgccggtggccatggatgacggggacctcgatttctccaacccggacacattcctctgcccggccgtcggtggtgctgaccccgacggcagctgctccatggacagctatttcgacgacatcctcaaggatacggagcaccatgcatgcacccacacccacacctgcaacccgcctgtgcatgacctctcacacacccacacctgcgtccatgtccacaccaagatcgtctccgccccatccgacactccgtcggatgctgccgagaccgccgagtccccgacggagaacaatgcctccaagaagcggccgtcgggtaaccgtgccgctgtgaggaagtacagggagaagaagaaagctcacactgcctcgctggaggaggaggttgttcatttgagggctctaaaccagcagctcatgaagaagctccagaaccatgccacgctcgaggcagaggtatccaggctgcggtgcctgctcgttgatattagaggaaggattgaaggggagattggggcttttccttatcagaggccagtgaagaacatcgatttggtttctagt

SEQ ID NO: 77751 - DNA, 3388 bp, Oryza sativa
aggataaaagtcaattgtgtggggtgttaattgacagtcccctctcctccaagggggccatggtatttatacccataggtatccctttgtccaagtggacttagggaaccaaatatggatccaatcgaggaagtcattgttgtttccatgaaaaattctggttgtctttctttatccggaactccctcgaggtcagttcccgtataagacatgatatgtggtggatcctgccgagatttagttacctattattaggtatgtggtatccatacccctgacagtagcccccgacttcaatgcaaatgaacgaattcatattctcgaccgctaaccatggaataactgttatcgagctcaagtgaccgttctcggtgagttcagagataacgttagacttcttttgtcagcctcgggaggacacctaaagggtttgtctgagtcaatctccgacgtcaaccaagaaagtacagagcatatgactaagtctcctgtcttgctataatcgagaatttggattgaagtcaagaaattttatctcggcgggtacaccatctcttcattccgtattccttgtcgagatccaccaactgttctcgagcaatcgagaaggcgtagaatctgcgacgaagccttgtcaacatttgtcgtactcgccttagtcgatcttggtgtacaaccatagagacatggagtcttcgataatgtcgaatagaattttcctgaaatcaatactcagaaaagaatattagatagaaatagcccccgagtgaacgctcaaagggtaacatgttataatatgtatggaaaaccgaaaatgaattaaacttacagaccaatgttttgtatatgagcgtctactcttttaccgacttcgatcagtcagtttgttgagttatacactctccctagcccccagccttgtcatcggagaatcgttctcggaagatatggctcctggacctttgacctgcctcggttgaacaagcactgatcctagcccccagccgtgaagttggaaaatccaatttccgattacacggcttggttaatacgcacggtgagaactcttacacaaccatatcttacatggtctttcatctctgaaggatccgacaaggccttatcggctctgggcatccccagccgaagttcccttaggttcctcagaggccttggcaagacggcgtaaagggacattcggataggtttcaactctaggtgtcatcgaggtaagggatctcagggtaaaacacctggtgatattgggtacctgatatcaaactttgtgaagtagaggtaatgggagaatcgctacacctctggtcgaggaccaggtagtagtcgtaacccgaccacttgaagtggaaatagtgggagaatcgctacaccgctggtcgagaacagctagtagtcgtaactcaaccactataagtaaatgtacgagagatcgctacgattgactggttgagaaccagtgaataggtgtctctcgatcatttgaagtcgtggtgcgaggaccgctgcgttattgttgtagtcgtacctcgaccatctgaggttgtggtgcgagagattgctacgtactggttcgaggaccagcaaacatgtagaatcatctttggaacaccaatggaagttgcggtgcgagagattgctacgtactagttcgagaaccagcgagcgtgtagaattatctctcgatcgaggaccagcgagcgtgtagagttatctctcgaacaccaatggaagcttgcggtgcgagagattgctacgtactggttcgagaaccagcaaacgtgtagaattatctctcgaacaccagtagaggtgctagagttggtttattacatgtgcgtctcatgtggccagcatgactcacacacccaactcgtagcatatccggatgttcgttcgcaatcatatcgggtgatcaagccgacgatgttcgcgataattatccgttaacaaccttttctcgagtagtccagccatggccggtgctatgagataggtcgtcggtcttcgttggcaggttggacgcgacgactctgcatttgtcgaggtcgttctcgataatgcggtgtactcgaccacaacctactcgagtgctcaattgttcctgaaaaatattttctagaaggcaagacatacagcagagaatatcgagtatgtattcgaaaaactgcatggatcttctagtattatcaggatatagcgagcagaataaatatcaggcattatgtaaaccgtaaacaagtatgatttatatggaagaaaacagagcgagcccccagcgttagaccatagtctatttaacatcggggacacacgcacaatagatattgtatagaaaacatgctctaggtaaacataataaattatagatctgacaatattgtacgatctgaataggtacgataaattgcatataaaatattgcgtacctttgtagatacatgccggatgtatctacgaaattagtagattaatttaaaaaaccaatctaccaattaccttgttgcgtactcgttcgacatcatatgatctgacatcttctggtatgccgcgaagcttaaggcttggatgatctcgatagaccaagttgtcgatgatgatgagcgttccgatctaatcggaagatgtacttggacaggttggatctccccacagccgaagtcgtcgagtagcttgttgtcggagaatccatctctcaaacccatctcgtcgaaaccttgaagcaccaaaatccccctacctggcgtgccactgtcgacgtttgatgtctcgactacggtatttgcatggcatggggatcgttggtactagggtatacgcgagactgagataaaagagatggagatgaggatttttatacaggttcgggcccctgaattgttaggtaataaccctacatcctgttggccgaagccagtattgctcttattcatgataatcacaccagtacaatgtttggggtagcctatctaactgttgtcgacatggcagtctgaagatctgactcgtagtcgaccataggtagcctttctcctcgaatccgtgcccggcgagatcagagatagcgctttcatctcttctgacagtatccaaagacaccggagggtactaacccagcttattcctgaagtcgatattcggcggcgtgtcttggcttatgtaagcttctatggtggggcttctatgtcaaatgggttgggtgttgattgtccgtccccttttctctagggggccttgatttatacccattggtatccccttgtccaagttgaacttgggaaaaccaatttggatacattcccggtagtcattggttgttacacagaaaacttttggttgtctttccttatcaagaaccccctaggggtaagtt

SEQ ID NO: 77752 - DNA, 19037 bp, Oryza sativa
ttattgaaatacggaagagagaaaaaagataagtatatgcatatgtggtagcccccggccaaccctgcacgcccgaggggggtgcggggttggcccgagcccgagacctgacacccgacccccactaggggtagaagcgacgaaggtgttcgatgttccacgggttaggcagctctgtgccgtcgcccgtggccagccgaacggagcccggccgggagacgccgatcactcgatacggaccctcccacattggtgagagcttgctcagtccagcacgcgtttggacgcggcgtaggacgaggtcatcgacgcagagtgattgggcccggacgtgacgctgatggtagcgccgcaggctctgctggtagcgcgcggctcgaagggccgcgcgccgccttcgttcttccaagtagtcgaggtcatctctgcgaagctgatcttgatcagcctcgcagtacatggtggcccgaggggacctcagggtgagctcggatgggagaaccgcctccgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttctgcgttggcgcgctccacttggccattgcttctggggtgggcgggagaggcgaagcagagcttaatgcccatgtcttcgcagtagtcaccgaagagctcactagtgaactgggtgccgttatccgtaatgatacggttaggcaccccaaaccgagcagtgatacccctgatgaatttaagtgcggagtgcttatcgatcttgatgaccggataagcctcgggccacttagtgaacttgtcgatagcgacatacagatactcgaacccgcccggggcccgtctaaatggacccaggatatcgagcccccagacagcaaacggccatgaaagaggtatggtctgcagggcctgggccggctgatgggtttgcttggcgtggaactggcacgccctgcaccgccggaccaagtcgaccgcatcgttgagagccgtcggccaatagaaaccctggcgaaaggccttgccaaccaaggtgcgtgaggcagagtgggctccgcactcgccttcatggatatcggcaagaagctcgacgccttgttcccgaggaatgcacttcaggaggactccgttagccgcgtgccgatagagggtcccttccaccagcacgtagcgcttggagatgcgctggacgcgttcactcccttcgtggtcctcgggtagagtcttatctgcgaggtacgcctggatctcagcgatccaagcaatcaatctaagggagctgggagcgctcccctcgggtcccgaggcctggactccgacgggcctcgggggccgttcaggcgcgtccgtctcccctagggggtcgggtcgcgccgacggctgggcaagcctttcttcaaaggcgctcggtggggtctgggctcgcgaggaagcgagccttgagagttcgtcggcgaccgcgttatcccgtctgggcacgtgccaaagctctatcccgtcaaaatggcgctccatacgccgcacctggcgcacgtaagcatccatctgcgggttagagcactggtactccttggagacctggttaacgaccaactgagagtcgcctaacaccaggaggcggcggatccccagtccagccgccactctgagtcccgcaaggagtccctcgtactctgccatattgttggttgcccgaaagtcaaggcggaccaggtatttaaggacatctccgctcggcgaggtcaacgtgacccccgcaccggcgccctgaagagacagggagccgtcgaactgcatcacccaataggcggtgtgaggcagctgcgaagggcccgagctggcctcggggatggagacgggctcgggagccggtgtccactctgccacaaagtcggcgagggcctggctcttgatcgcgtggcgtggttcaaagtgcaaatcgaactcagagagttcgattgcccatttcaccacccgtccagtaccttctcggttatgcaagatttggccgagcgggtaggacgtaaccaccgtgacctgacgcgcctggaaataatggcgcaacttcctcgaagccatcagaatagcgtaaagcatcttctgggcctgagggtatcgggtcttggcgtcccggagggcctcactaacaaagtagacgggccgctgcaccttttggcggggccgatcctcttcgctaggggccgcatctccagggcgcttttcgtccgagaggccgcgcggggcgcactcggcttctgtgtcgacgacctcggggtcggaaggcgacaggcgcggccttcccgcagtggccctggggccatcctgggggtcgggggcttctggcaccgtcggacaagcgggcagagggccagctccggtcgtcgggggcctcgggccgccgttcggctcgggggcctctcctccctgctctctcccgggtcgagtcgatacagggtgctcttcgtccgagaggccgcgcggggcgcactcggcttctgtgccgacgacctcggggtcagagggcgacaggcgcggccttcccgcagtggccccggggccatcctgggggtcgggggcgcctggcaccgtcggacaagcgggcagagggccagcttcggtcgtcgggggcctctcctccctgctctctcccgggtcgagtcgacacagggtggggatgcgcggagcgagggtcgtcctcgtcgcgctccacgaccaacgccgcgctgaccacctgcggagttgccgccaggtagagtagcaacggctcatctggctccggggcgaccaggactgggggagaactgaggtacgccttcaactgagtgagggcccgttcagcctcctccgtccagataaacggcccggagcgtttgaggagcttaaataggggtagcgccttctctcccagcctcgatatgaaccgacttagggcggccatacagccagtgacgcattgcacatccctaagcttcctgggggggcgcatccgctctatagctcgtatcttctcggggttggcctcaatgcctcgggcagagatcaagaacccgagaagcttgcccgcaggcacgccgaacatgcacttgtcggggttcagctttatgcaggtggtgcggagactttcgaaagtttccgctagattcgagagtaaggtctcctggttgcgtgttttcacaaccaagtcatcaacataggcctcaacattacgtcctatttggctacccaaagaaattcgagtagtacgttgaaaagtaggacctgcattctttaacccgaaaggcattgtcgtataacaataagttcctacgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctctcggatgaatccggcctccagaagtcgcgccacctcctcgcggatgaaggcttgacgttccggggcctgccgccgcaccttctgcaggaccggccttgcgcccggccgtacggcgagacggtgctcaatcacctccttggggaccccgggcatgtccgccggtctccaggcgaagacgtcggcgtttgcccgcaggaaggagacgagcgcgtcttcctatttgtcgtccagaagaccaccgattcgtgtggtcttggacgggccgtcgcccagggcaacctgcttgatctggacctcgtcgcacgtgatcatccgctgcctcggggcggctgggacggaggtgctgagcttctcgtcgccacccgtgggcttggatgccgtggcgaggtggtccgcgcgctgctccatgcaagcaagcgcgactttgaggtcgccatggacggtgatggggccaccggggcccggcatcttcatctggagataggcgtagtggaccgccaccatgaacttcaccaacgcgggcctccccaggaccgcgttgtagggtagactgaggtccgccacatcgaagttcacccgctccgtgcggaagttggcggaaccaccgaaggtgaccgggaggtcgatatggcctagcggccaagtgtgccccggcgtcacaccgatgatcggctgggacgaccggagcaccatccccggggccttaatggcgtcaaaggcagcgggggaaaggatattgagggctgcacccccgtcaatgaggacacgccccaacttcacattgcaaacggtgggggaaaccaccatcgcgatctgtcctccccgggcaacgcacggtgggtggtcggtctgatcgaaggtgagggcaacctccgaccaccgcgcccgccgcgtcgcctcatgggtaggggccacggccagaagctctcgcttcatggccttgaggctccggcgagaagcgtgagcacacgctcccccatcaacggtggcgacggtggcctcaggctcctggaaccctaggtcatcgtcgccatcgttgatgtcctcggcgggggccttctgcttggcctcacctcgccggttgccggcgggagccgccggggtattgccctcacggcgctcctgcctcctctcctcctcccacttcctcgtccgctcagccaaacttttgaccgcgcggcagtccacgaggtcgtggagggaggtgttgtgcacggtgcaccacttgccggtcgggcgctccctactgggagcgccggcctccttctttttgtcgctcgcaggcctcccctttcgggtggcccgcgaagcgccctcgacggcgaggacgtgaccctcgtcgtcggaatgggccgacctcttcttcctcctcctgtcccgccgccctgaccgagcagcgggcccgggggcggccggagctgccacaccggaaccggaggagttccaggtccaggcctcctccttgcgagccacacggtccgcgagctgaaaaagctccgcggtggtctggggctccttggaggcgatcttctcgagcatgcggttgtgccgcacgccccccctaaacgcgtagatcaccgcgtgtgcagggatgcacagtatagtgttgcggacttgacaaaaccgctgaatgtacgagcgaagagactcatcgtcccctcgctgtaccacgtgcaagtccgcttcttcacctgggcgcggatatgtgccctggaagttcatggtgaactgctggcacaaatcctcccaagagtgcaccgacgcgggtggcaagttcattagccaaccccgcgcctgtcctttcagggccatggggaagaaattcgccatgaccctgtcgtcacccccggcggcctcgatcccagtcgtgtagatctggaggaactcggcggggttgacgcttccgtcgtatttttcggtgatggtgggccggaaccttgggggccaacggacgttccgaaggctcgccacaaaggctcgacagccggcaccgccaaccggggacacggggggctggcccccgtgcccggaccgaagtggcgctccggacgaggaagcgccctccgatgcgttggcagcacggcgatcattgcgccggcgctcgatattgaagcgggcatctggccccctacgcacatcttcttgggttggaggcgttgacgagggaatggcggacgaacggcgggtaacggccgccgctcgccgcgccctccgcctcgacgacacggagccagcagtagcaacgccagtggccttggtggcggaggaccgccagtcggcgcctaggcgctgctgcgccgtcatgagcaaattggccacgtcatctagccaacgtcgggttgaagtctctggatcagggatgacgggcgggtgacgcaggagcgcgcccgcagcctggagcgcgccctggggcgtgctgccatcaccgtagacgaggagacgacgctccccgtctcgacgtccttctccatcgcccgcgtgcggcgaagtcgcggatctttcgacctcctcgagcgcctcctcccgcccaagacttcggcgagagggggacagtggagtacgagctcgacggcgcaggttctgctccccgtcgtcaccgctagcgctcggagagagattgtgcgccactgcccgttcggccatggggctgagcgggagaagcttggcgcacacgaaagaggacgagggcttagaaagacacacgcgccccctacctggcgcgccagatgacggagcgtggagctcctcatcgggagaccgcgcaggcccccctttgccggttcggccgggggcactaagtgaggttcttcgccctcgatttccttaacgtatgccgaaaacgtccgtatacacgcaagtataccatatcgatatgtgacgtatatcgaagggtagagggtataccttacctgtaaccctgacagtagcccccgacttctgtttaaatgaactcgtgtaaccgatcgtgacttttgatgtcgaggttgttgttgttcttggtgtgaggaccgagagacaaggagtaatcgacaacaccaagtgaagctcaacggtcatgagtgaatttaaattgaagtccgaaaaactgccacgcgtaacggacctagaaattcccggcggttatctctctcctttccttggaattcgcaccgtcggaagtgcgactatttaagggagtttcggggatccattttgaagtccgcctgttgtgaaaaaactctccagcccccaagcgttactcgtcttctccgctcccgcaaaaaccctagctagctcatctcggtcctttctccggcgatctccggcggcaatggacctcgacaagtatacctccaccagcgcgtcgttgaagaaactacaggaggatggcgcccttcccggtcgcgggaccatggagagagaagcaggaggtattgaaccctagcctttcctaggtcgcatggttgcgatcgaggactatattctctgtggttttcttcctccgccttctgaatttcttctcttggtcttgaatttctacggcctttctttggtccatttgaaccctaattccatcgccttcctcagtattttttcacatctttgtgaggcctacattggggtagagctgttccttgacctctttcgtttctactacgagttgcgtttgatggaatccaacagggtatccggatgcgtcggtttccgaccttgggatggcctgaagtcgcgctatatccccttccagtgcccttcttctcgtagcaaatggcgggcgaggtggttctatcttcagatagaaaattcggatccagtcttcgttgttcctgaggaacaaccagacaagatttcgtcttggaccgcaaaacccgccttgaccccttctcttcagtccttcatcgatgccatcgatgacctccgagtacgaggtttgtcggggtatgaaatcgctgccgacttcattggtaggcggatccagccgctctaggctcgagcccacccagcctttgactattttgggctggaggacgcgacccggatttctcctcggggtatttttcttgtatttaaattgacttccttatgtgtgtgttcctcctgacttatcgaattccgattctcgatctacaggtttgaacagcgaaaccgtggagcgccgcgtcggccaattgatgatcagcggcccgacaacggcaagcaacgtccccgtccccctttgcgagaagggggcagccgaacgcgaggctgccatcaatgtaagtgtactcggtggcccttttgcatttttcttccggaatcgcattgtgacttcatgaagtgtaggctctccctctgactgatatcatcgggccgctcgtggatcatcaggcggcggcgtcgctgaaggaggacgtcgccaaggaggcgtccgatgttgctgccgctgcagccacaacgagtggcggcaactttccaaaaagggggaggaaattctcctccgtgatcggaaatcgtcggaagacacccaccccctcggtaagctctcctggtccttcatcgcgtagtcagaaaacttccacctcacatcatgcccgttatactctaggcctcggatgcgtctcccctgcctccgcgacggcagcagcttgtgacgcttggcgagaagtaagtggatgaatttgaggttttctcacttcgtcaaactcttgcagcctgtctcaattgcggcctttcacagggcggcgcgggcgaaggcggcgcaagacgaatctggagggacctctagcgcgtctcttgctgtggcctcgacagatgtcgtggtcgtgcccaggagccgcgaggcaacgcctagtggcccagccagcgatctcgcggctggttggggtccgccggctgccgtcctcacctgggaggagctccaggtcgagatggggcgcctccttgaggctggtggtcacagtattagccgcgagatcgcggaggtgagggcggcagtggcgtcgtcggtgaatgagcgcgccgaccggctgacgcgcgatttggcagaggttcgcgaggacctccagaagatgagggagctggtggccggcaatgagcgacaacggcaagggctcgagcatcgtatgtcggagcttgagaacttgtcggaaatccgtggctcgctgcgggtcacctacactggtctgcaccagctcgccggggagtgtggcatcaggaccaccatcccggcgaatcccgacgagttctcgctgacgtcttcgcttgcaaaactggccacggcgatggaggcgatcccctccaaacacgcagccatgatcggagaggagacgtcaaatgggatctataccggggcgtgccatgtccttgcgtgtgtgtggctggcgcatcctgaactcgatctccagaagatcttggatcagggggcggctagcgatgcgcgcaaggatgtgatggaagaagtcggcgatctgggggagtcaatcctcccgctttttgaagagtaggtttttggctcccttgtactctttagtcatgctttgtaagactctcattggttccaaccgcctttgtgtgtgcagtcatcaccttagttttctttagcattttgatctcgagtattttgttgtcgtttgtagagatgttgatgtcgaggatgtccagtagcgtgggcagcctgagttgccagtgatcgtttcggcacttgcgttcgagccatatgtgccgcagggcgatgtagatcaaaattcgcctatggaaacgggcatggcgacgacttccttaggttggttatttttgttttcatctcctttactcctccgtctggaccgacttgctttgctgtgttctcgggagagaagagcagtttgacttagtcatttccatgctgagcagacctcgagagtgcgcttgctaaccaagatcgtcgcatccaatattggaggacaaaatttgaggtagcggaactcgagaggactatgctggaagtgaagaaggaccaggccgtggaaacactccgaggtcgtgaggtgtggttcagctcgtacctgaagagttgctgcacatccatgacaagagtctgtagagagctccgagtaccccgtggggatcctgaggaatcggcggccggatacatctcgtggctgaatggggcctgcgcccagctcgacgacatcagcaagcgtattgacgaggccctgaagcaggagtgccgtcgatcgagccgatatgccggggggcatgtattggcttgcatacgagatcatcgcccgcagctacacctcgagttcctccacgaagggttttctcgttgtcggagaaatcctacggagatagatcacttggcgaagtcgatggcgccgctggggagaaggtcttccagtccatggactggcgttggccttcctggtagtctccgtatcctatgacaaatgtcttagggaaaagtgtaatataattttggatttttacgtaattgtaagaagtatttgtgaaatagaaaagaaatctatctaactaagctttcttactctggacgtagtgtgtaagagtgtcttcgcacttcgcgacttcgatcagtcgtttgagttatacactctctctagcccccagccttatcatcggagaattcttctcggaagataaggctcttggacctttgacctgcctcggttgaacaagcactgatcctggcccccagccgtgaagttggaaaattagtttccaattacacggcttggttaatacgcacggcgagaactcttacatgaccagatcttacatggtatttcatctctataggatccgacaaggccttatcggttctgggcgtccccagtcgaagttcccttaggttcctcagaggccttgtcaagacggcgtaaagggacatgaggataggtttcaacgctaggtgtcatctgggtaagggatcatcaggaaggaacactttgattgtaatatgtacctgaaaataggctttattgaagctgtaagatgtcttacaagtatggatactattgacttatacatagaatttatgtaattgatcaatgttccaggaatttgccaactcgcgaccatcgctgtctgcaatcttgaatgcgcctggccgcaagacctgtgtgatcgtgtacagtccttcccatttgggtgagagcttgtttcgccctgcttggctttgaacccgtcggaggacgtagtcgccgatcgaaagcgtgcgtgctcggatgcgcttctcgtggtaacggcgaatggcctgttggtagctggctgctcgaacggcaactcgttcgcgatgttcctcgagtagattcacagcgtcatttccctgctcctcctgatcctcatcggaatacttctgtactcgtgtactttgatgtcgtagctcggtggggagcatgtcctctgagccgtacacaaggaagaagggtgtctccttgttagacgttgtcggtatggtatgcacggcccatagtactgatgggagttcttcgacccacttcttgtatgtgatatgagcctgtcgtagacgcaggtcttgattccttgtagtactatgccgtttgccctcttgacctgtccattgctctgagggtgagaaaccgaggcgaagcagatcttgactctcagcctgatgcagtaatcctggaaatcggcactgatgaactgggagccgttgtccgttatgatacggtgaggcaatccgaatctgcaaaatatccctttgatgaatttgatggtatggtcggccttgatttcccccgtgggtgttgcttctatccacttagtgaatttgtcgatcgccacgaataggaacctgtagccgccctgctctcgtgggaatggcccgagtatgtccagcccctagcacgagaacggccaagtaagagggatagtctagagtgcttgcgctggtagctttgtgtgtttattgtggaattgacaggcttcacaccgctgaaccatgtcgcaggcgtctttgagggcgattggccagaaaaacccttgtcgaaaagcttttctgactaatgtccgaccgacggcgtgtgactcacagatcccttcatgtatgtcgaggaggagatgtctgccgtcatcggacgagacgcattttaggagtatcccgttaggcgtcttcttgtatagatcgttgccgatcatacagtagatttttgctttacgggttattttctcggcttctgcgtcgtcctcgggcaactcttcgctgcctatgaatttaatgagtggggtgtgccagtcgtctgtggtctcgatatcggcaacggcgcgctctgcctctatagcccaagagctgatgttgaggacgatcaggctatctttgccgcttgcctctttcactgatggccttgtcaggacgtctagaaaggtgccaggttcgagtggctctcgtctggacgcacgccatgctagatcatccggctcgatgttgtccttgcggtatacatgtcggatctcgatcccatcgaaccttttttccagcttcttgacttctacgagatacttggataactcggggctagagcacttgtaatctttatgcacctggttcacaactagtttggaatcccctttcacgaccagtcgcttgactccgagtgcagctgcagctctcatcccggcgagtagtccttcgtactcggctgtgttattggttgccctgaagttgagatgaattgcatgcttgaattgatttcccgaaggtgatgtcaagataaatcctgcccctgctccttggctgttaagcgcgctgtcgaacgccattatccacgtttcgttgtcgatttggttgtctgacctgttatcaggcatagtccaatcggctacgaagtcggcgagtacctaggacttgatggctgttcgtggcacaaagtggacatcaaattggcttagctcgactacccattttgcattgcgaccgacaacgtctttgtttctcacgacttcaccgagagggaaggaggatacaactgtgaccctgtgggtttggaagtagtggcgtagctttcttgatgtcatgattaccgcgtagagcagtttttggatctgtggatatcttgtctttgcgtcgtggagagcttcgctgacgtagtagactggtcattgcaccttctctctcgacaacaatgatagtgctaacggaatatggcatggcggcaatatagagaaataattcttcattaggttggggggcaacaagtacagggggatttgataggtagcgcttgagtgcaatgaatgcctcttcggcttcctgtgtccatacaaatttgtcttgcttcttcagcagagcgaagaaaggttgtccttgctctcccatcctagcgacgaacctacttagtgccgccatgcatccggttagcttttgtacttcatgttctcgattgccttgatcttctcaagatttgcttttattcctctgccagatacgaggaaaccgagcagcttgcccgatggtactccgaacgtgcacttctctagattgagcatgaggcgatatcgtcggaggttgtcgaacgtttcccgcagatcgtcaatcaatgagtcgcttgtcttggtcttgaaaacaatgtcatcaatgtaggcctcgacattgtttctgatttggtcgctaagtgcgccctggaccgtacgctggaaagtgtttcctgtggttattagtccgaacggcatcttaacgtagtaaaataccccgaacggcgtgatgaatgttgtcttctcctcgtcctctttcgccatgctgatttggtggtagccggagtaagcgtcgagaaagctcaacaactcacaaccggctatcgagtccaccagttggtctattcgaggaagagggaagtaatccttgggacacgccttgttgaggtcggtgaaatcgacacacattctccatttcccattggccttccgcaccatgactgggttggctagccactctggatggagtgtctgtccaacttgtgtatagggcaccatgttttcttcgtgtcgctgccttgtgggtctgggcgcttgggagggtccgcgtattctgttgcgagaacctccgcttgagctttccttttcccactgttgcgatttttcttcttgcttgactcaggtgcttccttggctagtttcttctctccttcggtcttcggtttgtcgttcttgcgtctcagtgcgtcgtccgcgtgagcgcatcgatcgacaatttcgaataatctccgagttgtcgtgacgcgcttcgttgccaactcctgggtagtatagcgatctctgacactggacttgaaggtgcggattacagaagcgtcggtgatttcggggattgtatttctacactcattaaagcgccgaacataatccctcaaggattcacccgggttctgtgtcaacacatgtaggtcgtcttcgatcgcgtggcgcttgtaagttccctgaaagttggcgatgaactgctgccacaggtctgcccatgaagaaatcgagtagggcgggagatgcatcatccatgaacgcgtagaacctttcaatgcagttggcaaataattcaccaacgcgttgtcgtccactccggcagcgtagagtactgtggagtagacctgaaggaattcttctgggtcggtactcccatcgtacttctctattgctcctggtcggaatctctcaggccatcggacatcacgcagcgaacgactgaaagctctacacccagcgctgggggcggtgggttgtcggcgatcgtacgtccttcgtggatgtctatctgatgatgaggatgaggaagatgacgatgatgacgacgggtcacttggttctggtgtacgattacgagggcgtcggccaggttctcgagaatcctgtcgtcgtctcctgttgttgtcccggcgccgatctccatcatcgtcgtcattatggcggcgtcctcgaccagtatcgcccagcacctgccgttcgcgatcatcgtgatcgtggcggttgtggcggttatcacggtctcggtcttcgctcgaacggcctcctcgttcttcgttatcgggacgtcgtgaagagacacgatgtcgggaactgttctcgttgtctcgtgcgcgtcgcgcctctcagcggccattcaggtgatcgcggagatcgccggtgccgcgaggtggaggggtggctcgatgaggcgattcctgctgttcagggttttcgccattagcaccgccagttggtggctgttccgagtgcgctgcagcagcggcctcttcgaacgcattgctgaggttggtcactgattcccgtagtcgttctgtccaccgtgcgacatcgtcgttcagaacgggatcgttgggggtttccctcagtattgcgttgacggccctgatgtgctgggccaatgtagtcacttgattttccgcttccgaattagcgcgcgctgacgtgctggtccagccgatagtcaatacctcgcatggcgtactcgttgacgatgagccatagtcttcgagcaggtgcaagactgatggttcatggggatcgatgtcgattaccccaacgaatcgatctgtgatcagcgtcgctccttgttccttgtcctcatccctgagggggatacgtgactgttggaccttaggaggtgacgtcttcatggcgctgagaaagaccttgcagcttgagaggtcgtgattctttgtcttgtgaataggacaatagacatcaagagttggagaagtacgctgaattccacgctctttgcaagcacgaatttcagcgtgtacgttgagaaaaacccaacaggcttgcaaggtgtgttttctggttttgtggataggacaccaggaccttgtcacctcggaagtcatcctcgtcgactcatgattcttgtcggaaagacaagatttggccgcattgggatccttctcgggatcggatgtcgtcgacgttccgttctccacttcggcgggaggatctttcgacatggagtcgtcctgggttgtagccactgcgttctcccttccggtcattgatggaccagccgagatcggcaccgtggtgtaaaccgggaagatgatttcgccgacttgagtccacaccagcattgttgaagtaggaactccttggttgaggttggtgttgacgctgttgtcgacgaagctggatgacatggtagtagaaccttgagcaccaaatccccctcttaacgaccaaatttggtaaattctatcactattggcatcgaaggtgaagatcagatcgaggtggaatccaagatgaagatcgttgcggaaacagagtaagaatcagctgcagtccaaatcggctaaggtcaggtcggcagagttcgagtcggacggggctagccgatacagccgattccgataatatgactcggtgtacgtcatcgggttcaagttgatgtgcttcaagatgattgccatgcatggatagagtcctgggaaggcaattgtatctattaattaggatattctatttaatttccttagagatatgtttgggcaaaagcctgccgtaaagacttatggtatcttagagtttgttagagataatagtcgtgtctgttatgaacgtatcttgtaattctcgggtataaatagacccgagtcctatgtaaaaagaacaacacatccaatacaatctcggcgcatcgccaccctttatgctttacttttatttcgacgagttcgtgctctcgggttgagctgcatcggtttcgaacttcaacaagaggtaaagcttgtcatgacgacttatgttcttaggattagtgcttccatctttatgacactctaatcttgtctatataattcatcgagttatcatatatctcatataatcttcgataatatcttcatctaatctgtaaccggctaacatctgttaatggaaggcagccgattaggttagacaatgatgttaacttagattatgtgatatatctaccactctatgaaacttccagcgtcttgattgtctagatattgttcttcttttcatacttaatgctgcatcagttgagtttgatttattaagtcgtgcttagaattgcaatctctagcctgctttctggttgccgattagggtagtatcggagtttcagccgatcttatctgatttaactacttttattctatatgcttgattgacatgttaaatctgccctttatgttaagattttaattgcatctaagtatattaagctactgtttggtatattctacctgctttaacatcttaatatagagtggtatcggagtattagccgatacatgctagatccatttgatcggctatgctataaatgtatataatcccactattaatatatatttcgatctaagtgatttatactgtctcggcaaggcgaccgatctatcccaatcacttgatttaagtatatatcgatataaggattatatatcattaatatctacagccgatcaagtagatttagttctgatttgcttattgatatttgccgatcgatgtacgcatgacatcggcttgaaataaatgatatgtcatcggcacctagccgatcggctatcatttataggattaactgtggtttctttgttctatttcttgttgattgtaggatcaaatcaactggcacgctcatacacccgaaggagagttttggacctgcactggagttaagcagatctcccaggcctcgtgttttctgtcaacaccccctacctggcgcgccactgtcgacgggggatacccgtagaccggatatagagggtactggggtacgctggtacgaggatctacgtaatacggcatgcgcgcgggccaccttcctagttttatctaacgatgtataatattggatccaccaatttaactgaaaataaaggggtatgtcgacgtttgatgtctcgactacagtatttgcatggcatagggatcgttggtactagggtatacgcgagactgaggtaaaagagatggagacgaggatttttatacaggttcgggcccctgaattgttaggtaataaccctacatcttgttggccgaagccggtattgctcttattcatgataatcacaccagtacaatgtttggggtagcctatctaactgttgtcgacatggcagtctgaagatctgactcgtagtcgacgataggtagcctttctcctcgaatccgtgcccggcgagatcagagatagcgctttcatctctcctgacagtatccagagacaccgtagggtactagccgtgcttatccctgaagtcgatatccggcggcgtgtcttggcttatgtaggcttctatgttgtggcttctatgtcgattgtgttgggtgttgattgtccgtcccctctcctcctagggggccttgtatttatacccataggtatccccttgtccaagtagaactagggaaaccaatatggatacaatccgagtagtcattgttgtttccatgtagaactctggttgtctttccttatccagaactccctcgaggtcagtttccgtataagacatggtatgtggtggatcctgccgagatttagtcaactactattaggtatgtggtatccataaccctgacaggatatatgttttgcttttttattataatttattggattttctttaatttataagagtgtcacatggcggctcgagagcgtttatagggagtttcatggactttactatataaaggatagatacctaagtatcacatttgatacctacggagtatcatgtctgatgtcatactaaattcgatactttcggtaccatactaacatgagcatgatatctaagtattggatctaggtatcatgtttggtactggaggtatcaaatcgggtatctacggtaccatgctggtatcagttattccgttgtcatgctgacatcagctattccattgcgacggtaataccgttacgtagtctgtctacctagtaaactttaggcccacgaaaactggaactgggcctaagtaggtcgaaaagttgcccatccaccgtgggaataagttcatctaaggtcccttaacttgtcaacgaatccgattttcatccttcaatggcaaaaccagatacaacgggtccctcaactatcaaaaccgatgcagattaggtccctcggcggttttggctgacgtggcacttacgtggctaatttgactcggtctcgatctgatgtggcgcttatgtggcaattcgatccgaaaagataataaaccccgtgggacccacatggtaatttcacacacaaaaattataaagaaaaatagcggggcttacatgggccccacatattaatgggccccctttttttcctctttttccccaaaccccctcttttaaattttttccctgtcctattttactttggagctcaccccggttttcttggtcccagggcttttttacttagggaggtttccacg

SEQ ID NO: 77753 - DNA, 17153 bp, Oryza sativa
ccccttccagcacccgccgagtccccctctccatccgccctctctctctccggccggccgcttccctccccctccgtccccatctcctagccggcaagcagggacgcatggaccggcgcgcgacgaggaggagcacatccggtcccctctgcctctccctctccatcggcttcatcgaaggcggccagatctggagagggggaggtcggggtggtaggttggtggcagcgatgtccggcggcggcggtggccaagggaggtggcaagcggcctccccataggtgaccgggtgcagatccggtctccctcctcctctccctctccggtcggggcagcgacgtgcggcggcgacgtgcggcggcggccgtggccaagggaaatggcggtggcaacggaccccggctgtgattggcagcagcgcattgacgacgacggagtgagttcgtgcatttgcttctgttgttgatctgtgatttgtgattgattggattgttgttcactcgggacttgtgattgttgttgttgatcagtgatggattttgttgttgttgttgttgttgaccggattgaattgcatatgtgattgttgttgttaaccggggaattgcatctgtgatttgtgatggaatgcatctgcttgaatggtgtggctcaaaagcatcggctcagctcggcttggagccggcttcttcatttttttttttgaatctgggagagcacaaaggtgccagttctacaaccggcaccaatgacatagggtcattggtgccgaccaaaaggtgtcggccgggaaactggcacctattgccggttcccaaccggcacctataagggtttttgtactagtgcatgtcactcaaatggttatgaaaaaaatttgaggaggtgtattaacatgtgatatatcactccacaaacatgcaagttcaaattcaacttctatatctcgcaatggaaaaagaaattaaattaactatttgagtgacatgtaaacaacgggggacatctcgttgagaaattaaaatccacgccctttctgaagataatgacacacacagctcctcagttcttaggttatcaacagatcaatcgaactgacattttgcaggcaattattaaatagagtactacctccgtcccaaaatatagtattttttttggctatgaatctggacaattgctacattttaggacgaatgtagtacttaactcagtagtcaatcttcacacttggtacgtaggtattaggtactagtcagcagctagcacgaagtcttaaaataaatgaacaagaacatcacgagctagagaactacgattagaattgaacaacaagaaaagaacatataaccaacggtaggtcatcagtagatgccgtgcataagtcatgcgaaattatccctgctgagatatattgtagaattaattttattttcctagcgatcaaattatgcacgtagggccatggcgcgcgccccccacatgattatggacgaggtaacatccacgtgatctattatataatttataaaaacagcacgcgtggcctcgtgggaacaaagttaatttgattgctcttgttgcaggcacgaccaacaaaaatgaaattaaaaaaaaaaaactatgcgtgtctgctagactgctacatccaaaatatatgatgtaacaaacattatgaaaaaaaaaagagtgagtatagttgtcttcatgtatgtccgttgtgtatgctcacatgcgcattatcaatcaagaacaacccatgcattgatccactgggccaccaaaatgaagtatatgcatatactatctccctttttactacaaattgatctttcatcttattagaaaatatacatatttattattttattttattgtgacttgttttattattaaagatattttaagcataacttatactttatatattttcactaaatttttaaataagatgaatagacaaacgtcatgtctaaaagtcaatagcgttatatatttaaaaatggagaaagtattccctgtagtttttaaaaaatgatttttagaaacttgtataattttgttctcaaaattatctcattttgtaatgctctattcaaaacttgtttgcaataattgcattgttaggttgctatcaatgcttgttcatgatggcggcactgaacagttagttgtatgacctaatagcatcatcaagaaaatgagaataatccattcccaaaattttttattagattttctaaaatgaaaataggaattgaaaaaactcatccctctaagagaaaccctaaatttaattctcaaaaactaaaagtgagcccttctgttaaactaccaacagaaatctcccgttttccatcatccccgcaagaaaaaagatcgcgcgacccatcccatgcactcctcactaccctgacgctgtgtcgatctccctctcaagtgctacctggccccgaggccgatctccctcccacgtactccctgcccaatgccgatctccctcccacgcactccctagccaacaccaatctcccccggggatttttctcaactacaggtacttgtataggtcacaaggcaaatgttcagacattacaagtagatgatcaaatgaactcacaacattgactctttagcagtttgcctcatcatggtccaagtggcaagcaaagatggatgaagaaatataacattatatgtttcagttttaggactatattttttttactaagatttgtgctatttaatcaagttattgtgtagtaatacgttttagatggatgactctgtaacaatatacttgctacgtgcaatgacatgtgattcataataaagatttttcaataatgatttgtgacagcaacaagaaattatttcttaaactgtgtttgatgatgatactatcactgcggttactataatgaaaagtagtgttacagcttatcagaactcatgtgttaccagtgcaaaattatgtgttcctaggctatgcggcaacacatgttcttgtgttacaggagctaaaaatggtgttactagctaaaaagatggtaacaccttttcttagcagttgcaacatgaattatgtgctacaagggtcatactgtagtaacatggccaataggaatacatatcagtttgtgttactggagtcctcagtaacacgtttttgggcatgcagtagcgcaaagatgtgttaccagaaccctgttctgtagtggtgcaccatcccctgtcagctccccttcccctctatcccccgccactgttcttgctccacctctccctcccctcgctttgccacctctctctgcatgcactcaccatgctaaaaaaacaaggagacgagttgtcgaagcaatctcgtccagatgctactggatgatgagtcttcatcggatgatgaagaagaagaattttttttaggtggttcaaatagtgtactgtcagtacattgaagaatcgaagcgagacaggtctgtctttggacatgaggtgattgatagggaaagattggctggtcattggagattgtacaatgactactttttagaagaacctacataccttcatgttcattttagacgcaagtgtgtaatagtgaatagtatttttcttcaatcttgatttgaacagtgatgcatgtattaattcttattgctacttattgtgcaggtttagaataagaggacatctctatttacgcataatgaatgatgttgaagtgcatgatgattaatttgtgcagaaaagaaatggggctggtatccttgggctatcctatttgcaaaaggcaacaataatgtcgcgcatgttatgttatggaatagcaggagatgcagtggatgagtaggttcgtattggaggtaatatcattattgagaatcttaaaagatttgtcatagccgttgatgaagtttttggagaggagtacatgaggacaccaaatgagaatgatatagctaggttatttgcagttggagaaaaaagagtatttctagaaatgtgggttctttagattgcatgcactggagtggaaaaattgcctgactacgtggcacaattagtataaagggaaagagaaagttcctactttagaagtcgttgcctcacatggccgatggatttggcatgcgttttttttggtttacgtggaactcataatgatattaacgtgctccaaaggtcatcgttatttgcaaagctagctaaaaggcaggctcctaaactttattgtggtattaacgaacatgactatactatagggtattatcttgcatatggtatttatctttcataggcaacactcgtgaagagtattcagctgccacaaggcaataagagaaaatattttgctaaagcacaacagtccgttaggaaggacgttgaacaagcatttggggtgctgcaagctcgctttgctattgtccgtggactagctagtttttgggatgcagttgaagcatgtagatgtaggccctgtttgttaattctggtactccctccatcccaaaatataaccacttctagccctcagaatttgtcccaaatataacaacttctccaccaacattctcttcccaatcaatcatcaccctctaccattcacttttttccagcaacctccacttctcaaccaatcacaacctctccccatttaattcttcctactttcttaataatagtgtccaactctaaaacttcttatattttgggatggaggtagtaataatgacaagcgctaattgtggactaaagtgatataattgagttagaaccacatgatatacataccaagggtgattaccgcagattaaaattgatggtgcaaagcaatgggataaaggtggtaaatctagccttttattttaatcgatcgaggcattgggtgattgaatttttgctaggtttattattagctttgccgtactatcaaaaagggtaataactttactaaagaagtgatcaaaatgtcgcattatgtcatatgcataaggtcacttggtttgattatttgttccctccatcttttcaatctctagtcggtctgaccgtgggcagaccgacgggtcatggccggtccgactgggtgtttgtgagtcggttggatggtcacggtttggcgatccagaacagccaaagccaatgccggtctgaccgaagccacaggcggtctgatcggccggcccatggtggtctgaccagtgggtcttcggcggacaatggcttgtttctagcggttgccctagaggccggtttgaccggccaccccctagcggtctgaccggcagacatctgagagttggggttttgccctcaacgactagttttggtgagtggggggtatataaatactcccctaccaacagcgaggggacgctctaggaactctattcacttgcatagaccccttgcattcactctcacatcaattgagctcttgtttattcattgtggttgttagagagtagttttagcaaagacaagtacattgcatcattgattgagttagtgtgacacttgatcatctccgagccaggttgctacttattactcttggaggtagtcgcctcctagatagcttggaggagttgccctgtgacctctccgagaaggttgtggagaggtttagtgttggttctgagtggtttggagttcaccatcttgggagcgaagggagaactattctagtgatcgaggcttgggtagtctacttcgagaccagctcccaccttgcccaccccttgacgaaggggttcggtggttgttgtggttgttatagaccaattttgaccgtcaatatttctggaaataaaagagaactagcaatgcttgcatgcatatttaatcaagaataatatatttccacttgtacttggcaaagtatttgtatgcaagagatcttcatataaatggaggagaaatgatggaaaataacctttcagctcgacgtgtggcacacttatggatgaatgggcccacaaacccattagaacacctgtaaatgggcccaatcaccatgccactaagtttaggatccatcaagtgaagcaccagagaaagcacgggccagatgggccagcccagggttcggccgaaccgccaccggcgcttctgatcctggtcttccacgtggacatcccagatggcttcccaatgatggttgcggggcgtttaggacatttccaactttgacaaccgtcattggcagcctataaaaggacctctcccctctccatgtcaacacacacaaagaaggatcaagcaagaagctctctgtagtttatttactttgttttagtgcttgtggagtagaaatagaatagtttcttagttcttgaagtctttcggtgaattcggatatggctctagtagcttctctctcttgtaagactttattcaataataaaatattcttctctatatagttttggtcctttactttacttatataattatttgagtaccaactttagttcatacttgactcgtcataattatgtagctagcttattgaagatatgcaatggtattagttggtgttcatttatatgattgctctatgtcatctgcaaagatgtggagtactatttagtaatataaatgcggtgcttagattattagataccattaaatggtgctatatgccacatatctgtagaggtaggccgctgatggtgacagttcagtacgtgtattcctccacgtgcttatatagggctaagagaattttctagtgtgggtactcctccatatccattaccggttggatggccatgatggattatcgtaaagaactcgacaatcaagggttgtttctctatataccaagagagcatagttagagggtattggctgcataattgtaccatagcaaatgtagactaaaatgactatatactagaagtacagaaaatgatgcttttcttattctttctccacttagcttagattattattttagtgagaatattctggttagtttcttctatgtgtcaacctatcttacccttgaattgattaacccctgcattagactttgatctatacatgtgatgtaaatattagcatggtactctcttataatatattccctttggtttgaataaatacgataccttggaatacttccgggtgaaatgctaatatttcaagcgtcattgctgagaattatttctttctccacttaacttagattattattttagtgagaatattctggttagtttcttctgtgtgtcaacctatcttacccttgaattgattaacccctgcattagactttgatctatacatgtgatgtaaatattagcatggtactctcttatcatatattccctttggtttgaataaatatgataccttggaatacttccgggtgaaatgctacagcggtatatctatgcgcttgcggtttatatttgtaaccgtaagaatactgagtaatatttcaagcgtcattgttgagaattatatttctagtaaggcaaattttgctacaggacatcgcgacttcgtggttttagctgtaggataccgcgcgaagtcacttttaaggaaacacactcacaaaagttggatatttgctggtggacaccacacccattaaaataataattttctgttggagaagagagagaaatcatgtgaaatgtcagaaatacccctggccccacatgtcagctctccatctctcttctatctgtcctctcttcctcactgcttggatgtagagccggtgcggcgtatgctcccacggcatcaagaccggcattgccgcggtgttcacagcggagtgcaaggcgacgacgagtaggagagggacaacagcgatttcttgggcggtggaggtcggtggatccaacgacaagagagagagcgagaggattcgatcatttgagagaagagtgaaagatggcggcgatggaggaagaagacgatggaaatgagagagagagagagatgacaaatgtggtctgccggggagcccacgcctcctctgcggctgccgagcaggccgcttgctcgccctccggcctcggcacgccacccgccgcttccacatcactgccggcttgggagagatagagagaggaagatataaggggcaatttggtcaagccgtgtaaaaaagtggaccctctctcgcctagttagcacgaaaacattaatttaatggatggagtatcccctagcaaataaccacatttatagagtgggttcccccaaaagtgacttcgcgcggtgtcctacagctaaaaccatgaagtcgcgatgtcctgtaccaaaatcaaccgtgtctttgtggtttgagcggtgaagtttggtttgcctcaacggggattacgaaagcagtgaagtttaggagcagaagagggagattgttggaccatatttttggactagaataacaaaaaatatggattgggagtggattagaggcactgctggtgatgttctacaagcatatccagtagatgtgccatatgcccatagctaaatttaggcaacgaggacaaaaactagctccagtagatgcacaaaggttttgcaaaataaaaaacagaaccgaaaattcgattagtactttgaaccaaccaaatttattctggaataacgaagtaacctagaagacttaattttattataaagcccaaaagaaggcagtataagcccacgaaatccctaacctatccccctcctcactcagttcacaaactcatcacgcactcatgctcccctcctccccctgatcggcaaggcaatggctgctgtcgaagggtaaactcctcgagcgggggactgtgagggcccctttttggttcggaccaggggtgcgggtgaaggcttgagagatgaagggaaggtgatgcagaggcatagttattaagaccagaccagtaatcaaaccggtgaggctcttggttaaatggttcactggttcaaccgggtgaataggtggtctaacccggttcaatacttatcaaatatattaatcattctattaaaacacaagaggcaaggtagcctggtggttgagagagcactttcccttcctatcccacgcataattttccctcatttttcccccacctgcacgcgcacttccccttcctatcccacgcatagttattgaaccggcaaggccctcggttcactggtttgattggtcgcaccgttggttcaaagcggtttaatagtttaaatatataactgattcagttcattcaaaacgacaagcatggcctggtggttggtgcgctgtgctttcaatcaacccatcgtgggttctcgagtcccacccaacacctttattaccctatattttctccaactatcccccgcatgcacgtgccctctgagatagcagcggttcagtgccgatttattaaccggttttaggcggttttcacaaaaaaccgggcggtccagccggtttttaccggttcaatcgcacaagcggtcttttaactggaccagaccgatcctacgcagctgtcggagaatgaactcctccaccagggaaccgtgaggcccccctttgtaagttcggccgggggcagcaggtgagattcgagggcttggtgagcgaagctgtgtgatcttgagggggttcaatcccccaaagacgatgagacaaaaggggtttatataggttcgggccactaagtgtaacaccctactcctgtgcttgattgattgagtgtagaacataagtgcttggggttgcgagacccaagcgccagttcgctcggaagtccccccctttctcactaggcctggacctccttttatacctcaaggggttaccacataggcccaacaacctaacttcgtcgagaagtattacaatctttgcattaaatacatgtcttgttccttgacgtggaagccgcatacacgtcgcctcggtcgtggggcctaccaaaccatgccgcctgacacgggggatgcccatgtcattcaccatttaatgggtgaagatttctgggctcctattacaccgggaaacgggagcctagctttgaccggagtgggaggaccgactccggctaggataagaggatgagaacctctcaccatcattatttgatgagacatgtcaggttgcacgctgcctgacacacgagcaacgcacaggcgcactagccagtcccatcggtcattcgaccggtgacagaccggttgagtacactgcacgccgcattaaatgcggcgtggcgcgaccgctcgggtcgccataaatgtgggtaggtgggcacctgtaggcggacacctaacccaacgtacatggtgacctagagagggggtcgggggagcccaacccctagtcacgggagggagcggtcgccgcccgacctcgggcccgatccccccgcgggggagggccacgtggctcctggggcagccttctccctctagtcttggccagggagtggccgccaccctacctcgggctcgatccccctcgggggagggccacgtagcattggggggcagcctcctctgtccaatctctgggatggagtggtcgccgccctacctcgggcccgactcccctcggggagggccacgtggcattggggggcagcctcttccgactagtctttgggaaggagtggccaccaccccacctcgggcctgactccccttgggggaggccacgtggcatcggggggcagcctcctccgactagtctttgggaaggagtggccgccaccccacctcgggcctgacttcccttgggggagggccacgtggcattgggggaagcctcctccctctaaaaatgatacccctgggcccatatcaccgatagtagcacccggcgttagccctgaccaaaacctttcccaggtggtcagggttgacgccaatctgctagtcagttgacatgtgggcccgatcttctgtcctatcattctgggagttgggcggtgggagtttagtcacgttcaaacgtcgccttaacttcccactttcctcccggtttccgaggcgttgtgggctcgggagtttagcccgtaccttaggccgtgaacttatttcctgtatatagttagcaaacgttgttagattctctcgggcctgtgaccttacgccgtgtaccttgcttgcccctgccttttgttaacctctgttcgtgttctacttcatctattcaaacgattattttggcgtgagcgtgaggactgaactttccatagccagcaatcttcacccgcgatcaagccaagctaggcactgtagccagccggcggggctagagccaaccactacggaagagccagcacagggggccccgggcgtcgacggcgcccagagcttgacgcagggctaggagagagctaggaatcgtagcccccgcactttaagcaaagaatagtttgaatggttgaaacgaatacaaactttttgttaccaagggaggcaagccagcgcgcgacacgtgggtaccgcgggaccgcgaggaagagatgggtgagagataaatataagcaataataattctatgcaaacgattaccttcgcgtgagtgcgaggactaaattttccatagccaacaatcttcacccatgatcaagccaagctgggcgctgtagccagccggcggggccaaagccaaccgctacggaagagccagcacagggggccccagacgtcgacggtgcccagagctcgacgcagggctaggatagagctaggaatcgtagcctccgcactttaagcgaagaatcgtttgaatgaatgaagcaaacacaaaccttgcttgcatgtcgcgacctttcaaacctttagctcgaagagggcctcccaccatgggttcctaaccattttgggaagcctgcgaccacttagcaaatgaggtgaggttcccacgagcctgtgtcctcacgctacacattctgtttgctctttcctttcggtggcttccttccaatatctctcccttctacatcgacgactactttcgcacgagtgtgagagccaaaaaaactctagagccagcgatccccatccatagttgagccaagccgggcaccgtagctagccatcgggaccaaagctagctgctacggaagagccagcacagggggtcccgggcttcgacggcacccggcgctcaatttaaggccggaatagggctagaaaacttagcccccacacttagcgaggaaacgttcatgtagatgggagagaggttgggctcttaccaccgagggagcaaacaaatgcgtaacacgcgagcgtcgcaaggccatgagaaaagaacggggggaaaataaatataagacttcaagctgtactaagctgatgaattgaaaaattgaaaaatacttgaagcttgaaaggacgattagttgagccgggccgggcaccgtagcctgccggtgggaccaaagctagccgctacggaagagccggcatagggggtcccgggcttcgatggcacccggagctcaactacaagagtcctcccaggagtagaccgaggcaggtggcaggttcataagcgatccccgtgcttggccctggagggccatggggaagaaattcgccttgacccggtcgtcaccccacgccacctctaagatcgtcgtgtggatttggagggactcggaggggttgacgcttccgtggtacctttcggtgaggccggtgaagatgtggggggactagccccctgcctggggtggcgcggctctcctgaggaggctgcgccttcccccacattggcggtgcgacgctcgtcacgccggcgctcaaaagaacctcaaaaatcacgaacgcgccccctacctggcgcggcagatggcggggaatgaactcctccaccagggaaccgtgaggcccccctttgtgagttcggccaggggtagcgggtgagattcgagggcttggtgagcgaagctgtgtgatcttgagggggttcaatcccccaaagacgatgagacaaaaggggtttatacaggttcgggccgctaagaagcgtaacaccctactcctgtgcttgattgattgagcgtagaacacaaatgcttggggttgcgagacccaagcgccagttcgctcggaagtccccccccccctttctcactaggcctagacttccttttatacctcaaggggttactacataggcccaacaacctaacttcgtcgagaagtattacaatctttgcattaaatgcatttcttgttccttgacgtggaagccgcatacacgtcgcctcggtcgtggggcctaccaaaccatgccgcctgacatggggggcgcccatgtcatttactatttaatgggtgaagacttctgagctcctattacaccgggaaataggagcctagctttgaccggagcgggaggaccgactccggctggggtaagaggatgagaacctctcaccatcattatttgatgggacatgttaggctgcacgccgcctgacacacgagcaacgcacaggcgcactagccagtcccatcggtcattcgaccggtgacagaccggttgagtacactacacgccgcattaaatgcggcgtggcgtgacctttcgggtcatcataaatgcaggtaggtgggcacctgtaggcggacacctaacccaccgtacgtggtgacctagagagggggtcgggggagcccaacccctagtcacgggagggggcggtcgccgcccgacctcgggcccaatcccccctcggcggagggccaagtggcgcctggggcagccttctccctctattctcggccagggagtggccgccgccctacctcgggctcgacccccctcgggggagggccacgtggcattggggggcaggctcctccgtccaatctctgggagggagtggccgcctccctacctcgggcccgactcccctcggggagggccacgtggcattggggggcagcctcctctgactagtctttgggaaggagtggccgcccccccacctcgggcctgactccccttgggggagggccacgtggcatcggggggcagcctcctccgactagtctttaggaaggagtggccgccaccccacctcgggcctgactccccttaggggagggccacgtggcatcgggggcagcctcctccctctaaacatgatacccccgggcccatatcaccgacagcagcagccacgcaacccgctatttcttcagaactggacggtctaaccggttcacagcagggtcgattgcatgctggtcttttacctagaccggcaagggctctggttagttttttccggtccaaccgccagtccagtcttttttccagtccgaccgccaatccggtccggttttaataactatgtgcagagggggtcgggcccctcggaagcaatggggacgcaatcggtttatacaggttttggccgctgtggaagcgtaataccctactcttgtgtgtggttggttctggtgggaggatacaagtgtttttttctcttcggatccctctccccctgttgacggtcattagcgattagtttcgacctcagtgttaccaaaatagagaactagttatgcttgcaatatccatgttagaataataatattcctctagcatttggatcactaaccttttgcaaagaataaccataaaatggagaggaatctacatcaaaccagacaataaatcaatctgacgatgtcgaggatcagacttatgtatgaatgggccaagaactcagaaatgacacgaccaattggaccaaaattcacaagtctatagagaggagaagtccaggaggccgccaaccaaaaatgtgctggattggaccagcccatggttcggccgaactaaggggttcggccgaacccccatctgctccgttggatgcagggtttggcgtggacgtccaggattgctctccaatgacggttagagagcatttccgaccattccaactgccataaccgtcattgggaggctatgaaaggacttggcacaatcatatgcctttgtgagaaattatacactttgagtgatcgagagaatcaattgaggagcaaagcaaagttataatttcatgaaaagtaagggcgacttgagtcaagattgttccatttctcaattccccaagatcgcatggtagacactacaaagacccacaagtatagatatgactttgaataatttgtttgcataattataaggaagtcataaaccttttgtagagtccatagccttcactcgggacgagcaaatgttaagtgtggggatgttgttgatgatccttaaatcgtaatatttgaccgtcaatacatgcatataattaaataaaatatggtatctaacttagtggtagggattattactaatcaattccactagtgttggtaaaatatgtgtatgtaggtattttaaggagaaaacacacccggcatgtgaggaaacacacctccggccaatcagacacaagcacatagattggagggcccacaagtcaggtggaaccaccatggaatgagtcataactgtcataaccgccatcagggcccaccagtcagtgtccctgtcaaaggagaggccaggaggtggggcccaccatgggttcggccgaaccaccacagcctcctctcatcctgaccttcgacgtgtacgctccggttgaagtctcaatgatggttggagggcatttaggacatttcccatagctgtaaccgtcatatgaaggctataaataaagctcctctccctcacttcactcacacacaactttgagctaaattacaagaggctctattgtatcttttgtacattagaattaggtagatagtgaggagaagctctggaggagtgcctggaagtttggcgctcatccgacttctacctcgacgagtgtagctctctaggaggaattctggaggagtaccgaagctgtcggtacactctgctccgggttcggagaacttcttctattaagtaagcattcgagatcctttctcttgttatttaattacttagtctgagtaatacaaatttctatctttgcgggttcattgtttagtattcatactaagtgctctagtactatgactctggataaagaaggaagttcctgtataagtattagactagtaattaataacatagacgtggtgtcttggttagatattacctttgtttgttgtgtatcccacggatttgtcagaggtaggctgcaggtgatgacagccctgaatcccttcctagtaatcctcaacattcgaatacatcatggagctatagccggaaccacgctggcagaccagcaggggtcggtgcccgaaacaacagatagaaaactacctttgcttagcttagataattaaaatacatagaaaatcctctctagcctgcctagcctacctatagctgttgtccttggatcatcttagccttagatagattgtacacattttctgagttcgatatccttttggggtcacccgaaggtgaagtgttacagcggtattccgtgcgcttgcggatttatctgtggtcgtaagaaataccaacattgccgccacctgtcgccgccgatgctcctcctcaccggtgtccacgccgcctgccgccgccgcttgcccgctgtgccacccaccccccgccgccagcttcccgttgactaggattgttgaccctacatttttttcccacttacatgtgggtcctaaaaatttaatttttaatttttgcttactagtatgccatgtcagcaaaactaggcaaaaaaatactaccataagacctcctttgaacggtttgtgtgagtttagaggtagacatttctggttttgtggttaaaggaccttaaaaaaaactcgctgttaagttgagagacctctggtgaacttattccaaataataaagctcatataagcaaaaaaaaaaaaaaaaaaaacaagcccaaccaagaagcggcccgctaaactgcatgtttctccaatctattggactccgacgatgttctgtaggagttgagtaggaccatgcgtcgactcaagtggcagtaggtggggccgcgggtggctgctcgctcgtgcgcaccggccgcccccacctccaaccatggcgtcatcctcttcctcctcctcctcctcctccccctcttcccccttctctcccttcgcgcaaccaccacccaccaccc

SEQ ID NO: 77754 - DNA, 596 bp, Oryza sativa
caaagggacatctataggtataaatacaaggccccctagaagaagaggggacacacccaacagactcggacaacatagacgccacaaagccacaagccaatacaagcctacataggccaagacaagctgctagatatcgacatcagagataagcctaggaaaacccgatatggtacctacgggacccaaagagaggaatctagcgctatctctgatctcgctggatgcggatttgaggaggaaggctaccctgttgtcgactacgagtcagatcttcaggccgccacgtcgacaacagttagataggctaccccaaatattgtactggtgtgattatgatgaataagatcaacgaccggcttcggccaacaggatgtagggttattacctgataattcaggggcccgaacctgtataaaaatcctcgtctctatctcttttacctcagtctcacgtatatcttagtaccaacaatcctcatactatgcaaataccagaatcgcgacatcaaacgtcgatagtggcgcgccaggtagggtgattttggtgcttcaggatttcgacgagatgggttcaagagatagattctccgacaa

SEQ ID NO: 77755 - DNA, 694 bp, Oryza sativa
cgcgtgggacccacggcgccggccggtgcgagccagggtgcgcccggtccaccgtgggccgtggggctgccgcgtgggccccacccccgtggaaccagtccgcgcgcccctcccctcggctgacgcaataaatccattttaaattaaaatttaaataaagaaattcgcaaatattcatttaaagattaaatcggattaaaacacttaaattgattttaattgaattatgacgcaataatgaattatttttgaaaaggaaaaggaggattattgcgtcagcgggctagggttttggtggaccgggcgcacgggcgacggctcacgcgaacggacggccgagatcgacttgatccaaaacggacggccgagatcgaacggtccacgaccggctcacagcgaacggccccgatgacgtcggcgatgacgtcaccactggcggcggcggctcggcggctcgggtttgcacgctcgccggcgaacgacggcacggcggcgcgaacggaaggcaccaacgggtagagcgcgacgcggcgaactcaccggtgaccaaaagagcggcggaagatcaacggacggcgacggcaacgaggaggaagcggcggcaaacttcgggtcgacggcggcgacggtgctccggcggtcttcggcggcggcgaaagagcggacgagaacggcggcgacttggcgatcacga

SEQ ID NO: 77756 - DNA, 3131 bp, Oryza sativa
cccgcggcaacagttccagtccctccgcgcccccaccaagccccccttccacttcccccacctcctcctcccctcccgctcctcctcccgccgctgctgctgcgtccccgtccccgcccccggggcgaggtcccgcggcctgcccgctcccgtatccgcctccgcgctgcccctgcgggtgacgcctccgcccggggtggaggtggagggtggcgtggggagggcggtggcggcggcggcggcggtgaggagggtcgcggtggcgctggcgtgcggcgcgcttgcggcggcatggtgccaccgggcgctcgcggtggcgggggcggcgggagccgcaggggcatctggggcggtggaggcggcggctgggtttggcgggatggcactgcgtggtggctggccgagggtgctgcagattctgcagctgcttagagagcaggggattattctcgctgtgttgcttggcctctcggcgtttttctccatggctgagacttccatcaccacgctatggccttggaaggtgcgtctaccaactatcaagtgccatgatacaaatttgttacacaatgtctaattgttgcgtaacatcacttcactggttgaaaatttgttacacaatgtctaattgttgcgtaacatcacttcactggttgatggttgtaacataagtctagctagatcagtgattgtgcgcaactgggcatgatgatgaaaatgatagtatttggggtttaattttaaaatttccatggtgaattgagccatttaggtaggaaggacacgagtttacatgaggaaggtggaagccgtataaaaacatctctgatgttggttttgagtgttgacgggtgggtactaggccattaggcattactcaacaaagggagattatgtgcatcagatgaacagtttgtgcaggggcttagttgcttcctgtgctggtgttgttgcatgatcctgagctggtactgaccctgtaaatatttaccagctcccaaagtttcttttgatgtatttatggtttgaaagaaatacatacagtacacaccatactaacatatgcactacttcaaactggatgcatgcactgatacccctgtaattgtcaggggaatgtgcactgtcacagtgtcactgactgcccatgctaattcttattattttctttgtcccaacaaacaattagtgttcatccagtggtaggtcaagttatttgcacattttaagtttagtgcggctttatcttcattcttcaggatcatgatttaagctctaggttcaggtttagtaggtaataacattaatttaacattgagttttaagcttctgtaataatttagttgttacaatttggtctttgtgtcatcgtctcccaaatcagcatgctttggatggacaaaatttaattgaatccattagcaaggcatatgaccatactattgagtccatagtttcatgtgtgcatctctgctgggattatagtttgacataacatcttttgttgttccatggcaaatgcataagtccccaccttgtttatcatccattaaaccctgttggttgatggtagtccttttcatgtctaaacaattgatgcttagatttggttttctgttccactaggttcgtgagttggctgaaaaggaacctgaaaatggtgttttcagaatgctccgaagtgatgttactcgcttcctgacaaccatactcattggcacaacgtaatttattaaacctatgtgttctgccatgtttattatattttttttctataatccatattatgtcattgagttcaatccatacccacaatatgccactcactgtgagacaaacttttggccttttgggtcttggaaccacacatttggagatgccagtggtgtattgtggacattgagtgtaattcagtggcataaattggatccctccttattattttcttcctcacactggaatacttctgtatgaaagtgtggtcaacattggcgcaacagcaattgttactgaggcggcaactgcaatgtttggtgaagcaggtgtcagtgcagcaacaggcgtcatgactgtatgtcgtctcttttgcactgatctactcataataaaaaatgttctcttatgtttatatgacgtctaactgtggagccccaccttttttcaggtcgccatcttacttcttacagaaatcacacccaaaagtgttgcagttcataatgctacagaggttgctaggtttgttgtaaggtgagacagatgtaagcaggacttagtttcaaatatttgttgaaatagcctgcttgttaatacgatgtttaatgctgtatatctattgtaatgtatcagaccagttgcatggctttcattggtcctgtatccagttgggcgaattgtcacttttctgtccatggggatgctacagattctaggcctgaagggaagaaggtaggcatacataatactggcatttaatgtatattttctgcttgtgtagcattgttaattgttgttcttgattaactgagtaaccaaaactttaaaaatatgagtagcgtgtccttcataaacaactccaacaggttacaaaaagcttcttccttcatattttgctattggtgttaaaggtaactaggcagggatgtgaacggcatgggtggttccacaaaatatgcaccaatataaaaagccaagtcgatcaaactcatgtacaacaaggattcaaatatggattaaccgaataggtggttatcagttatcgtaagtattggatatttatatactatatacacaactatcactatgatggatttggattcaactgtatattttgaacctaatatctgtatgtgtattgttgtgcaatttaaacatgttcagaactcgaggtgtgaagatttttaaataatcatcagattttttttaaaaaaaattggtagggtagagttgataatttgtgtttggattggcgccaataagaaacaaatttatgggtaatgctgaaacatttggtagggcaaacttttgaggggatgtttggtacggttgcaaaccaaaatggacgtacattttttaaggacacggaattctgtgtgttttacacaattttttttttcagtgaaccatatgttact

SEQ ID NO: 77757 - DNA, 7201 bp, Oryza sativa
ctacgcatgcatgcatgaagttggtacgtatagtacgtagctagctctttcaaattgttgtggaacgaatccatccttccgagttgaattaggtttcgacctgcgcgcgtcgagagaaattaaaatttaagagaatatcaaataagatatagttcaaattgttgtgtatcgatcgatcggtatatcaaataagagattatagttcgttagctagtacgtacgtcgcggatcggaccgcgttgctcgatcactatatatatctgtcgatcattttgctcctacgtcgtactcaaaccaaggcaaaatctagctctccatccatctctctttctgcttgcattgcgtcctctctctctctctctctcgctgcttgcgatttcattcctttcctgcttcaggcagctgcaattaatatcgtcgacaccaggatataaagctccatgtacgtatatccaacaaacatctcagtaaagctgcacgcatgcgcgttcggatcttacattttctgtacgttttttatcttcagggcaaatgctgatggcatttcctttggagcgggtaggggcagtcaaagcacgaggcagcacaatgctagtaattctcattcctaactatatatattatgttgcttagtttctgaattctccgggcaatttattttgtttttcagtccgaagtgctacaggtgggcagtttactatgccttcaggtatgacacggtccgatcaaagccagatggcccggttgcccaattctcaacgtcatgggcacaacgagatgacagaacgtaagaaacatatcaataaacatactccatcggtatgtaaatatttaacgctgttgatttttttaagcatgtttaaccgttcgtcttattcaaaatcttttgtgaaatatgtaatatatatatatatatacacaaaagtatatttaacaatgaataaatgatagaaaaacaattcgtaattacttaatttttttaataagatgaatagtcaaatattttttaaaaagtcaacggcgtgaaatatttagagagagatatagtatttattaacctatctatttcattttagttactcaatattcctaccttgcataaccggtttattttattaattcttcagtggaaaatgtagctcgagcctcggcgagtactgtacatggtactggccccgaatcacacagccgtcaaaacaaccaggaggtgccgccggcgtcatcaggcagggactacgacaccggtttaactattttatacacttgatgactatgttttgtgtgcaagctagtcatatcgtttgtatatatcattgactaactcgtttctctttttttcccttgtctatccagatttcaacgatcgaccatttaataagaaatctaaaaagaagagtacgtctcattgcattttttaagccaagtacgtcattatcttcaaacacagtatgttatcacatagatagttgatgcatgcaagtttacggatcgatctacacacatgtgtgctgacgaaacatttaattttctttctcattgacattacgcaggtgatttgtgactagtgagaggatgcaacaagtaaacctttaatcgacgacctctctgcatatatacaagctttgtgagcataatggccggaagttaattatttggctgtcagcaaacccccccccctcccccccaaaaaaaacacatacacatacacacaaaacatacacacaaaacgtagaggacatatccggtgaaaatgagctaagtgttgaaaactcgtgaaaatcatacctaaaagtttcgtaaatttatgaaaaaaatactagagataggtgtagatataaaatacattctcaccaaatcttaactccaaactcaagttcgttatcagaaacaaaaaagacaaatttcaggtgatttcaggtgaatagtgtcctgttactattcacctaaaatttgtcttttttgttactcctaaacgaagttgagtttgaacttgagatttggtgagaatgtatttcatatctatacctatctctagtatttttttcatgaatttacaaaacttttaggtatgattttcacgagttttcaacgcttagctcattttcaccggatatttccctgcttactttctacttgtgttgtccggccattttatattatctgttctgtcagggttaagtgtagtagatacaacagatgggtaaaatgagctactttctccgttccacgatataagattttctaacattacccacattcatatatattgatttattaatatctatatgaatatgggcaatgttagaaatattgatttattaacatctatatgaatatgggtaatgttaaaatgtggacaatgctaaaatgaaataggtgccggttctaaacatggagccgagcatcccctcgtctactctactcattgagaacaagcacatccgcatcacattcatcaagaacaagaatgaacaagaacattcatcacagcaagcacatccacatccaacattcatccacaacacaagatttggactcaaatttatgcaataaaaaaaagaagggattcacacctcgtcgtgccacctcccgtcggcgagcccgccgcctccctccggccagcccggcgctgcgtctcctctgtgaacccgccgtggcaccgcctgccgccacctagtcccggcgagcccgccgcctcccctcccgccagatctggcggaagggaggcgtcgcccgccgctgccgcctcccgccgccgcaactgcagcctccctcctaccgccgcaactgtagcctctcctcccacccttgccgagcacctaccgggccgatgccgtcgccgccgcccttcctcccgccggatctggcggagggaggcgcctccgggccgccgccgctccttccgccgcgcaccgccgaagccgccgacgccgcccctccagccgccgtgagcgagaattataggggagagagagcggagagaacgggagtgctggctcctcgacactatctcctcgatcttatctcgatgctagtggtggggcccgccgtctcagctcatcccggctcggctcaattagctggtgccgcatctataacaagtcataggtgccggtttttaatattaaaggtgtcggtttttaatattaaaggtgccggtttttttaaaaaaaccaacccaaatgtaataggtaccggtttttatttagaaccgacacctataattactaaaaggtgtccgtttttacgatttcagcccgcactattggaacctatagtggcgacacatatttgatattttgtagtagtgcttctataatccaaaaataagtccaccatctgcctggcacactatggggtataggtatggcatacaggtcagcccccgtttgatttttggttcctataggtatgtccgttacgcgtggtgacagtttggccacatgccaatcgtcaccaatttgagaaaataacttttcataaaaatataattgtggcctctcacatgcaatcacatgtcatccccttatatcttcttcttcctcactctccctcctcttctctctcatgccaccgcctcatcatgcaacctgctcgcctgtgcttgttgtggaagaaaaggaacctccacgagtgcgcctggccaccgtcgagctcttcacgcgaccatcctccacgagctagccagctccactcatcactcgtgtcctttatgaactcgatggcagcagcccactcgctagcacaagccaatatatcaagctcctaacctgatgaggaacacgcatgcccacgtgcattgagcaggctagaaagaaacaaacggtccagagcacatatttgttgaatagtatagggagataggatactatgaatattggagatgttgtatctgttgtttttataagcacataatgatttaatttattccataaataaatcataacattgcagatgtaaactagcatcaacacatcattagatttacatatgtaaactaatcagtaaaatatgaacaaatcaaatatgcgcaacatgttgaacacgtaccgagggttccggatgaccgctgccatgccatgcgaggcaaggcgagcacgtgtgtgttccccctcttctctccacctcacatgcttaaagtggtaaggagggcatcctcccttttaaggaggtcccctgtctagaatgagtaaggaggttctaaactcaccatgcatgccatcccatgaggtgggcttttgtgattttctaaagaattaatcttcgagtgggctaaggcccatctattaattccaacagtattgagcctccgaagccagtatatatagaagtacatatggagtagataaggaaggattacaaatatggaagaaatctactacagatgaatcatatcctaatatgactctaccatacactctaacaatattcacatcaaacagttcgaatggctagaaaataggctcaaagcggcgaccatgcatgtcttcttagactaccgctgccatggaaggagggtagcgggatctagctacaacgaggacgtaaggagatcaagcggagagagatgggatacaaatggttgtgtgcagtgctaaagagggaaggatgccgacggagacgacgagctctgcgcttagctcaccggtggccctctcctccacgtggctatccgatcgggtcctacccccaacagggacggtagcgaggcagccaagcgagtaggcccattatttatttataattttagagctgattgtatatcacatggaacggaaatcactttggagtgaatcaggggtataatttgtccagttaaaaaagtttgggggtatgaaatatcttgtattagactttaggggtataaatcgaactacgcaaaggttagggaggtaatttggatttttttttccccaccacaattccatgagccctgctgcaaaagaaaaaaaataaagtgggacctgccataatatttgttgatttcgttcttgcttgccagtgataagtgatcccccaactccaccatctccagagatgccattgtcgtcctagtcgaccaccgtagtctttagcacccaaagaagggatccatcgcgttatgccacccatgcaatagttgatgccccccgtatgcccagtagcctgctagtggattgggtgggaatgggtttattggattggatttcctcttggattgtgtttggatggtttgtaatgggctgaggaaatgtgggttggtgtggtttggatttggtcgccgtttttctggactagaaatggtttcaatccatgggtttctattggatggcagaatgggcacaacccaaaatggttgccgtgcatcgtcaatccccaattcctcttctcctcgacagccaagtcaacacgacaaatcgctcgatgcaccgccgctgtgcttgccaatgctttcctcgctgccgtggctcgccggcgagacgcgcaatctggggcaagcacatgtggtggcgaggtgagggcgatggagcgtgcgcggggggcgtggaaggaggtggagctcctggacgagcggcgtgactagcggtcactgctgcaccgacggtccagccaccgcagctaccttttgctccgcctcttccgcgccggcaggcagccgttgccatcggtgacgatggcgccatggagttttgcttggaggtaattgtggcaccatggattagcctatgccgcgcgaggaagacgattggttcgtcaaggtcagcatccttgttgatggtcaatggattgaaatgggtttgagtggtttggaaaggtggattgaatccatatgaggggaatggattggcttggtttggactgaggtagaaaatgggttggaatattggtttgggttctaaaagttgatttgtggactggattggtttgggctactttaactggttgtcatggtttggactgggaatggtgcgggttttgatccattggcaggctttattgctcacatcccatcaccatcgatgagttgctgccatttcgccaacctcctattcaagcttccccgcgtcactctcctccatctaggagttgattcttggatgctccgacacaattgattttttggatcagttttctagttttcaaggatctagtagcgagaaaatatcttggattggcttcttaattagcaacatgatttagaatattcaaggatgtgttcgagagaaggggaaagaagaaaattgagaagatatgcataacgagataaaccattaatgcatgatctattacatattaattattttaaacataaaaatgattaatataatttttaaaacaatattttttttattttttctaaaaaaacacattgttagtagtttggtaagtctgagcgcaggacaccagctatttctcgtatcgttcaaataatctgctttgggtgtgtttagttcacactaaaattggaagtttggttgaaattaaaacgatgtgatgtaaaagttggattgttatgtgtgtagaaaagttttgatatgatcgaaaagttgaaagcttgaaaaaaaattttgaaactaaagtcagctttattagtactctgctgataatctgaatctgcagcttaaggtgacctatgtgcttgctcttgcccgccgccaacaggagctactcctactcgacgtgtgcatccttctcctgcgcctcaacaacagtattgattgagggtgtttttgattcatggtcatgtatggataggatatagccatctatattttattgaatatggtgatttaattttctgtttggtttgtatggatatggcgatccaatttcttgtttggttcgagggatatagcatagatgagaaaagccaaaagttagtaggacccatttgtcatatatatatatatttatcaaaatataatcatccgagatcttgttttaaagatttaattacaaatataatggtgtaatcaaatcataaattagataaatggtttagaagaaaaaatcatttggagcttgcttaagaggacaaccacagccaatcggaataggacacttcacccagtccaaaactggatggcttcatccagccaaatcggccggatgcactcatccagcatagtaagggaatactctctattatgtaccgtctcatccaccctgacctccaaccaaacaccacagaaactcgagcggtcatctcccatccagactc

SEQ ID NO: 77758 - DNA, 4500 bp, Oryza sativa
agtggttgggttaattacaagaaaaatccaatatctgggggttgataaaataatgttgttaagttggatcaaacaactcaaaaccccagcccataggttacatgcaaattagttagttaactacaacaatttgctgaattattaacctcttaatttattcactaattgtccatgcatgcaacaaccaagccactatataggtcagtggaagagagaaggttatagcaaagcagcagcaactcaagtactcccaggtcaacaaggccaaaagggccagtgagtggctagcttaattagctaagctcatagtcatagcaatggctggagccgtgctggtgaggagaatggtggtggtggttgccattgccgccttggtggcgcccggcgaggtggcggcgcagctgacgccgacgtactacgacggcagctgcccgagcctgcagtccatcgtgaggtcggccatggcggccgccgtgcagcaagagccccgcatgggcgcctccatcctccgcctcttcttccacgactgcttcgtcaatgtaagtacaccatagctagctagctagcttgagagtggccagccatggcggctctgagaatgacggcggatggggatcgagctgatggtcgctcgccggcgttcatggcgattatatatgattgcaggggtgcgacgcgtcggtgctgctggacgactcgtcgacgatcaccggcgagaagaacgccgggccgaacgccaactcgctgcgcggattcgaggtcatcgactccatcaagtcgcaggtcgaggccgcctgccccggcaccgtctcctgcgccgacatcctcgccgtcgccgcccgcgacggcgtcaacctggtaattaatcaatttaccaaccaatttaattaataattacttttacactgcatgcatgtcaatttttttttttaccgtgcggccgctcgccgacaggccgtacagccaactcaagctgcaaatgcaacgcactgcatcatgcccgtgtcaaaaagccacctacatttttaatgacgcacgcatgctcgcgccgcgcgacaaattacaatctagagccatccgcacatgccgtaccccctcagtctcaaaatattgtttacatgtaattcaaataaaaaaatttaactctaaatattttcgttacgaaatgcaaaagttaaatttggatttacatatttgtgggaatgatatatcatatattaatacatctgcttaattttttttaatttttttagaattatttgggtgacgtgcaaataaggaaggacataccctcaagagtttagaataatttcctgtccaatatctcactgccatgtgggccatcccctcccacgtccatgtacagttgatttgcgttgattttacttgcggctgcatgcatgacgaaaaatgattgacgctgatggatggatcgaccgatcgccttagcctgtcaatcttgtcgtgcatggggtgtcaagacctgcctaatcaccacaccaaattgtaactaaactaattttacagcggtaatcaactcgagagaagtaaaactaatttggtgcgtaaatttgatttgctgcagttgggtgggccgacgtgggcggtgcagctggggcggcgcgacacgcggacggcgagccagtcggcggcgaacagcaacctgccgtcgccgtcgtcgagcgcggcggcgctggtgtcggcgttcgcgtccaaggggctcgactcccgcgacatggtggcgctgtcgggcgcccacaccatcggcgccgcccggtgcgccaccttccgcgcccgcgtctacaacgacaccaacatcagccccgggttcgccgtccgccggcggcaggtgtgcccggcgagcggcggcgacggcaacctggcgccgctcgacgcgctcagctccgtccgcttcgacaacggctacttccgcaacctcatgggccgcttcggcctcctccactctgaccaggagctcttcaatggcgggcccgtcgactccatcgcgcagcagtacgccgccaatggcgccgccttctcccgcgacttcgtcaccgccgtcgtcaagatgggcaacatcagcccgctcaccggctccagcggcgaggtccgctccaactgccggaagcccaactaagctccggcgatctttgagattcgtgcccggtcgatcgatcgatcgatctttgagattcgtgcggagatcgatcgatcggacggtctggatggatggctagtcaactgccagctaggactaggggatggaggaggtggggcccagggatcagtgagacgtgtggctttttttggcgtgggaaggaagcgatcgagaatccaagggaccgaaataattaggtggagtggcgctgtcaaaaggggaggatcaagagggaggtggggcccacgctgcagtgacacaaagggctgcatgcattgcctttttttttttgttattttggtttggggttaattatcgcattcttttcctgtatcataatattggtggtgatcgatcgatcgatgcatttggtaataatttgagctgtaattttttttttttgtatatgtactaccccatgatgatgattgagaagatgactgattagtttgcaaggcatgcagatatgaataatggagacactagttcatgcatgcatcgtgcatgtggtgtgttttcctcaggatgcagacaagtcgtatataatgatcatccatgcatgcgcttatatatgggacaaatatgttactgtaactaggggaaaatgctattaccttcctaatatcgggacgaagaggtaatattgaataattatactcaatctaaaacgaacgcatgtgcataattattagaccaattaaccgtttatcatatacacgtatactcaaatacaaagatccattattcttttagtgtatcatataaactagctaggtgcctgggtggcccgcgcaactgcgtggttagcacccatacaaaattatatagtttttaatatggttttacttaaagtttattaaataggtatcttgttgtcttaagattttgaaagaccaacccttatcatccccgtttttctaattttatagtttttatactcctatacggctcatccactgtctcttctatttcgtgtcattgggattttaaaaattggatataattattgtttgggtttttttatactttctaaaagtcccgtcaaaccatcagtggctttgccactatactcctctacggcttgcccggtgtctcccttctttattatcattgagaatttaaaatcaaacatgattatcattgggattttttttatttttagatgtctcgaacctttaaaaattggaccttgtaatttttagagtttattgtgtcgtggggtttcatttttctataaaatttcgaagtcacttcaaacgctgccactatactcctctacggcttatccgtcgtctactctttattatcattgggattctaaaagtcgaacataactatcgttggaattcattttttactttctatatgtcccgccaaccgtcggcggctctgccactatacccctgtacaacacgcccgctttttattgtcattgaaattttaaaaacgaatatgattatcatgagtgttttttttactttttagaagtcccgccaaccgccttgactggttgcttcacgtcttgcctgtcgttcctccttttaattgtaattaggattctatttagtgttttatcaatagtttttagatgtcccaccactactttactcctttataggcctattacttacttcctcccgtttacaatgtaagtcattctagcatttcctacatccatattgatgttaatgaatctagacatatatatatatatatatatatatatatatatatatatatatatatatatatatatatatatatatatatctatttagacccattaatatccatatgaatgtggaaaatgttagaatgactttcattatgaaatggagggagtaattattctcgtcatgtgttttagatggtcctttctttcaatggtctttattatcttatcaccaattttagttatttataaattgtattcctagttgaaatcttatttttcttttctaatttcagaatttattttattttttattttgaattttaattaatattgcattgtgttcttttaatatttttattttttattttttattttcagtttcacttgtttcaaaattgtattcctacttgaactttttttattttctttttctaattttaatttttaattaatctcgtattgggtttttatatagacttttatttcaatatttcttaattttaattctgaatttcagtatttttaattgtatttctacttgaactcttcttttttttttggctaatttcatattttattttattttttattttgaatattaattaatctcatattaaattcttatatgatctcttctttcaatagtgcttatttttattccgaattt

SEQ ID NO: 77759 - DNA, 19623 bp, Oryza sativa
actttgtctttgtcctacgtggcagtgacatggactggaagtaaaatgtaaatttttaaaaaatgtgggtcccacatgtctgtcatacaaaacataaaattagtggggcccacatatcagtcaaacaaaacacaaaaaaggtgaggcccacatgtcagtgggtcccacatgagcaggtggaggagatgccatggggagacacccctgatttccagctgcatgtagccgaggaatgttagaaggggtcggagagacttctacaggttgtcgagcacaatctcggcggtagacttgatcggggatgtttccggcgggaagaacaggtcgtggatcttcacaaggacgaagaagggtatatggttctccaggaggtagaacacgtcacggatgtgctcgatgttgtcctgcgcgcacatctcgccgccggaggagctgcttcctcccccgaatctgccgataccaaagcaatggaggatgtagaacccatcgaccaacaacagtttcgacggcgtcaggtcgtcgaacttattggcgccgtctgcgtagtatctcctcacttcggcaaggaagttggcggcggcgatctcacccaggtagcggtgcagcgtggaccgctgctcctgctcgtcgccggggagggcgccgtggagcgccgcaagcttcacgggttccatccgctggtcgggattgcggtggtaggggccgacgaggatcgagtcttgggtgtactgggaactgtcgacgttgcgaatgcctctcttcaccattgagatgtggtactctgaagaagggacgattcccttaaccttcaaatcaaattgcgcatgctctcgtacaaaccctcaaccaatgccttcatgtcgatgattgtttgcggattggggtttcctgcaaatcaaattaaaagagcccgttgctaccattttagaccagagaggcagagactatctaatgatatttacttatatactatttacatcgtcagatttttttctttttcacaataatattattgaacgtctacaaattatatggtaaactattatatatacaacaaattaacgcttggacacactgagagataagagttagcacgggcattttaaaattgaacaagtgaatgttattttcaaccctcccaccccctccccccctcccccgggcttaaccatagaagtcaaaagttcatcatgtacaaacgtagacgctcatagcgcgtcatgttaattatagccacaagtcatgctttttgttccttgcgtaatttctgtgcatatgttttcaggcatatcattaacatctgatataaccacaacgtcattcattttatcataagaccacatataaaaaaatataaattccttttggaatactatactttgttggattatcacagtacatatttttaggatgtgtcactattttagtaaaactagatatgtatcctgcgctattgcacagaccctgctatttttctaaatgttaaattgttttttggtaactaaaatttattagtaattacatatttatatccgatacgattttttatatataaggcaatcatacgtcatttaataaatccatcgaggcttgcttgcaggggaagaattggagttcttgtttgcatgcatcaagtttaatatatactactaaaattgagatcttagataatacaaactaattattatttgaaatttgttttttcaatgttttccttagcgactagcgcatgtctcatggctgatagtggtacctaattggttgttcataacattaatatcaattccaataattttaactagatatggagctcctcggcccttttcaaataaagatgatactaataataatatatagatatacaaagttcaaaaaaggtttagtcatcacaaattagttgtcaagggattccattgttgtcatgtgttggtggctcgttgtgatctttgctggactcatgtagtattgtggttggttgactagaaacctaatgcaacttgaccctagtcatcgtcttctacaaccctactctccttgtgacggcttaatacaagcttgcacgatacctgtatgttttttttttctcataacacacttgtaagacttcttttccctcagtatgatggtctagctataacatgggaaaacacatacaaattaagccatataaattatccgacaggaaatttcatacaagttaagtgtttgttattctacctttttaaagaatatatagtgttattatctcaaatttattaacggctttaagaaatttagtaggagggttatatagcaacgtttaatgtgtttaaaaattaataatttataactattgcaaataaagttatatagggtgatataatcattgttgtcaatcatcatatatataacttcgtatacctacataactaagccgtgccggggaaaattgaaccaaagtgatagtcgaaaaagttactatgccattataaaattgtaataagcaaaaatatcaaaacaactttcaagtgttcttacttttatttattatgaatatttttttaatatataacttcaatcctctcttaggtccaatctgttcggtcatatcgggctcggtgattgctatacaattatacaatatattttattaattgatttgtactttttatgatcgattgttttgatggcatgcacatagctagaatataactcgagtaacacatttttacaacttaaaacatagttaatatggatattaaattattaatttttttatctcatctaaccaagaaggaaaaagaacaaaaaagatggtacgtacataaacacgtacgtgcacatccacataagggagatgggaccatttctccgtgtggtttttaagataaatctaattagaaaatcttaaaacggatctaagtggtagctacaaaataggagaagttagctactgatcccttcatccaaaagtacatatttctttttatcaccaagatatgtaattaactcatccatcatgtgataaaaccaacgaactatacacatgcatgcaaccaagaatagatactgatatgacttcttaggtttcggtcaaaaatttaatttagcatgtagagattataaatagttcttagactttctaaaaacaaaaaaaatatatttcttaatctttcggatggaggaagtagaaaatagggaaggggagagttggagggtggccggagggtgggggcagtaagtacttgcacaaccagaaattttttttccgataaagatctattggttaaaattaatgggtccaccaatttaagaaaaaatcaatggttatatatttatcatacctttttctaatttactagaacatcatgtggtggcttattaggagcgtttgtagaagaccatgacggtttgaaagcgtttatgcatgggaagtttaatggacttttagtatataataaatagatagatgtgagataataattataaggccacccaagaccatacgctagtcatacgcatgccaacactgcaaaaataaattaacctaccatccatggtgttaacaaataaatagctttaatatatagcgcgtaggaatgaaaacaaacgatcgatatgcgataaatataagagaactagatataatcatactatatgtttatgtaatttcaagacatgtaacgtccaagactccaagcgcttggctgatgacaaacaaaggaagttcgagttcgcttgtacgaataatggcaaattagcaaaaccattgacataatattaagagatgaccaaagatgatggagaactttccgaaaattgaacaaatttaacgaaaacatttggcagcaaattttgttaataactacgtaactgatatatatatcatggacgtggaacactacattcataaataagagataatataattaatgacgagatgtatgcacgatctacacgtaagtaccttcctccatgagtgacctctagccagctagtttctggagctctagcacttgcttccttgtactccgatctgatttgcctctgcgcatgtaataccgtgcatgcgttctcgctctatatatagagtgtcagcagcttccatctcttgcaaccaaactagctactcttaatttccttctcatttcattcccgacaagctcggagaaacaataaactagcgcatgtgtgtcatccactatccaaagcatttgcctttccgtatggaagacgaattaaaatgcaaattttatgcaaaagcaaaataattgaagttgctttacctctttccatttgtaattgaaattaattaatgattaaagcaataccgttaaagtaggtcaattacgtaccacaccattcgctactactacggttttatgttttaacaggtacattttctgtgtgtactacttccttcgtgctctcacttattctgaacatgcatttttccttcatttggtagtctggaaaagctagctagcttcctaattggaaatgtgagcatcaccaacaaaatatttatatcattccctatccaaaaatatgaggatttatatatgttaaaaatttgctccaacatattctctaatctcattccttatcccgggattatcgttctctttttctaaggaagcattttggcttccaatcgtggcacttcacgtgcaggaagagattgcacacgtgatctagcatgagctggcgtgaggaaggagagcaaaatatattttttttccggtgaagattttatcttggcccaccttttaaattattaggaaaccaattttacctaatctcttggagagaggaaaattttaacaccttaaattattattaggattcccataataaagaaattgggaatgaaattttaggatgctgttggtcatgctctaacttgcttggtgagcatatattaaagtttacccatctataaaatcagacaataatgcccctcccggctatcacatactgggtatatgtagatcaaccctattttcctaagtgtgaaaaaaatatcaaaaaataaaaaaaattgcacatctctctctcctctacactagagatgacaaaaaaaataggggggggggcagccacattggcgcactcccctaccacctcaatgtcgacacgctatggtggcaggaggatggcgccagagaggctggtgctgtcctgttggacgacggcgccagcgactctagctccaaaaaagaatcttttgtgtgataagtttttttaggggtctatttgcgaaataagttctttaaaaagaacaaattgtgaaaaatcctgttttcctgcatggtgattttttactatatacagaaaatagcattccccaatacttagtctttaaaatggtttcaataaaacagatggagaattgatatttcttgatgtccaacacgtggagaccttgatccattttttaccccccgtccaatgccgcctctatgttctctctctctcttgcatagtagctaatatactaatggtgatatatattaattagatacttgttgaatcatttactaaatatatctattgcttcaaagaaacgttagtgatttttgtttccaacagtcacgtataagccttttctgtggatgtgtttgcgtttttgcatctgaatcatctagttttcgccgacaaggcacccaaaagcaagagtgtaaaaaataattactaataagtaaaaatccttctgtttgtatgtcaaaattgtaaaagctgcagtgaaatgagcatagctcaattagttgcctaccatgcatggttcaagtcttagacttgatatgaatattcgaatttacgatcaattattcttttagtggtaggtaatgtacccgttaacactaatatgtgtctatcatgactttataaatatcaaggcataccagctcaatcttttgaagatttttactattggggtagggtatacgtgtctacgttgaaaatggtgagcgtgagtgcgttgtgggcgtctgcatttgtattttgtttaaaagaaatacaaaaaccgccattaaaaccatattttactacctaagctattccagctggttttaataaagggtgcacaatatctaatttcatagttctacgctcgatcgggaaatagttgagaaggttaattaaaatgaactttaactacttttagtaattaagttctaacccatgcatgtacaaatgtgtgcatgttcgccgctttttccaaaagctaacggaagtttagatgcaaaatttgtttaattaaggcaaatactttacaatatatttattactttaaatttaatatggcgtgtgcttttaattaagtcatatgaaattgaaagggctagttttggggatactatactacacctttccagtgcactggtgaataaatcaatatttaattcgaccggacaactaggatttatataattgttattttgatgtaccagtgtgtaagattctctcctccgtgtgccatttgttgtgggttggttggtgactgtgcgtgaaaacagtcgagtgtgctacttagacgctgccgtagttactatcgtatcggatatttggacactaattataaatattaaacgtagactattaataaaacttattctataaccctggactaatttgcaagacaaatttattgagcctaattaatctatgattagcctatgtgatgctacagtaaacatgcgctaattataaattaattaggcttaaaaaatttatcacacgaattaactctcatttatgtaattaattttataagtactctatgtttaatactttaaattcatccgatatgatagggactaaaatttagtgcctcgatccaaacaccatcttagctaacactacttacggttcgacgacgtgcatctaaaacagagagtaaattttaaacaacaaatcgataaatgtaagctacgaaaatagtgcatgctgaaagctcttcaccagtgctaataaagatctatctttagtcccgttggtaagataaaaaaaaaactctatccttttgaaccgggactaaagatatctttagtcccggttttattgcaaccgggactattgtgtattttggccgaccgaccaaagatggtttctccaccagtgattgttccatgcggcaaaatatcaatttttgcatctggacaaacgatccgcattcacccaaaatctgaaaatcggatctttgcaatttacatgcgaaaatccgattttcaaaataatgttttcaagacatggggatagacaaagcaggtcattgatgtatataaatacaatgttttattttgtccaatcaaaatataccatgttttgttttaaaaataagaccatgcgaatattcgatgaacatgttggccacttgataaccgtgtcatttgggtctttacaaggtttcatggattgatcattacttcaacctttgctttattcgcgtcttagttaatgggggaacgtatcatgtgaaaaccagggaagctgtgcaaacttgcaaactctcaatcaacaccacataatcaccatctgatggctagggatagaggtgggctaattttgcacttaagcgcccaccattagccatactaatcttgcttttttcaaatcacctcctcccctaatccccagtgcgcacgctgcctgttcgtttctcccgtcccgtccacgagttgcccgtgagtcgctgccaccgtcgtccgcgtgtcgcccgtgagtggctgccgccgtggtacgcgagtcgccgccgagctggccctcaagtcacagccgcacgccagcgagtcggcatggagtcctcgcccacaacgccagcgagacgtttttcaatgtttcacagtttcagtgctgatcagtgcttagaaaaaacagcatgaatgtttcagtgttttagtgattgtaaacaccttgtaaaaaatctggtagaagcaactgagatacaatttttcaatgtttcagtgtttcaatttcacacacaattgctgaatcattaaaatacacaagttcattacataggaggcaccattgctgaatcactaaaaaaatcagcatgaattttcaatgatatgagtcttctggtacaaacaactgagatacaatttttcaataaattttacacacaatgctccacacacaagttcattacacaggaggcacaattgccattgcagagccattttttcaggcattacagccccagacgaggacgcccttttgttcaggcacaattgccattactcagtttctgatccagtactgactgaagccgtggcaggactgcccttgggtgcctgctacacatgtgtgacaatagcaaaccactgaccatgaaccttgaggtactcatcctgccacacatcgagcctgacctgtaggaagttgtcgtgctgcctctcactcctgatggagtcctagtaatcactggcagtgaagccccttctcattttttgctggtgatgcgcaggtgccggtgaagcgttgctgccgatgatgatgcgccacgctgctgcccatggctccaattcatgccctacagaactgggcagaggtgccaccatcgaggacatcctgaactggaccaccaccgtcgaggacatctccctggcggccgccagcaaggccacctccgaccaccactgcatggctggcgcagcccaacgcgggactcatgaggcggcgcggctgggtctgagatggcgtggcggatcatagtcggcgactggatcgcaagtcgtggggagacgatactggcgtaggggctcgggtataaaagtcatgggaggcggatggcgcaaggggtgttttgcaaaatagacagaggggctggcgggcggttatttgcaaatttagcccacctctatccctagccatcggatgctcatcctgtggatgtgatcgagagtttccaaggttgcacaggctccctggtttccacctgatatgctcctagttaatgaactacaaagtagctagattagtttttatttttacccataagcacctgaggatgtttcatatttccacgttcccaaattaatcatcatacgatgaaaaccaaattttcttaaaaagcgatcataatgtaactgcaactatatggacacatatttcatcgaagtacagttaatgtaacacgaaaaaatatgtgcatgttaaggtgtaattgtgcaatgtgtttttaaactatgcatatgcattgtggcaagatgtatgcatattgtacgtgacgtcttaatcaatgcggattaaactattcttgatcttgatgcacagaacattattatgattatgatggtcaatttaggttctaagagagtatttaaatactccctccattctataatatataatataagacacagccacttttttctagatgttccataatataacgcatgcatgtatgtaggcaattaactatgatccttctccattaaattattactttttttaaatcctccactctcatgttctttaattctattatatgtatgcattgcatttattaggatgatcgaaactacaagatgataataaatatttttttggtctttgggttaggggtggttagaacaagtttaatagtatagcctactactaactccaattcatatatagttaatctaatagccaattcatacaatagttgcttactatactattaatatatgaccccacctgtcatacacatattgtttattggagtccgcgctgcagctggctacagatctgtaacccgctactcttctctctcatcttttatcttaataaaatatgtttacagctggctaatagtctgctattgtacctgctcttggaatggagggagtaccttagttaccttttgttcctaataaatgacttggttcaaattgcataacatggtttagaatctttttgggtcgtaatagctgctgctaacttttttgtccataactcgcgtgtccccgggggaaagcatgccgagcagtagcagcctacgttgggtcctatctcgtgatgacgtccagtcggggtcgtcatcagcggtacttcagcagcaaagcatctttcgatctgataattttgtttgccgttatttccaaactttttctttaaactttcaacttttccatcacatcaaaactttgctacacatataaacttagatacgactctcggtcgggcgatccatcgggagagggttaaatcgggcgctgacgtcagcatgacatcagcgcccgatttacgtgcaaacttactttaaactgatttttctcttaaattacttatccaaatcatgatccgattataccattaaattcgttgcaattaaatcttcaaaacaagaccacacatggatatattccgatgaaatttttttacctaattattgaattatttttaaatgttacacgatgttccaccaggtatatcggaattgttgcactaagtagatcgaaaatgttttgctcatttaaatcgggtgttgtttcaccttatataaaaacgatgtttcagcaaatagcgaaagaatgtttcagttcactgcaatatttgatccatacatagtgaaacattgtaagtacactaggtgaaacatttttcggtggaacaaaaaatgaaacgaattcccttaataggggtttccaaaatatatgggttttttgttgcaatagaatgttttagttcactgcaacattagatctatatatagtgaaacatagtgagtacactaggtgaaacatttttatagagaaaaaagaaataaatttccccaatagaagatttctaaaatatgtgagttatttgttgcaatgacgcgttctataatatcaaaatccaccacaacatttgatccgtatatagtgaaacatcacgagtacactagttgaaacatcgtaaaactactggttgaaacatctaaagaaccatatgcagcatttttaaaaaaaatatcaataaaaaagctaaaatattttttttcgaaatataatcatgtgtggtcttgttataaaaatttaattgcaacgaatacaacggcgtgatcggaccgtagattggataattagtttagaagaaaaatcgttttaaagctattttaaatactcagcatgtggttcgaggcgtccgatttttttcggccgctcgggcgcccgacgcgcaatatttccccataaacattcaacttttccgtcacatcgttccaatttcaatcaaacttctaattttggtgttaactaaacacaccccatttatacccttactttcatttacattttcatttacatgttcaatattaattttattctcaacttttacggtttatatttttgccgttgctattttaactgaataaggtgtttgcccttgtttttaccgaagggagtggagaaagagttatatattgcggtaaaaaaaacagagaaagagaaataatgattttctaaaatatggattgacttttttgccctagggagatttagactactgtctgcctgcactccagaagatttttttttacttttttatgttttaattttattaaggggcaattgtgttcttacctttactttcgattgcaattgtaattttatccctcttttttagactttgctattttgcccttgctttttgaaattgaagcttaggtttgcccctgttctgttaagtgaacttaacggaattaatttggttataaaagacaagtttgccctggtagatttgcctactacgaggcagtgaagaatttgcaggacatgatccgattaggatttaataaaaaaggacaacacagtgaatgaattatatcactgtttgatgtgaaaacaatttgctcgtagttttagatccttccatctctgaagaaccagaattattaatacgtaaggagcactggagggagcacctgcgtaggagcagtccctaattaatgagcttaacaagaaaagaaaaccaacaaaatcaaacaattaatgaagtagccgtagccttcggcctcctcttcgaagactaggacgccgatgctgccgacggcacaatgcatggttttgtaggaacagcaggagttgcagccggggcagcagcggctcttgcaggttcgacgggttttcttctcctccgtcccgacgctgacgatgtccgccatgaatttcctcactcaccaccgtgccacacgcggaccagtctgctccgcttgcacaccaacgcgccgctgccgtcgcttgcccgcgcgctcctcatgctgcctggctcctcacgtgcgccgctcagctacaccactaccactccgtcgcccaaccacagccggccgctgtctcgcccgcacatcgccactgtcttgctcgggttaggggttgggtccgattggtgaataggcagacagatctggatggactccatgctattacttgcttttgagggtatacttactggtcctttctacattttctcagaaatttcttatttttttaattcacttaatctgggcccaccaacatggtcatccaaaacaagggcaaactgtagcttcattaaaaaaaaaagataaaatcactaaccctaaaaactgtgggcaaaatcacaattacattctaaaacaagggtaaaaacacaattgtcctattaaaagaccttttcaacaaatatttataaaaactaaaccttttaaccacgccagcagatgttgtcttgccacgcaagcagtggaggcgtgacaagaggctggcgtgacagggcaacactgccgcaccagctatgggtggtgtgatagagttatttggccacgctataaaaggtttagatttgaaaatacatttgggaatagtctactagtaaaattaaaacataaaaaataaaaaaatttcactcgacaacatcctgactcgaacattccttgaccctggcgcgacgacctgtgcttgacgacctctgcttgcgacggtggttgcggtggcaggtggcatcggagggatggccaggcgtcggggagcagcagccgttggcggcgccctgaccagcggcgagctggaggccatggcggtagagagtagcgggcaagggggtgacctgacctagccgcggcgaggaggaggctaagcggcgcagaggagttgaggaggccgtgcgacacggttcggctccaagcaggcggcaagggatgaggtgcgtggaggcggcggctctggtgagacgatgcagcggtcgatatagatggccatctgggccgcccggcacgagacggcccaagcccggccgtgcatcagccgaagaggcttgtcgggccggcacggcccgaccgacgcaccgggcggtgccgtccccgcccacgctcggcatacacggcccaatactactcggaccgtgccaggccggcccgaaggcacgaaggctcatcgtgctttctcacagaaaaagtctaatttaggtccctaaactctgcgggctatatttaaatggcttgaaaataagtctattttttatacctctcgtcttgggccttgccttatacgattatataagtctattttacatccctatatattttttatttgatcggccgtgccaggcctgcccaccgtgccgagggtacagcccaggcacagcccggctgccgggtcaggccagcacaggcacgaccccaatcgagctgtaccgtgcttgggccaggccaaaatcgcgggcttcgggccgggccgtgggcatcgggccatatggccatatatagcggtggcgttgtggtgcatcgaagcaaagggtgagggtgcgacgggtccccgtccagccaccgtagcggggcggctttggcgtgccggccgctccatcgaagcaagcctgtgaggcggcggcgcagcctttcttgttcggcgcgccgcacgacgacgatgaggcgttgtgctgttgtctctctcatggccttgcggcgtcgtcgtccagcgccgaacgaccactgatccgccgacactactacctgagcaggccgctccgtctcagtggttgtcttgctcaagaagtgagtaggagctgctgcttgctttttttttttttttgcttgtgctacttcttgctacgcttgaagcctggttggctgctgttgctgtccttgaatctatcaaaatttcattgatgattggaatctggaaaaattcgaaacgtgcaataacaagggtacgcatgtctttctgcaaaaaattatcaccgttaacatgtccatctaaaataggtaaaaaaacagggtaaaaataaaaaccctaaaaacaagggtaaaattaatattggacatcaaaacaggggcaagaacaaaattgaataatacatcaggttcattcatcaaatccaatgatctatatcatccaatccaacactccacgtaatccagatcacctaacgacttggtcttcctcaccttccctctgatcccgtcgcacactgctcccctcgatccccctcctcagcctaacctctaacccttgtcatagctagtgcagtcaccgcagcgctgtcgacgatcccccatcctccacatatatgtgtagatttaggtttgatttgttagttgtataaatgaactttacttgcgagttagtacaggattggtctttcaaacaagtaatatactgtcacaccctgaaaattcaaaatatataaattgttgtttaaatggaatttttagaatttattttaaaagcctagaagagaagatctaattttttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggttttaaaaagtctcttttggctttgggccgaaagtcggcccaaaaccgctctctctctcctcggcccagtccggcccagtccgccgccgcgcgcgcgcgcgtccgcccgctgacaggtggggcccacctgtcagggtcgtcgtcaacctccggccgccgccgctcgaaaccctagtttcgcgccgccgccgttcccttccaaattcgatcgatcctttccgtttccggccgaattgatagaggggaaacaatctccgggatctcctctaccttttctcttttggaaacatcggctaattcgttttggaaatcgttggaatcgagttcgaatcggattcgtctctctcctccgaaccctaaaccttccttctcgtcgccagccgccgtgggccttcgccgtcgcctccgagcccctttaaaaggttccccggtgtctcctctacccgtcgccaccttcgccttcgcctctcgtcgccggaagagctctagcgccgtgcaacctagcgccgccgtcgtagccgtcgctccagccgtgcgccgccgccgtctcggtcgtcgtcatcgctcgggaaggccaccgtcgtgatcgccaagtcgccgccgttctcgtccgctccttcgccgccgccgaagaccgccggagcaccgtcgccgccgtcgacccgaagtttgccaccgcttcctccttgtcgccgtcgccgtccgttgatcttccgccgctcttttggtcaccggtgagttcgccgcgtcgcgctctacccgttggtgccttccgttcgcgccgccgtgccgtcgttcgccggcgagcatgcaagcccgagccgccgagccgccgccgccggtggtgacgtcatcgccgacgtcatcagggccggtcgtggaccgttcgatctcggccgtccgttttggatcaagtcgatctcggccgtccgttcgcgtgagccgtcgcccgtgcgcccggtccaccgaaaccctagcccgctgacgcaataatcttccttttccttttcaaaaataattcattattgcgtcataattcaattaaaatcaatttaagtgttttaatccgatttaatcttcaaaaattcataactaattcatcttagctccgatttagttggttcaagtctctaattttttctaaaattgagatctacatgttaaaaatatccacatgtactgttcaagcttatttatgtgctgttttggtgattttgcttctttatgtttacattctgtcgtttccggagagtccgttttcgccggagaagagtttgaagagttccaaagcaagcaaggcaagtcacacagatcctaaacaaccctttgagcatgttgatcctatttaaagctattgtttctattcaaatattgcatttattttcgaatgtcattgggtggaattaacctattgggtggaataagttattccttgataccttgggttattataatttgactagttgagctctatatgttggttcaactagatgtattagatataattgcttagccctgcttagaaacattagcacactattgggataacttatgaatcactataatttaatgatggcttaatgatagttcacgatggccaatcgtgatttgttaattaattatttgccaactaaaacctgaaatgatgggttgtgagcacatggttttgatggtcgtgctcatgacaattaaggaccggttcacgagtttcagttgtgaaacattaaccgtgccaaccacaagccagcgtgggcaacggctttatcttttgtatagcatggttcattgcggggcaccagactgagaagtggcggagataagcccacgggggtcgctggggagtccatgccttggttttaaggggggtgatatgatacaggaaggtgcgctgcagtggattgtgttatgcaaggggtattgtcacaacttctttcggaggtaccgtggtggtattgaggcacgtggtgacatgatgtggggttgtgtcttgtgggtacagtggtacacctctgatcagagtaaaactattcgaatagccatgcccgcggttatgggcgggtctaacaatgtctttcgtgattagtctcacccttctcatcataataaaaggtgctttaattggtaataatttgattagctcctagtttggaatggtatattcctggtttggagatagaactatgcagccgggatggttgttcagaatggttgggcctatacaacagggtatgttgtatagcgttggattaatattgtttaattacttaactgttttattaaattctcaaatgtttgctaaatgctgcttttgcaaatgaaaccctactttcatttgtctttagatgccgcgcttcaagcctgagtacttgtttggtgttgagggatttgtccaagagttgcgtacaatgtcctttgtcattggatttgggactgcccctttttatgcccagatttctcatgatcgtcatgaagagaagtgccgagtcaaagtcaccttgaacagtaatagtgaagatatcccctcagtgatgttcgaagctggaggaagaaactacatccatgcatgtcaggaggtggcaaggatcgccataggagagctccgcgatcgctatagtgatcagttggccgacacggagtatcgctatcatcctcgtcaaccccagggaagtgaccgtggcagctaccttgagactgaaggaattgagaatgatgctaccacaaggcatttggttgagatgctgtgggctatggatgaaacccgtgcggagactgtgttagcggctcaagatcgtgaagaccggaatcgtggtaagatttacaagctagaagacaaggtggatcgtttggagaaggagctagctacgttgaagggagaagcaccgccgcagaaggccaggattcgtctcaccgcaaggaagagagctctatttgtcccttgctatcaattggcgccaaaggttcgtgtggtggagaaagaagttgccccaaccctagcagatccttcggtcatcatcataagtgacgatgaaaaagaagaatccaagcgcaaccattccaagattgagtgggtagcaactcaagatgatgaagacgagccgaacgagccttcaatcgacctccgatgctcggaagaactagagtgccatgtctaaccgttgtcttagatcgttgtgttagtttgcttgttttaagtttgcttgtgggtgtctcgcatgtgatttacatcagtggtgggatgtaagtgcatgtgtttgtttgcttttgagtgttaggaagttggtgagtttggtggtgtgagagtcttcagtttgtaataatgaaactcagttaagatcaataaaagttaaagtaattccctgtcctaagtagtttcccccggtttctcttcttgtgccctgtctatgccagatggtgaacacacgcagcaacgggaatggccccagtaacaataacaatggagagaatcccactcttgctcaagttcttttcaacagactcagcttatgaacatgatgatgcaacaacttcagaaccagcaaaaccaaggaaataaccatgcacctccccaaaacaagttagcagaatttcttcgtgtgaggccgcctattttctctagtaccactaatcctgttgaagctggtgattggctgcataccatagagaagaagttggatttgcttcagtgcactgatcaggagaaggtctcatttgcatcacaccagttacatggccctgcctctgaatggtgggatcacttccgcctgaataggactactgctgaacctatcacttggcttgaattcaccgctgctttccggaagacgcatataccatcgggagtggtgtctctcaagaagaaggagttcaggtcgctcacccagggatctcgctctgttacggagtatttgcacgagttcaatcgtctggctcgttatgctccggaagatgtgcgcaatgatgaagagcgtcaggagaagttcttggaaggacttaatgatgagctttcttacccactcatgactggagattatcatgatttccagaagttagtggataaggctattcgtcaggaagacaagtacaatcgcatggagcagaagaaacgccggattgctcaattcaagacacaacaggggaataattagaagccgcgtcttactttaggaccccagtccatgccacagggaggttcttcgtctgttgttcgtccgcagcgtcagttcttcaacaacaatactggcaacaacattcgtaatcaagctccacgtcctgttgcagctccaacacagcaacaacctgccaagagggagcaaggcagcaagcccgtggtgtgtttcaactgtggagacccaggacattatgctgacaagtgcccgaggcctcgacgtgtgaaggttgtccctacccagagcaactctaccgtaccagcatcaaaggctcgtgtcaatcatgtcgctgctgcagaagctcaagatgctccagatgtgatttctggccaatcttatcctgctagaatccaaagaccttgatgtcatcctagggatggactggttagccagacataaaggtgtgatagactgtgctaacagaaaagtaactctcaccagcaatgatggtcgagttgtgactgttcatgcattgtcttctgagtctttaaggtcaagactgaaccaaataactttggaagagattcctatagtccgggagtatcccgatatgttccccgatgatttacctggtatgccgcctaaaagggatatagagttcagaatagatttggtaccagga

SEQ ID NO: 77760 - DNA, 15940 bp, Oryza sativa
  unsure (1)..(15940): unsure at all n locations
cctgcagcccaacctgaacaatgcatatgcttcaatccagtcggcgcaaccattgccccaaacgcagctgtttcaacggaggaccaacatagtgcttccctttgcgagggcacttccatttaccgcggatctctgtcgttgttggagcagctgctacttctgaaacattagtcatgtctgctaaggggcttctgctagtgcgttcttggactacgactttctgttccacaatgtcacggttctcttgcaacgtcgtggacttcgctcttctcgttgggggcttaggaattttgtttgtgttgaatgtttgttctagtttctcctttctcttgatggcaacaaaaccatcagctgcaactgtttcttcctgctctttgtcatccattgcagggttgccatggcaagtttcttctcctggagaattttcttcagtgttaggtatgatgatatcattacaaccgatggatggtaggctgctcttaatgccatttccgtcaaaccgccttttggtgcgatccttgcatgttctagtacaatcaactgacagtttgctctgctcattaccatctttcggggtgattttgtcagcatgacatgaactcataccatcaccaattagcagtttgctctgctctttctcctgatcaacctgggaaccttcttgagtatcacctacatcgatgccattacaatccaccggcagctcactgcattcgatcgcgccttcctgacctccttgagtatcatcatcatcaggcaagcccatggcattgcgatctggcagaggctcggcttcatttctctgaacagacaacaccgcctgagtttcagtttcagaagtctcaccgatgttgtcaagaaagccatctccgaacaagctccgcaagctttgcttcctcttcgtgccacgctccactttgctcttactaatgggaatgaactctctaatagcagaaacctcatgctcgtgttgctgtccacattggtttcccctcaaagcagaatcaccatcaccatcaccatcaccatcatgggtggtcggttccaacaacgaatccacaggcaccccgacctggatattctagaacaaaatatgaatttaaggaagtcaatttggataggaatctctgagaaaaaaaattggattgtaataatttgtgagaatgggtagcaagataaatagaagcaaatcgagcatgatctgaccaaaaagaaaaaattgcagcaacattttacctccagcgggtcttgggtctcgctgccgctattgccgccattgccaccaaccagctccggcacctccggcgactcgtactcatagctcgagaaccagttcttgatatccggcggctctgacgaacaacaccgaaaatgagatcggaagatccaaaattgccgtatcaagaaatgctacaatctgtcagggaacacaagggaacctacgggaagggaacgagaacgggtgcgagctccatcctcgcgcctgcaggaccaaaaaaaaaatcgccatcgtgagggtaagagcatcccgaaaggccaatcggttgagccggcgagcggcggtcgacgggatagcattgaagaagcaaggattgggaggataggaggagatcgaaggggaatgccttgaggcggcgtacctcgattgcggccgcggattcgtcgggggtctcggccatggcggcgaccgaggccggagggtgggagtcgcgaggaggaagaagaagatgccgctctgccgcggtgccgcgtctggggctctgaaatttcgaagtgcccgcgaagcgaaaagctcatgttgccgcgcgaaatgaaaaaggggaaaaagaaatcgccaaagacttttcggcttcccgtcaatgcattgaccaggccgtgaggcccctcgtggctagaaatggcgggcacaaatgagccggcccatataaagtttttcttttcctctttctgtattcgtaacaacccgtaataaaatattgactcgtcaggcaactgtcacgctttacgtttcttgatcttgacggaagctagtcaaccgtctctgacaaaagtcaaccaacattttgatctctactcggttagacagctcggtggatcgacgtccccaaacgccaccccgtgcgcgttccggcagaacgacgccgccggctgctcctcctccgccgccgccgccggtggctggtacctcagccggacgtccctcatggcgatcccggcgcacggccggctcgggctgcagtcgaacctcaccgccgtcgccgtcgccgacgtcccctcgatgtccgtgtacgacacgccgctgatctcgatccccgacccctgaacacacagcagagagagaagccattacgacgtcggcatccatggcgatggcgcgacgaggtcacaggtttcagggctgcgtgcctcggttgggcagctggcgttgccggggcagtagttctggtcgacgatgatcgggttgctgacgttccgcatgacgacgccggagaaggagacgccggcgaccgcgccggcgttcgccttcgcccacgtcttgatccgcagcccgttcgtcgtcccggcgagcgccgcgcccttcacggtgatgttccgcaccgccacctgctccggcgtgtcccccaggctcccgatgctgccacacaacacagcaatggagctctctctgagcatcttcgagcagacgacatggatttcggctgtgtcgctcacctgatgccgtggccggggccgcaagtgacggcctcgatcaggacgtcggaggagccctcgaccatggagacgcagtcgtcgccggtgccgatgacggcgttgcggacggtcacgccggtggactgcttgatgtggatgccgtcggtgttggggctgcgccccggcgccgacaccaccgtgtccacgatcgccacgccggcgctcgcctgcacggtgatgtggatcccggcgctgtcccgcgacgtcagcccgcgcaccgccacgttcctcgaccggtatatcgtcagcgacctcgtggcgggcgggcagtcggggcggcgtgcgcgccggcacgcccagagcgcgcggccgcggccgtccagcgtcccgccggcgacggacacgccgtccacgtcctggaacacgatccacagctgcacgccggcgtacggcacgggcgcgaccaccgtggcgcccgtcatgttcacggccaccgcgccgctccggcacggcccggcgaacctcgccctggacaccaggtacaccccgcccgccggcacgaccaccgtcgccgccgccgccgccgcgtcgcccgcgcacgccgccgcccacgcggcctcgaacgcccgcgcgctgtccgtcaccccgccgtcgtcgcccaccgcgccatagtcgatgacattgtacgtcgccgccgccgccgccgccgccgcaacgaacgccgacaccagcaagtgcgcggcgacggcggcatgagcatgagcgcggcgcggcattgggtggtgggggaagataagcttgcgatgcgattgctggtgcgatgcaacaagagttggttgtgttaaagcgacacgttgatgtggccttcaaaactgtcttggacgtgtgtgccatgagtggtttgaggggcaattacttgtaagattaggcaatgttatgtactgctgctaatgtgtggaccagttgctacgccacttattcgtgtgcacgggtgcacagcaaggttaggcaggacttcaggagcttgcagtgcagtgcagccttgcaggacattaccttcttttctcagttccctctaggccttggtgctacgaatcttagggcatgtataaggccacttacagtgcggtgaggtgtcgtgtggcaatctccatccacgttggcccaatgtacgcgtggaggagagaaggaggtggggcccacgttttccccaggttcgcgtggctagttttggctccgagaacctcagcaaattttgtcagagaaaagcacatgccacagagcgagagagagagagagtgaagaagctcgccggagagggagaggagtaggggcgctgaatccgtaccagatctgtgccgagttcgccatcccatccggcggcgacgagaagagctcgcccgcggaggtggtgaagcgacggcgccccgccggccgacgccgagctacctggccgccaaatcctccgccgccgagctcccccgccgcctaatcctcctgctacgagtggtctcgatgtgacatgcaagataagaccacttaaagaccacaactcccacaatggaagccacccttgagtgttttttgtgttttagtccttagtttcttacatgtcggcccttgtaaaactttattattaaatccttgattttttttataattggactctatgacaacaaaaagaaacacaaatatacccctgatctcctgtcggtcccacttgtcagcccctatctccttttcctcccctcccctactccttttccccatcaaagccaccagacgccaccaactcctcccctcccactccgctcaccgccggtggcagcactgcctctaccctccctcggctacactgatcggggcgtcaagctccgtggcagagggctacgagctcgagctctctcctctctccgccagcgaactggagctctctagtctctcccctctcctcgtgacggaccgaggggggcacggcagcgatgagacaacgagctcacctgatctgaccgttatctcggtgggcaatgagctcatgcggtggagtcctcggcggtggcgcagacgacctcattgaattcggacgcaatcttgctagatccggccatgaccttggcaagcgacgagcttgtgcggtggagttcgtggcggtggcgcagacgaactcgccggatctggacgcaggctcgtcaaatccggatgttggtgacttgccggactccttgaaggcgttggcggcacacgacgacaaccttggcagtggcggcggcgcatatataagtcatccctcatatataagtcatccttggggcagggcgggcagtgcagccgtcatggccccaggcgttaagcaccccccccccccccaaccaaactatatgtagctaagtgtgcatatatagtttgggtttgtaagtacatgttgctttatgttgtacttcctcaggaaaaaaaaacctcatattcattgtacttatgtccccttctagatttttttttggatggagtattagttatctcttggaaagagagttaggttcttatatatatattatgctatatgtatgtactacttccatcacaaataaaccaacatgggtagggatgcgatactagacagtacaacaaatctagatatgattcattgtactatctactgtcacattcatactcagcttggtttattttgagatggaggtagtatggttaaaatcccttgaacacacaaaaaaaagataatagttcgatgatttttatttgttctacgagatggccatgttagttagtgccttagtaatctatagcataatttccatgattgattcatttctcttgtagcactgcactaattttctacagattgcgtgatttttaaattttagggccataacagatattatacacttgaaaagtttggtgttgataattcctttttatagttaatttgtttttctattcaattatcacctaacaaatagtttatgtttagtgatgtgttaaagttaaacattccattctatttaaaataaaaggccacccgttagggttcaaatcctattgcccatatacattaagcacacgtaagtggactttcaataagaatttattcaggctacggatgtgaaattggtcttcgtgtatgttaggggtagacttgtgtgtagtaatgtgcacatgtgtgtctcccgtatagtatgaaaagtttagtcatatttatatatacaaatgctagttatcgtagggtctcaatttttatctcgctctacactaaaatttcaggtccggccctgctcacttagggcaatcttcagacaaactccaagaaaaagtagtgaaaataaaaggtgaattgaacaaacaaataaaataaaaatattaaggtgatagattgtacaaattatcttttagtttacaagaataaaattagaggtgataattgcctattctacacaacttgctcttactccctccgtccctaaatatttaacgttattgacttttttaaacatgtttgtccgttcgtcttatccaaaaaatttaagtaattattaattcttttcctatcatttgattcattgttaaatatacttttatgtatacatatagttttacatatttcacaacagtttttgaataagataaatggtgaaatatatttaaaaaagtcaacggcgttaaatatttagtgacggagggagtattaccctgtaaactgatggtgtatggtcagcggcgttgtccgtttggaatttgatcgtttctgctaactaaaagcgaacctagtttcaagtgatatatctcggactttcagacggaaattaatttgacattcatgtggaaagcgcgacagcttttgagtaaagttgggtaaacttaaactgaaattaaaggcagaacaacttccacctaaagatatcccatccactctcaaccaaaagtctcgagcttccggttcactttcaattaatcattggcattattaaccatgattttggagcggtttaaagtcagatattatcggctgaccgctcaggacaattttgcagaggcacatgcatgaaacattcgaaacatttgttcttttttttccggacactcaagctttggcatgagcttagcacgacaatccattagaagatgcagagtcaggcctgggcgacaaggctactcgtttatctcaaaatttatagaaagtctgaaaatatcatatcaccgtttcgctcacagtacttaggtgaaacggctgttagcgtaaaagtttttataagtaatacttttgtgttcctcaatgacttaaaagtaaatgctgaaaaattaactacaaacagaaaaactcaaaatcaaatctagttaaacttaagttttaaaattcaatttttttatgcttaataaagaaaccatatttgataccggaatatttgttttgataacatgcaactggtttccccgttgggtaatccttcacatttggcaaaaaaagaaatttcaagaactagaaagcctacgtggctacgtaatactctgtttttatattaataatttggaatattttgagcatactttagctttctttgcaaaaatccaagagagtggcttaatccgcccgttagtccgttactagggccggccgtcgtagcttccggatacaccaaccaatatggcttgctttttccgtcgcaaatcaccaagattttcacatgtagatgcaaccattgtacgcttgctgccgtacgtcggcggcgtcgtgccgtgccgtgcggtcgccggtcagaggcagctcggtgggatgaccacgccggacgccgacccgccggcgttcttgcagaaggacctcgccggcttgccgccgccgccgtcgtacgtcaggttgatgttcctgagcctgatccccgtgcatgggttgctcccgctgcagtcgaacctcaccgccaccgccgtcgccgacgtccccgtgattccctcgtactccacgtcgctgatcttcacccccgagctctgttgatcatcagccatggcgcccgatcagctcacacgcaccgagctccaagctcaagcatggcgtgttgctagcaacaagctaggtttggatttttatttttatttttttgaacttttttaattttaaaaatataaactctttcaaaacttaattatttacaagatatgaatcatttgaccatgccaaccagacaaacgtccagtttacctgatgtgatagtgttatttggccacgccggattgattagagtgacaatgttatttggtcacaccatcctaattgatggtaagataaaactgtacagttgtttgtgttattttactatgtcaaacgggctagggtagccaaaaggttcatattttaaaaaaagttttggaagatttatttttaaaatttcaaaaagaaaaaagaaaaaaaaatatcctatgtttgtggttacctggccggggcagttgacgttgccggggcagtagttctggtcgacgacgatggggttctggacgtcgcgcatggcgacgttggcgaaccgtacgccggagacgcggccggcgaagggcttcccccacgtcttgatccggaggccgttctgcgtgccggcgagcgacgcggactccaccgtcacgttccggacctcaccctcgccggcgcgcccgccgaggctgccgatgctgatcccgtgcccggggccgcaccggatgttgcggatggccacgccggaggtgccgggccccacggagacgcagtcgtcgccggtgcgcaccgtcgcgctgaggacggcgacgtcgcgggacagcgcgacgtggatgccgtcggtgttggggctgtccgccggcgccgcgatccgcacgccctggagcgtcacgccggcgcagtcgaagatggagacgtgcacgttcttgctgtccaccagcgtcacccgcttcaccgacacgttgttcgactggctgatgtccagcgtctaaaagccaaattcgatcaaatttacgaacaaattcaaacgtgaaacacagtatgggtttgaatatttgaaagaaattaattactgtggtgcctggtgggcagcggcggccggcggcggccttgcacgcccagaaggcgtggccgttgccatcgagcgtgccgccgcggatggcgaggccgtgggcgtagtggaacgtgatccacgacgcgttgccgacggccggcggcgcgacgacggtgccgtcgatggcgagcaccacgccgccggcgctgcggcagggcccgcggaagtacgcccgcccgaccaggaacgtccccgcggggacgcgcatcaccggccgctcgccgtcgtcgccgcacgccgccgcccacgcggccaggaacgcccccgccgcgtccgccctcccgcccgcccgcgcgccgtagtccaccacgctgtactccgccgccattactgacgccgccgccgcgagcgcgaggacgacgccgaccaccacaaccaccgtgatgacgctcatctcctctgctcgatctcaagctgatcgagagagagggagatccagagacgggatcggctgcgagattgctcgtatttaatggcgatctttcttgcatttgcgttgatttgcgggcggcgcggccatgttggggtgcctcgatcggagtgcgtgtgatcggctaggtaggagtgtggggtgaaggattgcgcggcggcttcgcgcgcttcaatggcgggaaggatcggatgcacggaatggaatgagattagcggccgtacagaatgccgtggtgtgtacggattgcttgccgtacagatgaatgtgtaggagagacggtttgaccgcgggcgacggaaaattgttcgtgattatgcatatttgtggtttcatccatgatactaatgtgtctttcaaaatactctctccttccccctaaatgtttgacgccgttaacttttttaaatatatttgaccgttcgttttattcaaaaacttttatgaaatgtgtaaaactatatgtatacataaaattatatttaacaataaatcaaatgataggaaaagaattaataattacttaaattttttgaataagacgaacggtcaaacatttttaaaaaaatcaacggcgtcaaatattttgggatggagtaagtatagtagaagtgttatattaataagagagtacttattttttgaatgggctgacatttcttagctggacgttctgctatggttcttttgtaattgtactgagcagataaattacttaaaagaaactagcactatatatcatgaagaaatgaaaacatacggtatagttgtttaatatagtataggaggaattagattactttgtaatatatattggattcgttgtattgagtcctgtatatatgaccagtatatatagagattatatggatagagataagaaaggataggatacaatcaatcctatcgtattacaaatttaactatcatatactttagtaatataatatattctaatagtatataattgaatgtgtcaaacaaatagggcttatgatcttgattatgaatcgaacaactatgtaaatgtaggaatgatgtgatctgacttttgtgtgttgtccatgtacaagctatacctaatgagtgcattgaaatatccgattgctaaaaataacgaaaagttaacctactgccgcttattcgtgctgtttgtactctactgactggtcattcgtctggttaatttgctacctactttcttccttcgtcctaaagtgttgttatttaagattgtgatccaaataaatctttgatttgtacttcatccaaaaaagaactcaacataatataggataatataggatgtgatctgtccatattcattttactagaagaagtcacatctccatctacaagcataggtatctttgataatagtgttttcattatcttgatgagctcctctttatttaggcttacgagccatcttattaaaaaaaaaagagaataaagcccaaacaaataaacaacttaatccgatgaataggatggcaggaaaggtatcatcctaaatgaacttatcatgattcatgccaaattaatacttagtcacataaaaccccggccttaaactactaatccacagaaaataccaaaaattgatgggcggatgcgtgcatgtttcttttttttttctctcccaccgcattatcctcttctgtgtaagcagaaattttatatggccaattctgattcagaattgaaagtttcttagggcattctcaatggttaaggtcactagagcaataagatgggacccacattcttatgttcttttgtatataacatatgctacaatatatatagctttttcttgatattaagctgggacccactcatgaaaaaactctattcaacataaagagcatcatgcgtggtgcaaaaggtatgaaatatttttttatttcttatggtctaaccttaaggttggttatagccatatttttactttctcctctcccaatgcataaaggtagaaaaaatactactttattctttaaggtggctttgcatgcaacgttgtggatgcccttatggaaaagttttcgagaataacgatttatgatagacttgacaatcccaagccaaaccatacacatttatgtgtgcaccggggatgcaagtgtgcttctttttctcgcttatcctatctatatttttttttctaaaatttatattaccatgtaaaaaataaaccaccaagcatgtttttatatggagagtagaactgcccatttatgcatttgtacgtgtttttatatggataatagaactgcccactttcatggctaaagtacataaacattcgccaatctatctattatataattaaaggaatagaaaaagaagcctccacggtcgctcttatggcctagaaattctcatattaatcggagaaaaagaaaaaacagagtccatatagaaatataatttaaaaatagttgaaattcgaaattaaataataaggaatattaaaagaggagactagagtccatatagaaatacaatttagaaatagttgaaatcggaattaaaaaataagaaatattagaagaggagactagagtccatatagaaatacaattaggaaataactgaaattcggaattaaaaataaggaatattagaagaagagactagagtccatattaaaatacaattaggaaataactgaaattcgaaattaaaaataaggaatattagaagaggagactagagtccatatagaaatataattagaaaataactgaaattcggaattaaaaataagaaatattagaagaggaggctagagtccatatagaaaaacaattaggaaataactgaaattcgaaattaaaaataagaaatattagaagtagagtatagagtccatatagaaatacaattaggaaataactgaaattcgaaattaaaaataaagaatattagaaatagagtatagagtccatatataaatacaattaggaaataactgaaattcgaaattaaaaataagggatattagaagtagagtatagagtctatatagaaatataatttacagaaaatttagaattttttaaaaaaatatattaaaagacgagtgtagagtccatataggaatatatataatttacaaataactaaaatttgatattaaaaataattaataactaacacgtatataaaatataatatgaatattacacattagtagttttataaagttattgcaaaatttaaaattatgttgtcattttaatatatttgaataatataatgagaaaacatatatgctattatatgagaaaaaaatataatgataatagcagcgtaatctgtgcgggccaccatgctagttatataaaaccaaccaaatttagcgtaataacaaccattcatcacagcttacctcacccagaacaaaaaaaaaacaaacaaacaaacagctgagctcctctttttgactgaactatcacaatccaccatcagttgactaacccaaaccatcatcatccaacggccctccgccctcctctccacatcgtcatcacatcaaatccgtcgcaccagaccaaagcaccccaccccactccagtccacgctccaaaccctcacgcccccacctcaccgccgccggacggcgacccctccccggccgggatcggcggccaggcgagctcgggcgcccacggctagccccgatcttcggggatccacgcgcggctcggctgcagccggcgagcgcgaggtcgactgcgggggaggccgcggcctaggtgtacgggatcgggcggcggccgctgcgacggcgagctctctcggctgcgtgaccgccggcgtggtgcgggggactgtggtattctctttacctccaccggcctctcgcgacctagctgtttcttggtcaaagtcaaacctcctcctgattagctctgtatttagctgttcatagtgatgtcgatttccgcttttcccctgatttgctctgctgctagtatcggatcgaattcctgctgacggggatgctcctgttttgctcgttaggntgatccaggttgcatgttcctagtgctagttggttgttgaccccattggtgagagncttttttcatgttaagctgtggtttctggtcgatgaccaaaaaaaaaagaactcttgctgttgttatctttcggttccagcatttattttgtatagatccatggtgcatttaatccacttgcctctcatgccttgtatatatcttaaataagtttggctagcaagaatgatgtacttgatgcctcgatgagccacagtatcaatgtgtgtgttacgtgtgatttagctatagtctgatgtgctacaaatctaaacgttagttcttatgcattggtaaactctgtatgagtattcttgtgaatgttcacactattttctcttatgtttccatgtaggcatccaagagcttcattctcaagtttggatgttgaaggggttcaggaagtagagcacaccaggatgtctgtcaagtgttccattactattatcatccaacttctcttctgctatatgctttgtcagccatgctatggcacattaagtgacatccaatgcctaaagagactgaaggaatcagttgacccaaacaataaattggaatggacatttactaacactactgagggatctatatgcggattcaatggcgtggagtgctggcatcctaatgaaaacaagattctttctcttcatcttggcagcatgggtcttaagggccatttccctgatgggcttgagaattgtagtagcatgacttcactggatctctcgagcaacagcctttccggtccaatcccagctgacatctcaaaacagctgccattcattacaaaccttgatctatcttataatagtttctcaggggagattccagaatccctagctaattgtacttatctaaatattgtcaatttgcaaaataacaaattaactggagcaatcccagggcagcttggtattctatctcgcctaagccagtttaatgttgccaacaatcaactgtcagggccgataccttcatctttcggcaaattcgcgtcatccaattttgcaaatcaagacctctgtgggagacctctgagcaatgattgcactgccacttcaagcagccgtacaggggtcattattggttctgctgttggtggtgcagttataatgtttataatagttggtgttatcctgttcattttcttgcggaaaatgcctgccaagaagaaggaaaaggatttggaagagaataagtgggcaaagaatatcaagagtgcaaaaggagcgaaggtatacttctcattttggaattgtggtgtatttttgagcgtgcacatctatctatttgaattcaccttgttactcttcccaatttatgaaacttggttattttctggtggtggcagttattgtcttttccaatcacgcttttgttcttgggatttaagaattaataggtgcctgtacttgttcagatgttcaaaaattgtgggtattggttaactcgctaagcatactaacatattttcatgccacgaaataaccacttaacaaagattttattgttatacaatctctctttcgtaattgatggtatattaatgtccaaagcatgtttctattttcccaatctgttatcaagtggcaccctcttcccagttcccacccatctctaaagaaacttaattgtatattttatcagtacagcgcttagggatttatttttagcatcagacctgataatatttgattagtcagcacattcacctacagaaacagtattgtttgatggattttcaacctttttttttattcaggtatccatgtttgagaaatcagttgcaaagatgaagttaaatgatctgatgaaggcaacaggtgattttactaaggataatattattggatctggtcgatcaggaactatgtacaaagctacactcccagatggttcattccttgctatcaagaggctacaggatactcaacattccgagagtcaatttgcatctgagatgtcaacattgggaagtgtaaggcagcgcaacttacttcctcttttaggctattgtattgctaagaaagagaggctcttggtatacaagtatatgcccaagggttcactctatgatcagctacaccaacagactagtgagaaaaaggcattggagtggccattgaggctcaaaattgccattgggtctgctaaaggtttggcatggcttcaccacagttgcaatccccgcatccttcaccggaacattagttcgaagtgcatattactcgatgatgactatgaccctaaaatttctgattttgggttggcaaggcttatgaaccccatcgacacccacctgagcacatttgtcaacggtgaatttggagacttggggtatgtagctcctgagtatgcacgtaccctcgtggccactccaaaaggggatgtttatagctttggagttgtgttgcttgaacttgtcactggtgaagagcccacacaggtgaaaaatgccccggaaaacttcaaaggaagtttggtggattggataacatacctgtcaaacaatgctatccttcaggatgcagttgataagtccttgattggaaaggatcatgatgctgagctgcttcaattcatgaaggttgcatgctcgtgtgtgctttccgctccaaaggaaagaccgacaatgtttgaggtttaccagctaatgagagcta

SEQ ID NO: 77761 - DNA, 1723 bp, Oryza sativa
attaaagttctcctctcctttttcttttacaagtttatagattagtttttttattactacctttattccttcttctttctgtccgacaatatcgatatttatcctgattaagtcgatattgaagagagtcgatgatgaattattgtcgtggaattattaatttatatcaccttttctctgagttatctcccggcgattgtcggtcggggaatattgtttgtgtttactgatcacaccacacgtgaatcttgtccatttgtaggacgggaaagctgcaggttttggagaaaagattagtcagagtaaaacaaatttgtctgtctgttattgacttgttgggcgaagaatcgactccgcgaatcaagcctgattcacaacctctatataattaatttatcgatatatgcatatatcctattgttaaacagaggatgaaagaggagattccatgttcactatgttaagtgctaaaaattaaaggatctatatgcatgtttatgttcatgctacatctacattataacatgtagattaataagtatatatatatatatatatatatatatatatatatatatatatatatatatatatatatatatatatatatatatacatatatatggacagagagaaaagtttattcgtctcttaagggaatgccctctcattttgcatgtcgttgaaaaagttttaaaaattctaagaaaataaacttgtaaatcggatacgaacttgtgtgtttgtggagtaaaacatcatatattgttcatcatgtcaaaaaaaattttgatgatttttggagtgatatgtatgaaatgagggggatatcaccttgagcgacaaatatccatcttcgtttgttaaggttgttttatttgcttaagagatagtactacaattgtatttctagctagtttttcagttcttcgatcagttttctttcatcaaattgcaatcgttacttaattgatcctgaaaactaccaaaattgcaaatagctagaacgtatggggaatgcgtcacatgaacacagtatcacaattaatacgctagggatgtctccttcacagcccatacatagctgatcacagctaattaagcacacattatttggaataaatccaaattgcatgccggcttgcttgctggcttgcttaatcatcatatataccaataccttttcagatcgagacagttgctgctcgtacgccttctctcgtgaaaatccccttgttaagaaagacgtacgtactagcttgcacggcatgaatttaatcatggacatgatcaattgatcagaacaacaaacagtgagttagtttggtgtgttcatgtatgtatcaatgcatgtggctctcgtacgtaggtgatgtgtatatatgtatatgtttttagtattcaacaattcatggtacatacatacatacgcaagtagtatgagatttggctgtttgtttgggcatgcgtccaaagatagtataagtataggcgacattgacatgagtctctgcaagctaataataattaattaataatcttctgtctgctaactcatgcatgcatgtagtgttgtcccggtcccacgaggtttgtgatcaccaaccaatccatctgtagtgctaccaaacaccacatataccggtaacaaacactgaccagcacgttgcactggtgtactgatggcagcagcatcttctagtacatacaagtactaattact

SEQ ID NO: 77762 - DNA, 4248 bp, Oryza sativa
  unsure (1)..(4248): unsure at all n locations
tgccgcctggggaagagcgtgttgccggttttcctcacccaatcgagaaacccctatgcataaaaggacaacgtggcagccatcccgaggagaaaaaaaattcaattctaagaaaatcggtaggagtagagcttttattaattgatgataggtagaagaaaagagggttgaaatataatattatgagggccctttaaaaccaccgtacattggagaggtgccaaatgggcaccttaacagtgacttcaatccatgcatatatatagatggcaaaccttctctcgtttgagatagataaagatcaagactaaacttagaaaaaataaagcacacaaaacggaaaagtaatagtgtattattaaatgagttctaattattataattttagaaaatgggtttatttattattctaaataatttttatatagaaagtttttaaacgaaacacaccgtttaccagtttgaaaagtgtgctaacgaaaattatgataaaatatatatattaatttaataaaaaataatgaacggggctagattgcaagctgtccaatactgtggctgcacgtgtttttgaccgatatttgcaaattaaatccagtgatcgacgtcttagggtgtgtttagatccctcggcaaaatttttcactctgtcacatcgaatatttggacgcgtgtatagagtattaaattaaacgaataaaataataattacacagattgcgtataaattgcgatacgaatcttttaagtctaattgcgtcatgatttgacaatgtggtgctatagtaaacatttgctagtgacggattaactaggcttaataaattcgtctcgcggttcacaggtggaatatgtaatttgttttgtaattagtctatgtttaatacttcaaatgtatttctgttgtccgatgtgacacgccaaaactttacacctatagatctatgcccctgtttagatccaaccctaaaatttttcaccctgtcacatcaaacgtttgaacatcttcatgaaatattaaatataggctaaaaaataactaatttcacagtttgcgattattttgcgagacgaatcttttaagcctaattgctccatgatttgataatgtggtgctacagtaaatatttgctaatacggactaattaggttcaataaattcgtctcgcggttttctcacagattatgtaattagtttttttattagtgcccgaaaccccatataacaccctatatagtactcgatgtgataatttttgcatttttaggtatcaaaataaacaaaacccatcctagtggatttgccaaaaccttatccctgaatgtaaacaccctcttattatgaaaatcaaaatgaaccagcactagctactactctagctaggtagtgcaggttctagggtctggacacgtactggcagtacagcatgcacggctgcacccaatgtcccagctgcaggctgcagccgtacagggcttcccagccgacacgatccgggaaatggtaaactttgtttcaaaactaaccctatcaattaagtaatgactttatcaaaatttgacgaggtaatctaaaacatggccaaaatttacctccattatcaagttttgataattctaaaagttcctctcacaaaatcttaataatggtaacaaactaaacataacttccacttctcaactttaccaaatacaatatcaatatttgataacattgatttagacattaaagtgaacagccccttaattatctttcgtcctctttccggaagaataatactccatctacataactctgccagtctgccttgcaaaactaaagcacttggaacagattcctctctgcaaacagcggaacagagcacccaaacagcagaaagggagtacagacacgcaccaaaccaatgaagcagccgcttctcctgcgatcgacacgaagagagatcggtacagctcatgcgcataattccctcgcccaggacagcattaggttgcgaagcagcagtacgcgaacacacacatgcagtagcacccgcaccgtaggctgcagcgatcgaatagcagtgcagttccatgaattccaaggttggtggcgaactcccgatcgccggaacgctggccggacaggcgtttggtggatccattccatcgcattttgcatatcttcgcgtaatcttagctgtagccctgtacttggagtatgtatgttttctggtcatacctgatcattatttgctaataaatattattagccataccttacaaagactaagaaaatcttgtcatatttttttaaattcattaatatgtgagatctaatttattggaaagataatcttgtgataactataagtacaactaaacagccaacaaggtgatcaaacttatcaaactatggtaaaatatggttaacaaacaaacactcacaaaggtcgttctgaagtgtggcaaactctgccacacttttcatattgttgtcggcatcacggactcatgtacgtatattgtacagaatgcatgaatgtaatggaataagtctatttggcctccctcatgtcttgttgttggtcaaatcgtatccctcaaccgtaaaacagggtacaaattaatttctttggtagttttaaaagtggtttttgctgacgtaacacgttgacttggtccaagtatgtgtgggtgtgtgcgcgcactcgacaatgacatccaggtgaccagtttatcgctgccgtgggacatgtcgtcattggtgcatcctggtgagagagaggggagagagagtggggagggaggcgaggtgaggaagataagatttggatgatacgtggatcccacccgctgacttagctagtcaattgcggtcaatatatcacgtcagctaaaatcaccttctaaaacacctaaggagatgatttgcaccgatgtttaaacacggggaggtgttatacccggttttgtgttagacggaggcgattcagtcatgaccaagactgaggagaaattatagacttaatctgaatgttattgactgctatctccgtccagcccatcgaagaccctgttagttccaattgttatatgggccaaaatgggcccaagaaaatcctcctcctttttcagcgtaaccataaccctccgcgaaagcagccagctaacccaatgtgacgcgcgtagcgcaactgtagagcgtgtgcgcaaccatctcgcacgcacttgactgacagccactctccgccgaaccccaccaccatgccgctgccaccccatggtgggctccctcccgcacccatcatcgccaccgccaccgccacgcgcgccgaattcgccgcccacttccaccacaccaccatgcgatgcaacaaccggtgggcgcgccgcgcgcagctctcgcggttaaattctcccaacacctgcgcacggcgcacaacccaacgccggcccgccaagactacggacgaacgttcgtccatccaccacggccctcggagggcacacgacgctgacgctggatccgacggagtcgggtgatatagattgattggttactgtttcacaagttcacaacttgtttcgatgcttaaaagttcgtaaagcgaaataattgcacctaatagataaactaattagcaacatgtggttngggcaaaaaacattagtacaaaggatagggaatcttttgccaaaaaaccaaacaatattgtcaaaatttttgccaggaacaggagccccttggcagcaaccggaacacaccggcttttgagcctctatcaacggtatcgattaatcacccttatcgtctttggttccttctgcttgcttctcttgctggttcgtcggtcggtggagtttgagcctgcgccatggctgtcggcgggagagggagacggccgctgctcctgctcctgctcctcctcgccgtggcgctggcgctggcggcgcgcgcgcgggcgcagctgtcgccggggttctactcggcgagctgccccaccgtgcacggcgtcgtgcggcaggtcatgtcgcaggccgtcatgaacgacacgcgcgccggcgccgccgtcctccgcctcttctaccacgactgcttcgtcggcgtaaggaccgcgccgctcgccgccgtccggacgaacacatgctgcctcttctccgcgcactgctaagctttgattttgtgttgtggggttggggttcacagggctgcgacgcgtcggtgctcctcgacgacacccccgcggcgcccggcgagaagggcgt

SEQ ID NO: 77763 - DNA, 1148 bp, Oryza sativa
aaatatgataaaaaatcatggtaatcaacgagtctaatagcctaggctatggccctcatcataaccaaaatgtgcatataacatgctaagagaatgactattaataaaccagtcatctcaaatcaacccaaacaacttttgcagcctaataaagctgacaaaaatggtataacacctttctgtcgggcacctttttatttgcagcataataattccaaagaattatcgaaccgcgttaaaaaggattttagcagcatcgggccacatcattgtgagcacaaattgccaaagcaaaaagcacctaagtccctagggatcacaacgggccacgctgattataatattgggctgaagtactgtacagacccaggcccattagtactcccgataccctaacaaagcaccgaagtccaagcatcgcttcgtcttccccaccgagactctcgccatttccccactccttgctacagtagcaaaccgcaccgtcgaaactagggttcatcaatccgtcccaatccattctcaaaaaatcccacgaaacttctccgcgtgtccaccgcaccaattcctcattcccctccagctatatcttggaccaaatctaaccatgcaactcgcatccatggcggaggagagagaaagtttcgagagtcagtgggctccctccgatgtaacggaagagaatctgaaagaaatggtggtgcacggcgttcttccgacgaaggaaatcatcgggtggcgaccagcgttcggcaaagcattcccgacccccgacacacacgagattgtggtattctctcacttcttctatggcggattttctcttccaacctcaagattcttccggggaattctgaacttctatggaattagcttgcatcatctgaatccaaactccatagtgcatatcgccaattttgttcatgcttgcgaagcttttctgggcattaggcctcatttcgccttgtttcgccgcatcttcttcctcaaaccctagccaaacaagagcaaactgtgcgttgttgggggtgctggtttccaactcaggggaacactaagccaaaaatatttctccatgcccttcaagacctcaaacaaaggctggcacgccaactggttctatgttcaaaatcctaaaccagcccttc

SEQ ID NO: 77764 - DNA, 10138 bp, Oryza sativa
gtgaagggcgcattaaatcaggttctgggggttaaaggcggaagatggatttggttgacaagttaagggaccctagatgaacttattcctccaccgtgacaggcctagccgctaggcccacatattcagcaattcagataggccgatccaaccgcgtacgaaaggacaagtactcgtggtgtctgtcgttctcttctctgatcataccaaaaggacaaaaacttggattagtgctgagctggcgctgttcaaacgcgcaaccaagcagatgccacccaagccaagaggaaaaatccaggtataactagggcctcgttcattgtgaacattattgacctctgctgtctttgcaaggagcaggtgatgcttataatttaaggcgccgttcggaatttttattcgggactctagcagaaatgagaaacgtatttatattttttttattctatcagaaataggactgtctccagtgaacttggttgtgttcgttcgagattgggaaaaccttttccgacacaaaacaaaacgtcagattattatataattaaataaatattatcttaaaaaccacaaaattagattagtataatttttaagtactaatgcactgtttagcagtctgcggaacacgcacgtgagagacggagggggtagaagttggaaaagtgtaggatagaactcagccttagtgaaggctgataaattcacacgttccaaaatggcccaaattgaacctagttgggagtaaataatgagttggactgtaatttggagggaaaaaaataatgcgaatgatgctggattttcgtaattggatttccgccgaaatggaacggtgcaggcaacgttgccaacccatcatcatcatcactatcgtcgtctgtgcatcctttggggtgtttaaatcggatatacagactcatatttaaagtattaaatataggctaatgacaaaataaattatagattccgcctgtaaatagtgagacgaattttttaagtctaattaattcgtcattagtaaatgtttactgtaacaccacattgtcaaataatagactaattaggcttaaaaattttatctcgcaatttacccgcaaactgtataattagttttttttctatgtttaatactctatatatgtgtttaaatgtttaatgtgacagatgtaaaattttgcatagtaactaaacgtttaatactctacatcctcctgagacgcagcgcgggctgtccatgtcagggaatgttgagttagttgtgattggtcgctggcgtggacgccacaggccccgcacctaaacatttctggcacgcatcgcatcgttcggttcgacccgcagccgattcgcgcgccacgtacataccgactcgtcgatgatacgagagccgtgttaggcgctgtcagcgcgtggcccccacctcacatgcatgctgctctcccgccttgtggaattgccgggcccgtctgacctcagccggtcagcaaccgttagagacggagctatgaaagccgatcaaaaaaaaaagattaggtatagcttattttcatcacacgtacatttctaaatataaacttaaacatccacatcggtttaaatttaatctaaattacagtaaagtaaacgagtgataccgctcttcacatctgataattgatgttactgtttacttaatcatcatcattaacaacagcagcagcaaccacaatgctaacacccttattgatatacatatacaagcctgagagatttcaaacaggaacacacccaaatgcttgcttgataaactagacttggttaactaggctttgttgggcagtgcaaattgggaactaatcttatgcacataaaataaaatacatggttaattaagtgttagttaaaacccttaaaataatatcaatatgatttttaccaactttattatagaaaaattttgttaaatatacatcatttaatagttcagggaacatgcgtaaaaaaaatgaaggagtgaaagttagataaggtgagtatcgaatatacatccttaggtcatcaccaatgcgtagcctcgggtcgtcccctcgccgacggatgtccagctccgtttgcccgtcgtccccccacgagagagcgcgtccctcagctgggagacgtgtccctcggtcacttttggctgacggacgacacgaagcgacgcgttaggggcgatgggctcctgtggacaccgtagctccaccaccaaattcccctttcacccctctctcccccccccctctctctctcctgttcccctcaaggtcgagccggaggaagagtaggaggcggcagcagctgccgtggtggaggcgcggcggtgacgctagaaacggggaggacgagggtggaagttgggccaaaagggagagagaagcggtggcgcaccagatctggcgacgacccgcgacatcaacgggcggagggacggccgcgccgtcctcctcgtcctcctccgctggtcagagtcggagcgccgtgccgtccttctccgccggcgccgcgcccgccaccgccggccccatgcccgcatccgccggtgccgcaaagagggagagaggccttgagccgacgatgggagagagagagggtgagaggcgtggagccggtgacgggaggtcgaaggcgtcgagccggcggaggcgtcggtcagctcctcgcctcctcggtggatgccacacgcggtagatgggagggagtaaatgaggggaagagagagaggggggagggaagagaagggtagtatagtaaaatatctacatgtgctttttggatagggatactgaggggagtttcccagggagtaccctcagttagtgagggcacccatagagtatccctgattagtgatgcccttaggtttcatttggcagtgctgcttagattatcagcaacatgtgaaactatacgagctattaatgtagattaattgaatattaagcatcacatacatacaaaaaaaatatttgatttttgagagaactaattttatgtagaaagtatttgaaataatataccgcttaataatttaaaaaccgtactcaccctatatactccgtatgagcgagttatcaatccaataagcacttttactgcttgaatcaaccacaaaatctctgattccataaagatgcccataactgcctgatacagacagctggcgtacgagattatgagccaaaacattttttttgtcaaatggcatacattaagtactactgttagggccaagattaagggactagcttggcttaaaataaaacggagagaaagaaaaggaggtatactccagctgctagccacatgatcacagcttgtgtacgtacgtacaggccgtctcccgtgtttcaaggcgagacatgcttaatttgctaatggactcgacgcgtctaagggttactcactccattactttgagacaaagattacttgctcgattagtttattaattaatgccctaatcatccaactaacaaacggctaaatacagtttcaaaagcagacgaacctaattacgaatcacaaagagagatgcctcacatatacatttgtaatcatgattggccggtcggcgaaaatgaaaaaaaaagataatgtgtatctcaatttctgtgtgaaatcatcagagatgtatcatggagagggcgaaatgagctataattgttaaactaggtgaggacacccactaagcgcgtcggtatggttcgatgtatgcacgttgcgacggggccctcactactgatcattctcacagattcaggtcttcaggacagcttaatttgtttatgataactcgaaagacaaaaatatttgagattattatcgaatacttgtcatatttgataaatgtactatgtttatattgaactcattttaagtttaacaaagtctatgcgaccggttggaaagtagacaacgcatcttgtagtgagcctattcaaatgccaaattaaggagattctgctagttccttgaaaaaatagaaaaaaaataatctatctttctaacatgggtttcttttcgatttcaatagaaaataaactgattcatgttaaaaccttcacacaaaaaaaatcacattataaaggagaaaatcccaagaaagaaaaattgaattgtcaaagtcggatgaaaccatgtgttccctccatgaaacccgtaatggaaggcaactcagttcatcttttttttcccctttggccagttgttcatcatcaccgctggttcgatcagacggacacgcaaaccaaccaaatccccgcgatcccagccgtccatttcccccacaatattctattcccgccctgcgaccatatagcccacctcccctccttccttccccgcatcaaacctctcctcctcgtcacacaccccgtctcgccgccggcgatgcgcagacgccaatgacgacgacgacgacgacgacgaaccacagcgccaagagcatcctcctcctcgcgctcctcctcgtgccgcacctcgccgcggcgtcgtcgggagatgcgctgatcagccagcgccgccgcctgctcgactaccacggcggcggcggcggccatggcggcggcgacgtgtacgtggacccgtcgtacacgttcccgaacgcgcggctccgcgacgcgtacgtggcgatgcaggcgtggaagcgcgccgtcctgtcggacccgcacaacgtgacggggacgtggatcgggcccgacgtgtgcgcctacgagggcgtgttctgcgcggcggcgcgggacgacccgcacctcgtcgtcgtcgcctccgtcgatctcaaccacgccgacatggcgggccacctccccgacgagctcggcctgctcgccgacctcgccgtgctccacgccaactccaaccgcttctgcggcgccgtgccgagcaccctcgagaggctccacctcctccacgagctcgacctcagcaacaaccgcctcgtcggcgcgttcccggacgtcgtgctccggctgcccagcctccggtacctcgacctccgcttcaacgacttcgagggccccgtcccggccgagctgttcgaccgcccgctcgacgccatcttcctcaactccaaccgcctccgcttccggatccccgacaacgtcggcaactcgccggcgtccgtgctcgtgctcgccaacaacgacttcggcggctgcctcccggcgtccgtcgccaacatgtccggcacgctcgacgagatcatcctcatgaacaccgggctcaagtcctgcatcccgccggagctcggcatgctcaccggcctcgccgtgctcgacgtcagccacaacagcctcatgggcgccatccccggcgagctcgccaggctcgagaacatcgagcagctcgacctcgggcacaaccgcctcaccggcgacgtgccggagggcatctgccacctgccgcacctccagaacttcacctactcctacaacttcatcaccggcgagccgccggtgtgcatgcacgtcaaggcgttcgacgatcgccggaactgcatccccggccgccccgaccagaggccggcggagcagtgccaattccaaaacacccaccacgtcaactgcgacgcattcaggtgcaagaagttcgtcctcccgtcgcctccgccaccggcaccatcgccgccgccgacgtctactaccaccgccgtcaccctctcctccaccaccttcacctcctactccatcttcaccaccaccatgtccatagcctactccaccttctaccccgacggcggatacttcaccaccatcgacatcgacgactccaacatcttcaccgactacatctcctcctccgccatcgacagtgtactacagctcgccgacgccgccgtactacgaggtttcaccggaggacaggtacctctcgccgccgccacctccggcgtaccacgagggcgccgccaccgccgtactacgaggtgtcgccggaggacaggtacctgtcgccgccgccacctccagcctaccaagaaacgccgccgccgccgccgcagtacgaggtgtcaccggaggacaggtacctgtcgccgccacctccatcaccggtgaagtggaagctgccggtgtacgagtactcatcgccgccgccgccggcagcaacatggaagccataaaattaaaatcgattctttcgggattttttttttcacacactatgatcatacatattgttaaatttgttgtatgttgagtaaaaaaagggatgctaaatcttttctgttactacccctccttcctgattttcttttgcttgaactgtatgtatttttcttcttttatttttttctccttctttgaatgaacagcaggaaatctgcttttcctcccattgatttgcttgatttacagataatccattgtgaacaaatggccatattctgatatacatagacagaaatgaagaagaaaagaatgagagattttatattctcatttgcattatgatggtgtctatgagttggcaatattatcctagaaaagttaagcatatactagtactgacaactaaataagcattggattctgctaactggaacagctaagattctgaaggctccagaaaagtacaactagcaatttgaacacactgaagaatggccaacagcttcatcctcttcaaaggttgccagcagcgacgcaatgttctaagcaacaaagtcagcaaaagttagcatagcaagggaagtgccggggaccatgtaatctgttaggccaatttgttagaagtcatcgcatcagaacattcatctgcatgatctctctagtatgatagcagcagtattattgcattgggacaggagaagttgacatcacaggataaatgtataggatatatagaacaagaagatttcatcagagaatgagaaaagagcaggaaaaacatttgcctggccggccatgcattcaggttgttggatggaatattttcaggaccagctcagagtagtatctgcattgatatctatcgttgatggagtgtataatgtaagtatgtaatacagtaaaaaaaaatggagctattgtacttgtactgttcagttacttcagtacatttttgtttatctctgtgttgccgtacagtgtactactacaatgcaaagggtgtcaccggattcgaactgtgttgatttgtttagtgcagagacttaaaaccgttgattttgacttaacccacgtcttgcgcttggcgcgtactaattaaataaactagctggatgattctaaaagaacttcgatagataatcgcctacacgaacaccaacgtgcatagaactttcgtcgctgccgccagctgcagaacagagtatgcgctgcacgtaactaattggaagaaaagaaaattatcttgctgtatgggagtatatgagtatatatacgagtgtgcatatgttcttgctttgcaggcagacatgcaaactgtcaggctaatcgatccctctcactgcacaaacgttgatatgcagaaatcagaatccaccagttcttgatttactgaccaatcaaaaatgacgatcaaatcaagactgcccttccaaacaaacaaacaagaaaaagttaaatcaaattcaaataaggggatcgagtatgcatgataccaaaagaaacagagagagagagagagagagacaaatgagtagatatgcagagagatggctgcctcttgccttgcagggcaaaaaggcaagcagagtttggccgtcctggcctgtgaacgaatgaatcatctgattaggtagtagtaccggtgtctggtgatcatggcgccgcgaggatgagaccaaatggttagtaggagtagcaaacgtagcgagcgatgaccaggcaacaaaaccaaacctcccaatttcccaaccaaccagcggcagcgccggcgcgcatgtgcggaggttgggttcgcatcgcctggtgtttttgtagcctagctagtagttctgacttgctgcgcgcgcacgcggcggagtcgccggcgccggcgcgattccatcattggggcttcgtttgctgttgcccctctctctctctctctcgccgtggctccgtcgactggtcggtgttttacatgtgcgtcgtcgagatttttctttttgtactgccacgacatatatattgggtagcggcagtacgtcgttttgctcggtcgggcgcaactaacaactgccgatgccatccatgtgagtgtttgacctcgctgaaggtagtgatattcatgtgcgactatagtatttattttactagtgtgctgaatgtgcggttgtatgctttaggactttgttcagtctcggttgcctggaacttgttgtctatgttggatcttaccgtgtgattgttggttttttttttttttgagaagatgatattcttctgtgattgggttacattccctgtcaatcaaatatgggccaccttgttcgttggttcctgctcggtgtgggccgtatgtggccctttgagagtccaactagtactttacgcattcgacagtaggaataagtccattttgcctccctctattcttgccctttgtcgaattacatccctcaaccacgaaaccgggtatattatctcccctaaatgttaaaaccagtacaaaacaactcccttggtggtttttgacagtggttttgttgacgtggcatcctagtcatcgaaaaaatttaaaaaatacgtgagggcccacatgtaagtggcatttctattcttcctctcctccaccactctcctctcttctttcccttctctctcctcgaacagagcaaggcaaggagaggcgccggaggcgcgggaggtgtgggaaccgccgaaggatgtgggcgcatgccgcgagggagaggatcgccggccgcggcgcccgcacggggagggttcacctgccacagcgtcgatctgctcggccggcaacgcatcctcccgctgtctattcgcgccgccgacctccggcaaaatacataagctcatcaagctacctttcgaagagcatgtcatgtgctgactgtcgagtgcaaaagattgagctttcacctaaaacacttggagggggataaaccggcaaccatccatggagcagtaggagtaacaactgaagatgatcatgatccatcccaacaagtcgccggagcaagtagtagcctctttcgagcttcgacaccacacgaggaaaaatcagacataaaaacccccatgaagaacaacccagcagtaacaaaagcatcccccctccattagctgcatgtccctttctggaattctccttttcttctccaaagagacaacgtgagacgcatggatgaacaattggcggtgcgcctactactgcccggactcctcatcggactcgccgtcatcgcggtcatcctccccgtcctcctgctgctgttgatggtgttggtgatggtggtgcgggtgtggcagttgaccagtggcactggcgccgccgacctggtggtagaactggctgagcgaccgggcgaagagcacgccaatgtggccgtcctgtgagtgtcctagctctagccccggcatggccgccgccacgtgggcggcgaacatggtcgcgaacccgatgtggcaccggcgaacgccgcggcggcagcccacatgtggtggtggtggtggtgcaacctggagagggcgcagtttggggaagggagggagggtgcgacggatgtcagcgccgacacccgtccccatggcagtgacgattgccggctccgcctgctggagcagccactggacggtttcaccgtcggacttgtggccgagctcccgcgttagctggaagatccgggcagcacacaacgccggcatccgaatccgttgtccctggccgtccaccttggtgtgccggtccttgttcgagctccgcttcggacctagcccctacattcttcttccccccccccccgacgccgtcggcaccacctgcatttgttgctgctgatagcggatcctttccctttgggcgtgcccttcattcttcgggcgtacccaatttttcggcccttcggggctctcctttgtccgaaaaagaaaaaaggtggaggaaaaaagaaaattgttgaggaaaacgaaaaaataaaatgccctttcatctgtggccccttatggtatttgtt

SEQ ID NO: 77765 - DNA, 4873 bp, Oryza sativa
  unsure (1)..(4873): unsure at all n locations
gaagaggcccggcccacgacgggggtaagtaagaggtgagacngcaaaatcctcctccccccccccccggacgccgccgccaccacctgcatctggtgctgctgaaagcggatcctctccctcggggcgtgccctcgcatcctccggcgggtccccacatcttccgcccctccggcgcctcccttgtccggagaaagagagaagggggaggagagaggagagtggtggaggagaggaagaatagaaatgccacttacatgtgggccctcatgtattttttttaatttttttcgatgactaggatgccacgtcagcaaaaccactgtcaaaaaccactaagagagttgttttgtactggttttaacacttaggggaggtaatatacccagttttgcggttgagggatgtaattcgataaagaggaagaattgaggaaggcaaaatggacttattcattcgacagtatgtccaatatgaactattctggcaggggaatacctatgcatctttcgaaagatttttatgatgatatcacacagatttttaatctttagattaaaatccaatagacacagtagaaggcaaaaagcaactaagaaacaccataatagacactaaattgccatatcttcaagaaaaagaccaaatccaatataaatttcaaaacttgcatgtgaagattcaaaaattacactataacttataaaagttacaatgtaagtttcataaattacagtgtaacttgcaagaaaatacactgtaaatttgagtgagagataagaaaaaatctctcgagtgagatatagcaaaatcgttcggggagatgatcaaactgaaccaaatttgcttctatccgctagttatgtcagctagcttttcacagcggtcaatttgttcctatccgttgtccgaacagaggaggtcccccgttggtctcgttcagaacacaatttgttgtcaatgcagagaaggagaagaaacaaatgagcagtgatatctcttgactttcgcttacacatagatagcaagcagtctagttgtggaccaatccggccttctgcacgcatacagtcactcacacgctactacgctatctttacatggagaacatatacatatattgcgacatagaagtgcatatgacatataattagtgtgcacatgtgtgcatgctgctgctgcatgcagcgctagattattcgttcgcagcaggtagcgaagttgtgtgatcagttttgtcaggcgtggtccggctcaccaggaagagcagcgagaacatcaggaggagcagcgaatacatggcggtctatgtcgtcaggtggactagcgaacacttggtccggatcatggtctacgtcatcatgggggctagagaacacgtagcggtggtccggatcatggtctacgtcatcagggggactagagagcacgtagtggccggcgcggagaggcctcggcagtctggccgccgccgtggtcttgcagccgtcgtagcactgcccgaagcaggcctccacggcgcccttgccgtctgcaaaaccaaaccaagaattagttgccgccactgatgtgtcacgatcaaattaaagttattgcgtgcttagttacccggaaggaggcggtggcaggagcccaaggcgcaggagagttggcactccatgtcgccggcgaggcgggacgacgacgacgacgagtacagcgtgggcttgtccggctggcacgtcttgtcgcaggcgtagctgcagtagtcgaccatgttgttctccctggccatgcagtccttgaagcagaagtcgtagcagtcggcgtccgcgccgccggcgaggaatgtcagcgccaccaccacggccaccgcgccgagtgcaacaactcgtcccgtcgtagtagccgccatcgatcgcttccaactccggacttccctgccacgatcgatgacaccggacgctgcgggcgccgcggattttgtagcgcgcgccgcgggcggctgatgctcacgccgggcgcgtgggcgtgggggagcgcgcgcgtgaaggcgagagtgcaagcaagcgagcgagagagcgagcgagttggtgcttcgatcgagtgggcggcgccgcggtgtgtgcgtgggtgtaagcagtgtgtgacgcttgcgggcaacgggcagcggcgcgcagcggcagcgcgtacgtttgttgttgcgggcggttgctgtgtcggggttggtgtgccgttgcgtggcttcgatcggggagggagcgcggttgcagccttgcaggggcggaaggcgtgatatgggcggccgttttcggtgtaacgttaaaattgtaaggcggtgaagggattgaaatcttggattacggaaaaaaaaggaacgtggagatctaccggcgaaaacagaacaaactcaagaaaatcgatggctacacggtacaagtcaaattgaggatttgccggtttcctaagcaactgccgagcaacgggaaaaaatcgtttataggtggcaaacaattcctttttttcccccaattgcacggcttacccacaccctcatatgcgtcccgtaacatactctcaaagaggtagatattcctgactacgaggatttgaaacatagtgcatggagtccaccaggacattcccaacccaataattagaatggtgtccatagtattaaataagttgtcacctagaacaaaaaatgacatggcaagtgaataaatgaggaaaaaaaaggaaaccatgtcttgcatgagacatggtttctacataacatccaagacatcatgtgagataagtagcattaaattaaagtatggaatagtggtgtttgcattggaagagtagtgtctagtactagtttcttgataatgtggaatttatggaaaccatgtctagtgttatgggttgagactgctctcaccgcacaattggtgctcccttgatggcaaacaatttatttggatgagaccttaagttcggtctcgggaaaaagttatggtagtactacatcactcgatttttttaaatggtagtcctggccggcatgtatgagctttagttatgaagatttaatagttgtgtacttgtgttggagaaaaccttgtactccctccctaaaataaatacaaggcgtgcatgcatttgaaaatgtcgtgtttattttgtttactatcaataagcttacaatatactcctatgtttagtgccacatgagtggtaccgttggatttatatttgaatatacttttttgagtgttaattttgtagatgccgatgatatatatgaaagatattaatgatcaaagtttgacagtagagaccgtatcaaaagattgatatgctttaggtttctcaacaggcaaataaaaatatgcaagtctgaactcaaaattatgaagtagggaggacacaaaaatggacaaaggccattgtaattttgatccaacggaagctatgtactaaggtgaaaaatcgaagtgtttaatatccctcctttcctagaccccaagccatagcccacggcagcaagatgaaaaatcaaagtgtttaatatacctcctttctagacgtcgcggccatggcccagataataagtacctcgacatataaaaaacttagtgtaaaatttagatacctgaggtactttctctctcgttgcatagttaaatgtcttcagtttataaaccacaacccaaaagtgccttccaagcaagcccaggcccggtcctgtcaatttagtggcctagagtgaaactagaaaaatgggccctttaatccaattataataatataacgatatttctaataaatttaatgcataaaaaaatattcttataaaacaagttatatatcttaccttaaaattttcttctaacatttaccgatgcgaagtcattgacgatggcatcaatatcaattactcatcaatagctcctttttttcaatgtatcaagtcctctatccttctcttctttttttcttttctcacttccagatgcgtgctttttgggcaacatgatttcactgtaaatttagaaatttataagtaatttatggaaattatatcaaactaaattcaattcatcattataataaaaatgagtgctggtaaattatcaagttgagatttgagagctagagaaaatgactattcactgccctagttgcacacttgcacagctggactgtaggatccctaaatcccaaaatcagaatttcagaaatcagaagagaagcaattgaagagtaaaatttgaatcccaaactttaaacatatacacttagtatacatcaaaggggagagcaattgggtacctccagtaactgaacggagagatttgcatgttgcaaccggctgctggcggccgccgaggacgacaccgtcgacgcgccctaaaccctcgcccagtcgcccctcggaacaagacgaggaacagaggaagggcggcagaacatagaagtagcgaacatgaggcgatggcggaaggaagccaatcgacgaaaatttcttcctgtacgtgtctcttcctctcctgggctagtttgggctaatgggcttcctaattcccatgggctattatctacagcatatatggggttgggccccttcacttcgtgggccctgtgcgaaggcacagcttgaccccccccctcaataaaaatataattgtttttaatcacttatgtaagttcgctccatatatacgtgtgtaaataaactgtcttactactctacgtagtcgttcggaacttagatatttaaggccacgtatcaactgtaacgatagcagcgacatgtattacagtaattaaatgtaaggtaattaaagcaaagaattggtaagtaactcacactaaggtataaggaatgtttaaagatatctcagca

SEQ ID NO: 77766 - DNA, 10220 bp, Oryza sativa
tgcgatttgtatgtgaaggaggattttttaggacaagcattgggtttagggcaccttaattgtgaggggacctttgtatgaggtatttttataaacccccccccccccccccccccgggccaggcctgagcaagccaaatggaccacacaaacatgggcttatggagaaaacacaaactaggaagcttttggcgtttttccatcttagttcaatggtatccacaagaccacaatcctcatgtgtgctcttaattagatgttactgattgaatgtgtgctcttgtatgatcatcacatgtggtatatatccagttgaataattcgtcttatagttttagatggattttccatcagaatggctttttcttggtgaggtctatatacctagctttaattaataatggctatatcaagagaaataaggtcctgtatagatgggactaaaacttttaagtccctatcacatcggatgtttgaaaattaattataaatattaaacgtagactattaataaaacccatccataatcttggactaatttgcgagatgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccacctaagtgtatttggaagcttaagttgtcacttaaaattaaaattttcgtgtggtacttgcttaaaagagttgtgttaactaaggataatttggcaaggcgtaactggaatggcagcttgaggtgttctttttgtttgaagaatgagtctattcaacatctctttatgaattgtcattttgcgaagttcatatggagagcagttcagttctcttttagttttaatcttccagttagcatatctcatatttttaatgggtgtcttttgggagttgataagaaaaagagtaaactgatacttgttggagcttttgccatttgttgggcaatatggctgagtaggaacgatatggtttttgataaatcaccatcattttcctatatgcaggtcattttcaggacaactcattggctccggttttgggcacaactacaaaggtatgatgaaaatgaagagtttctgaaagttgcatgtcgaaagtcggagactacggttatgtaactttttactaattatggttgaggatttacaaatcatatcttactataaagttatcccccactaactccttaagcttaacatgcaaagatgccacatcatcatccactaacatgatgccacatcatcatccactaattaacaagatgccacatcatcatccactaacaatcatcacatttaaacatcacgcaaacatactatatctttataggttttataatttaagagcttttcaaatacaaacatgttaaattatcatccaacataattcacacaatgtttcaatgtatatctttattatgttttattatatcctatatacttatatagttcattaaatgattaatctatggtccaaattatctttctcctttttttctctaattaagtcatatcacattaattgtttttaacctttagatgattaatctatggtccaaactatttccctacttttcttcttccatgaagtcacaccaccttactttttacgtttgaatcaccattttacatactatttaaatttaaattatcataaaccacttaatttacttaatctgatgttatctagctatcttacacgttattttttttattgttatcatactaaattcccgcagtaatgcatggggttttacctagtagacttgaataattgtgatcaccttaagttaggctggattctttgttattctctacggtgtgttctattcatttggatttacactgtcttcttgagtggtactatgtaataattggctgtagctcttttgaataaaggccgggatattatattccatttttaaaaaaaaatgtggtacaaggacaacaggtttcgttgttttctgctaagattatcatgtccctttttatgctgtaggacaataggagacatttggcatcccttatcttgtgtattcttaggaattggtaagctcgcaaaactttaaggatgaaactgggtgttaatcacccgaagattaatgcatacgtttcttcgacttgcacataggatcgatatgtataagtttaatttggtcacatataataacgagaaacaaaaaaccaagattactaatcctgggaaaaagaaaaaaatgatcgcaattcagtaattaatccactaagtctctgcagtaatccatctatctattactagaaaaaatgcccgtgcattgcaacggaagaaaaaaaaacttatctcaacttcttaaaaaattgaaaacgttaccgtcgtccgtaataatgaaaaagggaaaaaacattaaaacaaaaaaaaaggaaagtccgattcaatttgcttccgtcgtccgtgaaaattttcgtctataatatcaattcttcgtccgtaaatccgatggaaatccaatcggacaatccaaacaaagagaaaaggaacgggaaaaataataaaaaacgcacaactcttatctcaatcctgtgggaagccgtcgacgccactaaatccacccgtgggaagttgccgtcgccgctggatccgcctgcgggaagccgccaacgccactggatccacccagcggaagccgacgctgtcgctcgcggtggggggagggcgccaccgccgctcgcggtggggaaggacgacgccgctgtcgcaagcggtatgagagggcgcctccaccgtcgctcacgcgtcgtcgcagctcgctcgtcaccgggagaggggtttgggagagagaagaagagaatgtgatgtcatctgtaaaaaaaaaagcaacaaaaaacatgctaagaaaaactgtcggaaagaaatgtgccatttttaaaaaatggttaaagaaaaccgcgcatgaaaaaaacaccgtttataaaaaacaagatgcttcgaaaaaaactataaaaaaacaccatttataaaaaaaaccagatcgaaaaaaatcatattcaacgcgagaaaaaactgttgtttctaaaaaaggttcaagaaaaccgtttgactcaacacgagaaaaaagaaccaccatttctaaaacaaggttagagaaaaccgtccgactcaacacgagagaaaaaaatgtcgtttataacaagaaccgctccgaaaaaccatctgactcaacgcgagataaaattgatggacacttgggttggataggatccatcgattttttttttccatctcctacacggtttttgtttccttatctattctccgaccttgcacgtctctgtatgtagttatcagactatttttgttaagtatagctactattcttgataacatatgatatgaaaataatactaaaaaataaacatatttttaattattatttagagaagagtgcacagtgactctattttgtgtagacttgaccagtggcgaagccaggataaaaattcacctatggcgaacttactacggactaagtactagtctagtactctagttgtataagaaaacacacatacataataaaataatggtacaatgcattaattaacatatagatattgtaaaataatgataataagtggatatttggatgattatagtatataaagaagcactaaccaatctgggtagcttttgaaattgggtgcagtcggcgtcggcgattattagatggctcttcctcttccatggcgcaatctgggtagctacagatattacgagctagtttagcattactactcgtaacaactgattgtctgattcaacaggatatagttgctaatgtgtgagagatcgatggaaccaactggtgtatcggagtgattaccgtggcggcgtccggcggtgtcccggcaggagacgattcgactgtcgacgagaggaggcgatcagccgatgcgatgaggcgatgaactgaaactgaagcgacgcggcgacggcggcaacaagcgattgcgattcccagtcagactcccggctgtccgcctcctagtattcttgggcggttgggccaatgggcctgcttcgttgtccacatcggcagcaaacaaaggcccagcaaagtagcaaacatcagcgcacaaagaaacgaaacgtttctgcccgctgctcgccccgcagcggagttaaggcagcggcacaccattgccatagacaacgatcgtaactagatctactgagtgccattgtcttcatcaccctcctggtagtaagcgtagagatcctccgaagcttcatctccgacctctgattaagtttgtatattgcaagggtgagtaccaactcagcaagccaccatagcaacaatgcacatgatagaatgtatttaaggaatagctgtggttcttttgcgtagagcaagttttgcaattcttttcagaagcctaagacctagcatagattgatcaaattttagccactggagttgactatgcgaggcaatgtaagatttaattgattctattattggttgtaaggatgagattaaaatagtatttgtttatttgtgcttgcttagattgtttcctataggataccctgatcttgaagtgttagccgttctgatgttcgtgaacttggacatgctgtacatactttgttggttgatctcattgctcaacatcagttaatgactgaaaactgccatgtcaaattgcccattattttaggaaagaaaatatgagccacctctcatacaagagacaaccttcacacaaaccctaagaaaaaagagatggaagaaagatgagattggacaaactaataaaataaaatcatttgggttagcatgctaagaggtagtatatatgtggtgtattatatatatcacatcttattttatatggataaaattagatgtgacaactacccctagtataaaacttgcccttatgttggcatgagcattgtgtaacccgtgcatcctatttagagttctttatgttgatattttttattcctaaatttattttctagattcttttctccttaatcattccaattatcatcgattgaaagagggcaaatttatataatttcaaggcaccagatagataccactctacccagttgggaagcttctagaatctgttagaggagatgttttcttttctctaattttttctcttatataatctctagatttatctcaaagtattgattgattaaatgattaattgatgattggctcatctcatcactcttgcactagttaattaatgcctgaaaaataccatgtcaaattgcccatcattttaggagtagcatgctttccatgcttcagtggttcagtgaatataacctgctgattgacagcatgattggatcctgtctcttttttggaccatcccatgttgcatcacacttgtgaaaactccagataccaccagaaatatccgtatcatctgacctggtactgataacatagttaagcaatcatatgaaaatcctgtgcattttccttttctccttgacagatatggctgccctgatattgagaaaatcgagagtttcaataaactctacaagcagaaactggatgagataatcgaacaaggcgaaatacccctggacctggatatcgaggcaagtcacccaatcaaatttcttactcacattcctgattagttgcatctgcatttcagagcaacttactgagaaccgatttgctcatttcaggtctcatcaccaggagcagagcgacttctagaggtgcccgaggatctggatcgtttcaaagatatggccatcagagtgcaataccttgttgaaggcgacgaccttgtcctgaagcagatcctgcggaagaatggcatcttcttgctcaagtctgttgacattcaggcagaacattgcatcaggaagcttggcagatgtcaaggagaaccgagctgcagctgggaaaggaaggtcattgaacaggaaacaaagggattggaggctgcaaacttcgtttaaagcggtgaagaaggcaaccctatacttggactaaaatatgatggcatatgtttggatagcagtggtttagaaccaactccagtattagtttaaattgggacgaaatctcacatactctctgatatacttgcaatgctggcaaaggatgttcagttctgtagttagattagggtctacttgatttgtggaactgaatgagttttgtggaggcaaatttcgttgtaaggcacagttatctctgagttacattctgagcagaacacagaataggatggcagatgtacgttctatggaatcactcattttgggtactgaatttttctctactattctcttctggagagtgatgaattctctgcagttgactgcatctgaaagctgttctcatgcaagtgttcatgatttatttatttattattcatcagtacattgttgtgcatgtttgttctctcagtcctcacagtcttacactaagctccacgcttagttactcctcttgttgagaaaccttgctgggctgaacggcgagagatcgaagatgctggcactgccgttgaggatgagctccgcgagcgcagcgccggtggccggagcgttgaggattccccacccgccgtgcccggtggcgacgtagcaacccttcaccccaggcatctctccgatcaccggcaacccgtcactggtgcacggcatgtagcaagcctgctccgccaccacctccgcgccttcctccctcttcagctggctggacaccctcccggcgatctcgtgcagcgccgcgatcgagtccggatcaccggtgatcgtcgccggatcattgggcacctcttcgtccttggttatcccacaaatgtacacctccccctggtgcaacacataattcaatatattaatggtggctagttagttcacatggatcgatttagcatttgagattaaggggcagtggcaatggcggtgcaccggtgggccgcgggtagatctccggggcgagcatcttggcgccgggctccggttggtagctgaggaacagcgcgtgcggcgtcatcttgtcgggctcacgcggccggagcacgacgctgtgccccttgagcccggacacgtcgaacacctccctgaccatctcgaacccccgaccatggcccgagcgcgaacaccacggcgtcggcgtccaccacgccgcggcccttgacctcgaccccgatgacgcggccgtcccggacgacgacgcgcttcacctcgccgatgaccacctcggcgtcagacgcggcgaggacggccttggtaaaggaacccgggtgaacctgcgcggtggtgtccgctgtcgcgagctcccgtggcggcgcggcggacgcggccgggtcgacccaatgagagagcttcgggtgcggcgccggagaggcggcggcggcgaggtccgggtgggtggagactggggtgccgtgtggcaatttataaggaaatattctaattgaaatggctatactgcccctgtccgtttggcttgcatatatggacgcggcttgccttgctccatcctcccatccgtactcccgcatacgtggcagcatctgctccgttcctagcttttttccgttggcccacacctgaagtacgatccctgtaaatcccgtgaatcccgttccaccaaacaggaaaaaaaaaagcggacatttttcttcctctcccagctacttcctcttccagactcctttatccccttgctgtttcccattgagctccacatatgcccattagttgccagggaagataaatctaatcctcatagttgatgcgtcagaggcggcccaaacgagaaccgcgccctggccgagccagcggccacggtctccctaaacaagtcgacgataaacaagagctcgttcggtggcgccctcaagctatggagcgacggtggtagtgcgtggacgagttggcgagctggtcggtcggggtggacgcgcgggaaggcacgctgggcgtcgtcgaggcatgcagcggccggagacgacgttgctattgctggtagtcctgcaagtgagcagtacactagcatggatgtgttatacctactgcactgcaagttcgctgctgagtaaaatccgaggttaaacgagagaattgcaaagaacacgagtaacttatcttacgttttaagcgtccgatgcatcaggtatgttggaaacaatatctgtcgttccttagtactactattttggggtggatattggtgtcctgatggtgtatgattaagtgaaaaaaaaattgttggggatgatgcttctgttgaaatagagtctagcgactaatgttggcgtcaagtgtaaatattatccatccaaaacacattcatatatagctataattaaatggttagttacctaatggatgatgataacccaccaataatgacggtattcaacgaatcgtactctcaagtgtgggacaacggaaaaaagctacgaacgggacagatgccgccacgtatgctgtagtacggatgggagcagaacgagggagcaggcaagccgcgtccgattgtgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttaataaacagttaagtaattaaacaatattaattccaacgctatacaacataccctgttgtataggcccaaccattctgaacaaccatcccggctgcacagttctatctccaaaccaggaatgtaccattccaaaccaggagctaatcaaattattaccagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggtttatctccgccacttctcagtctggtgccccgcaatgaaccatgctatacaaaagataaagccgttgcccatgctggcttgtggttggcacagttaatgtttcacaaccgaaactcgtgaaccggtccttaattgtcatgagcacgaccaacaaaaccatgtgctcacaacccaccattaccaggttttagttggcacattaattaattaactaatcacgattgaccatcgtgaactatcatgaaaccatcatgaaatattagtgagtcattagttatcccgaatgtgtactaatgtttctaagcagggctaagcaattatatctaatatctagttgaaccattataaataaagctcaactagtcaaattgtaataacccaaggtatcaaggaataaggtaatcaaatacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagcagaaaagagcaaaattgatgaactactgtaccagtgaaagtgcattcaaggctctg

SEQ ID NO: 77767 - DNA, 1343 bp, Oryza sativa
  unsure (1)..(1343): unsure at all n locations
agaccgggcgcacgggctacggttcacaagaacggacggccgagatcgaaccaatccaaaacggacggccgagatcgatcgggtccacggcggctcacggcggacgaccccgatgacgtcagcggtgacgtcaccgacagcggcggcggctcggcggagcggacggctcgggcggcgcacactcaccggcaaacggcggcgctaggacgcaaacggagggcaccaagatgtagaggacaacacggcgaactcaccggtgaccaaaacggcggcggaagaccaacagacggcgacggcgacgaggaggaaacggcgggaaccttcgggtcgacaacggcgaagctgctccggtgatctccggcgacggcgaaggggcggacgaggacggcgacgacttggcgagcacgacggtggtcttcccgagcgacggcgacggctgaaacgacgccggcgcacggctggagcggcggcggcgacggcgaagctagggcacacggcgctagagcgattccgacgactagaagcgaaggcaagggtggcgacgggtagaggagacaccgggggtccttttaaaggggctcgaaggcggcggcgaaggcccacgacggcggcaacggcgaaggaaactcgcggcttgaaggaaagaggtcgatccgaatcgaactcgattccacgaacttccaaaacgatttagccaaagattccaaaggagaaaaggtagaggagatcccggagattgtttcccctcaaacaattcggccggagaaggaaaggaacggccggatttggaaaggaacggcggcggcgcgaaactagggtttcgggcggcggcggccgaaggtagacgatgggtccgacaggtgggccccacctgtcagcgagcgagggcgcgcgcgcggccggctgcggactgggccgaactgggccgaggagagagagaggggttttgggccgactttcggcccaaagccaaaagagactttttaaaacctttttcaatttaaattatttcttaaatgcaattccatttattaaaaatacttccttagctcaaataaatcccagaaaaatctaggaattatagaattaagcaaagtatttaatgaaattttatctggccccattttatattggaatttattaattaaaacaagatcttctcttcaagacttttaaaattatttctagaaattccatttaaacaacaatttataaattttaaaattttcagggtgtgacagattggctttggccatttggtggcagcaaggagctagcttacatttttgacatttcaagctagacatattgatgngctnctgtgcgatctgcaatcaatgcca

SEQ ID NO: 77768 - DNA, 7269 bp, Oryza sativa
  unsure (1)..(7269): unsure at all n locations
atctaaggttaggcgaacaaatttggcaccacactttagctaacaatctataacattgccacatttttctaagataatgacacgtgggaccagagtgctagaaagagaatcttgccacaagtgtggcaatgaaccaaacgcatggctaacttagtcaaaaccgcctaacttgaggtgtggcaaagtgtgacaacatgtggtcaccaaccaaacaacccctaaatttcataaaactgcaattgttttgtcaattgctacaattttagatgggaatttcaataaactgcgacaatagcaaatgattttctttttcactgggctgactgaagatagccgagtaaagtttgttaagaagagagcaggaacagaggattacaaattcaacaacagagttttataatgcttaattgattataaggagagcaattcgacgtcaacaactacgaatggagctagcaagatttaatccatttagttgtacaaggtagcagaaccaaagcataaactgtacaaactatgataaacatgctcttccattccttggatcacggcctgactctggctggtcgcagtctttccgaattctgacgggcaacgtttaattcttgcgatggtagccttctatggaaaatcagaagacatggtacacctgtaaaacaaatcaacaaaataataaatccaagccatattagaaatggctaaactattatgcttcttcaaaaggaagtaattcagctaccaagggaaacaattaaatattaaaattgagatggtttgatgcactattgcctgatagtacaatcagaaattagttgattcaatagctcatcaatccaaaaatataatgaactttcaatcatgtaaaggccaggttttatctaaaaaaattatccttcaatcatatccaggtcaagtacaaagaaacactatactcaatgttctgccccgattacccagatactatactcgtctgaatcataactaagtgaatccatcagaagtcagatgcctcacatcatattcagcttgaagtgcaaatgaacttagcaaatgcccaaaaaaacatatatacactcttacagaagcaatgcataaacatcattgaagagtgccctgcaatgcagaatgcaccgatccatctggccaacacccaacatgggttgattgagactacaaaaaatcagcagaacagcatactgaccagcagctgattaaatgtaatagtttgcagcacacagccacaggtgcgaacagtagggcgttatcaacacagttggatttctggtatgttgttcacgtggattgcttacgttgctgaataatattattagaacaaaactttggttggacattcaatattgtatattctgatgacagtcaaaagtggtctagccatctaattcttaaatgcaagatcatggatgtaggtacatcattttcttgctgcttgcagcagtaacaaaaaattgcagcaacaagatagagccaattttcccaaggtatactaagaaccaacaaaagctactgcatactacagaagtataaaaggtgcaagtaagatctacattctgcacgatataaaagttactgttaatatatctccctctcatatcttgatggtcacaacaaataaagtttgatcatatcacacgtcagtaccatggaaagaacagtttttgaaatcaaaaggctcaaccattcaatgcaaggaggcaggtttatccacagatcagcatggaatgccataggtggagcttagattataaatgtaaccaagattgacttcagcagaaatgaagtgtttattgattacaactgccgcagccacaacagcttcggcagcaagacgagcaagcaaatgggtcactctgcaacatgttgctggctctatggaaattccaaggataagacttgtcatgactctccacaaccactgtagcatctgcagacacacacccttctgaagacaaatgactcagcacgacaactctagaggaaccatcatccacaaaaataagcatctgctccaacatttgggctcttcccattacaaactttacaaatgccagctcactgtctttgcctcgagcagcttgaaacacaaacttcctcagatgtgaatggacacattccgtgtagcctactagatcccagaactccactccaacattaactggtgtctcagaaggaactgactgtatttcaggcaaacaagatgattcagtcaacaggagcacacacatattacaaagtgaataatgcagtggcttaagattagtaccatgatatacaatgtttctaagcatgggaagcatctaagcaacaggggcaccagtttcacttgctcctcgacaccaaactgcaccttcaacgccaatgtcctgagggtccgaaccattgcacttggcttcacctttatcccatcctacgacacaaaaaaaagcagttacacaaatgcaatttcacataattgtgaaaaacagcaaggagctgccacaagaaacagccagcaaccttgatgacagtagaaccgatcttgagctggtgcagaccgacatcgaagtacccaagaacctttagccttggcgcattgatgatcttgacgtgcgtggatgctccggcgatcggctccagaagcagccgctccatgttgggggcatcatcgaggtgcacctctctgaccatggacatccatagcaccacgcaccggaggctccccgaccagatatggacgtatcttgggtagtcctgtgtaagcacgagcgcgaggctctcgagctcggggcagcgggggagcacggcgtgaagctcgcggtcctgcatggaggagtggacaacaacgatctcctgcaggttggcgaaggctggagggaggccggctgtgtccgggaactggcagaggccgagccagaggcggcggagggaggcgcagccgaggagatcgggtgggggacgccactcgatgggccatgatccgttcacgacggcgagttcaccgacctccttggcggcgagggaggcgaaccaggacgcgacgacgtcgggatccacggttgccaggtgcgcggaggcaaggcgcgccaaggcgactgggcccgggtgggcggcgagcgccccggtgacgtcgcccggagcgaggccgccgtcgtcaaggtggaaagggatggaggcccaaacacggcgccagcgggaaggagatcccggcggtgcggccggcgtccttggtgggaaggcgcgaaacgaccctgcgaaggagcgcgtcggggagccggctgatgcggtcctcttcgtccagcgagaagacggcggccgcgtcggcggcggagggagaagaagggtgagagttcccggtgaagaaggtgggaggcgggaggtaggataggacgacggcgagggtttcgtccatggcggcggctgcggcggtggtcgacggcggcggagggaggatggcgagttggtggggtcaggaaagggaagcggtgaaatggcgtgacgatgagtggtatgggccgaaaagcccggcattggtccaacaaatcgaggcccaaatagtgtgggccttaatccaaggccatctatatatgggccgaaatttcagtgaaaatcctttaatggatcaaaatcttactacttgttttcttccggcaaattcaaatttaaaacaacctacttggaattcaagccagataaccaatcagggctcccttcatatttgactttttttcgagacaccttagaattgtttgacccgtatttgtacatcgttatctaaattagaacatccttcgtagaaatgctttcgaacaaacgtcctaagaattcaaaatatcggatccttatccgaaaccgccaactaccaactcaatccttatccgaaaccaccaactaccaactcctccaccacacattccttttttttatctcttcttctcttttgctctatctctatcctcggagcttcagcactaccacgttgtcagaagtcgggagagatgacgaagccatcgtcgccggtggtagtggtgatggggtacgtaggacatcacaggatagggatttgtaggaggcgttggacctcaccgccttgccgatggccacactgcagtcatactgcagtagctgagcaagacaacatgaaatagggaggagacgctcgacttggcatctgacggagatcaaacgcggacgcgactggccctggccaaggttgcccgtctcacgccgtagctcgtccgtgtccttccctagccaatacattttccccgccgcatcattcactagttccagtggtcggagtagaaatagatagaggtgggttcattttgttagagtgtagtgatgttatactttattgtattaaggtgtttcattttgtttcgattgaatgttgcatgtatttattcttcgcattgcaattggtatgtttcgaatattgcatttggttgaaacacttttgttaaagctatgaaacattttcctccgatcgatgaaatgtataacattttcattaagtggtgtaaaatgtgaaatattttacaataatatagggtaacactgtccgatgttgcggacatcaagccatagtcggctcccatccttcatccttgcttatatgtagcgaatcaatttgcttattccaatcagagaggttgcgttgtccaagacttcgaaaatgtcggcttgcaaacttgtctatcacatatagcaacctgacagtatgtgtgatacaaacatatctggatttatgggatgttatgatttgcaataaactatatagtacaaacgaaatatccccgtcgctaaattttcccaaaattaatgaaggacaacattaacttttattctctccgtcccgtaatataaaggattttgaaaggatgtgacacatagggatgaaaactgtcggaagcctcaaccatttccgtaatcatatttttctcggaaacgaaatcgaaaacggtgaagtcggaaaagaaaacgatatcggaaatatcgaaaaaccggaaacggaacaatacggacggaaacatgtcggtacagatcggaaaccgataacaatacggaaacattaaactataaaaacatatattaaactttacataagtatgttatatgtatacataaattcaagcttatactatataaattataaattaacttcgttttagccatgttagagatttgattgaagagtcagtcaatgtgtaagttgtgggacatgccctataaatatcaacatatttagaatacggtaattaccatattataagaaacggtaattttcacaagaatatggtaaatacggaaacgataggtataacaacaaaaccatttctgtttttatttccatatttttttaccattttcatttttgtttcggtcaattaccatttccatatggctcggccggtagaaagtcaaaaacgaacgctggtcggccgggaattaccgttaccattttcacccctagtgacacatgtactacgaattcaacttcatactccctccgttccctaatataagggattttgacattttacttgtactgtttgaccattcgtcttattcaaaaaaattggaattattatttatttatttgtgacttactttattatccaaagtactttaagcataactttttgttttttatatttgcataaattttttaaatagacgagtggttaaatagtgtaagtaaaatgtcagaatctcttatattaggggatggaaggagtagtattaaaatatatcacgtcccttcaaaatcccttatattttgagacgtatgaggtacattttccaaatccataaacgattaatttatcgaatttaatatgaaccacgtacatgacgacccaaacacgaacatcaagtaatcttatagccgtcgttgaccggctggcaccggttaccggccggtaagcatggaacaatggaagtggcaagtggctagctatctacgtggccacatcgatgtcgcccttcacctccacctcgccgacggcggcgaggctgcccctctcctccatgacgatggcgacgccgccgtccttggcggccgcctcctcctcctgggcgagcacagcgtcgagtatccggagcatctcgtcgggcgccacgagctgcgggaagtggccggccgagtcgacggtcaccaaggcggcgcgcccgatgcgcccctccatgtagcgcccgacgcacggcggcgcggcggggtcgccggaggcgtgcacgagggtgcacggcgcggcgacgcggcccagcacgccgcggttgtcgccgaggaagatcatgcgcgccagcgcgtccgccacgcgcgggtccatggcgaaaaaggtccgcgccagcgtctccgcggcggaggggttgtcgccggcggcgccgacgatgagcgggacgaagcccttggcccaggagaggaagtccgacgagatggtggccagcatcgcgtcgatctccggctcgtcgaagccgccctcgtagtcatccgagttgatgtacctgcaaacaaaattaccaaagttgaaaattgtaatccggatggttccttgcgcggaattaagattgaaattaagaaaaacatctagattagaagtcgttaatttcatcattttgatctaatctaagcacgcagctggtgatggtcaaccactagcctaataattatataagcattttaagccggcatagacttcagataagataaaatgatagcttaattccatggttaatttattacagttacgaaactaaatatttgaaatttcagggtctactggtgggtactgttagctagaatattctaccggttgaatgttttaatatttttttataaaaaaatagcatgaatttgttcaaattttaaaattttcaattccaaattttcggaacttcgatcacccctggtaggtttcatgcattccaaatagtaaacctggcttaactgaaactcgagatcttcagcttaactagtttttgaaactgtgttcggatgccccctttctcaaccactctttctcgttttccgcatacacgcttttcaaactgctaaacggtgttttttttttgcaaaaagtttctatacaaaagttgtttaaaaaaatcaaattaatttattttttaaataaaatagctaatacttaattaatcatacgctaatgaatcgttctgttttccgtgcgttaagagatagcgaacacaggagtggttccttttgccatgatcgaattaatgatggngtnctgtnccactggagagcattcatgcctg

SEQ ID NO: 77769 - DNA, 26935 bp, Oryza sativa
acaacatccgtaatcaagctctacgccctgttgcagctccagcacagcaacaacctgccaagagggagcaaggcagcaagcccgtggtgtgtttcaattgtggagacccaggacattatgctgacaagtgtccgaagccccgacgtgtgaaggttgtccctgcccagagcaactctactataccagcatcaaaggcccgtgtcaatcatgttgctgctgcagaagctcaagatgctccagatgtgattttgggtacgtttcttgttaacttagttcctgcaacagtgcttttcgattctggtgctacacattcattcttatctaagagttttgcgggaaatcatgggatggaagtagaagatcttagacgtcctttgatggttagtaccccgagtaatcaagcactctctttgcaacgtagcccctttgtcagaatagaaattcaaggaataccatttctggccaatcttatcctgttagaatccaaagaccttgatgtcatcctagggatggactggttagccagacataaaggtgtgatagactgtgctaacagaaaagtgactctcaccagcaatgatggtcgagttgtaactgttcttgcactgtcatctgagtctttaaggtcaagacagaaccagataactttggaagagattcctatagtccgggagtattccgatgtgttcccagatgatttgcctggtatgccgcctaaaagggatatagagttcagaatagatttggtaccaggaacaactccgatctataagagaccttatagaatggcagccaatgagttggcagaagtcaagaggcaagtagacgatttgcttcaaaaaggatacatcagaccgagttcatctccatggggagctctggttatttttgtggaaaagaaagaccatacccagaggatgtgtgtggactatcgtgcactaaatgatgtgactatcaagaataagtatccgctgcccagaattgatgatttgtttgatcagcttaaaggtgccaccgttttctccaagatagatcttcgatcagggtatcaccagttgagaatcaaagaggaagatatacctaagacagcttttaccactaggtatggattgttcgaatgtactattatgtcttttggacttaccaatgcccccgctttcttcatgaacttgatgaataaggtgtttatggagtacctagacaaattcgtggtggtctttattgatgacattcttatctactcccgaaccaaagaagagcatgaagagcatcttcgccttgcattagagaagctacgagaacatcaactgtatgctaagtttagcaagtgtgaattttggttgtctgaagtgaagttccttggtcacgtcatctcagcaggaggagttgccgtcgatcctagtaatgtggaatccgtaaccaactggaaacaaccaaagacagtttcagagattcgcagtttcctaggccttgcaggatattaccggaggtttatagagaatttttccaagattgctaagcccatgacacgactgcttcagaaagatgtaaagtacaagtggtcagaagaatgtgagcagagttttcaagagttgaaaagtcgcttaatatcagctcctattttgattttgcctgatccaaagaagggtttccaagtgtattgcgatgcatccaaacttgggttaggttgtgttctgatgcaagatgggaaggtggttgcctatgcatctcgtcagttacgtccgcatgagaagaactaccctactcatgatcttgaattagctgcagtagttcatgcgttgaagatttggcgtcattatcttttcggtactcgtacagaggtatacaccgatcacaagagtttaaagtatatctttactcagccggatctgaacatgagacaacggagatggttggaattaattaaggattatgacatgggaattcattatcacccgggaaaggctaatgttgtagcagacgctcttagtaggaaaggctattgcaatgctacggaaggacgacagttgccattgtaattatgcaaggaatttgaaaggttgaatttgggaattgtcagtagaggtttccttgcatccttagaagcgaagcccactctaattgatcaagttagagaagcccaaattaatgatcctgatattcaagaaatcaagaagaatatgagaagaggaaaagctatcggtttcttagaggatgagcaaggaactgtatggttgggtgagagaatctgtgtccctgacaacaaagatttaaaagatgcaattctgaaagaagctcatgatactttatactccattcaccctggtagtaccaaaatgtaccaggatctcaaggaaagattttggtgggcaagtatgaagcgtgaaatcgcagaatacgtagcagtatgtgatgtttgtcagcgagtcaaggcagaacatcagaaacctgccggtttgctgcagcctttgaagattcctgaatggaagtgggaagaaatcggtatggattttatcactggtttacccagaacgtcatcaggccatgactctattttggtaatagtcgacagacttaccaaagtggcacatttcattccggtaaagacaacttattccggaagtcgcttagcggaattgtatatggcaaggattgtgtgtttgcatggcgtccctaagaaaatagtgtctgatcgaggcagtcaatttacttcaaatttttggaagaagcttcaggaagagatgggttctaagctgaactttagtactgcttatcatccgcagacagacggacaaaccgaaagggtgaatcaaattttggaagacatgttgagagcttgtgctttagacttcggtggaagttgggataagaatctaccttatgcagaattttcgtacaataacaattatcaagctagtcttcagatggctccttacgaagcactgtatggtcggaagtgtcgcactctgcttttgtgggatcaaacgggagatcgtcaggttttcgggacggatatcctaagggaatcagaagaaaaggtaaaggtcattcaagaaagattgcgagtggctcagtctcgtcataagagttatgccgacaatcgccgcagagatctaagttttgaagaaggagattatgtgtatcttcgtgtcacgcctcttcgaggagttcatcgtttccacaccaaaggaaaattggcaccgcgttttgtgggaccttataagattgtcagtagaagaggagaggttgcttatcagttggagttacctcaatctttggcaggagtccataatgtgttccatgtgtcgcaactgaaaaagtgtttaagggtacctaccgaagaagctaatcttgaacagatagaagtccaagaggatctgacctatgttgagaaaccaatccgtatcttggaaacagatgagagaagaaccagaaatcgagttatccatttttgtaaagtccaatggagtaatcactcggaagaagagtcaacttgggaacgagaagatgaattgaagtcagctcatccgcatctgttcgccagttcttccgaatctcgaggacgagattccgtttaaggggggtaggtttgtcacaccctgaaaattcaaaatatataaattgttgtttaattggaaattttagaaatgattttaaaaagccttgaaaagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaagtcttcttttggctttgggccgaaagtcggcccaaaaccctttttctctctccccggcccagtcggcccagtccgccgcagccgcgcgcgccctcgctgtcgctgacaggtgggtcccgcctgtcaggttcgtcttccccgagccgccgtcgcccggccgaaccctagcacgccgccgccgccgttcccttccaaattcggcagctcctttccttctccggccgaatcaaaagaggggaaatgatcctcgagatctcctctaccttttctcctttggaaacttcggctaaatcggtttggaaatcgatggattcgagttcgaatcggatcggcttttctctctccgagctcgagctttccttctcgtcgccggccaccgtgggccttcgtcgccgcctcctagcccctttataagcttccccggtgtctcctctacacgccgccactctcgccttcgcctctcgtcgccggaagagctctagcgccgtgtgccctagcgccgccgtcgccgccgtcgctccagtcgtgcgccgccgccgttccagtcatcgtcgtcgctcgggaagaccgccgtcgtggtcgccaagacgtcgccgtcctcgtccgccgcttcgccaccgtcggagaccgccggagcatcgtcgccgtcgtcaagccgaaaagcgccgccgattcaacctcgtcgccgtcgccgtccgttggtcttccgccgtcgctttggtcgccggtgagttcgccgtgccgtccgctacccgttggtgccctccgttcgtgccgaagcgccgccgttcgccggcgagcgtgcgccgtccgagccgccgagccgccgccgccggtggtgacgtcaccgctgacgtcatcgtcgccctttcccgtgagtcggtcgtggaccgttcgatctcggccgtccgttttggatcaagtcgatctcggccgtccattcgcgtgaaccgccgccgtgcgcccggtccaccgaaaccctagcccgctgacgcaataaatccctttttccttttcaaaaataattcattattgcgtcataattcaattaaaatcaatttaagtgttttaatccgatttaatcttcaaaaattcataactaattcatcttagctccgatttagttggttcaagtctctaaatttttctaaaattgagatctacatgttaaaaatatccacatgtactattcatgcttgtttatgtgctgttttggtgtttttgctcttttctgtttagattccgtcgtttccggagagtccgttttcgccggagaagagtttgaagagttccaaggccagcaaggcaagtcacacagatcccaaacaaccctttgagcatgttgatcctatttaaagctattgtttctattcaaatattgcatttattttcgaatgtcattgggtggaattaacctattgtttgttatagcccttttgttcttgattactttattccttgataccttgggttattataacttgactagttgggctatgtatattgattcaactagatattagatataattgcttagccctgcttagaaacattagctcactattgggataactcatgactcactattacttaatgatggcttaatgatagttcacgatggtcaatcatgattggttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcgtgggcaacggctttatcttttgtatagcatggttcattgcggggcaccagactgagaagtggcggagataagcccacgggggtcgctggggagtccatgccttgtttataagggggtgattatgatccaggaaggtgcactgcagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccatagtaaatgatgctataattggtaataatttaattagctcctggtttggaatggtacattcctggtttggagatagaactgtgcagccgggatggttgttcagaatggttgggcctatacaacagggtatgttgtatagcgttggattaatattgtttaattacttaactgttttattaaattctcaaatgtttgctaaatgctgcttttgcaaatgaaaccctactatgccatcctttgttatcctgtgcacttgcatatttgctgcgtggcttgctgagtatgtcatatactcaccttgcaatcattcatcagaggaagagttctacagtgatgctgatggtgtggaggattaggtgtagccttggtcaagctgcctgtggagtggagtcgtctgcgccgtttatcttttctttccgctgcttagatctttattgattgagaggaactatctacctctgtaatgacattttatacgcttattaattagagtaataattgtactctattatcaatttgttattgtgtgcctcggctgattcctggacgagggttcacacacatgtaagcgtttggaattttggatagaaattccgggcgtgacaagttggtatcagagctccttgaccctaggttatgccatatggttacccatagaagccctctaaaaatattggaaaaatagaactgttctcctctccttctcttttaattaaaccaaactaatggcacatgcacttcataatcttttttaagggttctcattcaaaatttattccagtgttattagtactgtacatctattactgtactaatggctcatttaccagcaaaagttttacaatattgttttatttaatcttgctgcaataaaataaattaagcaagttgattttataactttcttttatttcttttgaaacctgatgttcaaaagtacaaaatttgtaaccttgtttccagctgtttcaacttatcttgcaagcttggtttaccgtatttacttacctttttactttgatttctaactttattcaaattaatccaaaaacttgtgctattaattggataaatgtcttaactccctcctttcacttgtctttagatgccgcgctacaagcctgagtacttgtttggtgttgagggttttgtccaggagttgcgtacgatgtcctttgccataggatttgggactgcccctttttatgcccagattcctcatgatcgtcatgaagagaagtgccgagtcaaagtcaccttgaacagtaatagtgaaggtatcccttcagtgatgttcgaagctggaggaagaaactacatccatgcatgtcaggaggtggcaaggatcgccataggagagctccgcgatcgctacagtgatcagttggccgacactgagtatcgctaccatcctcgccaaccccagggaagtgaccgtggcagctaccttgagactgaaggaattgagaatgatgctaccacaaggcatttggttgagatgctgtgggctatggatgaaacccgtgcggagactgtgttagcggctcaagatcgtgaagaccggaatcgtggtaagatttgcaagttagaagacaaggtggatcgtttggagaaggaattagccgcgttgaagggagaagcaccgccgcagaaggccaggattcgtctcaccgcaaggaagagagctctatttgtccctcgctatcaattggcgccaaaagttcgtgtggtggagaaagaagttgccccaaccttggcagatcctccggtcatgatcataagtgatgatgaagaagaagaatccaagcgcaaccattccaagattgagtgggtagcaactcaagatgatgaagacgagccgaatgagccttcaatcgacctccgatgctcggaagaactagagtgacttgttaagtcgttgtcttagatcgttgtgttagtttgcttgctttaagtttggttgtgtgtgtctcgcatgtgatttacatcagtagtgggatgtaagtgcatgtgtttgtttgcttttgagtgttaggaagttggtgagtttagtggtgtgagagtcttcagtttgtaataatgaaactcagttaagatcaataaaagttaaagtaattctctgtcctaagtagttcccccggtctctcttcttgtgccctgtccatgctagatggtgaacactcgcagcaacgggaatggccccaacaaccccaataacaacaacaatgaagggaatcccactcttgctcaagttcttgctcaacagactcagctaatgaacatgatgatgcagcaacttcagaatcagcagaaccaaggaaataaccatgcacctccccagaacaagttagcagaatttcttcgtgtgaggccgcctattttctctagtaccactaatcctgttgaagctggtgattggctgcatgccatagagaagaagttggatttgcttcaatgcactgatcaggaaaaggtctcatttgcatcacaccagttgcatggccctgcctctgaatggtgggatcacttccgccttaacaggactactgttgaacctatcacttggctggaattcaccgctgcttttcggaagacgcatataccatcgggagtggtgtctctcaagaagaaggaattcaggtcgctcacccagggatctcgctctgttacggagtatctgcacgagttcaatcgtctgactcgttatgctccggaagatgtgcgcaatgatgaagagcgctaggagaagttcttggaaggacttaatgatgagctttcttacccactcatgactggagattattctgatttccagaagttggtggataaggctattcgtcaggaggacaagtacaaccgcatggagcagaagaaacgccggattgctcaattcaagacacaacaggggaataatcagaagccgcgtcttactttaggaccccagtccatgccacagggaggttcttcgtctgttgttcgtccgcagcgtcagttcttcaacaacaatgctggcaacaacatccgtaatcaagctccacgtcctgttgcagctccaacacagcaacaacctgccaagagggagcaaggcagcaagcccgtggtgtgtttcaactgtggagacccaagacattatgctgacaactccccgaagccccgacgcgtgaaggttgtccctgcccagagcaactctaccgcacctgcgccaatggcccgtgtcaatcatgttgctgctgcagaagctcaagatgctccagatgtgattttgggtacgttccttgttaactcagttcctgcaacagtgcttttcgattctggtgctacacattcattcttatctatgagttttgcgggaaatcatgggatggaagtagaagatcttagacgtcctttgatggttagtaccccaagtaatcaagcactctctttgcaacgtagcccctctgtcagaatagaaattaaaggagtaccatttctggccaatcttatcttgttagaatccaaagaccttgatgtcatcctagggatggactggttagccagacataaaggggatagactatgctaacagaaaagtaactctcaccagcaatgatggtcgagttgtgactgttcatgcattgtcttctgagtctttaagatcaagactgaaccaaataactttggaagagattcctatagtccgggagtatcccgatatgttcccgatgatttacctggtatgccgcctaaaagggatatagagttcagaatagatttggtaccaggaacaactccgatccataagagtccttatagaatggcagccaatgagttggcagaagtcaagaggcaagtagatgatttgcttcagaaaggatacatcagaccaagttcatctccatggggagctccggttatttttgtgaaaaagaaaggccatacccagaggatgtgtgtggactatcgtgccctaaatgatgtgactatcaagaataagtatccgctacccagaattgatgatttgtttgatcagcttaaaggtgccaccgttttctccaagatagatcttcgatcaggatatcaccagttgagaatcaaagaggaagatatacctaagacagcttttaccactaggtatgggttgttcgaatgtactgttatgtcttttggacttaccaatgcccctgctttcttcatgaacttgatgaataaagtgtttatggaatacctagacaagttcgtggtggtctttattgatgacattcttatctactcccgaaccagagaagagcatgaagaacatcttcgccttgcactagagaagctacgagaacatcaactatatgctaagtttagcaagtgtgaattttggttgtctgaagtgaagttccttggtcacgtcatctcagccggaggagttgccgttgatcctagtaatgtggaatccgtaaccaactggaaacaaccaaagacagtttcagagattcgcagtttcttaggcctcgcaggatattaccggaggtttatagagaatttttccaagattgctaagcccatgacacgactgcttcagaaagatgtgaagtacaagtggtcggaagaatgtgagcagagttttcaagagttgaagaatcgcttgatatcagctcctattttgattttacctgatccaaagaagggtttccaagtgtattgcgatgcatccaaacttgggttaggttgtgttctgatgcaagatgggaaggtggttgcctatgcatctcgtcagttacgtccgcatgagaagaactaccctactcatgatcttgaattagctgcagtagttcatgcgttgaaaatttggcgtcattatcttttcggtactcgtacagaggtgtataccgatcacaagagtttaaagtatatctttactcagccggatctgaacatgagacaaaggagatggttggaattaattaaggattatgacatgggaattcattatcacccaggaaagggtaatgttgtagcagacgctcttagcaggaaaggctattgcaatgctacgaaaggacgacaattgcctttggagttatgcaaggaatttgaaagattaaatttgggaattgtcagtagaggtttcgttgcagccttacaagcgaagcccactctaattgatcaagttagagaagcccaaattaatgatcctgatattcaagaaatcaagaagaatatgagaagaggaaaagctatcggtttcttggaagatgagcaaggaactgtatggttgggtgagagaatctgcgtccccgacaacaaagatttaaaagatgcaattctgaaaaaagctcatgatactttatactccattcaccctggtagtaccaaaatgtatcaggatctcaaggaaagattttggtgggcaagtatgaagcgtgaaatcgcagaatacgtagcagtatgtgatgtttgtcagcgagtcaaggcagaacatcagaaacctgccagtttgctgcagcctttgaagattcctgaatggaagtgggaagaaatcggtatggattttatcactggtttacccagaacgtcatcaggccatgattctatttgggtgatagtcgacagacttaccaaagtggctcattttattccggtaaaaacaacctattccggaagtcggttggcggaattgtatatggcaaggattgtgtgtttgcatggcgtccctaagaaaatagtgtctgatcgaggtagtcagtttacttcaaatttttggaagaaacttcaggaagagatgggttctaagctgaactttagtactgcttatcatccgcagacagacggacaaaccgaaagagtgaatcagattttggaagacatgttgagagcttgtgctttagacttcggtggaagttgggataagaatctaccttatgcataattttcgtacaacaacagttatcaagctagtcttcagatggctccttacgaagcactgtatggtcggaagtgccgcactccgcttttgtgggatcaaacgggagaacgtcaggttttcgggacggatatcctgagggaagcagaagaaaaggtaaaggtcattcaagaaagattgcgagtggctcagtctcgacataagagttatgccgacaatcgccgcagagatttgagttttgaagaaggagattatgtgtatcttcgtgtcacgcctcttcgaggagttcatcgttttcgcaccaaaggaaaattggcaccgcgttttgtgggaccttataagattgtcagtagaagaggagaggttgcttatcagttggagttacctcaatctttggcaggagtccataatgtgttccatgtgtcgcaattgaaaaagtgtttaagggtacctaccgaagaagctaatcttgaacagatagaagtccaagaggatctgacctatgttgagaaaccaatccgtatcttggaaatagatgagagaagaaccagaaatcgagttatccgcttttgcaaagtccaatggagtaatcactcggaagaagaatcaacttgggaacgagaagatgaattgaagtcagctcatccgtatctgttcgccagttcttccgaatctcgaggatgagattctgtttaaggtgggtaggtttgtcacaccctgaaaattcaaaatatataaattgttgtttaaatggaatttttagaatttattttaaaagcctagaagagaagatctaattttttaattaataaattcaaatataaaatggggccagataaaatttcattaaatactttgcttaattctataattcctagatttttctgggatttattggagctaaggaagtatttttaataaatggatttgcatttcatgaataatttaaattgaaaaaggttttaaaaagtctcttttggcttcaaaaccgctctctctctcctcggcccagtccagcccagtccgccgccgcgcgcgcgcgcgtccgcccgcttacaggtggggcccacctgtcagggtcgtcgtcaacctccggccgccgccgctcgaaaccctagtttcgcgccgccgccgttcccttccaaattcgatcgatcctttccgtttcctgccgaattgatagaggggaaacaatctccgggatctcctctaccttttctcttttggaaacatcggctaattcgttttggaaatcgttggaatcgagttcgaatcggattcgtctctctcctccgaaccctaaaccttccttctcgtcgccagccgccgtgggccttcgccgtcgcctccgagcccctttaaaaggttccccggtgtctcctctacccatcgccaccttcgccttcgcctctcgtcgccggaagagcactagcgccgtgcaacctagcgccgccgtcgtagccgtcgctccagccgtgcgccgccgccgtctcggtcgtcgtcatcgctcgggaaggccaccgtcgtgatcgccaagtcgccgccgttctcgtccgctccttcgccgccgtcgacccgaagtttgccgccgcttcttcctcgtcgccgtcgccgtccgttgatcttccgccgctcttttggtcaccggtgagttcgccgcgtcgcgctctacccgttggtgccttccgttcgcgccgccgtgccgtcgttcaccggcgagcgtgcaagcccgagccgccgagccgccaccgccggtggtgacgtcatcgccgacgtcatcggggctgttcgctgtgagccggtcgtggaccgttcgatctcggccgtccgttttggatcaagtcgatctcggccgtccgttcgcgtgagccgtcgcccgtgcgcccggtccaccgaaaccctagcccgctgacacaataatcctccttttccttttcaaaaataattcattattgcgtcataattcaattaaaatcaatttaagtgttttaatccgatttaatcttcaaaaattcataactaattcatcttagctccgatttagttggttcaagtctctaattttttctaaaattgagatctacatgttaaaaatatccacatgtactgttcaagcttgtttatgtgctgttttggtgattttccttctttttgtttagattccgtcgtttccggacagtccgttttcgcaggagaagagtttgaagagttccaaggccagcaaggcaagtcacacagatcccaaacaaccctttgagcatgttgatcctatttaaagctattgtttctattcaaatattgcatttattttcgaatgtcattgggtggaattaacctattgtttgttatagcccttttgttcttgattaccttattccttgataccttgggttattataacttgactagttgagctctacatgttggttcaactagatgtattagatataattgcttagccctgcttagaaacattagcacactattgggataacttatgaatcactataatttaatgatggcttaatgatagttcacgatggtcaatcgtgatttgttaattaattatttgccaactaaaacctgataatggtgggttgtgagcacatggttttgatggtcgtgctcatgacaattaaggaccggttcacgagtttcggttgtgaaacattaaccgtgccaaccacaagccagcgtgggcaacggctttatcttttgtatagcatggttcattgcggggcaccagactgagaagtggcggagataagcccacgggggtcgctggggagtccatgccttgtttttaagggggtgattatgatccaggaaggtgcgctgcagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcatcataataaaaggtgctttaattggtaataatttgattagctcctggtttggaatggtatattcctggtttggagatagaactgtgcagccgggatggttgttcagaatggttgggcctatacaacagggtatgttgtatagcgttggattaatattgtttaattacttaactgttttattaaattctcaaatgtttgctaaatgctgcttttgcaaatgaaaccctactatgccatcctttgttatcctgtgcacttgcatatttgctgcgtggcttgctgagtatgtcatatactcaccttgcaatcattcatcagaggaagagttctacagtgaagctgatggtgtggaggattaggtgtagccttggtcaagctgcctgtggagtggagccgtctgcgccgtttatcttattttccgctgcgtagatctttattgattgagaggaactatctacctctgtaatgacattttatacgcttattaattagagtaataattgttctctattatcaatttgttattttgtgcctcggctgattcctggacgagggttcacacacatgtaagcgtttggaattttggatagaaattccgggcgtgacaagcaccaccggctcgcactccattggattcttcgattgaggattggatttgatttggattcctcgtccgctacgctgtctgtagcttattaatttggtaggtagctaacgaaacgagatgagatgagcttgacatcggattcgggattggggaattttggagtagtcgtatgtaagcaattggttggggatgcgaggtctcgaacacgacggcgtcggtcgagtgcgtggtctgcctcagcgccgtcgacgagggggacatgtggctcttgtcccacgcctcgtgccaggtctgccacgggaaggccgcgcgcatatcggtgacgcgcgacgtagttgtgccagcctcctcgccgccgtccgctccgcctgtagcccgacgccgcttcgctgctctgccgccatgctccgccgcggcgctcgcccgccgtcggctccgcccgcagcccgccaccgcttcgttgctctgtcgccacgctccgccgcggcgctcgcccgccgccggcatccgcgcgtgcccatcgtctctcctcctgccgctggcctgaagaagagaagagagaagagagaaaagagaagaaaaaaatgtgcagctgacatgtgggcccatgtaattttttaaatgttttgctgactaggatgccatgtcagcgaaaccactcatatatactgccttgggaccttttatgcacggtttgtgtgtgtttaggggtatacatttctggttttggggttaaaggatcttaaaaaatctcgctgttaagttgagggaccttcggtgaacttattcccatggggaattacaggcaattaggccactcattcttgggccgcctaatgggcttcaccgaagggtctgtccaccctgggtgccaattagttcacatatttcgcgaagatcccttgcttcacccttgatcttgcgcttcgccttcggcttcgcacttcgcccttggcttcgctcgggatattgacgatgtgtttcagcgggctcagtcaaaggccctcgtgtcattcctctaacaatttatgttgtataaaagagtaaaataaatgtgaactataactaacctactaacaaggagtaaatatattgcttctgaattttgaatcatgacaagcatatatgaaaacaaatgcatatatcaaagcatttagcaggcgcacacaacatcatcaaacaacatcaattagcagctaggaacatcatttagtagcagctagcagcagcaccaagcttcagtattagggaatctaaatacatgtgaatccttattctgtcaaagtggttctccaaagaaaaattcgactccaatggtgctgacattgtgaaagattcaaaaggagaggtcatctgctcaaaccaagattccaaatgcatcacatttcaaccgatcgaggcctatgtgggatagagaagacaactgggggctcatccgggacggttgtgggaacggcgctgcatccaatgatcaagtggccaccatgttcatgccacatggggaccattaggaaaagaaaacatggcattcatatatatcaatgacaatgatctgctttgcagtgtcatgcctaaaaagtgtgcattcaaaatttccaatagggaacaatttctgcttttgagactggtacagatttattcccacccttttgatatttaaaatttgttgtcagttttcgtatgtcgaatgtgagtactccagtagagagtgcattgcacattcgtactcgactgtcagggcatgcacagtcgacataccaacccaccagaacgattggaacggagaaatttagtacacatgcaattagaccataggaccctttgtcattattataaacattcaaaaaatgttttcaagtagtgctgacactggtgcgcgaatataaattttgaccagatcacgctgtccattatataataaaatatgagcttatttcccagtgcactgggaaggtgtaatagcctcggaactgggcattttaatcatatcaaagaagaattatttataagcccacatgttagaaaaactaactgccttagttgtgttattagtaactttgtacaggcatacagtatggcacatttcattaggcgaaaatctgtcagggcattctaaatactcaatttatttgtcgttcgagcaaatacacactaaattactaggtatatggctaattacatcgctatatcctcattaatttacatcctagctagaagctgatgtaatatctcaatacggattataaaaatgaagttattacgtagtagcaaaatgaatttgatgctatatgtaattataaagctaattacatatatagtacctttattttttccgtaggacctttgagcaactataacagctagctaaaactcgacaagtatgtgaaagagagagacaaaataaaaaaagagtaaatttcactttggtctagttcttttgatccaagtttcacaaagaatcagggctaacacaaagttttcacttaacaccatatgtttttacatttgattgcactttggaagcaatttgaactggcccatctacacaagcaggcagaactgcagctgctagccatcttcttgcctttgttctgcgctgtcgtcgcctcggccaaagccaagccacagccatcgccaaggctatggaccacaacccagccaccacatcacgtccttgttggaacaatgacctagctaccaccatcaacatctctttgtctggatccaatgtctccacgtccgcgacccattcaagcccgtcgccgatctctttgttctgtgaccggtgacctcaacaatctccaagcacattcttgtcgttcgagatcattgcttctcccacttgccgcaccttctcggatgctctttctccccgcatatgctcagctgttatgcacgtgcagagctcacccacatccttgttgcttggcggtggccagatcagcattgccggtgccgaaaaaaagagggtgttgcctgctaacgtggatgggccacagccaacatcctatcccaaatcaccaacccctagtccaaagtgcaacctagtgcaaaattatatggtgttaagtgaaaacctaatgttaggcctggtctattgtgaaactctggtaaaaagaactggtccaaagcgaaattctcataaaaaaaaacctggtcttcacatgctccaagaaaattgtattacatatatagatgagcaaaatagagaggtaattaaccttataaataaactattgtacatcttatattaggtcaaacataagcttatagctaatagttggttctagtattaaaacttatgctatttatttaagcaatgttgatgttaaaagttttttggaaaaaaatggtactacttttgatgacatgacacaaacaagctggcctgtgtaagctacaacgaacgcgacatgcccggcacacggatctaaataaaatggaattggcgccttattacaatttacagaacccggataaaaattaagtactcccaatgttaactactcttaatggagtgaaaggagagaaaaataaacctaacaaaaggcgggtagttcgatatttaaggtttgccagctccacatgtagatgttatggtcggcgcttgaaggacttgactgcatagattgcctgtataagttcacagacaaatccaaccatggcagccaccagcaccgtcagcacgaacggattgctcaagtagcggtggtagagctgcgctatccacctaatcacgcgggtcttgtacatacgttcgaggcccttcctcgtgtcgagcaggtagttgtggctgcgctcgtcggccgggttgatggtgatgccgacgcagagctcgccgagcatcctggcgacgtcgccgtcgctggccaggaggctcacgatgatccccttcttggcgaggagcgcgacgtcgctcgccgtgccggctagctgcgacaggaagtagcagtaggccgtgacctggctccccaggctcgggttgtgctgctccagcatcatcaggttccggaggaccgtggacgtgttcatgtccaccatgagcggcgggatgctcagccgcagcgtcagcggatggaacttcacgtccagaacggagcgggcgccgccgccgtcgacgaaccagcgccacgcgccgctgctggcgccgtggcggaggtggcgtttcatgaagatcacgccggtggcatggtagaacgtcgctgcgcgccaccggtacaaggtgggggcggctgccgtagctgatctccggccggtgtcgacgacgtcgaccggcagccgaacagcatcgccggtaggaataggatcgtcctgtgggacgaagtgcttgtgcagcatgtgatgcaggtgccagatctcgcggggcacttgggtcctaatggagtatccgaaatgtttgagaagtgcctggacttggacggccaacgtctcatcgagctccctcgccatcacccccggcgtggttctacattcacggagcaccccgtagatggcgcggaggacacagaagggtatctggttatccaggcggtagaacacgtcgcgcaccaattccatgttctgcatcgcgcttccagtaccatgttgctgctgctggctcgtccccgcaccgttggccctgacgggtaagaggtcatggagcacgaacttgccaaggatgtagcatccgtcgaggagcagcatctgcacgaaacccgcagtacgtctcatggcatcgcaaggcacctgctccatgtaataatgctccttcgcaacgctttcgagggcagtgaccgcatccactaatctcctcagcacggcagccttgtgctgctcgtccaccaggatcagaatgccgtagagcatcaccttcttctcctgctccatcaggtggtagaagggattgtggtggttggggccgatgcacaccgcagccggcctctgcggagggcataataacggaatcttacactcgggtcggttgctccctgtcctgcttctctcccagcaggccgtcaagttggtgagcagagtttcaatgcaaatttctgcttggccttctgctgaataatgtttacagtcagtgttgcaagcattcaaaaaactaagggatatctgccgtactagcagacttaggtttgcatgatgacgatgtagcatagctaaaaaaaaaacactgttcatacgcggcaggaagaaattaattagagagtaattaaattgtgtcgccggtatacaaacttatgaagtgactgtattttagtacataaacttttaaattgcttattatgatgtgcaaacttgtctagtatgtagtgcgaaatagttcaaatcgatatatttgtgactaatcatgttgagttagtctgatatataatttcgtgcacaaacgatcaagggcatgacaaatgtcgtgtttgtaaatgggtaacaattatttcttctattattttgtatatattcacctttaatatgtataattaacatgacttttatatatttgattgaacatatgtgtatttaggtaacctcatcttgacatgaaagcctatataacaatcctaatcagtattcaacttagtgaaattagttatgatgtattattttgggtttggattgtacacactagacaggtttatgcatcaaaataagtgatttacttgtttacgtactaaatcgcacccacctcgcaagttcatatgccagcggtgtaattattgaattaattaaaagaccacaaagcaagctgaggaaataaaagtacagatatattgttcacactaaattcagcatcgccaaacaatataacaaaattgtcacttgcaaattgcaatctactgcaaatctgtgacagctatattaggttgttctttctatacgactgaggggggccttgatacatatttaaatgtatataactatataattaaacacgttaatactgtttttaattgaacaactataacttgacattatccgaaaaaatgtactccatccgtcccaaaatataacaaattgtacactttacaatttatcttaaaacgaaacaatttttccatcagcattctcttcctaactaatcacaccttccaacattcaatatccctacctatctccaggtttcaacaaatgtcaaccttcctctattaaatattcctactttcttaataactgtatctaactttaaaaattcttatattctgggattgagatagtagatttcacgttcactatttggttcatattggatcatcaagtgcaatatggaaacaattaaaaaaatcccctgattgattactaaaaattaattggcttttagcgttaataaatgataattgaacccatatcatattaacagaatggttttcctaccgtaccgagtaagaaacaagtctatcctatatatatcctaatccgttggcttagtctgattttttaacttttagctttaccctgaatcaaattttaaaatttaaagtaagtaattaatggctcagaaatgttgcatggacataataaaactttaagcattatgaagaatagaaggaagaaagacccatgaaatacagaaaaaaaatagaggacatttgagaatagattacaacagtgctcttctaaattgaaattatatgcgtcttgtagcatgctatatattggctatatattggacggccggagcgtagatctaggttttggggccggatacgtcagagtttcaggcgactgataatttatacagaacacaacagaatcatgtttatgttcaaaactattctgaaactgttgcacagtaaaatcaatatgaccccagtgaccattaattaattacatagatacaaatgcactgaagaaacaagccgtaataactattctgaaactgttacagtaaaattaaattaattaatatatgcttcccagtcgacatttctcttagcaaattacgttttccggatcccagtgaccattaattacatagatatatatgcactgcagaaacaagccgtaaatgtgacggacgtatacatagattacatcgtacgtacgtgcttaattacttacctgcaagctccatatcggttgtctcctggtggctatccataagctcgtttctctgtatgctatgcgtgtctagcttgcttctgtcttgctcggtagaattctgcaccactcacacacacacacatatatatatatatatatatatatatatatatatatatatatatatatatatatatatatatagtctaagtgacagccaccacgattcaaaaatatcacatcacatgcgaatatgcgatatatcgagcacgctacatatatacaatgtaaagtgtaatcgaaaccagtgaaagtgaagtaattaaagttcgtgcagcaaccactcaataaaggtgtccaaggcacgtactggccggccgtattggggattttcttgacctgcaggcgggcccaatcaaggcagtcgttggatggggtaagtagtcggttacagtttagaacttggagttgtaataggtattaggactagagtatgagtcggactctatcccaggatcgtctctcataaatagaggggcgtgcctattgtaactgcatggcgacttagcatagcgagagggagcggctgccagcggcgaccggccgtgagttgttgtaactctgatacgctgtatatgccggaccggggaggagcgcccgtaatcagtgccccagagatgtaggctacggctgaactccattaccaaatatcgtgtctcggtgtagtcatcgttttggatctcctatggtgttttcttccgcgtttagctaccgatgtcgatttcggggctggttttataacaagtggtatcagagcctgcgggaggtccatggtagaggcgcgatggaggtgccccacactgcgtagcttgcttgtaatgtccaggaaggggcattggcgcaaggtggagcacggcggcgatcaacgaagtcttgatcggtggatcgaacacttctggaggcgaccggaaccgttgatggccgctttcaatagggagatgaccagacgtggtgctcgggttgatggccgcggaagcgattggcgaatcaatcggtggatcggacacttcaggcgggtggctcgaactttccagtgagctactctcgacagggagacgtgcggccgcatgctcgggttgattgaagctagaggcgatcagcgttctcgatcggtggattcgaatactctgggcggggtggtctgggcctttcgatgagctgcgttcgacagggagatggctagacgtagcgctcgggtcgttcgatggctggaatacggcatacgacttgtcggcttcgactcgtgacttgattgatggtgttcaatcggaagtaggagcgggtggtttctacgtgctgttttttgatgtgctgacgatgtggtgcgtgatggattgctattgtggcggcgcacatacgataagcggcggaatcaggaagacgggcagccaatacagaccgtcattgctctatttaatcgtgttagcacagcaatatgcattggatgcaactgaccggcggtgttcatcgccggcgaggttcagcgggatgccgggaggctgcgctagaggtcgtacgggtgcgtgaaggctgaggaggtcacgggaggtggcgatgtgcatgtgttggtgtcaaagtcgttaccatgtaacgtgaccaaagcccagctagtagggaggttcggtttttttaccgagattgcgcaggtcttgatctgggtgtgtcatggatggagtcggcctaggactcgtctctgttttggcacagaagagcagatcgaggggaaaccatgtcgggcacggaacgggaatcggaggaggacaacgattcgttctgcaatcggactctatttttcccaaaataaaagcagcagaggaccacgggattgcatcacaaagcaatcggaacaaatcacctagcagagggcgagattcgtacccaattttcgcagaggtggaggtgctttgggcagcgaggtcccaggtgcggcaggaggcccattacaaggttttcgggctaatgccacaaaattttgggcaacgacgtgattttcgttgcaatacataggggttattgctaccgaagtctaatttagttgcgatgggggggcatattaccactaattatgtagtgttgcgattctaatttttttgttgcaataactaggaagtatcgcaacgaataaatctgcgttgtaattagggtgatgatattgccacgctttatgttattgttgcaatagttatccatgtcgcaacgaatttagagcgttgttataaggttcatgtatatagcaacgcaaaactactttgttgcaaatgagtctataggtattgcaacgcaaacctaaattgttgcgaattagtctataggtattgcaatgcaaacatgaatcgttgcaatcattctttgatattgcaacaaacaccgaaaatcgttgcaactaacaaggttctctcgcaacaatatttcgtcattgctatagtttaacgaatcgttgcaataggtgagattggtggtgccacttgcagattgttcatgggcccttgtattgttaaactttaagttgtcttgcatcattattgtggcccgggccaggggtcatgaattacgtaattaagtcggccggccaactagctgggctgaatcgttgaaaaaaacaggtatgattaaccctacccttagcaatcgatagatagataaccctgatcagactagctagcgccggtgaccctagtatatcttgcacaatcgccggcgacaccgaagcactcgacgctggcgagaccacaccctgtccctgtctcccaactcgatatctcgacgccgtccgaatcgatcaatatatttatatatattcaggtacctcttcgatcacgagtgcaatgaaaactgttgattctttttttctatatatctatgtaattaaaatttggtttatttcattgcatactatcccttaggcaaatttggtaacggattttctcacttggaatatggcatgtgatgatgatcatagttggatgctattgtctcagtcagatgatgcgtggcaagttggattcgagaaattcattgaacatacatttgaaggtacctatccaggagagactgcggcctgtccatgtactaggtgttgttgcatggcgtacggaacgaaaattgaggttcaacaacacttgcttggtagagggtttgataaggatttcataaaacagaaacgttctgttagtaaacctatggttgtggatgatcgggagattagtgaagccgaagttgatgatgtcggctctgtcgataatttgctttcttcgctaattagtggtgctatacacggggatatcagagataataatattaaggtgccaaatgagtcagcaattttttcagtttatggaagaagctcggaaagaattatacccagggtgcaaggaggctacaaaggtatctttcattgttaggctatttcagattaagtgcatgtacggtatcagcaacaatgccatggagcaaatacttcacttattctgtcttttgctccatgagggatattgtgtcccaaatactttggataaagttcgtaaggtagtccgagatcttgggttggactaccaaaagattcatgcttgtgtcaatgattgtgtgttatttcgtggagagtatgataagatgaacacatgtccaacatgtggggagagtaggtggaaaaatatagattctggaaaactcggggaaggaagtggtattggaggaccaaagaaaaaggtccttcgtcctcgtaaaatacttcggtattttccacttattcctcgacttcagagattatatatgaatgagaccacatcgacatatatgcgttggcacaaggaagaattggttgatgatgggaaagtgcggcacccagcaaactcattagcatggaagcacgtaaatgaaaagttcagggatcggtttgcatctgatccacgcaatgttaggcttggacttgcatcagacggattcaatccatttgggatgttgaatgtgacttacactacatggccggtgatcctaattccttataatctgcctccttggttgtgcttgaaacaatcttattggatgatatcgattctgatacctgggcctagatctccagggatgaacattgacgtatatttgcagccgctgatcgatgagcttaaacagctatgcactgaaggagttgaaacatgggatgccaaggtgaaaaagaattttacgctacgtgcaattctgctctggacaataaataattttcctgcgtatgccatgttatcaggttggagcacaaaaggcaagtttgtgtgtccttattgtcacaaggatactgaatacttgtggttaaaatacggcaagaagcactgctatatgggcc

SEQ ID NO: 77770 - DNA, 32541 bp, Oryza sativa
  unsure (1)..(32541): unsure at all n locations
gaatggaatcctgctcagtatattttttccagcaattgcactgctgagcaacactaggtaaagctgtaagctccaagatatgcatgccatttggtttgtaagatctgtatcaattagccatgttaaaactttttctgtacattcttgccttgctgtgtactatctctaggattggcatgtcctgctgttgtaagatggatcaactgtatcagcatccgaatttagttgtagtagctcttagatttagcaatgttgaacagtactactgggttgttgatcctccacatttttttcggtgcgttcctttgtcatttttgttagttaatgtggagtgagcccctacaataatctgatgagatgtgggattactggtttctttggtttcttggtgagtttcagctaccgagttggtagttatcacccttgtgaaaagacttttagtcttcatgtctttgtttgcatgaaaattaccacgctaatatcagcattacaatagctagggatctcgaaaggaagcaatctgttatgcatgcacagcagatcaagaatcaatttaagagtgagaactaagatctaagctcttcaatgctgacaagtgacaattgcaaaatccgcatcaagtaacaaatccaacagtttcagtttcatacccctgaactgtattatacggattacggagtgttgatattactgaagaaaatgttgccaaaaatagcacattattagtgtaggataatttgatgtcacctcttaaactgaaactacatgccagtacgcagtacgcagacattagctcaatcatcgcaatacgtatcagtattagagaattggttaaattcattgcaatatatgctgcagcctaggagaaacaaaaacttgtgaaaattttgaggaagagataaaacagacaatagaagaaatatacactacaaatattataatggcattgtcaatgaagttggagtattagttgccaagagaaaaaaacacacacataatcagccatggagtaccattttcctatcggtcggcagatgagacactgcctgcaaaatcaggaaaatagtactctccgttccatattcaggcatggaagaaatcaccgtgttgaaaaacactttccttaatttcactggcttgagatcaatcgtgtggatatcgactcttttattttcgttaaaatgaaaactacctcagaagcatgccgatttggatgacacgacctgaagagcctcatctgttaccctagtaagtcaaagccaaaaccaaaatttaaattttcaaacttaattttgaagttaattttaaaatacttttaacgcagcttgtttttcagcattggctttaaatcgctaagaacacacaaaatttttatctataaattaatttttattccctaataagggaaaacaaatatgagcaaccaataaggaccaaagaaatggatgacacgacatgatgtttggcaaggctccctaagaactcgagatttggcaaccaaatcacaagcacaaaactggcacaagctcgagtgctggacgtgcatttgccaaaaagaaaaaggaagaacatatgtaggtccaactggatgtctgcagataaattattccatcggtttactgctacagacgccgcgagaaatacaaagcttgaacacactgttttcaattcacaagcaccgcattacacgactataattggagaaaaaaaaaggtggtacatgtctcacgctattgcaggtgttatgctggaacaggaatacaagcttctctcttgtttcataagttaacaaatccatcacactgcatgatggctggcggcacaggggaacggaaaaaaaaaagaaaaactagtaagggcgatatcgccggccatgactcccttcaccacctcggctgccaccatccctccggtcaccgcgtcgcattggtggtggagggggaattccaccaggctgttgcctatggacattggaaacaaatcgtgaggaatggagatggtatgctaaaaaattgtctagggcagcagaaaaattgtcttacagaacatatccaagacgcccgtcagggagcaccattgggaccatcctcattccagctggtgctggtcctctaccatagatcataggctgccaaaaaaaaggagaaaagtccataaagacagactacaatgtcaatatggtagcctacaaatgtttagtttggtttacctggttgaatccaggaccaccaccaccataagcaccatatggatctcccatgtagccaccataaggaggaagtggaaaatttggagctcctgctggcttgaacgagtgatcaggtttcttgtcacccaaaggtttggccatggatacttccagcacttgccctgtgtttcagtcagagcaagattaactctagttctgatgaacaaaatttagaagtagccattcacatagtccttggcaatgccagtggttccttgatatccaaaactaacaagttactaatatacagtgtaacagtgctgactgcaaaggtcctgtaaaatcatcagagcaaatgatctaaacatatctgctttccacaggaagcaactacctaaacaaagaataccaagttccataaataatgataaatgataaacaaggagaaaacattaccattaaattcatatttttcgcttcctttaactgccttcagtgcacttgatctttcagcaaagtgaacaaaaccaaaatctctcttatgcccatccttagcaggtggcaaaacgacttttgtgacctctccatgcttttcaaaaatctccttaatcttctctttagaagcattttctggtaagttcttcacatatatagtcttcacctgtaaaggaaatgtcattcagacaaaaatttcctaggactcaacaaaaaaggtgatatgacatatcaaagctaataatctctgtgaatataaaaaattgacaagctaaaagtgcatcacataaggagaaaccatcgaccacataaacaaccttgcacaggcattgaacgagtagaccaacttcaagtcaacctaactactatgtcagattgttttaatgtacagacaacaagcaattactggttatacatcccctactgtaccatgtagaaataaaagtaagaatgcgactgggacctagaaatacatcagcaaaaagatggttattctggttcagccatggtaaccagtaattatggttcacaaaatcttttaatgtcacagattaatgtttccttattcatttgccagttccttctctagcaaacattatatggcataaaggaagcaaattcagtgcctcttttccaagtaaattaccctaatagattcgcaatattgacagtttttttcctaaggggttctacttcagtgttcatagctgtactccgtacattgaagcataaattatgctgagtttttcatttacagtgtgccaactgagtggcccgtgcactgcaatgggatcaaaacatttcaaagctaatactaaaatttaaggtagtactgcatgtttcatgtgtaagaaaatgtcatcaatatagtacctgcaagaaaaaaaaaacacaagaagcatagatgcatggacagacaaggttgcatatgaactcttggtgtatgaatgaaatttagggttcaggtatatatgtctttaagaaaagtgattgaatcatttttcttggaaactacagcgttaagttctagacaaaacaattggcaagccaaagaccactgctaaagaagcaatgcactgattattataatttcacacttctgactgctggtgctcaccacaccaaacatgaagagtccaacttcaagaaaaagtaggcctctttccattcagaccacctccccatttgctaaagaaagacccgacaacttcaacacaacaaattaagaagatactgaatgatctaaaatctgttagtcttgactcttggagtattttctcaagcaccttgtatgcatacataactgaatgctattatccaaggcaattccttgtttgaatcccctggcagcaacacaggaaccaaaagaggaaaaaaagtcagcaaatgtcaccatttcaatggacggctggacacgagtcnnnnnnnnnnnnnnnnnnnntgctttctcccacttgccgtgcagccgttcccctgcagcttccttgagctgccatgcacatggcccatgtcacattgccgccttttgttgtgctcgcgctagtgggctagcgtgtaggagggtggtagcggatgtaaaagagggtgagatggtagatctgtgggtaggtgatgccagttagcaacttgaggtcaagcggccaaggggaagatagcagtggggcgtggtgcatgcaacagttgggggcatggggaacatatggtcagtatcggcacggcttgggaggcgccaagcacgcaagcattccatccatagagcatcgatatcggtagggtgtcgacctgtactgaaggcgcaatgcgtgaggcaggataaatgtgtgcgagaggaagataatggattaatggcatacgtcaggtgtgggatatgatcacgagtggagatggggaaacagtttctgcgggacgtgggggcagatggtttggagatgatgtgctggtgcttgattttgttcatgatgacagaataaggccacagcacgacattgcacgccgtgcacaatgggaaggacatgtgatggttggggcggaagggcagagcaaactctgctttttatagtagtagagataagggtactaatggatggtagattcaccaataggttttcttttcatatagtaaagatacctgggcagctgcagaagaagaatctgatgaacccttaggttcagcccagctgacggtcaattggctaccatcaaccttaaagtttggtgctgacaatttctgcctggcatagtctgcacaagcgtggttataatactcaacaaagaggaacccacggttacggcttgggtcatgtaaatcctgcaggaccaagagaacatctctattagcaaacttgggacctttgtcgtacaaaatacaactgtgaaatcaaaagacacaccttgaacatctcaatgttgacaacacctggccccttcccttggattatctttctcagctcctcctcacccaaccccttgggtacattaccaacgaatagcctgtgctttgcctgcgacagtgagcaccgcagtgtcctcccctgcaccaaagaccaaaccatccaatgtaagcacatcatacgtgatagaacaaagcctcctctatggcgaccaacagagctacaaggtaataccttgtgttctttgtcatgcagttcctcgatagcacgctgagccgcttccttcgcggtgaagttgacgaatgcgaatcctttgttctccttggtctctttatccttcatcaacctcacctgtcatcgatccatccatggcgtcatatcaaagttgcattgtgttacaggccgggcaaacaatactgaaaaagaagatgctgatagcattcagatacctcatagatttcgccgaacgagtcgcagagctcacggaggtcctcctcggtggtgtcgcgggggagaccgccgatgaacacctcggagccctgaggcggcagagcgagcagctcatcccacttccgcttctcgtcatcgtcctcaggcccatcgccgccgccgccggcggccttgtccatctcatgcgctcctccttcgcccgccgcggtccccgcgtctccgtggccatcgccctcgacctcgggatcctcctcgtcgtcgtccggctcgtcggagtcctcgcggcggcggcggcggcggtacccgtcctcgtcgtcgtccatgacgtcgttgtcgtcgtccccctccaggtccacctgctcctccggctcctccgactgctgccggtcggacatccccaaaaccctaaccctagaaacgaaccagccaccaccacatcaccaaaaaaaaatcagaaatcccatcccaaaagaatcccgcaaaacccaaaaaaaactccagatctagaggagaagcttaggttaaggaaaaaagatagagaagaaagaggaggaagagctagagggaggaggtgcgctcaccggcggcgaggatgcggcggaagaagcagctggacggcggcggcgctgagcacgcgaggaggtgacgcacgagagagagagagagagagagagagagagaggccttctgctgatcacggcccaaatagcccaatcggctatcagtcaaaactttcacatgttctctaaaatatttttattagctacttcttcacttgttcccttatttatatctcatcaaatcatagccatctcctatttaattacactcttcatcgttattctccatgaaattataaagtgaaaggtaaccaaacaattccaaagtctaaagataaaacaattccaaagtctattgataaatttttgtacaggacatcgtgactttgtggttttagctttaggataccgcatgaaatcactttggtaaacacactccgtacatatggttatttgtcacgaacactccatccattaaaataatatttttgtgctaactagacacttttttacatggtttagaccaaattgcctctcctttctctttcgattcctctcttcctccttatccctttctttctctccctccttcatctcttctccgcggtgcgtgcgccctgctcggcggtcgcgcccggagtgcgtgtggtctgctcaacgatggcagtggcgctcggagcgtggatggcgacagcggcggcacccggtgcgcgtgcagcctgctcgacgatggcggcggcgctggaccttcccggcatggccaagaatgcggcgattgtggtcgccgtctagaatctccccggcgtagcgaggagcacagtggattacaccgtagaagcctcacagtagtggctggtagtggtggcctcctgcagggccggtggtgaaggcgtggctctcctccatgctgcttggcgaggagcttgagctgctctgggccaagctggtcgtggccaagaaggaggcggcggggaagaagcgggtggcggtggaggagctccgccggcgcgttgactatgggcgtgacgagttgcagcggctgcggtcagatgtcgccgcaccgaggaaggagaagcacgcgttggagcagcggtgtgctggcgtggtccgcggctgctgctgccgccgagcaagccgcgtgcgctccgggcgccgccgccgctgccaagcttgtctcccgctgtgaccagccgtctgccgcaacgcctcagcagccgacaccgctgtgctcttggccgcttccaggaacatttcgacaaccacagggctcaccggccagcaacacgtcgacaacctcaccggagaagagagaaaggagggagagagagaaaggaggagcaatttggtcatgtaaaaaagtgagcctcctcttatgcccgatccaggtggctctctcaacggtggcgtggttatcctggttggcaatggcagtgaggcggcggtccacggtggtggcactgttatgcttgatgtccgcgtggcagtcccagatggcgacgtggcggtccatggtggcggcgctatgcccggtgtcggcgcaacagtcgcagggagcagcggcgtggaggtcacgggaggtggcatggggtccgaaggcggcggcacggggtccgcaagtgacggcatgatggtcacaggaggcgaggaggccgcaagcggcgaatcgacgatcactgggggcggcgaggaggccacagttgccggtccctgaccgtcttcattgccgtctctcaggtgctgccgacaatcacccgagaagacccgatgacatgacctgggtgtgatggcacccagatcgtcacaccctcgcatcaccccagccccgccccatcgcgccctcccgacgcccattttgggaatctgcctatcctcctaggataggaggaagggcactgtggagaggagaaaggggagatggcggtgccggcatgctgctgcagatgaggggccagaaacaggtcaatagctctgttctattgctagctactccgtaccttgtttctttttttcttttacttactatatgacaaattgattaatctccctgttgggtttttattaattctgatggagggaagtacgttttgttttgattgataacttttgtgccatgtgatttgaaggattactttgctaaatttagggcctcatcctttggctttttccgtaataagccaaaacggcttattagagaataaaaatgaatttgtaggtaaaacgtttatatatgtgttctggtgacttaaaagccaatgctgaaaaagaaactacgttgaaaatatctcaaaatcaatgtcaaaaaaaaagtttgaaaattcaaattttagctttttctttggctgaataggccatccgataggagccgagcaattgcataaaattcaaaacggaggcttgcagtactatcactaattagagaacagaaacagatactacaatatagagtgagagttggtgtacccttgcaaaagtccgatgataatatggcattatgctcaatgaatcctttattcagggataagtaatttgggttggataatcaattctaagaagtgtgtctatgtactgaataccattttaacgagggagctgtgagggtttttagaattcaattctaatgaaatcaaagaaaatctcttgaagatatttctcaggttattgttgccttttgtgtccttcagagatggatattttgtactcattgtgtccttcagagatggaaatttgagtcaacacaaaataatgttgtctaagcaaatggttgtctaaaggtaagatcgtcttttcatacaacttaacggagagttgttaataacaagttgacggtgatggtatttttaggaagttacttttgtcgatgacatttataggattagggtgcttatccatgaatatatatatgttaaaaatattgtgcaaaataatgtgaagggagatgattggatgttgattcgtgaacggtattgctaaaaaaatgtcgcaagttttttgggcaaaagactttcaaatgtggctatagtatagttgtaatggaactacaatgcaattacggctatagtatagttgtaatggaactacaatgcaattacatcgtagttacaatagtgtagcactgtagctacattgtaatctctatataagttagatataaagttgtatatattattttaactagcatggtggcccccgcagattgcgcggctagcatcattatattttctctcgtatatgttttcttattatattattaaaatatattacaatgacaacataattttaaattttgcaataactttatgaaactactaatgtgtaataactactctagtctcctcttctaatattccttatcttttaattccgaatttcagctatttctaaattgtatttttatatggactctgctttttctttttctccgattaatgtgagaatttctaggtcataagagcgaacgtggagactccttttttttctaaattttagttagtgttaaattcctatatggactctatactctacttctaatattacttattttttaattccgaatttctatcttttttcttaattgtatttctatatggactctatactctacttctaatattccttatttttaattccgaatttctattatttcctaattgtatttctatactctacttctaatattccttattttttaattctgaatttcaaatatttctaaattgtatttctatatggactctagtcacctcttctaatattccttattttttaattctaaattttagctatttctaacttgtatttctatatggactatgttttttctttttctccgattaatgtgagaatttctaggtcatgagagcgaacgtggagactcctttttttctaaattttagttagtgttaaattcctatatggactctatactctacttctaatattacttattttttaattccgaatttctatcttttttcttaattgtatttctatatggaccctatactctacttataatattccttatttttaattccaagtttcagttattttctaattgtatttttatatggactctatactctacttctaatattccttatttttaattctgaatttcagttatttcctaattatatttctatatgaactctagtctcctcttctaatattccttattttttaattccgaatttcagctattcctaaattgtatttctatatggactctagtctcctcttctaatatttcttatttttaattccgaatttcagctatttttaaattgtatttctatatgaactatgctttttctttttctccgattaatgtgagaatttctagaccatgaaaatgaacgtggaggctcctctaatattccttattttttaattccgaatttcagctatttctaaattgtatttctatatgaactctgctttttctttttctccgattaatgtgagaatttctaggtcatgagcgcaaacgtggaggctcctttttgttacgaattttagttagttttaaattcctatatggactctatactctacttctaatattccttatttttaattctgaatttctattatttcctaattgtatttctacatggactctataatctacttctaatattccttattttttattccgaatttctattatttcctaattatatttctacatggattctatactctacttctaatattccttatttttaattccgaatttcagttatttcctaattgtatttctatatggactctatactctacttcttatattccttatttttaatttcgaatttcatttatttcctaattgtatttctatatggactctagtctcctcttctaatattccttattttttatttccaaatttcacctatttctaaattgtatttctatatggactctagtctcctcttctaatattccttattttttaattctgaatttcagctatttctaaattgtatttctatatggactctgccttttctttttctccgattaatgtgagaatttctaggccatgagaacaaacgtggaggctctttttttattcctttaacaatataatatatatacaagttatattatagttatagtggaattatattacaattatactatagttagatttgaaagtttttccaaaaaaaacttgcgacagtttttcagatagtcccgaattccatgaattggtaggtgatgttgcatacttgcatgagtttgttatctttgcatgttgagccttaggatttagtgaattttaactttatagtaagataggatgcgcctaatctaacctacatgtgtgtatgtgaaatgtaatcgtaaatcaatttttatgctgatcatctatttatcttattttgactcgtatgtaatttccgacataaccagtttcacaaataattaagtactcgttaggtaatataactggcaggaaagtaaagcatgaggcaacaagaataacattattcattgtttcataagcattgttttgctgtatcaccaacgccacatacagagttttgagagaattttataaacaatattacaaatgtagcaaaccaaaaataaaacatcagcttctgacttcaatactgtagcataccaaaatgacaggaatgtgaaccgttcaattcagaccatgttaaggaaatctgacttataagttttaccaagccgaaatctgagcttcaagacaggccattcacctatcagcttggtaagaacgggcaacagtgctgggacaaggcaaatcacaatggccaaccaccgaagacgagcgactaaaaccgtgtacaaactgtcgacgggggatactcgtagaccggatatagagggtattggggtacgctggtattaggatctacgtaatactacatcaagcaaatggaaaacaaagattatactggtttaggccccttgataggtagtagccctaatccagttgatatgagattatatgacggaaatcacagattacaaagggaatagtggaactcgatgataccgacgagatcgtagtcgaattggttcaactagatcactcggcgacttggctcctgtaggctctgactttgtaagctatggtggatgtgttggcggtgagattcgagatgccttaggtcctctcgggggtcccttttataccgctagtcagttggtctccaagtaggggagacatcggaccctacacgatatagtgacgacccagttctgtacaagtaggactccttccatctgtggactccgtgatgaatttccttaacgtatacagaaaacgtccgtatacgtgcagatataccatatctatacacgacgtatatccgagggtagagggtataccttacccgtaaccctgacagtagcccccgacttctgcttaaatgaactcatgtaactgatcgcgacttccgatgtcgaggttgttgtcgttttcgcctgatcgatcttggtatgagaaccgtggagacaaagagtaatcgacaacaccatgcgaagttcaacggtcatgagtgaatttaaattgaagtccgaaaaactgccgcgcgtaacggacccagaaatttccagcggtcatctctcctttccttggaattcgcaccatcggtagtgcgtctatttaaggaagttttggggatccattttgaagtccgcttgttgcgaaaaactctccagcctccaagcgttcctcttcttctccgctcccgcaaaaaccctagcttgctcatctcggtcctttctccggcgacctccggcggtaatggatctcgacaagtctacttctaccagtgcgtcgttgaagaagctgcaggaagacggcgcccttctcggtcacgggaccatagagagaagcaggaggtattgaacccagcatgtcctgggccgcatggtcgcggtcgaggactatattctctgtggttttcttcctccgccttctgagtttcttcttttggtcttgaatttctacggtctttctttgctccatttgaaccccaattccatcgccttcatcagtatcttttcgcatctttgtgaggcctacattggggtagagccgtttcttgacctctttcgtttctactacgaattgcgttggatggaatccaacagggtatctggatgcgttggtttctgacttcgggatggcctgaagtcgcgctatatccccttccagtgcccctcttctcatagtaaatggcgggcgaggtggttctatcttcagatagaaaacttggatccggtcttcgttgttcctgaggaacagccagacaagatttcgtcttggaccgccaaatccgccttaaccccttcccttcagtccttcatcgatatcatcaatgacctccgaatacgagggttgtcagggtatgaagtcactgccgacttcattggtaggcggatccagctgctccaggctcgagcccacccagcctttgactattctgggccggaggacgcgacccaggtttctcctcggggtatttttcttgtattttggattctattcctgacttatcgaattctggttctcgatctacaggtttgaaccgcgaaaccgtggagcgccgtgtcagccaagtgatgatcagcggcccgacaacgacgagcaacgtccctgtccccctttgcgagaaggggacagccgagcgtgaagccgcaatcaacgtgagtgtagtcgacgacccctttatatttttcttcccgaatcgcatagtgacttcatatggtgcaggctctccctctgactgacgtcatcgggccactcgtggaccaccaggcgacgacttcgttgaaagagggcgtcgcccaggaggcgtccaacgttgctgctgctgctacgaccagtggcggcaatgttccgaagagggggagtaagttttcctccgtgctcggtaaccgtcgtaaggcacccaccccatcggtaagcccctttggtcattcatcgcgtagtcgaaagatattgtcctcacatcgtactcattttacttaggcctcggatgcgtctcctccacttccgtgacggcagaggctggtgacacttggcgagaagtaagtagacgaacttgaggtcttgttaatccatcgaactttggtagcctgtcttgatggcaaactgcggcaatcattcatagggctgtgcgggcgaaggcggcgcaggacgggtctggaggaaactccagcacgtcccttgcagcgacttcgacagatgtcgtggtcgcaccgaggggccgtgaggcgacgcccagtggtcctgccggtggccttgtgcctgctaggggcccgcacgccgacgtcctcacctagggggagctctagatcgagatggagcgtatcctccaggccggtgctcgtggcatagggcacaagatcgaagaggcgaaggcggcggcggcgtcgtcggctaatgaacgcaccgacaagttggcgcatgacctggcggaggtccgcgaggacctccagaagatgaaggagctggtggctggcaacgagcggcagcggcaggggctcgagcaccgcatgttggagctcgagaacaatttgtcagagatccgtggctcgctacgggttacctacaccagcttgcatcagctagccggggagtgcggcgtcacgaccaccatcccggcgaatcccgatgagttctcgctgacgacttcactcgcggaaatggccacggtgatggaggagatcccctccaagcatgcggccaggatcagagaggaaacgtccaacgggatctacactggggcatgccacgtccttgcgtgcgtaaggttggcgcaccctgaactcgacctccagaggatcttggatcaggggacggctaacgatgcgcgtaagggcgtgatggaagaagtcggtgatttgggggagtctgttctccccctttttgaagagtaggacttcagtttccctgtactccttaattagttatgctttgtaaaacttttgttggctccaactgcctttgtgtgtgcagtcatcaccttagttttctttagcattttgatcccgagtactttgttgtttgtagagatgtcgatgttgaggatgtccagcagcgcgggcagcctgagttgccagtgatcgttccagcacttgcgttcgagccgtatgtgccgtaggacgacgtagatcagaacttgtccgtggaaacgggcatggcgacgacttccttaggttggtcctttttgttttcatctcctttgatcttccgtctggattgacttaatttgctgtgttctcgagagagaaaggcagcttgacttagtcgtttccatgctgagcagacctcgagagtgcgcttgccgaccgagatcgtcgcatctaatactggaggacgaagtttgaggtggcagaactcgagaggactatgttggaagtgaaaaaggactgggcactttggttgtaatctgtacctgaaaataggctttattgaagctgtaagatgtcttacaggtatggatactattgatttatacatagaatttacgtaattgatcaatgttccaagaatttgctaactcgcgaccatcgccgtctgcaatcttgaatgcgcctggccgcaagacttgcgtggtcgtgtacggtccttcccatttgggtgagagcttgtttcgccctgcttggctttgaacccatcggaggacgtagtcgccgatcgaaagcgtgcgcgctcagatgcgcttctcgtggtaacggcgaagggcttgttggtagctggctgctctgacggtaactcgttctcgatgttcctcaagtagattcacatcgtcgtttcgcttctccttctgatcctcatcgaagtacttctgtactcgtgtactatgatgttgtagcttggtggggagcatggcctctgagccatacacgaggaagaagggtgtctcctggttagacgttgtcggtgtggtacgcacgacccatagcactaatgggagttcttcgacccacttcttgtcatgtgacatgagcctgtcgtagacacgggtcttgattccttgtagtactatgccgtttgctctctcgacctgtccattgctctgagggtgagaaaccgaagcgaagcagatcttgactcccagcctgatgcagtaatcctggaagtcggcactgatgaactaggagtcgttgtccgttatgatgcggtgaggcaatccatatctgcagaacatgtcggccttgatttcccccgtgggtgtcgcttcaattcacttagtgaatttgtcgatcgccacgaataggaacctgtagccgccctgtcctcgtgggaatggtccgagtatgtcgagcccccagcacaagaacggccaagtaagagggatagtttggagcgcttgcgctggtagctttgtgtgtttactgtgaaattgataggcttcacaccgctgaaccatgtcacaagcgtctttgagggcggttggccagaaaaacccttgtcgaaaagcttttccaaccaatgtacgaccggcggcgtgtgacccgcagatcccttcatgtatgtcgaggaggagatgtccgccgtcgtcgaacgagacgcatttgagaagtatcctatttggcgccttcttgtatagatcgttgccgatcatacagtagatttttgcttgacatgttattttctcggcttctgcatcatcctcgggcaactcttcgctgcttatgaatttaatgagtggggtccgccagtcatctgtggtctcgatatcggcaacggcatgctctgcctctgtagcccccgagctgatgtcgggggcgactgggctatcttcgccgtttgcatctttcactaatggctttgtcaggacgtccagaaaggtgccgggttcgagtggctctcgtctggacgcacaccgtgctagatcgtccggctcgatgttgaccttgcggtatacgtgtcggacctcgatcccatcgaatcttttttctagcttcctgacttctgcgagatacttggataactcgggattagagcacttgtagtctttgtgcacctggtttgcgactagttcggaatctccttttacgatcagtcgcttgactccaagtgcggctgctgctcttatcccagcgagtagtccttcgtattcggcaatgttgttggttgccctgaagttgaggtggatcgcatggttgaactgatctctcgaaggtgatgtcaagatgaatcctgcccctgctccctggctgttgagtgcgctgtcgaacgccattgtccatgtttcgttattggtttgactgtttgacctattttcaggtatagtccaatcggctacgatgtcggcgaggacctgggacttgatggctgttcgtggcacaaagtggacgtcaaactggcttagctcaactacccatttcgcaatgcggccgacaacatctttgtttctcacgacttcaccgagagggaaggaggaaacaactgtgaccctgtgggcctagaagtagtggcgtagctttcttgacgtcatgattactgcatagagcagtttttggatctgtgggtatcttgtctttgtgtcgtggagagcttcgctgatgtagtagactggtctttgcaccttctctctctcgacaacaatgacagtgttaacggagtatggcgtggcggcgatatagagaaataattcttcattaggttggggagcaacaagtatagggggatttgacaggtagcgcttgagtgcgatgaatgcctcttcggcttcctgtgtccgtacaaatttgccttgtttcttgagcagagcgaagaagggttgtcctcattctcccatcctagcgacgaacctgcatagtgccgccatgcacctagttagcttctgtacttccttgagtcttgtgggcgacttcatgttctcgattgcctggatcttctcggggtttgcttctattcctctgccagagacgagaaatccgagcagcttgcccgatggtactccgaacgtgcacttctctggattgagcatgaggcgatatcgtcggaggttgtcgaacgtttcccgcagatcgtcaatcaatgagtcgcttgtcttggtcttgacaacaatgtcatcgacgtaggcctcgacattgttcccaagctgattgctaagtgccccctggaccgtgcgctggaaagtgtttcctgcggttatcagtccaaacggcatcttaacgtagtagaataccccgaacggcgtgatgaatgctgtcttctcctcgtcctctttcgccatgctgatttggtggtagccggagtaagcgtcgagaaagctcaacaactcacaaccggctgttgagtccaccagttggtctattcgaggaagtgggaagtgatccttgggacacgccttgttgaggtcagtaaaatctacacacattctccatttcccgttggccttccgcaccatgactggattggctagccactctggatggagtacctctctgatgaaaccagctttgagaagcttgtcgagttcttctcgtatggcttgttttcgatctggtgcaaatctccgcagtttttgctttactggcttggcgtcgggttgcaccatgagtttgtgctcaatcacctccctggggacccccggcatgtcggacagctgccaagcgaacatgtcagcattgtcgcggatgaaggtgatgagtgcgagttcctatttctcgcctagtgatgccccgatcttgacggtcttgtcggggttggcactggagagtggaacgatcttgattgcgccgtctggtttcggcgtcttgtttgttttgctcactttcttgggtggctcagctgtggcgggtgggctgggcgtgtgctcgaccatgtcgaggctccgcttgtcgcattgcactgccagcttagcgttcccttgaatagtgattgttccctttagtccgggcatcttgagcacttgatacgcgtagtgagatgcggccatgaacttcgcaagtgcagttcttccaatgatggcattgtatgctgtatcaaattcagcgacatcaaaggtgatctgctccgtacggaagttatttgcttggccaaaagtcacaggcaacgtaatcttgcctaatggtttggacgatgactgaggagtgattccatggaagggttgatcggtgggtgtcaactcgcttcgtgggatccccatcgcgtccaaggtgctggcgaagagaaggttgattgagctgccgccgttgatgagaactcgcgcgaccttgatatttcgaatagtgggttcgaccacgatcggatatcgtcctgggatgacagcagtcttggggtggtcttcttctgagaatttgatcttctgttcggaccacttcattttgggcgcggccccctgccacgtcgaacagacttcacgttccactttcttgtactctcgctttgaggagtatgccgtggaacctccgaagatgtgcgagacatggagatcagagtctaggtatgctgagtccgattcctgagtagctacctcagcgtccttctcgactacatgtacttgcttgcctttttccaatgccatgtgctttgcgagcgactttttgaagacgaggcaatcctccagagtgtgtctgttcgacttgtgtatagggcaccatattttcttcatgtcgctgctttgtgggactgggcgcttgggagggtccgcgtattttgtcgcgagaacttccgcttgagctttccttttcccactcttgcaatttttcttcttgcttgattcaggtgcgtccttggctggttccttctctcccccggtcttcggcttgtctttcttgcgtctcagtgcgtcatccgcgtgagcgcatcgatcgaaaatcttgaatagtcttcgagtagtcgtgatgcgcctcgttgccaactcctaggtagtatagcgatctctgacaccggacttgaaagcgcggattacagaagcatcggtgatttgggggattgtgtttctgcactcattaaagcgccgaacatagtccctcaaggatttacccggggtctgtgtcaatgcgtgtaggtcgtcttcgatcgcgtggcacttgtaagttccttggaagttagcgacgaactgctgccacagatttgcccacgaagaaatcgagtagggcgggagatgcatcagccaagaacgcacagagcctttcaatgtagttggcaaataattcgccaacgcgttgtcatctgctccggcagcgtagagtaccgtggagtagacctgaaggaattcttctgggtcggtactcccatcgtacttctctatcgctcctggtcggaatctctcaggccatcggacatcgggcaacgaacgattgaaagctctacacccggcgatgggggcggtgggttttcggcgatcgtacgtccttcgtggatgtctatctgacgatgaggatgaagaggatgatgacgatgacgacgggtcacttggttccggtgtacgattacgaggacgccgtccaggttctcgaggatcctgtcgtcgccccccgttgttgtctcggcgccgatctccatcgtcttcatcgttttggcggcgtcctcgaccagtatcgcctggcatccgccgttcgcgatcatcgtgatcacggcgtgtggcggttatcacggtctcggtcttcgctcgagcggcctcctcgttctttgttttcgcgatgtcgtgaagagacgcgatgtcgggaacggttcccgttgtctcgtgtgcgtcgtgcttcttggcggccattcagatgatcacggagatcgtcggtccgtgaggtggaggggtggcttgacgaggcgacccccgctgctcagggagttcgccattagcaccgccagctggcggctgttccgggtgcgctgcagcagcggcctcctcgaacgtattgctgaggttggtcactgattcccgtagccgttctgtccactgtgcgagatcatcattcagaacgggatcgtaaggggtttccctcagtattgcgttgataaccccgatgtgctgggctggtgtaaccacttgattttccgctttcacattagcgcgtgctgacgtgctggtcccatcgatagcaaatacatcgcgcggtgtactcgttgatgatgagccatagtctttgagaaagtgtaggactgatggctcgtggggatcgatgtcgattaccccaacgaatcgatccgagatcagcgtcgctccttgttccttgtctgtatccctaagagagattcgcgactgctggaccttaggaggcggtgtcttcatggcgctgagaaagaccttgcagcttgagaggtcgtgattctttgtcttgtgaataggacaatagacctcatgagttggagaagtacgctgaattccacgctccttgcaggcacgaatttcagcttgcacgttgagaaaaacccagcaggcttgcaaggtatgtttcctggttttgtggataggacaccaggaccttgtcatctcggaagttgtccttgtctgctcgtgattcttgtcggaaggacaaggtttggccgcactaagatccttctcgggctcggatgtcatcgacgttccgttctccgcttcgacgggtggattcttcgacatggagtcgtccagggttgtagccacggcgttctcgcttctggtcattcatggaccagtcgagatcgacaccgtggtgtaaacgggaagacaagttcgccgacttgagtccacaccagcattgttgaagcaggaactccttggttgaggccggtgttgacgctgttgtcgacgaagcctgatgatatagtagtagaaccttgagcaccaagagcccctacctggcgcgccactgtcgacgggggatacccgtagaccggatatagagggtattggggtacgctggtacgaggatctacgtaatacgatatcaagcaaacggaaaacagagattatactggttcaggccccttgataggtaatagccctaatccagttgatatgggattatatgacggaaatcccagattacaaagggaatagtggaactcgatgataccgacgagatcgtagtcgaattggttcaactggatcactcggcgacttggctcctataggctccgacttcgtaagctgtggtggatgtgttggcggtgagattcgatgcttaggtcctctcgggggtcccttttatacgctggtcagttggtctccaagtaggactcggagatatcggaccctacacgatacagtgacgacccagttctgtacgagtaggactccttccatctgtggactccgtgatgaatttccttaacgtatacagaaaacgtccgtatacgcgcagatataccatatctatacacgacgtatatctgagggtagagggtataccttacccgtaaccctgacacaaactagttgcaaatgttctgatagttgccatgtatgaaaaccacatgagcttcttagtaataaacctgtaatgaagcaaaaactggagatcctcccacttggctatgatgcatatgaatgcaacagcaaatgaggaacatattgctaaggtgtctgagatcaagaaggcctgaaatgcaacctttttttgccataacaggaagtccctcacttccagcatcagcactcgacgcaggtcattaatgaaggcagctactccatccacgtcgtcgtcgtagcgatttggtgaatggcggtgacctcgtgttgcacggcgctggttgactgtgtcgcgaaggtcgacgggacactggtgaggtggagagcgaggccgttcaactcggcgctccctgtgacgttcgggaggcgagtgaacagatcgttcgtcgtgacccctgctcctgcgactagatcctgtgccggtgatgctgaggcttggctgatgataatcatgagatcggaagtgagggactcggctaccagtcggggtgcgggtgcttgcggagttggctggaaccgagacagcgatcatggtcttcgtttggttcaagatgttgacaacatgatcagcttggttgagtgcgtcttccttgaggagggtgttgaggagagtgattgctgcaaccgcgttctgctggggggtgcgaaagaccgctgttccatcgacgtcttgttgcccaatgagttctctcgctcggcgcccagattccaaggcgcgttgccgtcgatcttcagcctcctttgcaatccgttcgcgatcttgctgctcacgctgtagtcgttctcgctcctgtcgctgtcgctcttcctccagtcggcgacgttcagcttcttgccgtgcgcgatcttggtctgcttctcgggcttggcgctgttcctccatttcgttgtcagccatgaatacgccgaagaagaggggcgtgtagttatcctcatagctgtcgtcgaagttgtcgaggtcaccgtggtcgtagtggtagccgaaatcgtcgtagtcgaggatctcggttggtcgagaactgacgccgggggagctaaggtaaccatccaactcttccgtcgagactgtcccaagaggttggagtataacgccaacctctctggatctagattggatcggggccgaagccggagctcgcctagatcttcgagtgggagatgtcttggcagtgaagacagcggccaaattatcaggaagtttcattaggattgagggataggacccgtcgtcttgatctggtcgcggaagagtagattggatctcgcccgagtggtttgaagccgactcgggagagatgatcttggagtaggcctcggccgagttcggaataccgaagggcatggggacctggtctctccccgactggtttgaatccgagtcaaggagagagatcttgctgaagtcgttggtgatgaagttgaggctgccgaaccgaaacgcttgcccgggagggaaggcgaagtcgtcgatgccagaaacgaaacccatcgcacttagtcggcgagaacttgacgctacccctacctagcgcgccaactgtcgaaacaagatttcggcaataataaaagggagtggctatcaagctaggaaagtggatgggtttggagacaagaaatttttatacaggttcaggccttcttattcaagaagtaataccctactcctgtccggagatgattccgccgagtgtgttattgattgtatgattgggagaaaaaagaatcgtcccgagaggaacccggacccctccttatattggggaagggatctgtaatataaagtacagtccatatcctaacgggatatgggattacagataaaatacaatcgtaaccgactaggatcccaggtattttcttaacatacaagtttagaatctaacccgagtcctcatagagatattctatctatatttggtaccgtatatccagctggaatataaccgccatgtagatatggggtaaccataatctccacagcactatatcctccaggcaaggtgaaagctgctgcaaatgtaattgttgctataaggatcgctactaatgaagtgttgcttgtgtatctctcagttagtgccttgacatccttccttgatttattagttactttttccttcgcttccatatgaacattatgcataaaggatgcatcttggggatcagcttccaacataagcaaggacacttcattctgcatggaaatccaaataaagtcataaataatggaactaggatcaatatagtagcagcggcagcaacaacagtagcaacaattaaaataataaaatccccaaaataatatgaatatagtattgttacattaattatagttgtcagcaataaattataaaatttgaaaacaaaaccaattctatgatattaaggatgcatgctagtgttgaataataattgtatagggaaacaattcaaaggtccaaaaaatcttttgcacggtcatgggatagtgccaatgtaataacatgaaaatgtctaatgataaaaaccaataagattttgaacttcttaaaacttttgcatcatgcatgttagatgttctggttgtcattacttataaaccctaaggcagtaaggccctgtttggatcatgggattttcaaatgaactgtacaagattcttttagaatggttcccatgcattcctccagtttcataggaaataaaacatccaaccaaagctaaaagaacaattccttcactcattcttcctcactctctatatctatttgccgtgtgttttcctgttatcggaatcccttatgtttcactgttcgtgtgttttgaattcattattttccactttacgtactcaaccctatttcatctttgtcggtttatagtagaggcccatcgaagatgactcataagtgacaggttctagttaactcctctactgggtcaaaactatcgattatgaggtttaatattggctcgacaaacataatagttatcggtgacggcgaccagctgataaagatgacttttcacatcacagaccattagtttgtgacggagcctctcgccgatacagataagcccccccccccccccccccgcgcgacatagatgaggtgttcatatttatatttttttcctaacgggccctgaattgacaaacaggaaaaataataaacaatggtcacaaatacacaactaaattaatatcagattagcccctcaaagaaacaattttgtatctcccatcatctaaaccccaattgtcaaaattgtcataaaaagtgcactactgttcgctattttgtattttgttgggaagtctgtctgagggtgtgtaaaatgactcaaatgctgttcttctattcctgtgccttctcattctcatcctcgcaatttctctctcttccctgtggacgaactcgatatagctaggagtagctcgatatagaatactaacaatatgatgacatgggaattttgttcatgatctactagtataagctggctttcctaagtctaaaccaagtaatttagttgatgccgtcatcgacgaagtttttaaagttgaattgcacttgcacgtattcaagaagatgtacttgtgagatcagaggggaatgaaacaagcatacatacccagtttaacgtcttagcgcgacccgtgactttccatgattgccaacttggtggattactgtcacgccgaaatttagcccaaatttccagactattttgtgtattaaatccctatccaggaccagccagggtacacaaaacgacaagtaataaacagttacaaacgtaaataaagcgtaaaatacttacagaagaggcacttagtcctcacaccgaaacaaaagcagcagcagcggaaaaggcgatcccagcggggcttcagctccactccacaggcaaaactcaactggggtctgagccttggtcttttaacttcgtcttcagctcagaagcactacacttttgaaaaaggggaacaatagcaaggctgagtacaaccaccatactcagcatgccacaccaatgatgcagacgtgcaaggggagacaatgatggtttgtggctatttgcataaaggtggttgtaaagcattttattaagcaaaatagtaaaacggttgagtaattaaggtaatattaaatctccactgatcaacgctacaccacgttgaacaggcccaaccatcccacttgaaccaactagtgcattgagtcgatttattaagggtcagactaatcacggtgaatctggttgatcgcccataaccgcgggtacggctattcgaatagttttactctggccagaggtgaacaactgtacccacaagatacaatccaccggcatgtcaccttgcctgcgtagacacgtcaccatgtcgagtgattgtgacaagaccctccgcataaccctcccataaccatccacacaacggtaaggtttcacccccacccctaccccagaggtgggcagtcccctcgtgcgccgcggtgaatccggcagctggacaaccggacaccccagctgacccaactccatcacgcccaccctcgccaccggtgtctaggaaagggtcgagctatacttcagatcaagcagttacccactcccgcttgtggcaagcgctgtaagtcttccagggtttcctatgaaccggtccttaattgccatggatgcgactcgcaaaaccatgcacccacagcccatcattgagtcgcgttttagttggataattacgatcatgaaacattgctagatgtctcgagcacgcagctcatcaatatactagaatgtctaatactgcaatcatcgactgagctagtagtaattaagcatggctaagcatatagttctagctaggttaacataagtaacacaagctagtcgatttatgacccaaggttgacaaagaacagatatcaagtaaacatggcagaagcgaaaagaaagaaaaaccctgatcccatgtaattagcaaaacatacatatttatttgcaaacggtaaaacatatgtaaattgggatcaacatgctcaaggggaatgtgtgacttgcattgcttcttcaaacaatcttctgaactgaactcttatccttgcgaccgcgaacatccgaaacaatggattctacacgctagcacgcaaaacgacgaaaaactctaataaacaccaagaaaaaagtacataaaaagtaaacaaacatgtggatctcaactttagatgaatcttacaacttgaatggcccaattcggagttcgtatgaattagatatgaattttagaagttttgagccatttaaacggatttctagaattattaatgatttattgcgcaattaatatttgtttttacaaaggaaatgggacatcgctgacgtcagcagggggcggccggtgctaacacgtgggccctacgcgtcagcggcacaagggtaggggcgcacggtggacacggtccaccgcggcctcgggcgcacgtccaccacatggacggcccagatggaggcccagccgatccgacggcccagaccgaccgtggctaggatcaaggggaggcggccagccggcggtggcgcggcacggcgcgtggcggcggcgacccagccggacggccaccggtggcggcagcgcaacgcggcggccggcgaaggagggaaaaagagaggggagggaggcagttctcaccgttgggcacggcgacggagggaggcggccggcggagcgcgggatggatgggaggcggcggcgttcctcggggaggcgacgcggacggcgctccggcgacgaccagcgaaggcggagaagcggccgaggcagtcctcccgcgaggccgaaggaggcgacagagcgacaccaggtggtccggaatggcgcccaatggcagccgatggtgatagaggtggcggcggcttgagttgacagtgaaggtggagtttcggtgaggggttggggaaatggagccgcggttgggcttgccctcacggtggtggagctaacagctgcggcggtgtggtgtgaggtggccgggaacggcggcaatggtggtggtggctcgggtgcacggtggggtggcggttctagcggcgaaatggaggagcggaggggatgccggggtacggtacgacgctgcgaagccgccagtggcagttgcgtggagcggcggcggcgggagcggctgtggcggccggctggagtgtcgccggcgagcggcggagagagggagcacggtggggaggtgattagggggtgtggcgagctcggggtggagggaaaatgggagagggagccccggggatgctttttatagccttggaatggcgggatcgagcccgggagaggcggaatcggccggtgtcgtgggacgccgacgtgggctcgtggcggcggttcggcaccgatcttcgaggggcgagtgggggtttcggttgaggaggtggagaggaaccggtccacacggttagatgcgagctcgggaatgggagggcgccggatttggcggtggagtgggcggcggttggctggaggtgggagatgaccccgacaggtgggacccacctgtcggcgggtcggggggaggagggaggacgagacagttgggggaggcaaagtagacttcgggagagagagccgagcgggccgagggaagggaggccggcctgtgaaggaggagggggaggaatttgggccgagcccgaaagggaggaaggggaaagaaggagaattaaatttgttttctttttatttaaatgagtttaatgaactttgtgactttaaaattacttcttgagctctgaaaattcgtgggaaatttcagagagtacattaggggcgcaaagaatattataaaatattctcggccataattttcaaaggaaatttttaattccctcaataattcacttgattaaattgatttaacttttatttaatttctagaaaatgtattattaaatgatttttaatcccgaacgaaaattggggcgttacaattaccatggttgtcaagcattgtgacatcagtgcctctatgagacaacaaagcagccaccatttttgggttacccttatggacagcaacacgtagagcagttttcccatggctatctcgcatgccagtgagtttccgtagttgtggtgtgctcaggataaacttaacatactctacttggtctgcggatacagctccatgaagacatgtccaaccagtctttgtgcaatagggagcatctggacaatggataagaatctcttgagcaatgccaatatgccctcgaattccggcagaaacaagaagaggatctagtggcggtgttattgtctgatacgatgtaccctagagaagaatcatgttccagcaatactcgtaacacggaccatgccccagagggcggcatagtgaataggagcacgcatatattcgttttgttgtttggccagccaagggcggttctccataacctttttagcagcgtctgaaagtatgtctagggatgcaagtggggcgggcttttttttcggcccgcagtcccgccccacaaaaaagcccgcaaatttgcgggctggccatcccacgtggaccttgcaaaattgtttggcccatcccgcacagcccgttgggcgccacggcattagggcacagactgggagacgcgagacgcagccgcagcggcgcagccgagacgggagacgggagatggcggcggcgagacggcgccacagcggctgctactctcgtcttcctcgtcgcccatccatccaaatccagcagccgacgccctccagtctcctgatccagcgaaatagtgaatccagtgcatttcatacttcagttcttgatagttcttgatagatccatccaatccaaatcctgcagcttgcgatgctgcactgccgcctccagatctctacacactaattaaggtacaagattaaactaacctttcatgtgtttcttgtgtatttatgtgaatcaacgaattgcttctccaagaatagtagcaggttgtctcactcactctatttgtttttgtatatgttaaactttgagtgtgattggtgatctagccattgttatactggacatcagcgtctgcaaatgatctattgcatcttttttttatctaattaatgtggtgcatgattagctaccactggtttgacataacaagattgataggtgctcattcagagaagtttccttcagactaatttcttaattattagcttcagatttttttttcttgttctatagtatataaagtacagttacatgtagtagtaatataaagctactgttgcagtatctggtacgttttacccaacttcaacatgctattttcatgaactttggaagataaagatggttttggacaaggaggctacaaatgaagatgtaccattgcatctattgtcaaggaaatgaaagaaaaatttaagaagtactgggacgctcaatacttgcaaatatgtttcccggttatttttgatccaaggtataagtacaaattcattgagtttcgtttgaagtctgcatttggagctgctgcaactccttaccttaaggaaatcaagagtaatatgcagaaattgtttgatgaatattctgccaagtatgggggctcaaacaacatcaattctcagcccgaaacaagtgttgagcagaatgttgatgcaagtaatcaattcactgattggagacagtttctacatgacaaaagcaggagcaaagtaaagagtgagcttagtcgatatcttgctgatatgcctcaggaaggtgatttccaagatgggcatgattttgatatcttgaactggtggatggtaacaaaacaaagtaccctgtgatttcacgaatggcacgtgatgttttggctattccagcaacatcagtggcatcagaggcagcattttcaactagagaaaggatcattagtgactatagaagtagactttcgagcagtactgtagaggcattgatttgccttcaagattggatgagggcagaaggtttgggtgatttctttgcacgtgatcttgctgagagtgatgaccaaaatgtgcaacattcaggtatttaaattgagattcgtttgaattaacttggctattctatatttttgtatagttgtatactacaccactaacatcattgtttcttttttattaacatctaacagtccagcatgtactcttttttattaactccattgtttcttcctatacaggtgaaaatgcctatacacctctagtaacatgtagtaccagcacaacaaccagcagcaggttatatatctcactatcctcgaataactgcttgttattgtcaattatgtcctttaattcatattttggatgcattcttaattgatgaaacttagtacatatttactccattctacaatatggaataacgttgtgatcagtcggttgatgaattcatttctaattttcgattagtagtttctccactctaactttattaaatttaatgtgttgaaggtaatatagaaaaagaccggaagagctcatagagttggaagcagttgtttgtcactttgtcaattgggacagttggtttatcatgaagagaaaatgcatcatcatcactctaactttagtcatgatgttgaaggaaaagaatggtgttcttattcagtactatacttgttatgtcattgaaaaagaatactttcacatgaaaataatacagttttcatgtgctaaatttgggatatggagtagttatgtgcttgtgtgatcgatgaacctaattaaacagagatgtgcacattgtgggctgtccagcggtgcccgttgggctgagcaatcccgccaagccatgcggggcgggctgccgtttgcccgcacatgcagtttgcggctggtgtggggcggggcgggacggcccacaacccatcccacttgcaatcctaagtatgtccaaggaaacaatatggttgttacaattacagagtgtctgtgttgtactgtgtaattctaaaaaaaaagaaattaacaacgagaaatacctcgacctacaaaatctcacctgcatttccacttctcacgg

SEQ ID NO: 77771 - DNA, 1299 bp, Oryza sativa
gctcaagcaccatgtagccttgagccgccgtcgctccagcagtgcgccaccgccgttccagtcgtcgccgtcgctcgggaaggtcgccttcgtggtcgccaagtcacagccgtcctcgtccgccacttcgccaccgccggagaccgccggagcatcgtcgccgtcatcaagccgaagaccgccgccgtttcttcctcgtcgccgtcgccgtccgttgctcctccgccgcttctttggtcgccggtgagtttgccgcgtcgccctctacccgttggtgccctccgttcgtgccgaagcgccgccgttcgccggcaagcgtgcgccgtccgagccgtccgagccgccgagccgccgccgccggtggtgacgtcatcgctggcgtcatcgtccccgtctcccgtgagctggtcgtggaccgatcgatctcggccgtccgttttggatggatcgatctcggccctccgttcccgtgaaccgtcgctgtgcgcccggtccaccgcaaaccctagccgctgacgcaataattccctttttccttttcaaaaataattcattattgcgtcataattcaattaaaatccatataagtgtttcaatccgattaaatcttcaaaaattcataactaattcatcttagctcggatttagttggttcaagtctctaaatttttctaaaattgaggtctacatgttaaaaatatccacatatactgttcatgcttgtttatgtgctgttttggtgattttgcttctttctgcttagattccatcgtttccggagagtccgttttcgcagcagaagagtttgaagagttccaaggccagcaaggcaggtcacacagatcccaaacaaccctttaagcatgttgatcctatttaaagctattgtttctattcaactattgcatctattttcgaatgtcattgggtggaattaacctattgtttgccatagcccttttgttcttgattactttattccttgataccttgggttattaaaacttgactagttgagctctatataatggttcagctagatgttagatatgattgcttagccatgcttagaaacattagcacactattgggataacttatgaatcactattatttaatgatggcttaatgatagctcacgatggtcaatcgtgattggttaattaattaatttgccaactaaaacttgataatggtgggttgtgagcacatggttttgatggtcgtgctcatgacaattaaggaccggttcacgagtttcggttgtgaaacattaaccgtgccaaccacaagccagcg

SEQ ID NO: 77772 - DNA, 1541 bp, Oryza sativa
ttttttaaaaaaggggaaaagtttttttttggatttttgagcatgatgtgtacatttgtacgaagtgtgctttttaccacttttgtttttttttccaaacaccaaaacaattttgatgagtttgccaatgtgttcatgaagggggagattgtaaaatcaaaggtgtttttgttattattctgtgatgaacaattgggcattggagattatttgttttgttatttggaattttttcacgaagtggttttggagatgatcggatttacaggtgaatcgcaggattgtcattttatgtgaccggtcagaccgggctgtgtatgccggtcagatcagcggtgatcgagcggtcggaccggccagcccacggtctgaccggccagcccacggtctgaccggccgacactatgtcggtttcggtttcgggttgtttatttgaatatccgagtttatttcatgattatgacttctagatggatactatacgtatgtaatactattgtttgctgctaatgagtcaagttgaagatagcttggtctcggaatagggtttctttgtttgttccatgtgtaggtgactcgatgtctcgggagagtatttgcggtgatggaccgggagtcggcttggggataagacgacgtccgtggtggtcagagatcatgcgggatattaaggctagagttgatgcacgtggttgatggagattccatatgacatacgatggagttattgtgtgcgtatgggatgcggagttgaatttggaaggagtccaaatttggtacgattggttatgtaaagtttctttcttgtactagtgggtttcctaaggtgtttaggactcctagtatgagtttggttcgtggctttaggctgcctacctcatgtataaatagaggggaagcgtgaggcttcccggtatcgttttatagagcaattgaattgagttttgagttagggtttcgagtttagtcgaaatttttgtaaggagtgttgttggtgcactttgtaaacacagagagaagtaataaagtcgtcatccactttagagttctttgatttgtgtttcaccgggtttcgtcggtctaaccggcggtgcaccggcggtcagaccggtggcatatgggtggtcaaaccggcggcggcgacaggcgaggcaggcaactttggcggtcagaccggaggttcaacaccggttagattggcggcatctactcggttagaccggcagatcaatctcggtcagaccgactgtcacaccctgaaaattcaaaatatataaattgttgtttaattggaaattttagaaatgattttaaaaagccttgaaaagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaagttcttcttttggctttgggccgaaagtcggccca

SEQ ID NO: 77773 - DNA, 2248 bp, Oryza sativa
aaggcagttgctcccgttcttagttgttcgaagcagcacgtctgcttcacgggcagccatgtcctccttcaacgttgtggaatcaccagatttggctgcttccaggagttgtctgtcgatatagatggcccgcccggcacggcctggcccaggcacggcccaccagccatcgggccggcacggcccgatcggcacttcgtgccgggccgtgccggcccatgggctgcgcctcccgcccaggaacgaccaccagccgtcgggccgtgccgggccggcccgaaggcgcgggtggcccatcgtgcctttttttatataagtctatttttcatctctcctctttgggctgtggcatatatatagcgaaaataagtctatttttcgtccctcttctttgggctgtggcatatatatagtgaagataagtctatattctgtccctcctctttgggttgacatatatatatatagctaaaataagtctattttacgtccctattctttcgaccatggcatataatatgtctatttttactccctattgtttatgtgtcgggcctagcctgcggcccatcgtgccgtgccgggccagcccaacgtaccggtggagaggcccaggcacggcccagtggttgagccaggccggcacgggcctgacccctgacgggccgtgccgtgcttgggccggaccaaaacgccgtgctgtgtgccgggccatcgggcctcgggcctcttggccatctatatctgtcgatcgtttctactacattctctgataggttagtgtcggtgcctgatgtttcctccatggaattttacctccaattttagaatattgtgtgcacagattatctgttttccgttcaatattttggacaaagtacggagtactccaactggatgacttaacactctggaagccttctctgttaattaggcaaaaaaaacatattggatcatgtcaagaaattaataggactataatgttactagtttttagcgaaaataaaacccgggcctaacgtgttgatcgacatgcccagctgggctaaactactttgtcagagaagaagagaaataacgcgagtgttcgacagaaaatgattgtgtacgtattttgcaacaaaagaaagaagaaaatatcgtgtaatagttaaattacaacattctgggacatccttttgaaatatgtcaactgtcagcgtatttttgcaaggatatatatatatatgtgttctttggtgtggattcgaaactaattattcctcgtacatgaaaaatggaacgataattaacacacaattaattaagtattaaaaaatattaatatgatttttaaaagcatttttttcaaaaaaattcacaaaacattcatttaccagtctggaaagtatgtgtgtggaaaataaggaatgggaggttggtaagctcaagaaatgaaaacgacctagaagcattcatattaatcatatttatattctgttttaagttcaatatgttcaaggccgcagctctaataaaaagcactaaatctctagaaaagattttacccgttacataggaaggtttgtaacggttttattatgcatcgaacactgtgtcactacttaaaaaaacgatttttagtgatgttggccttttatttttctagtaggatatgattctcggagccaaatgtccgtctacgaaaatgtaaaccggagtgtattttcatcatccgtctacgaaaaacaatttttcagggcacagacggacctcttaagtagccggctgaaaaaaattgattttctcatgcggaacgttatatggtccgcatgcaaaaatcatgcataaaaaaaaatctaagtcattcttatcttctcctccacccctccccacaactcatttcccctctccactctctcacacacgcccctcactctctcctccctccctccctcaaaatctgactggaggagaggagggcgacggtggtgcggcggctccccctctctccctccccactcctagatctggctagaggaaagggagcgacaacggcggcgtgcactgtagcgcctacagcatctggaaagattggatttgctgcctgcgaaaatcattttcgcaggtggtgctttggtctgcctgtaaaatttaggtatttttacgagcctttagatacatacggaaggtttggccgcctcgaaaatgtgtttttaccgccaggaacaacgctttttccagtagtgtgcataacctttttttttcg

SEQ ID NO: 77774 - DNA, 31802 bp, Oryza sativa
  unsure (1)..(31802): unsure at all n locations
tgaccgtcccaagacctatatttgttaaactgccgacagtgaagagaaactagttggcagaactgccgaaccaaaaaaacggataggagggctacttgcttctattcaaccatgtactgatttcgatacatacactaaactatttgagtgccttgcacgcaagtataaatgaggcagcaccctttccaatttttcctggccaccgcaatagcaatgggaaaggnanaagtgccttctccccacacccaaccactcttggattcagtggcggcatctctcactagcttagctagccaaacaagaccagggagagaggtggtgtactggtagtatattgctagtaccaatgcatctagtatttatagagccgcaagtccatatagttgtatgtctcagttcactctcgcgtgcttcgtcctcagataaaatttaagccgacatagacctcagataaaatgatagcttaaatccatggtatttatggatttatataagacaatagaataatgatattttgattgttgcatgcataaatacatggtcactagtatgagagaaattgaacataaagcaatatgatgtaacaggtgataaaaacacaaaattttagttcacaaataacctatatattgcggctagacctactaccatgcatttttgttgaaaagctccatgatcctgatgtctctctaaacatgtgattagtactgtttggtaggctaatttgtagacaactctgaatttgctgccagctaatcaagctagaccaaccacgtctgtaaacatatatatgcagagtacctattctgtgagagccaaatgtatatacatgtactagagattatccaacgttttctagtttagcaattctatgcaaaggaattataagctgaccagatacatatagatcttttgttttaattagaggctgaattaattttcactataaaaaaatatctctcccatacacgttttatgtgatactctctctccattgtctcaaaatatagctacatttttagctagttcatacagtttaaatttaaactataaagatagctatattttgggacgaagagtgtacatcattatacctatcaatgtgaatttgattataactgtgtgatgaggaacttagtacttacaatctgtggctggcagcaggagagcatgtggatcaccaacgttgccttcaacagaggacaactcgaagtggactcatgtatgggtgtccaagaatagttcaatcttccagtcaaatgattgtctttataacttgttagtataactactccctccggttatataataattgacgttttgaacaaggatgaggataaacttttataactttgaccaactttaaaagtatttagtttcaagaaactagaacaacatatatagatttgtatttcaaagcactataataaaagtaaacatgcatttatttaatatatatatatatatattctaatagaaaaataaggtcaaagatatattttgtagaccgtgccattgtccaaaacgtcaattaaaatgagaccggaggaagtacaagtttgcattcaacggatgtcatcatgtctagttgcatttaacacaaaaaggtatctacaaggaaatagccaaaatgtgtggtgtggagtggtctactttttttcttatggaaaaaaaatataaattagacctaattatttttttgacttaagttagacctaattattaatatattaggaataatttccacaaataattaatgaggaggatcattctagaccacggtacatgactcaaccaaacaagcaagaacaaaccacctttcccgtcgacacggcacacgttctcttcaacaaatagtatcaacagatatatacagcgggtataaacacgtgtcattttgagcatgttttaagtcaaactttataattcagcttttaacatcagtatctttttcaatatttaattagatttgatgtaggaaaaaaatatgtgtagatatttgctccaagaagaacttccaaaatagtggcggagccaagaatttaacccagtgggattaattactactagtttatatttcagtggggcaatttctctaatttttctgaacttatacataaaaatcaagatctataggggtgttttttaaaaagttgtgggtcaaaacacatcatacatgctaatctttgtatggattatctccgatacaatgtgcaactagaacaacgaagtagaaagaacgtatagagagagagagagacaacgatgccatttcaatgcgatatattgcattttcatgaaactaacatttatatattgacatgcacatataaatgatgatttgcatgtatttgaatgaaccccactatggtcgtaaagaacaatagagctttgtggatatatgtgtcgcgctctgctagctggctactagctaggaggatcatggaaaagtggtagtttgtcgtttggcagggaaggtgtgaactgcgtggattccaaatttgcaatgtcgatatgcatgcactaataattagaaaacaacaaacttggcacatgcagcgctatcattgatctccactggtgcttactctaacattgtcttaattagacaaaaaaactctgcataattgtagatatcaagctatatatattatcttactttgctagtcaaacctagggataggccggatatgtttcatttttgcattatctgatgtgattgtacgtgttgttgaagcgtggcgcatatgtgtgcacctccgcgatcgctctgtcactcgtatttcttaaatgttcttataagaaggtactgaatcccttgatcttgtattaatgttttatacgttttggtaccttcccgtgagctgaagtatcgatgtatcacgttataattatatatcttactgtaaaaagtactccctccgtttcacaatgtaagttattctagtatttctcacattcatattgatattaatgaatctagattaatataaacatgtacatatataggagttttttttagtgctacatacatttttttatttcatctattctatcagctgatgtttttgccaaaattgtctttgtccaacgcgcgattagttgattaaatcaaaatctgtgacccctcttttctttcatggcaggtcagattccgataagaacgcagccacataatataatgatgtgtgcacctcatgatctcaaggggcaagatatgcacaaagattttctaacgatatcttattggtagcgatgcatgcctgcatagtctaatttggagccaaaaaggtcatccatggatggcaccgtgtacctaagatacaacaaagagatgacgttcacaagttgtacaactgataggagtagtagtagactggtcagagaggaggagctgggcaagctaggcaaggccagtcacatcttcatcacgtggacagcttgttcatgttcgatcagtccagcataagcgtccaaagcttaacttttcgggcaattaaattagtagtcggcatcaacgtgcgtcataccatagtcatatgttaggtaactactctctcggttcttgacctagaaatgtagctacatcttagaatggacgagacatatattgaattgaatcgtgaggatgctaaaaataattcggagtagctagctagctagatcgaacttctgtttgtgtttgtaactacttcgttttagcatgtcattataggtcgaagtgtcgaacaaaagaaaagtttatctctataacatgtagaccacaggtgtatggcatactaccaaacattattgagctaataagctgatcaaatcattgatctgacacgaaatcgtagcacaacgtggctaccaaacatatatactatcccctttgtcccaataaatttatttttggttcctttccatttatctcaaagcaagtttatttttagaaactattatattagagtttataaaaatagagaataattatatattgggagtaaataaaataagaaataattgtactgtgatttaaagtaaagatattttatcctcttcatttaaatttgtactaatatataggtataagataggtcaatattaaacttattttgagacgaaggaacacaccctttataggcgaccacgacgcacaactacaccacaagcagctgatagcccacccagccatatcaggccgaccgccgcgccgcctgtcgcgtcaagcttatagctacgcgacgccgccgttgctgctgcattctctcttctcagtcttctctccactccctccgcgccgcccctcgccccctcctccctcgcagtcgcagcctcgcgtacgtaccgttgctgtgtttgcacgtacggcgatgcgcgccgttggcgccttgcttgctgctgcatcttgcctgccggccccgcgcgcgcccacctgccccaccacctgctgcatgctgcgtctaccgcgcgccacggtgacgcaccggcttgcgcaacaacgctcctcgcgatgcgtacgcacaagtgatgtggctgccgcgtacgtgcgtgcagcgtgcgctctgctgctttcagacgacgagtcgatcgatcgatcagcagcgtacggcacgcgcgccggcgcacgcaatcctcaacagggccggcaagcggattgcaagttgtcagattttgggataactgcaggcacaaaagatttataacgggattggagattttgagcacacatttgatactccgtatcatctttgtgtgcaggtgcaggtgcagtcggcagtcgcatcgatcagttgcttaagagtcataaattaaacgtcgggccgggcaggaggattacttgcacatttttagctcgatgtgaggatccagccaaggaaaaggacatggtgtagacgtgcacgtgcaaagaatcgagggacatttattcggcggcgatcacgcgacgaaattagacgtcaattggacaagatatatctttctccttcgagattttcgatctgcttaattgaccaacgcactcgctattcatcgtgtgactgaaattagaagaagtttcagtcatatttttctttgataatatttgacggtcaggacattgtcttcaacctctaaattaattgggagaggaaggaagagagaaagggtggactgacccatggtggtgatagtgatagtgagccttgatgccacatgtaacttaaattacggtagataatctatagattagtatagggggtcgtcggcagggaaggggtaaagagacaatatggaagcgtttttagaaagatgacccaaggttttgcagagatgggtaggcggcgaggcgtcagagtcgtgaggatgaaggagggcctaggggagggggatccaacagttcaagccgccagagataaggaagaagaggcaacacgagatatcgacactggatttgaggaagaaaaggatggtggtagcatgaatccaaccaatatacgtataaagaaagagggtggtgagaagcggtagggaagtagtagttgacgtgatatgaagagtccatagtggtggcagctaaattgggagaggagagtgaagagagaggtgtgagcagtgtcggaggtatgatgcttacaatggctataaaattactcaagaatatcattattactgtagaaggtaaagttttgtgtcgaagaaatatgacataatagttgatcaaatatgctttaagtatagcactagattaaaactgagctttttgttggaaaaacaattagagcatcaccaagagactctcaaaatcaatgtcgtaattccaaatttttgatgttttttttcttaaagaaccaaatcctacaatgcccacaaaataaaaaaaaaccaaaaaaaaatgaaatcccatcttcgaaaatctcgctctccacaagtatggcactatgctcgtccccaatctgcaaggtcgcacgtgatcgtgtggagaggcaggtgaccgatcacccgaatgggcaagcaagagcaatcacgcggagggagaagcaaatgatttttgttggtagttttacagggttatccacttttttgaagactcaaatttagagtaactcttaaaaagaaaaatatttccataccttcaatactaattacagagtctcaacaaaacatttaggggattaaatttgagatagctcttggtggcgctcttatttagaccgaactacaacaaatacctaaagtgattccggcggttgaaaaatccactgaacagctgaccccgttgattaatcagtccctctatgttcttttccaccactcgctgcatttcgtccaatgcagacaatccacattcaaacagcaggcgaccgcagcgcgattgagagggggaaaaaaactgatgcgttgcacagcggctcagcccaactcgaacatctggttcacagagtcaaaaacggttttgatctgtacctggtcgtgtctgaggcaacatatatattcggcgccccgagtctttcggactgaaacgacgatacatggacatgggtaacaactaccaacacaactagtgggtaccaattataccaactatatagaaggtatagatacaagagctacagtacgcattgttctgttccactttgtttgcgtggggcgactggctgaacaattcagcatttcagccttatacacgaataattacagacaggtgcgaagaaacagagaacactgaaagcctgaagcctaagccgcttcatgatgccatatcaaggaatagacaccaggacctgaaaaagggaaaaaaaacgatgagattcttcgttaatccatttaacagaagcacacctcaagttgctgtcagctaaattggtaattaatcagcttgtttcgacagatttccaagaaattgatccattggaacgtatccttcaattcatatggctatcactgtttgactcgtgtgctcccacaattgcttcacatcactgagccctggtccatagccaatgtttctttcagtgtgtatgtatagtatagacacagcgtgagcttccttgacttcaaaagggtgaaacccaaatgtatctttcgttgtgaccttgtgggtttttctcttaaataacatccacacaatatcctgtcaaagttaaaacaggtttcccctattgaaaagtaagtttaataccatccacacaacgtcctgtcaaagttagaacatgttacctctattgcaaagtaggttaattgaatgttaacttggaaaaaagagaagacatgttgcatacgttgcttacgcacgaaagcagataatcggacatcaataggagctacacaaaattgtgacactactttatccaagaaaaaaacaatacaatagcattgatctatatccttatgataacaaggaaatcacatgaactctactgaaatacactgttaaagcaagcaattcaaacaagtcaaaaagaacatacataatcagcaccctgcaaaccaaatctgatttggtctaaccccaaacctagaaattatatactattgttgtagactgttgtttcttttcactaaaattcatactaagtcaaataaagcggtagtagtagaaggatgataagtggaactagtgaacgagtttgatgtccacaggacctgtggccaccaggcatgctcgttctatagcaatcaaagttgatcgtcagcaattaaatctcacacatagtgatccttgcccatcacctaacatgaacttccccaataatagtgattcatctacatcatcttgatctgactcctgagactcccaggcataccaacaacagctactctgtagcacacaaacttactctttatctagttgaaatccaaagcaagccccttcaaggcatcaccacactactctactgcacttgccacttttatttccaagatgcacctgctagagcaatcatcctctactacccaaataacaatcgtgtctgtcagtcactaatcaattcataaactaaagaacactgaccttacttcatatgcaaactacatgctgtcatcagttgcaatatcagcatgctcgtcagtgtcactactccacgatatgtccaccagaccaagctgttgtcagagtagaaagcccacagaagaccagaggaaagggttttgaacgtcaatcagctcactgtacaatgttttctgacttcaagcagtggcggacgcaagtttaaaatacagatggggcggcagagctagccctaattaggtgatggtacaacacatacaaaccatagtcgctggttcacggcattggcgcaacagcgcacggcacgaacatcgagaaagttaacaacgaagattggtagtcgaacaaacgtatataacttatatgtagagagataaaaaaaaaagagaaatgttgttagacaataaggggaaccactttcaatagctcggggggtataaaacgagatgaaaaattatttaggggtttaagtgcttcgctaaaatagttcaagtgagtaaaatggatttttttatatatttaccaatttaactatttactgtagactgtattatacgctaaagaaatagaaagaaaatcgaattttatgtatggtcaaaatggtactacttatacacgaattttcataagtgtttttttcctattattcaatagtagactaatgactaatgtgttagaaataggactaaaataaggttttggggtgtggggcgacacggactgtagctaggccggccgacccaccctgcccaatgggtgtgtccgccactgacttcaagtaggatggaacgaatctactcaggacaaaacacaagcctttatctccatagcattttgaacctgttcttggtccttttggtgatatagcttgtacaatttcaaggtcttgaaagcactaagtttttctgtttccgataatataagtgttatttttagagaataggccagaggcccagctttttatagaaagctattaaggtttcgctggggtgagaccagcttacagggcagttcagaaaggaaaaagggcacaacccggccagacataggttttcaacctccagtagcagaactcaaactacacaggtccaactctaaacaacagaaaaagctacaaggcgaacaaacaagctatggaataccacacctatccaacaccagttctggagggtctaaaggcagctacaccagtataatataagtgtgcctctggaactatatttataccgccttttctcataaggtacattgaaaactggaggtcaaattcagtatccaatttgtgggtaaatgtaccccaaggccccaccttgaatattttcatacttggcatgccaatcaagtatattcatctacttatcaaagttagtactgcacaaaatctatccacaatcatcgagggacattttgaggataacaatcacttggaaatccctcagtgatgtgaaattatgaatacacagagtctgcatatcagacagattctatatcataattatgcagctgacagttgatgtacaacactgcgtcacaatggtttcaattatcagtgttgaaagattcagttggactataaactacaagctccataaagatgatttgcagaaactggaactaatttacaatcaagtttggcagctgaaattgtaataaagagagcctatattgtatttcaaacgagtaacctcgtactggagtagtaatattctgtttgtattccgttataactttaagttctcctaagtccaaacggtagggaccattacagcataaaaacaacagaggtcttggaactattcatttccaggcaagacaatattaaaacttcactcttcaagtaattggaatcagcacttcatattcttcaattaagtggagagattatcatcaatcccatttgtcttttaaacaaattctcccgaacaacaaagaacatgaaacaattcaaagctattatactaaacaaaacaataacatagtgatcgtgtcctaagattacatcgcctaccaagccaagccatgagacagcgacaaaaaaaattgaaataaaaaaggaagcaaagtggtagattgctagtacctttacctttgtactaagagtcggctttggcggggcactcgaggctggcgttgaagtggcgggcggggaacttggcggagacggagccgacctcgaagacgagctcgtcgccgtcggcgcggatcccggtgatggaccaccaccggaagaaggccctgacgcggatgccgctgaggccggagatgcggcggtcgtcgagccggcccgtgaggcggtcgctgaaggaggcgaggtagctccccgcggggagcacgatccggcagctggaggcgaggtccacggcgaagtcccccgacccggagtccagcgtgtacccgcgcacgttcgccggcagcaagcccagcgggaacccgcggtgccggagctcgtcgtacgcggtgacgtcgccgtcgccgccggcgtcggagcggacgaccgggagggccgccgacgcgaggagtaagagcgcggcggcggcggcgaggagcgccccggtttgggcagtgggtgtcgccatcgctggctcgccgctgcttggttggggagttgggatggatgggcgcacgcggagaaggagggggtgacgtggagaggtggaagagtgtagagcaccatgacagttaggagagagttaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggccttatagcgtgtgcggcgaaaagtcaaagatttttttcctttaaataatcgtttgcaacggtggcagttggcagttttggcactgagcaaagtaggcccggctcggcccgacctaattaggcccaaaaggtaaggaccagccagagtttttttttttaacttgtgcatcgatgtgtttcatactttcatgtcagagttgttcaagtaggaaaatgttgtgctagtagatgtacacgagaatatgacccgatcgaaaacaagtgaaattgcaacagcccaaagaatccaaaaggctttttctgaagacaaaaacttctgaattcagagagtgcagactgcagacaagacagcagaggcaccagctatgcccaaaaagaaatgggtggctcgaataaaacttttaagttcctattacatcgaatgtttggacattaattataaatattaaacgtagactattaataaaacccatccataatcttagactaattcgcgagacgaatctattgagcctaattaatacatgattagtctatatgatgctacagtaagtattctctaattatggattaattaggcttaaaaaattatctcgcaaattagctttcatttatgtaattagttttgtaagtagtctatatttaatactctaaattagtgtctaaattccctggatccaaacaccacctcaagcttaagagttctgaacgatagaaaacccattcaaacaatgattcccagaagctaccatgtttatggcaaacaaccatgtagctgaaagttttctactgtctattttcatagtttgcaatcagttctccctagcccattttgtgatcaactaatcccaggtaacagtcagaagcttaactactatttcctggcacatatttgatatttcagcttttggccaacagaaaaaacaagatgtgaaactaaaaggattcctagaacctctgtgtgtgcataaaacagtaaatatctaatctgaattagttgccaataaaacaactactcaatactaattcatacataaacaatatgatagcaataatctaatgtcagtttcgtaacgaacacttcttttgagaatgtccaagaagatgacatcggccacattgaacgattcgttttggccgtttcaagctttctatcttaagaatcttcattttgggacgaccaggaggcctccggatcttgggcgggcgaagaaccgcatatgctttgcttcctgcaccttgtgcaaaagaaaacgggaggttccattggcttctatctggaattgaatagattggctgggagtaagtttcccgatacttcattatgctgaagcattcatgtgcatacaagcgaggatcttcaccacaggaaagtagtgcagcaacagcatgtgcacatggaatgccatatatttgccaccgacgacaagagcagcacctggcttgcgtatccacaatgtttgttcgctcagatgagactatttcaaactccaccttgtttgctcgaaggacttgatagcatcctgaatcagcgatagcttcagaaataagtttctcggctgatggaacaagaattgagttgtatgatagcgccaagttttgccgttcaacaaaccagcaggtcagttggtgtttgatatgctccacagtttgcactataggaaactcatgacactccatggcccagttatataatatctcagttatcccaagattaaaatggccatatcggataccctcaaagtaagaaactgcccagagatttggtgggaaacgttggaaccatggcatgacatcttgaacttggaccatatcatttacctttgaatcaaattctgctgctgttagagcataaacagcactccagaaaatgttcagaagtttaggatttttgaactcgtcacggaaattctcactcacatatctcaagcaaaatccatgaaaagcagtggggaagtttacttcaacagcttcaaccacttgtgattgcctttcagatagtatcgtcaagacaggcatcttatccgtgttaactccaagcatcttcctcagttctgaaaaaaaccacatccagttttcatcactttcagcgtcaacaataccaaatgctagcgggaacatcatgttttcagcatcaacagctgacgcacatagcaatgtcccaagatactttcccttgaggtctgccttgtcaatttccaaaaggggtctacatgcatttaagaaaccatgaatagatgcatggaacgacacgaacagccgctggaagctattatctggtccagtccctttgtatattgcaacactgccaggatttgtctgtacaatctgctcacagtaggcaggaagaaagcgatatccatcctcaagggtgccatgaacagcagccatgcttctctccttcccacgccatgcctgcatataagaaactgctactccatgctgctctcggatatcctgcaatatctcttttggcttatactgtgggttatctcttagcgttgcctcaacggacctagcaacccaaccaacggtagcctggtgatgatgcaagtcacgcacaccgtcgcacgtgtgctccccgtgcaatgtgcgtacagtgaaagtcgggacaccatggcactttgccacatgcacacgccacgggcagccttccctcgcgcacttggcgatgaaccggctccggtcagatttcacgacacggagctcgaaatgcatagcaatggccatgtccttgacggccctccggcacgcgtggacatcgacaaactcttgcccgatgacaaggccttgctctacaagattctgctctaactcatgcgtgggatctacaagactctgctctagctccgccgccaggtctggttcaactaaaatctgatcgtcttccatcaatcatccacaagattacaaaatcacttatcgcgccacatagaaagtttgctcgcaattcgaccgctgcacaagattaacacaaaacacctagtcattcaatcgaaaagaaaaaatggcaattcaaaagaggtacagccaagttcaaaccaaattagggcaggtgagttcggttgaaagttgaagcctactccctccatttcatgatgtaagtcattctagcatttcctacattcatgttgatgttaatgaatctaaacatatatatccatctagattcattaacatcaatataaatgtggaaaatgttacaaatgacttatgttgtgaaacggagaaagtactttatttacttcctattttttcttcggaggaaaaaataaactattcagtggcggatagcgtggagcatgaggttgagctgaaccaaaagtgctacaaagagtccaccacgcatccatgaaatccgcatgaaacttaacgattgaaatgggatgaaacttaacgattgaaatggaggaaagaaatcaatcaagtccccgtggatctccaacctactgaagtgggcgtggacaagaaccgagtagggatagtagaagaaagagatgaataccttcaactcgattcaagttgaaggcgggggacgaaagccccgcttccgccgccgctccaaacccgcccccaggggcgtgcgcgctaggggaacggcgaagggggagtagcccgccttccgcgtgtctccgggactagcaggcgccggcgctcggaagtcggcggaggcgggggcggcgaggagaagaagaacggcggcggtccggctgggcagatcggaaagacgggtggagggggtggggggcattttggtcattcgatgtttttcagccttttttttcgaaattaaaattcgggacaccgttcaagtcgaaagtagcgatgtggttttttttttacaatttttatttacatttttttagcatacacatatatcaatgcaatctattttttaaaaaataaaatgaccaaaatgctactagttaggtgggacaagtattagaagtttctaaatgcatatgtcaactaaatttcatctagtcccacaaagataaaatggaattatgtgggttttttttttacaatttttatttgacatttttttagcatacacatatacaaatgcaatcagtttttctaaataaaatgatcaaaaatgcccctagttaggtgggacaaagtattagaagtttctaaatgcatgtcatttcatctagtcccataaggataaaatggaaaatagaatatcacacattaggtacttcttccatttcatattataagactttctagcattgtccatattcatatatatatatatatataccatttcatattataagactttctagcattgtccatattcatatatatatatatatatatatggggtaatgttagaaagtcttataatatgaaatggagggagtagatcgtagtgacaaatagatgacaacaaaattattacttattgcacattaaattatctaggctctttattttcattcaataaaaaatactacatgaccaatgagatcaagtcctatatgtaatcactataattaaccatagtacagaatatactgtgttgtaaccatgaatccctacggtttatggcaaacatatatttctactcacaagtcacaaatgttctccagttgcttacttgcttgcgatctgaatccatttaagaatcccatttgaaacaagcagattcaaaacactacatttagtcaaaatatatttatgtttgacttttttattaagctccaatttttcactgtctactattttaaaaattatgatttattttcagaagtatttgtataagctaaacatactctgctaaagaaaaaagaattaagtgagatcaaacgaaaccatgcgagcacaactctcgggacattttactactctctacttaacataatgaaaatgttatgttaagttattgagtctgtgcaaatgtattactccatctattttttaatatattatgtcttttggcacgacgtttcaatattctccttattcaaaaaatgtagataagtatcatttttttacttgttttatcacttaagaaactttaagcatgacttgtatcctttacatttatataaaaaaaagttgggtgaatagctcatttagtccttcaagtttcaccgaaggctcaatttggtccttcacgtttcattttgtccacataactcctctaaatatttgttttggcttgacatcatctttgggcccacttaatatgccatatggctatttttagtcaatatttctattagaaaatgtcccttttgcccttaatttatatacaactatatataaaaaggagaaaaccaagatgaataaataacattgtagatatacttcccattatttcaacatgtgcacatgaaacttaagccatttctatcggatacacttgctagtacataatttattttcgttttacataatttactatacattatctataaaaaaaatcaagcatacattttttctcttatatatgtgaatgatgggggtataagtgtcatttatcaagagagttgttagttcaaggataagtttgaactaaaatgaaaacttgaaggaccaatatgaatagattgaaacatcaaggactaaactgagtctcaggtgaaacttggaggaccactttggctattcacccaaaaaagtttatggtgttgtcttacaaaatagagacagtatatcattggttatcggtataatccacggttgagcttagtgctatcttcataattatccatatcatctagaaactacaaggcatgtccggctgtctgttctatggctgcagcacagccggcaccaacagtgctgcacacacacggcgcccaacagggtagcacgcacacggcgcagccgtagctgccgcagccagcttgccgaacaggcccactaaagaactcgtgtttttctatgattgcctgtagtgttgtatctacagtagatgatattggcatacagtcatccattgctgctaaggggcagtgctacagaggatccttgtcccttttagggcatctgcaaccaaagccacacctagagtgccctcactaactaaggacactctcaggggcactcatcttccaatggaggatacacctaagtagaatcttcaaaatctgaagcaactggataaaggtactctagcccacagtgggtgtcccaacacaaaagtccacactaggtattttcccatactaccactctcttctctttttcttcgtgcctattcttcttcgtcgcccctcttctcctccttttcttcgcctcgtagcctgtccttcccgcctcggcgccgttgccgtccttcccacctcggtgccattgtcgtcctccctctccctatctcccccgccaccgtcgctcgcctcactctccctcctctctctctctctctctctctctcaccgctcacctcactctcactccccctcactctctctctctctctctctctctctctcccgtcgccgacggctacgaaggtgatgagggccgtcgccgcagcgtcggcgagcggacaacggtgagcagcgcgcggatctgttcgtcggcaagcggcgcgcggatctattcgtcgcgccgcggatccgtcgacctcgccgtcgaagctcctcttcgccacctctctcctagatctggcatgacggcgctgcctactccggttctgccccatcgcactcgtcgttgactccgcctcaccgcatcgaggtgaggggcaagaaggggaaacaaagggggaggaggtaggggacagggcaccgggtcgctgcaatgtgtaacctcgagggagtggctccggaaaaagggagctgaagagtcagaggcgtgcgttcccctcgtgggggtcgcacctccctctagggacacgcctcgcggacggagggcagacagcgtgaagcgggggcacgcattgtacgtggccttataagtctttggttacagagaacatgtaagcagatatggttgtgtattgtgtattggtggacgttgtcgtttgttgtttgcattttgcgccccaaccatctcttcgtgaaaagacaattccttcctctccctttccttctctcatctaagtcagcaaaataatcattttaacaggactttacttcctagtagtattgagttatatgtccaaacaatagctcgtatactcgtttatcttaagattttcattctgaacatttttctgcctttgaattgaagagtcgtgagaaacgccaagggtcttccgactaactccacgagatgatgggctagacgatctgggttcgaaaccttacctcttctaattattttgtattaggtcatttcctaatatttgcatcttttttaattgaagaatcgtttctcttaaagattacaatcgtgatcggaattcgtccgataaacatgtactatgtatgacacgttgacaaaacaaaagtactagccactaggcagccgccaaaatctgtgcagacttcatcaccttgcagatgctctccaggacttccatggggctgacattgccgaccacggtcacctttttgttctccagctccaccttgaaggacaccactcctgatcatgtcaatcgagtagagagatcactatatcagagtatcagctttcagtaagatcgatgaacatagtgtttaccagtcacattcattcatgtaccttccatcttcaaaatttgcttctcaaccttcctcgcgcagcaatggcagtgcatagacaccttcagtgctactgtctgcagtgcaccgcagcagcacatgcagaaaaacacagcattaagttactgacagagaaattagagaggataaaatctaaaggcaagaaatgctttcgatttcagaaacaactatatgcattttttttttctgaaatgatgatttcataaacaaggtagtacgcacctttggttctttcacagctgatgatgatgcgttcggttcgtcttcaagatcagtgaccggcacaacctgttccaagtggctcctcagcaggccgcgcctctcgctgcttccctcgtcttcctccaggtgatgatgatcttcattggaatgcggaaaccaacggaaagccttcttcagacctcttgcagccatacggaagccctctgattagacaccaattaaccagcttgatcactcttcaaatattagcttatatagagaattgacagaagtcacaaggtagaggcatttatatgagttgttgatctgcattcatgagacagccaatggcagtcctgcagtactattaacattgtagcttaaccaagacaaatatgcctgaaggaagatcctgtgagatcaacaaacaaggaatccataaccataagtccttacaacctcactggtagtctggtagatctatccgtccaaccactcaccagttgatagaaagttagaaatgattagacaactattatgtaccaggttaccaaccagtactgcatctcgatatcacactggactcctgtagaatggctgggtattaggttacctgatcgatagatatttcatctgaatgacaaaaattatttgtaaactggccctgcaagacagtttcgtacccactcgaagatgtcttttcagctgtacgcacgcgtatttgatatttcagtttacagaggatacgaaaaaaaaaagatttcagtttacagaggataccaaaaaaaaaaagatggtggtctgttgtagagggactctgggccagaagcgggcccaaggtgcagcagcctgttatccttccaccgatggaagcgggcagtgatcgctgctctgtgaagccagcctcacgctgtgcctgccactttagggccggagaagcaaagcaaaggccttcgccaaagcccctccggcccactacgcaacttggaacgggcaagccagcaagattacaacaacatggggcccaggatcagaatccacaccaaacatccgcagccacctttagtgcccccgcttgggttacaggctctcgctactgagctcggcgaggcagggtaggcgagctgaatatttaacttggtttccctctttgtaaactgtcgaggtggtactaaagaggtgaggaataaagctgctactcactaccgttttgtcatttgtgggtgtgtcttttcatggatttggacccccggcagttcttcctcttggaatttgtggcctggttcggcctctttcagccgataatgagttttcttttgtctcgttcgaaatgagtttttaatttttcatctttacagattggttattttctgccgtgctgcacgtaacccttgattctagtaagttttacagaaataatcataatgtaaaattcaagtgttcttttttttttatcattggccactggccagtttgcgcaggtaaatcttcagtcctgatttttttttatcactggtcatctattcgctaattcggtccagttctcataaacctataatttatgtttttcttgtaatgtgcactgtgcagctcagcgactgatcgtcaggggaaaaggttgctcggtttactacctttgaacattccaaatcatagtataatggtagcatagttaccgttttccatgatactcctatctcggcctttcagccagctaaacatctccctcaaaaccagaagtgcaatggacaagaaaaaatatagtgaaaactgagagttttgttgctaccaagatggaaccggactgactcattcaagctgtaaacttgtcacaaatcgcacccaggtttacacattgttcaagagatacaaactgcagctataaagccacttgtgctaacaaataccactataagaggataggtatatcagatcgacacaaagtacagtcgctaaaaagatgtactaaaaaacccaaacttttatcaaccaacgcagatcattattccaagctctcttcaagaaccgcccacatcttcagacgcaaccaacgaatttgacatttctcaacgcatcacaaccgagcaaaacctaaatgttcatgatagagtcagtcacctatattatcatcaaaaactgaatgcgttctctaaatcattgctcttacaaaaggcttaccacaattcaagcaacaaaggccacccctgagtctgctgtgaagtgacaccagcacaaacaggcgtttataaccttcagaacagtataaatcaagttaaagcagacagcttttaccagtttgtctaaaaaaggagagatacctatcaatgaagttaagaaaaaaggtgcactagaatggttagagagtatagtactactctagtataatttagatccaagaaaaagtgtctgggttgtgaaaatacatgctattgtcatttcttgaggcaaaataccctgtaacggttgctcatgtagaagtgttaaagaaagggataatgatatggagttaataggagcagcatgcttttttgttatatgacctaaaatggcatctaaatcaagaaaactagtgtaacattcacaatcattgtcccttacaaatatgctttggaatcaatccaaacatatcgctaaggtataaacagaaggattgtaaaaaagacaatgacgttcatgaaatagggcatgtagtgatgttaaatttacaagttcatacactagattgcacccaccagaaaagtttgtgtaccaccaatgcaatttactcttaaatttaatgttaggagtaaaatgagcagcaaatgcataccatttgctaaaatatattgtgtgcaaattagtaagggaattgaaaatgtcaaaatagggcagtacctaacataacttaggacaagaagccacccaaagtgctccagatcaaaacaggagatcactaagggcttaaaaatatagcctgcataagcatacaccacagataagtttgcaggacataaggaaaattgtaggtatatcaaacaaatatataaataactgaccataagcagcttattcagatgctattcaccttacatggtgcttcactgactgaagttcatctctgagtatctgcattaaggagtaaatacatgagctgaaaatcatggcatgaaaacagtatacaccaggtgagattcaaaatgttattagagaatacttgcctcctaggcttgttctgacgctgatcaacctcttcattgacaatatctgcaatgcaaaatgtcaaccaaatatttatggaagcaacttacaaattgtaatataatataagagtcaacatcaataaaggtagtatgatgtaccatttcgaggaggggaagcccccttgttagcaatagattccctgtaagaatgaataaatatttttaattcccactttcaaaggaaaattcatggatgatacaagaacacagatccaggtaggttacataatactaatgcctttatatgtatcgcgcccaaattcctccaaagtatattcccattcttatattaacatttctgaatcaaatgtgtatccaacagtaatacttcttttagccattcgagtgatccacttcatcagttcatcaatatacatacacattctgaaccagtacgtagttgagtactttgaattgaaatacaaaaatgtacatatatcaagctgggggctatcacaactgcatttgcagctaataatactagtcaaaacaagtgataatgtttttgaagatgcatacatggtcagacggctaagtctaaagcagatgttcagcactttagtttacaccaagaggcgcttttcccacagaaccagagcagcttaacccatgtatataagctatttgtcgattatatcctttacctggaaggaactgacgatgaggtctgtcctgaagatctggagtaaaaggctggatccagagcaatataaggtggatatgatcctccaaaagcaccagctgcaccagttaacagtggcaacctaccaaaccaacatttcatgtgttataagacagaataatataaaaaatcatgcaaataaggcccaacagtcagtatatagtttataaagacaaagaacaaaagcatcatattggaatccataggaaaataaatcagaactaaataaataggagaaaggtattattacatcttcaacaaaacaaaaatgacgccccaaaagagtttatgagcgaatattacttgggaaagcaagtttcagctataaaatcccataacatattatattgaaagataaaacaaaagcatttgtaacaactatcaattcctgctatcatagtttaattaaacaaaagctagacaaagtatagctagaaatcaaaacaagacgtgctattctaagaacaagtgaaaatactgtttggtgtaatattgtcttatattcaccccttgcagttaagattacatccagttgttacaccacagaaaatattattgtgaaaagcaaatctagtgagacaatgaaatataccatgtcatttcgttatttcccattcccatctgctgttgagccacatagccagggagggccataccaacagtaggaactccaacaccaccaggatgctgactgccaaattgcatgactgcattaacgatgaaaacaggaaagacaatgagttcaagtgatggcattggaaattagaaagtcaaagcaatccgattattacaagaaaagatctgttgaattactaaggaagcaaacctggaaggagagctggagtgccaggaaaattttgttcgccctgggcaagaccaatagccccagcagccccaataacctgggctccaccatacataaaggaaccccttcctgcttcctgactgttggtttttcctgccccagatgatgcatttgatttgttcgaactaggatacagaccattctcaacactttcagttgatctaacaggtagatgctgagtggttgacgggttgccagtgcgatggttcaactgctgagttggtattctcattgcagattgagtttgcacttgccctgacttctggtgcacgactgatgtgtgactttgctggtgtgtaggagccctaggattttggtgaagagacgaagtggactgattgtttgaaggaatcccatttcctccttgagttctaacaacagaagattgaccatgattaactgtcgatgctgcaaatcctgatgaattcaacgatgttcctccactccttggagattgtctaacaggaccatcagcatgttgaaacctgtcacgtgcaccataatcccttctaactgctgggccagattgtacctttgcattgtcatccatcttcatagaagatggaaagactttattggaaccccctgcttgcatattgtcccttctttgagctggcacagagaaatctgggttggaggcaccagagggataaaatggtggtgacgctgaatttaagcttgaattcacaacattctttttaggaggggccatttctgactgcgcatttaaagtttggccactctctctgacggctgaagcacttgcagcagactctcgtgatcttgcaggtctgaacaagtaataataagataattatgtaaggcgaaaatcacaagcaaagctgtgcagccatgaaacctatttacagtcaagtgtccccagtggtgtgtgcagtattgtgtttttgttgggtagttgggaaggattcaaaataataatcacttactgtttccgctggaatccaacaacatctcggttgttctttgcaacagcttcataacgtcgaggtcctctccctctaacaaccttttggggtcggttttggtggttgttgttgatatcttcattataaccgcgatactttccacctctggcaaacccatgaccagtgccccgagttctacccccaccaccacggcctctaaagcgaccccttgacattcgcttatcctgcaatgcagaaatcctacctcaatactaacattgaagaaaaagctatcatttgcacattaaaggaattggacagatacctcatagtgctcctcatgcaaattcatttcctcaaatctgtcatgcacccacgcttgatcatctttagcgtcccataacttcctcccaccaaacattctcctgctttcagaagaaagtaaaaaacaaaatcagcacagttgaagagcaagatctcatttagcagccactactatccaatgacagactgcagcagggtcaaaatataacgataaccaacatgagccgatgctcaatagattagctgtagctactatatatttagcagacgcttgccaaccagagcatccatttgcagaggagatgcaaaatataattgacccaggaagctaaaacatatggtggaagaagaatgatgaacatgctctattgctgattgcacattgaaaatcgttagcatacaaacaaaaggtaagctcgcagctcactcttcccatgttggtcccaacaatgtggcacagtttttcatcatcatggaatcaaatagagggggtgacaaaccctctaatgaatgcccgtggatatttacaggttatggggttttctgcaaaatagaaattactagcctgccatcatgggttgcaacaggtgtgttgcaagctgacagtgacatgtcaccggtgagcaccatgtggaatcattttgcttctatggcctgtttgacccgagtccgcatcaactaagcaagttgttgcaccgaaatgagtgttttgtaggttattgcacctatttgcagtccatgcaccatgagtacaatttactcttcttatagctaaattccaacattctatgcccaaaaacgatcattaggcatttaggttctactaaatatgcagtgattagccttctcattatattaaaatatgtcctacatattgcatttctaaggagtattcataacggccatctcatggcaaaaaatgaatttattcaattcacaatcagcccaatctaatcccccaacccctcctcttttcttctccggtgttagctaaacttatgcattagagtacatgcttaataaacattggctcttgtcctactaaaaccctagcattgaaggaacaaacaaaattctatgtagctaacctccaggacagcatcttaagcatcaaaatttaagcacacacaaatctgagttactgtcaaaaacaagtaatagcaagaaccaaggttgggaaaatgtgtctgcattagctcccaacaaacaagtatctagcacgagtccctggatttcattgtaggaacatatttcatgtaggactccctgaaaaagtggtttcactggacccttactgtggattatcatttgtcattataacctcattcaaacttttcacgtttcctgatattttatcagtttacagcttgatcactatgttgattttagtttcgagcacgacgacccaaacatattcaaaataaatgagttcagatgctctggtaagttatatccttcattttctacatagttcattttcaaagtttaaaatttatactaagcttaaagttcagttttttcttgtgaaaggcttttgcctgaattgcatgtgataaatccccctgcgcttcctcgcctacctttggcatcgatgcctcaattcacagattcactacgttttgattatgcccgttttactttgctgaagtataatgcagctctggcttcctcgaggccacagccacagcctacggttgagcaatagcaattctaccaaaactatgggtacagcagataaggcataagtttttcaggaagaactcacctgcggcggccacgactctcctcttggaagcggtcatcgtgcatgtagaaggcgccggacgtgggtaccgcaaacggctcctgctccttcttctcttctccatccccttccaccgccgcctctccctccacgtcgcccttctccccatcctccccctgggcaccggcgacctccttgggcggctccgcgcggccgtcgtactcctcctcgaagccctcgccgacctcctcctccgccaaatcatcgtagtactcctcgtcatcgtcctcgtaggcctcgtcctcgtacacctcggctgcgccctgcccgtcgccgtcgtcgccgtcgccgcggtcggacccgatccgcgccctcccctcctcggacccctcgtcgtcgctggcctcccggcgccgcatctccgggagcagcgcgtcgtcggggtcgctcacgtactcctcgtcatccccggaccccgccgtctccgcctccgcctccgcctcctcgggcgtcagcggcgccgcggggggcttctcggcggcgtgggcctgctccggctgcgcgtccgccggcgtcgtcgggtcggccatgggcgggcgggcgagcgaagcaaccctagatttggctgcggcggtgtggtgagattttttcttttttttttctcctttttcttccctctctctccgtgggtttggtttggtttggttttgtgtggggaagcgagacgaaagagttcgaatcgaagggggagagggggggaggcgtggaacggaacgggacgggattacggacggggcagggtgagagcgaggcggacggggcgtggaacggctacggcacgggagggcaaagcgcgagttctcgccagttttttagatgtaaacgtctacagcctacaggtttctctttggtttttggatggatacaggagcagacggttgctcagtgcggatttataattcggcattgctagtcttggtgttaaaatattatagggttatgattttatccgtgccactacaaatttatttatttagataaatgttatatttaaaagggggtgcgacgtataatgtggtgagaataattacatcgtcgaattatccttacgaccattagaccgagtgattatacggttagaaattttctatgcacgctctttcttttaatcagtgcatgtacctacgttgtaacggggtccatataagtaagggtagactataagtgtgattgaggataaaacattgtattcggtggttacatacatacgctatgtgtgggtgcatgttgagagcgtcgtggaagaagtggacggaaggaagatgagttggcttttaagctagtagagatgtaggtaaaatatttcagtcactttgcattttactgggccatgtacgagcggcacctacggcctacaaggtagtatggcgcacaaaccaacagcctatgttggccgagctagcggcaattcaaggaataagttcacttttcatccctcaactttacgtcaagtttgtttgacatccctggtacaaaaccgtgtaacttgtatcccatggcagtattgacctcattttcccatgtttttgctcatgtgtcagttgtccggccccacttggtcaggttgcagtgacagtgaaagatttgtgcaatgacgacgatgcggagaggagtgtaggcgcaacaatggtgatgacgaggttggacggccaccacatcgccgctggctccaccatataccgccaaaatatttccacccacctgaacctaagcacctaatcatccacaagctcgatcgctttacatgatataagcaacaacatgaaacaatcatgagtcgatcaaatgatccatggtcgaagatgataaaaaaaaagagtcacttttgatctgtcatggatggtagaaactagcaagaaaggtgtgtggaatgtgagcataggacgacgaagaaggagatgtgtttgccatagaagacgaggatggcggtgatgacataggtagcgtacaccgtgctggcaccaaagttggcaaagaaggagatgaacacgtgctccttcacattgagcggctccgggttgagggtgaactctaacggccgcgcgcgcgcagaagaaggcatgctcctacagtaccaccgccatgaggcagccaagcggcacaacggcaatctgcaaggagatagcagtgatggtgtgcggcttcgggtagtaccagaagaattggttgagaaaggagagcaccgcgcacgacgttatccctagactgcacatccggaacatcagcaccaacaactcgtgggtgaagcccacgcatatcaaccgcaattgatgcatgttcttaaataataaaccatacctgtgtcggagacaccaccagggctgagggagcttaggcttcgggaggtcgttgacctcctcaattgttgccgcctcccgcgataggctcaccgggtatgtcagccgccttaagcccccttgcgatcttctccatgccggcaagctgctagggaaaagaggggagagatggagagatgggcaagaaaggggataggtggggagaggtggaagtctacttacgcgtgggctctatatgttttcttttttctttttgctaactaggatgtcacatcagacaatacttaacttaacttggcacatcatattgccttagacaaacttgagtagttttgcaaagataaggggtggagatttttggtattgcgatttcagggacgtaaattaaactcgtcgtaaagttgagggattggcaagtggacttattcgcagttctactaccgttaccaggcccctttttgggccgttcggcccactacaccccaatgtattgtcgtgggccgtgagaccaaccggatcagagaagcgtgctgcggtcagcgtcacaccgaaaccatgacctacacggctacacgcgcgcacgccccgcctcgcctccgcttttctttcatagcttcgtccatccatggcgcagccgtatcatcctcagtcctcgctaagctagctgcctccatgcctgtgacaagggagatcatcgccggagccggagccggatcggcggcggcggcggcggctgtactggcgttgctggtcgcggccgccggcggtgacgaattagcggcggcggtgggtagcagcagcagcatcatgccgccctgcttccacgcgtgcttcgaccagtgcgtgcagcgcgaggagtactggttctgccagttctcctgctaccgccggtgcggcgccggcgccatcgccatcgccatcgccgccggccgcttctccggcaccggcgactgcgagcacgcgtgcgcgctgtccatgtgcggccagatcgacccgggcagcaagatgatggccgtgtgccgcgacacgtgcggcaagagctacgccgccgccgggtgccgccgccggccgaccagccttacggcggcagtgtgattcaatatttcgaccgcgacaaacaggattgccttaagcatgacgaacatctcgaattaattctcgatatgatgttaaaacacaaatccatgcacaacatattaacacaaatccatgtataataatactcttgagatggctaaattattgtcggagttgtgctccaatttgtaataacgcaattaattacgcaaggtatatatacataccgccgttcgatcgaatcgaattaacagtcttgtcttgagtcaactatgacgtttgtttctcgctgattatctgccatacaaattaccatgcggctgatctactaagtactgacatggattaatcaacacggtggaaaactaattaagtgcccagttactgtcacttgaacacggattactgccttgatccctagctacttctgtcagaccgaataccataaacgaaaatgtttaatgattctgtatgggctgcttggtgctttcttgtgtaagtgttctctcatcatgacagatcaaaacaaactggatttaatcgattcgaactgatcagctgaccacgaagagagatcgattacccgcgcgagcgacgcacgcgaatctgttccccgcgcgacgccgcgacgcgaacaaaagcgtgaattcgcaagctgcatgcccagctgcacctctctgtctctccgatcgctcgaaacgaattcagttttcgaacattccgtgcacggcgtcgaatcccggagccctcgccatcgcccacgccctcgcgcgcacccggaacgcgtgaccccctcctcctcgccgccggcgcggcgcgcgtgcaatgcaagcgctaatgcgcgcggctatatataccgcgctctcctcaccgaagcaaagccaacccgttcacacctcaccgagcgagcagctagctagctgcggcgatggcctccagagcggcggcggtcgccgtcctcctcctcgccgtggcggcggcgccgctcttcgccgcggcgagcgcgcatggccgaggctaccttggtgccaaggtacgtaccgacaccccgacaaattaattggttgtccacattaagaccaaatttactgattaattgtatctgaattcttgtgtcgattagtcctggcctcctgacggcagcttgagctcatcaagctccggcgaggctgcagcggcggacgtcgacgacggccacacggactggaagtgctactcctcctgcatgagcaagtgctgtcaccgccacgacgacgacgacgacgacaaggccaatgccaaggccaacgccaccgccggcgccgccgccgtcgggctcgacgatgactacaagtgcaagaagcagtgcctcggcaactgcttcaaggacgtgccggccgtttgctaccacaagtgcgtcgacgactggtgcgcgaagctgccaccatgtacgtaataaactaacacttcgcaacgtgatgnggtnctgtgcaattgaaagtcaaaccaaangcccactggggggggggnggnnggtatacagataggagaattgaaanaatgtttnnnanacgcgtcnnntatattnatgagatcgggtaattgatagatataccgtacantcntttatatccagtcgacgttcggt

SEQ ID NO: 77775 - DNA, 822 bp, Oryza sativa
cagacagccatgaggatgatgatgatgctaaacaagttgtgccctgacgcgtagtcagtcctcaccatcatcacctcatcggcacgtagttcatcaaggtcactggagctcgagaagaagcttaatagagcatggatcatgaaacagatctgattttttgtcgaatgtacgttagcagaggatggtgaggacgggtggtcggtgaggcacaacagcggcgccgaagtcgtgagcatggagaagggcagtgggcagattcggcattggaggcaaaggacgtcatgtgtctaggaggcggctcaggtgggggcggcgacagcggatccagtggtgcagctcaccagacatagggtaggggaggtggggcaggggaagcttgccagagttactgaagagggcgatgtgatcaacatgtaggaggagcaggagaagggagggacacagagagtgtgtgtggcgggattctcacccagccaatggtgatgctggtcagttggtcaggcagcgaaggcggcacggattggcgatgggccaatgggcaggaggagaggagaggagatagggttatgtgatttgcatgaatcttgatgagatcttggccattcaaaaatcagctgagggatggagaaatatcaagtaactgattacggcccattttcttaattaaatattacagcaaatatggtgttcctatatgatggagactagaggagaaaacccacgcagctgactgtgtatggtctttattaccacccttcttggatgccgaaattatgtggtgtccacacaaatagaaataactgaagcagaatcaaggtaatt

SEQ ID NO: 77776 - DNA, 785 bp, Oryza sativa
agtcttagcatatcaatttagctatatcggctgcttctcaatttagctctaaatcgcgttgctagattagattagcttagacatctaccaccctgaaaactcagtcaacggcttgattgtctagatattgtgtttcttttcatacttagtgctgcatcagttaagtttgatccactaagtcgtgcttagaaccataatctctagcctgcttcttgactgccaataagggtttcatcggggtttcagccgatgagttatctaggcgttgcatcggcttacaaggattgcatacatattggatttagccgatcgcaacatagattttactgtttatctaatcctgtggatttaatgacatcggacctccagccgatgtatgctttaaccttcggatcagtgcttattatatcttgtttctagccgattggtttatactagattatattgttattttattacatcatcatcagccgattgactttatatcattatctacattggacatatagccgattgcttaaaccctatcgctatcggctggtatcggcatcggctattatcagctatcggctggaactactccatcggcttgtcagccgatcggttgttttgatctactatttgcacatcttgtcagttgcaggatcaaactgactggcacgcccgcatctcatcaaggtttggacctgcacaggagctaagcagatctcccaggccggtgtgttcgattttttttcgtcaatagcggcacatgaccggtgataaaaattggttctcctctctca

SEQ ID NO: 77777 - DNA, 2386 bp, Oryza sativa
agattattataagtaatatataagttattagtatagttttctctattataatcttcccacaggattaaataaatacgatacccttgtaatactctcgggtgaaatgctacaatggtatatccatatgcttgcagatgaaatgtgtaaccataatataccacaagtgcttttgcgccattgctgggaattatatttctagtaatgtccttaagaaatagcaacaagcatttctggcgccgttgccgggaaagatttataaaagagattactataagctaatactttatatttacccttgtatagtccctgtcctttgcaggctaaccttggttgttttcactgttgttgtgaaaacagggtagtgtatgactggtttcaacttaccggaaaatttcaaagaaaatccaaaagttttctttcggagcgttaagccgcaagtcgtttctccgcagaaaactctcccgacaaagaaacccgctatcctagcgtcaccaagcttcaagacaatggctgaaaggactctccgcgagttcgctgccccctcagctgagaatgtgctcgttgggccgcaagttagcttaggagacacagactttgatctgaaatcgagccttattactatggcgcaggctaacgatggatgagtcgatccccaaagcttgggaacgactccaggagtatgtggccgcctgtcctcatcatgggatggaagagtgggtgatactccagagctgctacaacgggctcactcccatgtcctgcgaccacctggacgtggcagctggaggagctttcttctctaagacggtcagaggagccgtcgacctcatagagaagatagtctccaacatgggttggagcgaagaatgactccagacccgtcagcaagtaatgcacaccatcaaggatacggagatgctcgctgcgtaactagacctcctcaataaacgactggacgaccatgagaagaagccccaaggcaccgtctaggccttgcactcgcacatcacgtgctaggtctgcggtagcacaggtcattttgggaacgactgctcggaaacccgtgaggaggcaatgtacatgggcaacaaaaacaacaatgggttccgtccacaaggaggtcaagggtggaaccaacccagcccgtattaccaagggggcaataatggtaacttctctaaccagccctccttaaaagatctcatcttttcacaagctaaaactactgatgctcttagcaaaaagctggctgccaatgaaaagatcttaaaaaatataaatgtcaagctagacggcatttcttccgcattccaaaatcagctaagctttaataagatgatagagacccagctggcgcagctagctgcctttattcccgctaatgaatcagggaggattacgggccacctggtacactctgttaaaaatgttaaggcgatcacaacaaggggaggtaagtccactcgggatcctccatatcctaaccctgcaggaacaaggagcagtagcagccaggaagcgctgcctaacaacacggctgagacagaggaggtagctcagcccaaaggaattgtgccacaagagtactgcgacacgaggttgctaccattcccacaaaggtacagtaagccgtcggtggacgagcagttcgctcgtttcgttgaggtgatccagaatatccacattcacgtgccactgctggatgctatgcaagtgcccacttatgcattatatcttaaggatatcctcaataacaagaggccactaccaacaaccgaagtggtcaagctgacggaagaatgcaacaatgccatactctacaagatcccgaaaaataagaaagattcgaggtgtcccacgatcacttgctcgtcgggatacagaaattcgaccaggccctctacgaccttgaagctagtgtcagcattatgcccaaagaagtcttcgacaagcttaacttcacggtgttggctccaacaccgatgcgccgggagctggccaattcatcggtccgttactcagctgggatagcggaagatgtgccggtcaaaatacgggatttcttcatcccagttgattttgtggtgctggagatggagtcagacaaggagacgccactcatcctgggctgtctgttccatagcaccgcaggcgccaacattgatgtgggaacgggaagtatccatttccgtatcaacagaaggaatagaagttcgagtttcagccaaggactaagcaatgctccatggtgagaatcaaatacgggccaaacccatagaacatccaagtgatcgaagtggagcgacctcagacgaatagcctagtgaagttcatatggaacttcctgtagaagggaacaccagtacctagatcctgtgaaaggaag

SEQ ID NO: 77778 - DNA, 641 bp, Oryza sativa
acgcaataatgaattatttttgaaaaggaaaaggagggttattgcgtcagcgggctagggtttcggtggaccgggcgcacgggcgacggctcacgcgaacggacggccgagatcgacttgatccaaaacggacggccgagatcgatcggtccacgaccggctcacagcgaacggccccgatgacgtcggcgatgacgtcaccaccggcggcggcggctcgggcttgcatgctcgccggcgaacgacggcacggcggcgcgaacggaaggcaccaacgggtagagcgcgacgcggcgaactcaccggtgaccaaaagagtggcggaagatcaacggacggcgacggcgacgaggaggaagcggcggcaaacttcgggtcgacggcggcgacggtgctccggcggtcttcggcggcggcgaaggagcggacgagaacggcggcgacttggcgatcacgacggtggccttcccgagcgatgacgacgaccgagacggcggcggcgcacggctggagcgacggctacgacggcggcgctaggttgcacggcgctagagctcttccggcgacgagaggcgaaggcgaaggtggcgacgggtagaggagacaccggggaaccttttaaaggggctcggaggcgacgg

SEQ ID NO: 77779 - DNA, 9567 bp, Oryza sativa
ttatgattttcactaagaaactatattgatacatatatatgacaactttacttaaaaaatgacatggtttgaaataacatcaatataaacaacccctaagtttagaggcggtaattgtgagtgctcacttttacttctctcttggtacagtaaatctggaccatattcgatgtactacctaatataatactcccttcgttttacattataagttatttaaatttttttttctgagtcaaagatttttaaggcttgaccaagttcatagaaaaagttagcaatatttataacactaaattagttttactaaatttaacattgaatatattttgataatatatttgttttgtattgaaaatgttagtgtatttttctataaatttgatcaaacttaaaaaagttttgactaagagaaaattcaaatgacttatatcatgaaatggagtgagtacaataaatatgtactagattatgtctcatcttattctaagatactctctctgttctaaaataaatcaatctcatactaatatatgacatatcataatacaataaatattgttatattttatatgcagatttattataataggatgcatcaaattctagtgcgaggtgaggttaatttatttttggttgacggagagagtactgtacagtccgtactaaatcaaaatatagccgatgcatcaagccagttttttctttctcctgtgcgtctcaaaggtgccgggtatggaatcggcacctttgaccctggctaatcagtgccgccttgcgggtgttggttgggcaaaccggcacctaagaggttttccatcgggcaccatttaggatttctgtactagtgtttgtatcactcaacgtatattgttagactaattgcttgtcaaatttatgaagtttgaattttaaaatggtgcacgccgaagcgaacatattaactaaaagtagtacgcgttgccgttagaaaagaaaaacagatagataaccaaagaataagattttattgcactctcacatgtatttatattggtaaaagagctaaatgattatatagatttatcgtttctccactattataaaaattgaagatgtttttgccgagattttggtatatcatccgtgtgtttgagttgatttctaatttcatctttatctttttttgtctgtcttctttttttcgctgctttttttttcgattcgttttttcattcggtttcttttgctccttttttttcgctattttttttatctggttttttttatatctcatatcggatatgttgcacgccgccactgcttaccaaatctagcgcagtcccacttcaatatgtgtcccatgcgttttctactccaattgattacaaaaattgattccccacacctctctcatcatttttttctcacaattttcctttcaattcgctttaatccattggatttagtttttgtcgctgatgatagttggccggcctttaattttgcggattcgttctgtttcggaaaagcggaaagagtagatcgagtgaatcaaaacccctcgaccaattttcagatataaaaaaagatttgactggatttgatagggagaatcagctcctgcatacgggcataggactaggaggttgaagatggtggttggatgtgtgaattaggcctatagctccacttgtgggctggatcagagagataggacagtcggctgtacgagctgggcatgtcgctcgatttgtgggctagattggagagaatcaggtcgagcagagggaggaaagaatgggctttcgacccaaacaaaggaacaatttttattaagttttttaattataatgtatatatagtgatcctaatatttcattcattgctcagttcctaatagcggttgtaccacggaaaaacgtttttacccgttgcaacgcacgggcatttttctagtagaagaaaaagacaaagaaacttatgttaaaaggtagagcccatcggctgactaagagctgattataagtcgtaacggctattactgaaaaatactaataatagaacaaattaagagtaagacttttatacctgtattgttagcatcttaaaactcaatattaaaaaaggggactacgataaaaatactctaaaatcagctttaaaaatatttattataaacgagatgaggacttacaatacgtagtgtgtccgctcgggactactgtcgagagggcatggaattgaaacgccttagcaatgcttcgcggcgacggcaataaacgaagagagtttgagcatagcacagatgacccgatggatggcacgagcgagtatatatatgtacaaatcgttcatgaactgagggcacgaatgccgcgaagacttcgtataacaaatcgggggtggtggtcagctcagatgatgacatgtgaacaacaaggcgaagacttgagacgacgtcaatgggcctcatcgtttggaacagtactaacctaacaagttgttgggtttgctgtcccgtgtaccatgcatctgtttctgaatgtaaaatctctttttagcacaaattttatcacttctatagtattgttatttatttcattaatatcctcttattttaatctatctataagttacggacaatcaccattacatttctacgtttagggcaaccatattgtggctcaaaagcagacagtaagcaatgaatacacttttattatcaggttataagcattgtaaaaagaggtaacaacaactacttgattgtagtgttactaccgggtagcaagcataggaagttagcaaccaaatagcagataaggaacgtagcaattctacaggataggaaataattttttttcttggtggacccaatcttattctctatggcaggcaacaaacattgtgccctctatcataaactattacctcctgctgcttgggcccacactaatatcaagttgggttggatagactggacctgttctgctgcccgggctgcggccgcagccggcaagaacagtgctgcactcactatgcacgactgtagccatcacagtcggcctgccgaacatgcccactgagaatatccttaagagggagtggtggtggtgaatttgccacacctttaccaccgtctacttttatttttgcaaacaaaaaaaaaaggtcctacatgtcaagctccccacggtcaactttttacttttctgtgagaataaaatatataatgctgttagtaacaaattaaataaagaggatatatattgaaaataatggtaataacgagttaatgatatttttagttaaaacttctgttgcacagataagatgctaaacaacccaaatatatggccttattaatttcgcttatgcctatacttatattacttatattataagctaaaatttaaattataaaacttaatattttatttttctatcgatgtttatttcacaacatttatttttatttttgttactaaggacacgtatataaaatttacttataaattatttttatttgctaataagagatataaaggaaaaattggaaaaaccaccccataaatcactcgaagtttgacattccacccataagttattttgttgcaaatgtccactcacctactaagttttgttgcaaaaaaccatcccagtaaacacatgcttaatccaatcaatatgttttcataaagtgtgagcgattaatgtggttttaccaaaattaaatacttccagagtattcttgatattttttttgagataccacaaataaaattgcagacgagagcttaaacgttgtcacactgagtttctctatatgaaaaaaagttcaattaaatatggaaaataagtctaatgcaaacgcttggacggtattgacttggctagcttagtctgtgataactatacaccagcaataataaactgatttgattaagtatgtgtgcattatggtgattttttttaacaaaactaagtagagagtaggtatttgcaacaaaatgacttacggggtggaatgccaaacttcgagtgatttatggggtggtttttacatttttccccgatataaataagcacaacaataggactcatgcttattttctaaaactaagaggtaaggcaacctaaacattctagacttgtcttttttttttttgaactgagagagagtaggtggctgtcctacctgcctgtcgggtgtaccggttagtagtattaaagtcgcatattaacttttttcctacaattaatttacactagtagtcatcccatatatgtatatctattaatttcatttcattattgacattttacattaaatttgcctcatcgatgttgatatcatttggcggtattaatatgctacttttttattttcggaaagagagagctctatgtattaatcatttgagggattacaatcgcgagcttttagctcggaaacacacgccggtgcttgcaagcacaaaaccaccaattgcttcaaggcaaagcaagttgggctaaactatatgctactttattaggacaagttttacaaaagagatggatgtcacagctaatcttgactataacatcaactaataaatatatgtaacatgtacaatactcccttcttccaaatgtctaagacctatctcttttttatcaaggccaagaagcaattaacccattcaccatatgataaaaccaatggacatggaaccaataagtactaaaataacttcttcgattccgatcaacaatttaatttagtacatggtgactacatataggacttagacttttagaaaaactaaataatagactaagtcttagactttcgaatggagaaaatatatcatatctatactagttctagtgcccccaatgtttgttcgcccaatctactcttttttgtctctctccttttgttttgaattttgtgcagtggttgtctcttacatgagggggtggctccttatctctctcatctcttctctccttcacctaactatttaagcttatgtagcatctaggagattgtgcttggatgcttatagtatttgacgtggcggacgtgagcctattttttgacgcggtcggactgaaatgccccggcgccttatctcctcatattgcttgctggacactaaattgcttgctggacactaaatacataggtagatacattgtacatatatgtgacagatataccggcgtggactacgttctatccagccaccgccgccggcgagctccaccgtcgtcatggttgtcgcaccgggcgtgagaggtatacacggcattgcatcaccatccagccaactttgaaccccagcacgacggtgaacccgacagcgcggtcaccgctgccgcccccagcgctgtgtcactgtcaccgttggcgtccatatcgccccccggcagccgcctggaagatggtgctcacaccgccatcgaacgtgaggaagaggcaatgcagtaaccagacgtggcgcgccatcttggcgaactcgacgaaccatggcgtgtcggagaacgcgccccagcgctcgccacggcgccgcgctgcgccgtgctcccgaagaacaccgcctccatccgcttatgcaccacggacaggtacccgtcgcacgggaactcgtcgagcgcgccccaccgcgagctccgcgcgtcgaggaactctgccgctggtgccgccttaagctccgcgaactcgtcgaagaaccgtcgccggtcataggagctccggtcgtggagggcgctcaggccgaagtcccactggtggaagccaacgaacatattgagcgtgatgaacgactcgagcgtgaacttggcatcgccggcgtggcacagcgggacgcccgggtgcacgatgagatcccaccccgcctgccgcatctcgccgatagaaccctagctcaatatgaggagataaggcgcaggggcatttcggttcgaccgtgtcaaaaaacgtgctcccgaccaccacgtcagcacagcaagttttatatatttagacggcgaggtccatcggcaaatatcgacggttatgtagtgtctttccctaaaactttgtttttgcgatatcttgtagcaaaatttgccatatatcattgaccaaatttacctcaagaaagaagagaagattgtcggaagattgttcctccagccgagggtgtgtcgcttgccatataactagaattaaacactggaggatgctgccatgtggtgcggcgtgtggatcgccaggtgtaacaccacaggtaaccacttacctagagtaccacaccaaaatgcactcaaaaccattaacttccaaaattattagaaatttcagcagagtctcccctataaatatggatatccatgacagacagttataaattaaactaataataatatcattcccacagtgtgatccatccatataacccatggaaagaaactaatagatatctaaaggattatttcaagaccaaaccaggatatagtttaagtgtcattatgtacctaagcaatatagtttgatagtgcacagataggtgtgtatacataggtgtgtatacaggagtgctacttcccgcccatacatgccgatctcaatgtggacctaaaaccgaataaacacaagagtgagtacagaaatagtcagcaagtacaatatggaactagaaaacacatatacacatcattggcaataaagcatgcacagaaagctttttttctttgataagaaacacatttttaaacaccaagtcaaagaaaaatagtagttcccgtcccgtgcaggcatgaattgaaatagtagtttacatcccggacaattgtgaatacatcctagcatttgtcggcaaaaccgagtaagcgtgatcaacgcttacccacaggaacatgaatagaaaactagatagcacatccatgactcgcatggagcatgaataattgaaaaaaaaaacaaagaaccaaattgaaaccatattgcacatccatgtcaagcatgaaacttgaattatttaactagaaccaaaatccggaatattaaaacaagaataacattgtaaacataagatgaactcgaaatctaaatagcgtgaacaacaattttgaacataagcagtcacttgtcacaaacaaatatatcggaaataaatagatagagcaaacaatccataaatcacacaattagttcgtcatgcacttgcctccaatcaagggttggtatcatgcacgatctgaaggaccaccacctaatcacaaacaaaaccttaacaaacacattcaaacatgcatataaaacaatgaaaaatgtgaacctactcccccatcccatcaaaacacaattacaagaaacgccgcttgcactataaacaatactgctgcttcaaacctttatatcttgaaaaataaaaaggctatgactgaaaatatatacattttaaaaatctacagaacaatacctacaacttttatgtagaaagcatatttttattctaccatttaaatggactaatttgcgcttgaaagcaggcttcagaatctgtctagaatttcagagggcatatacaaaaacaactatatctggagttctactcatctaatcaaagtgtattttaccaatatggaaatctcggagaaaactctacaactttgtctataagaggcctgactgattccgctgtttaaccactccaaaaacggttcaatctactactatccagattatgacatagaaacaacagttgtactaaaaaatccatatcgcctaaaccacttgagataaattcgcgccctttggtcagaagatagatccaaatattatctacaactttctagttatacacttttgcataaaatatcatttagacctccgaaacttcgaaaaccgaaacaatgtaaatctgccaacgtggagaacagccaaattgaatcacaacaaataaaactccttctctaaccttccttatccacgaattaaagcactaaaaacaccctagaacaactgatagtacaaggggataaacctcacttagagtttccttcaagattccaagggaaaaacaatggggagcactgatctacctttctcctttctcctctcctcctccttgtttcgtttttccacttcgtttcttgttcgaagttcatggggtggagatctatgaaggcaagttgctgtagaggagtgggggatgtgatatcacatacagacaggaggaggggagggagaatggcggcgacgggtgagggaaaggttgggtttccggttcccctcctctctctctaggttttaggggagaatcaatgggctgggaatgcaactcaaaaccaataaccaaaccaacatatgttttttttatttttttcgaggtgttacaccgagtcgctacttgcctcatgacttgcgtggtggaattgaaaagaaataagttcactttgactcccggaaaagtgactcgaatctaatctatccatgaccctcaacagcaaaacctgatatcgtgattcctaaattgttaaactggtgcaatttaactctctcggcggttttggaggacagtttcactaacgtggcacctgcgtggccgtattgacgtggcacttatgtagcattagaattaaaatatatacgtgaggcccacttgtcatcctctcctccttcaccttctcttctctattctctcttacgcagttgggcagcgatggcaggcagcgctgctgtgggaagtggaggagagggcagcggcgggcaggcacagggcattgctcagcggtaggcggcgttgcggcgggagatggaggtgagggcagcggtgggcaatagcaggggcgctgctcggcggaggggctcgagggccccacaatttgtttctaaatgggtcccatatataatttttaattctaatgccacataagcgtcatgtcaaacgccacgtgtgacgaaaactaggtcaacacagccatgtcagcgaaaccgctgtacaaaaccaccgagggagttggattgtacatgatttaaatatttaggggctcaagatatctggttttatggttcagggtcacatttaaaggagtcattttgaaattattccaattggaaatatcgtggcgaacatttaggatttgccgcacggcgcatgtgttaagactttgccacacgtccaacttacactgggttttgggggcttagacagccgcactgatcgccctcctccagggccgggcctgtgtcctgtgcaacaatctgatgcattgcgagtagtcctgtccttctggatctctcgcgtatgtgtgcctgggccaatacagacacccggccagactcagtcaccatgcgaatttttttcgtttttagatttttttttaatatttacagaaataatctatcgaccaaaaaaattacagaaatagcccctgccgccctaatggtgggcggcaagctgacgtggcagacggtgggtcgaccgcgccgtctgccgccgtcggccaaaattgcgattaggcccctgccgcccgtacagagggcggcaaggggctaattgcaattttggccgcccataaagagcttgcggccgtactttttcatctggg

SEQ ID NO: 77780 - DNA, 804 bp, Oryza sativa
ccaagcctacttgtcggtctcccgagccgtagccactatcacgcgtcaccgccatgaggtccgcaatgcgcctgcaccacccacaccaccatgcctgctcccgtgccgaaccgcctctttggcacttggctcagtgacgatgaaagcaaagagcaaatttaattagcctgaggataaatttctctactcggataaaatctaacgtcatttactcaaaatgagacggaaatgctacttatcagaaggaaaatcggtgacctgtgcttttaacttaagaggaaaaaaaacgtgtgctaatttttttacccttttttcagatcgaattttctctcaaatttttagtcaaagctatagcacgtgccacgtggaaagaggtgatacaatattttatttttgcaggtctcatcggatgaaaaaaatagataatggtggacttaggtgatatgacttatctatagctagcagttatagatagttcaatttgtacatgctataagacaagatttgattcattttttctttttttaaaaaaagaacagagcaactaggtagcgcctcaaataagacaacagtatggtcgcagctgctcgaaaaaacagaatgcatcactctggtatattccttttaagtttgagggaatctggccagccggccatgcatatagaacccacttaggctgtgttttccctttaaacttctaacttttccatcacatcaaatgtatggacacatatatgaagcattaaatgtggatgaaaaaaaccaattacacaatttgcatgtaaattgcgagacggatctttt

SEQ ID NO: 77781 - DNA, 19431 bp, Oryza sativa
aagggacccagatgaaaaaagtatggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtctgggtcgtagaaacattatatggacttaaacaaggagaattatgtaacatgaagaaatagtagtacaatttgaacatgatacaactatttgcattgcggttacatagatgatattagattcgaactaggagggaggtagtgcaatagttgaacacaacgacgatgtagtaatgggacaaggaagcatgacagtagaaattttaatatgccaagttgtccgataatagctaacccctacgtgaggatccctctcctctcttaaaccgcgctttagtaaccctgtattgctttggtagttcaagctgcacaacacggctaggtggagttagaacccttctggtgtctatccattctctgtattgacatctccttggtggttcctgggaggaaagaatagatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagcacccgccagtcgctttgttgttcacgacattgtcgttcataagccgcttttctctgtaagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtgttacgaagaataaagcgattgcctatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctacgccagtttggatcctcaacacctcggcgtctagccattgacgaaagccggtcggatttgtaatgaagcaagtggggaagagagtactgaatgtgactgagttctgaaagattgtgaggcctcactcgttaaggcgacttatataggcgcaaaaaatcgagtgatacccctgacatgtgaacgtggtggggtatggtgggtacgcctgattggcgccgaaagatacatgcatgatcggcgccgaaagttacattggtcgtatgcgccaaatggcgggcaaatactcgtatcacacgcgaataaaggaggctgcatcggtgcggcagaaagtagtcgtgcatgcgccgaaaggtatcgtgcatgcgccgaaaggtatcgtgcacatataacaacaacgtagtcattacacaagcatacagtactggaaagtgaagcaagtaaacaaagagaagactgctctactggccctgccccgcgccgcgaccacgcttggtcctccgggcctgtgctcgcacgtggtcctgggagtaggtgaaacgatccggtggcacagcacgggtagcacgagtgtcccgcggaggagtggcctgcgcttggtcctgcgtctgcaccggcggtgcgcctcccagctgtgaaggcccgatgacgtcctctgttgagcctgaagcgaagtcgaagtcagtgatgtcgaagaggaaggtggaaggcaacaagtggtccgacgaggtcccagcatggtccagtggtggaccctgactcgacgtgccggctgcctgtgacgaagtcccggtgtactgccagaactacgctgagtgcgaggtcgacacagctgcctgagacgctgaccctgcagcctgggagaagtgtgcggcctgcgtcatagcgaactgggcgaaacctacacatcgacaacgggacccttgtaagctaagacataaaatatatgtaaattgattgtcgaagtaatgttgtttttttaagtacctgtggggggcacaacagaaggcctagccgaggaaggcggggtgctgaacggtgcacgaaaccctgaagcaatcggcaagtgaaatggctcacttatatgtgcgaggcatgtacagaaatagtaataaaaatacttacctccgtgcggagggggagttggcctaggaacgtgcgcagctggacggggaccagtcggtacgggtggccgccgtacagctgtgtctgcccgagcaacgtcgtctgcacgacaggtgagcactcggagaatcgagcgcatcgactccaccatccgcgtgtacgtcgtcaggtgctcctctacgggtaccggaatccccgcgcctaaacgttggatcgtcgttgaaccgtcaacgacgacccggttgatgtcgtcgacctgcatggttaatttgttcgtaaatattcgtaaaatttgacgaagagaaagacatgaaaacataaaggaatggtgcgatacagggtactcacagcacgagcgaagtcctggtcgcggtgcctggcatagaggtctctagtgctcgcaacgtggggttgctgctccaagggagcgaaggtgaccctagtacgggtgcgtggctggtaccagcgtaggtaggcctggtacgactcctcagtgtgtggctctccctcgtggtccacgacctcctcggttgcgagcaaccagtcctcaacaaaagtcgccaacttggcgggccagtcgccagctgagtgctaacccttgcgcgagtacctgcgaattaatgtgtaatattagtgtgaaacgacagatgttacaaattattgtgaacaggcagattttaatgcaacaacggaaagcgtagtgcaagatcttacccgtgaacagcagctgggacggtggtcggaaacggtactggaaagggctgacggaagccgaactgccgcatcacgcggaaaggggcgtgaggctcaacgcagatgtcgaagaccatcggaaccgtagtcatccagtacgcctggtccctggtgcagagtgtggacagacccaacggcgcacgagcctgggtagccgtggcactgtagggctcccacacgacgtcagtcggcagaaggcggtcgaactccataacaaactcaggatacgaccgcctaacctggacgtgagcccatcggcgctgcaatacgagacgatcgatgtgatgtacaatgaacttagcaattaacttagcaatacgataagatcgatgcaacgtacctgacgacggcaccacagagtacccatcgtagggtagtcgacctctggttgctcctcgtacagtgactcctcgtacgcgtgctggtccacctcagggcggccgatcgcaatcctctcagctgcccagatagaaagaaagagagggcacccaccaaaggtcgcgctgggatccgtcttcgtgcaagactcacaaagtgcacggtacagagccgccaacaacgcggaaccccagctccactgaggcacctcgcctaccgcggcgtcggtgatgctcctggcgtagtgcacgagtcccttgtcgaccgcgtgcccgtggccgccacagaacatcacccagccaaaaagccagagcaagtacgcctccaaacatcggctgtaggagtactcgtcggcctcctcctgtagctgctcaacctgcaagccgtcgataaaatgttaggcaccttaactgtggactaaatatgtaatacaattgtcatttcggtacaaaaacactcacggtgaactaaagcagccacctcttcgtaggtccggtgttgcggtggtgtgccaacggctcgagcgggaggtgcggtgcgcgctgtactagtgcgaaacgtgccgtcagatcgtcctgccagtctacagccgtggtcactggcccaacaacgtctcccgcgagcggtagccccaacaagtacgatacgtcctgtagggtaggggctacctcaccgcacggcaagtgaaaagtgtgcgtctctggcctccatcgatcgaccaaagctgctaggagggacctgtccacagtccatcgtctggctgggtccgcgtcgccggccgcagcctccaccagccgacacatcggtaggaggccggcctcacgtagcctgcaataacaaattaatatgtcattataaaaaatattacagtgcaactaacttatagtaaaacactgttcgtacctctcgacaaaggagtcgtgaaccgtgagtagctcaccgcacgtccgtgcccggaacgtcccaagctgagccccctgcaccgcagtaaggtgagaccggtgtcggtgatctatcgccgggtccaacaactgaggtgtatcctgacgtgccatctctgaaaaatataatgtttcgtgttagaacaattcaaaaaatagtaatgtaaaacaaaagataacttgcaaaattatgaaatagtaataaaatcatgagattaattatgtacaacaagagtacaggctatttaaatatagcaaacgttactaatggtacataacgatgacgtgcaatttaacatatatgtagagttcaataatataacataacattacttgtcaaagtccgacatacatcagcatacctaaagacattaggcaccttagtccgacgttacatcacgagacctaaagacatgacttgccgaagtctgacattacacgacgaaacataaacacatcgataagttcgaaacgaattacaagcaaatccacatgccgacatagaacataagaactacaccacgtagccagacgtggcacgacgacgcctaggacgtggtcgagtggaggtagtgccttcacccgtagggcgagctccatttgctgctgatcctgatagtcctgcctccgccgcacttggtttctccttgtctttaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactgtgacacatatactgcatctggtatgccacactccgctgcggcagcaatgacatgggtgcatggcctgtggagcagcttcggctttgcacaagagcaataacatgtgccgtcggctttgagaacacactcctgcttcactctcttgcggtagatacccctgcctgccttatcttgacatagtatctcaaacctgtgctgttgggtaccttgcactagagctcaatgtttcatggcctttttacgcaactcctctagctttttctacatgaaagctccaaacaaaatgctgttgttcggcatagagggaagaactgcctggaaccgatccctaaaatacctgcatgtcccatgtaaaatgaactccactatgccaactagtggcagtccacggacaccgcgcatcacccaattgtaaacttctgccaaaattgttgtcattattccatatctagcaccacctgtgtcatacgccttggcccatttctcttttggttcatgcagaatccactgagaaaatttccgaatctccaatccagttcttctaaccaatgttggactatccgttgggagaggtccaagagcttgaggagggtcagcaacggcggtcgatggagccgctgcacgctgatcactgcatttggctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcttcccaaacaccggggtatcctcgttccatactcccaaactgcaactctcctatcgctcgcagaatgccagcgtgcctatcatgtatcaggcatacatttggactcataccaacaacttttgttttaatcaattttaggaaccagtaccagctgtcggtattctcactctcaacaaaagcaaatgccaagggcaatacctgattgttcccatctacccctattgcagttagtatctggccccgatactttcctgtcaagaatgtcccatcaatgcagagaacaggacgacagttcacgaatgccatcttgcatgcatgtagagctaagaacgccctttgcagcacactcttgccaggatgttcaatcgaggggaatttcttcacttcgtaagagctcccagggtttctttcctcgataacaccaagcaggcgtggcaaattgtcatacgaggcttcgtaagttccaaatctcatctctattattttctgtttggccctccaggccttggcatagctaatagtatacttgtatgtctcttcaatgtgttggattattgaccttggttcatatgtgagattatcgatgacatgcgcatacatctcagatgcaacaaatgcacatgtaatgttcctgtggtatttctaaacactaggtagaaaacatgtatgcttggtaacaactgacactgtccaataatccttccatttccccttatacgcgtgcactctccagggacaaccatgtttttccctttcccacaccgaacttcatattgcgaccggttcgacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtctcatcatctgacgaatcacctttctctacacgctcgttgtcagaatcctccctctccatttcatccacaatggcaccgacagtctccccctcgtcggccactccacctggttgaatgcccactggagctactacgcccccgtcctctcgtgcgttgacctcctccacagaagtctcgtttacttcagcacttggtcccttgccatcatccatgttcgtctgcacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtggatcaactctgaagcccctcattaaccatccttttatagaaggtacactcctctcagccggtctatcaattcccctttctgatacaataaaatctgacagatctaccccagttggcccgtaacggacgtttcctggtccatggtaaacttggaatatttatttgttcgacatatctgtcaacgaaataactagatcatattactctttcatgcaataaacatctacaacgtaatatcttcttgtgtaagccaatgcaacggtaatgtattaattccaaactagcagatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaatcggcgtctgaatccggcagggcttcgccccttcttctcttctcctcccctctcttctttttttttcactggaattgaggagagaagaatgagggctgggggctgggcagcaggccttttataggcagcgaggcctgccgcccggccagagggcggcaaggggccgcctgcaaaatagccggccccgactggtttttgcattcgggccccttgccgccccaccagaggacggcaagggttttcctgcaaaaaaccctccctccgtcaccgcccgttcctcccccgtttgccacgtcagcttgccgccccagaggtgggcggcaggggctatttctgtaatttttttggtcgatagattatttctgtaaatattaaaaaaaaaatctaaaaccgaaaaaaaatcgtcaccatgctagtgcacagctcactgtgcaatattaggccttattcgttttgaaggattcctaaaggaaatctcaattcctttggaataaacactatttatgcattattcatgcattcggtttgtaggattcaaaggaaaattttccataggaacactatgccaatcctccaaaaatcctgcaaaatgtactaattccataggaatgaaaacatccactctatcctcttttgtttagctcggtggaggaaaaatttctgtgttccaatcctttgttttgcacgtgcattcctgtattattcctatgtttttcctattcctgtgatttggaaatcatgtgaaccgaatagtcacactaatctaaaataccgatttcaaggtgcaaactctaccaaatcattgggccacgtggccaaaccaaaaaccaagttcacatatcgttaaaatgtgccacgtgtccaaaagagcacgctcattttaaacgtgtgtgaagagtccagataaaacaaaggaaaaatccagagcattctaaactcggttgaaaaaaataacatgagaacacgaaaagaactggtgaaaaagaacttttaaaacaactataatataattataatataatttcactataactatatcataacaatattataacttgtatataagtattaaaatactatatgcaactttatatctaacttatatagagattacaatgtagttatagtacagtcacactattgtgtactccttccgtcccataatataagggattttgaatttttgcttgcgttgtttgaccactcgtcttatttaaaaaaatttgaaattattatttattttttttgacttactttattatccaaagtactttaagcataacttttcgttttttatatttgcacaaattttttaaataagacgagtgatcaaaccgtgcaagcaaaaactcaaaatcccttatattatgggatggagggagtacaatgtaactatagtgttacactacactatagtaacatttaaaagttttttttgccaaaaaaacttgtgacagctttttagcaattcgaaaaaaaatataaacagcgagctaatattagctgtcgtaaaccggcgacaaggaagacatctaccgcaatattttccggatccacggaagctgttgccaatgagcaagatccattcactcaatggagcaagcggagggcgtcgagccgtaccagctgtgatggtccgcgagtgtggacgcgccaaccagccaacgagcatcgaggtcgagacgccatccacggtagcaacgaccgccaccccaagctcgaccacatccaggaggaagaagagagagggatgaagaagggctcaatgaggatatccagatttggacaatcaagggacgagggcgatgttacctccgctaccatcatcttcctccacttctccttgttcttgcaagtgttgtcttcgtcaatggctgatgcctttctcctagcaccgacgcggcaatccttgttctcgcaagcaccatcttccccaatggttgtcgcctttctcccagcactgacgtggcaatccctgttctcgcgagtgtcgtcttccccaacagctatcgcctttctcccagcaccgacgcgacaagtaaagctccaatgccacgatccaacgaccagttctctaagccaccaaatccgacatcctttaacccaccggatccggggccacgatctccggtgatgctgagacatggcgggccgcgatggcaatgagcggtgacggggacgaatcatcgaagattctaggcccttccactttctattactaggtgattctccatgctttgctacaggtttgctaagcaatttttaatatatatttttttttcatcaatggagctaagagtaaaaagaatagaaaataatgaaactaagcctcatcttaaaagcgaacaatttttacttgtcaaattacagttttgcccttgactagagaacaattgccaagcctaaaaattttaaaacggtttatttacacgacaagcaaaggcctaagaatgaactaataacaatttgacattggaacataagatgcaagtaaacacccattaacataagccatgtatagaagcaatgttcagagtacatagattaggacttgcgcagaattccactatcaacaatatataataaacatagtcagctaagtaatgtacaatctgtaatcaataataaatttttttgggctcaaacaatatcaagatacttggtcttaaaagcatgacccaaccgaaatctgagcttcaagaccggccattcaccaattagcttagtcagaacaggcaataagattgatagaaaacaaattccaatagccaaccacaggatgcgaggggcaagaacagtgtataacccagtggcaaatgctgttgtggttgccatgtatgccaaccacatgaggtttctagtaatggttctatagtagagcaagaactcaaggtcctctgacctagacaggatgcacacgaaggcaacagcaagtgaggagcacatagctaaggtgtcagagatcaagaatgcctgaaatgccagctttctagccatgataggatgcccatcatcgctgctatatcctccaggtaaggtgaaagcagcagcgaaggtgattgttgcgatgaggattgccaccaaagaagtgttgtttgtgtatgattgagtcagtgacttgacatctttccttgattcattagttaccttttgcttggcttcctcaagaaggttagaaagacatgttgcatcttctggatcagctctcaacataagcatagacacttcattctgcacacgtaaaaaaaaggtgcacatgaagcacatggtattatgatagcaatgcaaatgagtggtgctataagtttgtgattagaggccagaatgaaggagaatgtaattatgtaacagcattttataagactacgcatatcctgcaaatcaaatggaaatgatgtatttatgccacatgtttttctttgtcatttgtccctttgtttactttttgattcatgctgctgatgcttgtttgggtttgctttattaatagtatattgcacagtatttaacaggcatcaattctggtttattactccctccatctcaaattatagagtgtcatcttttttaggaaaaatcaaactcactaacttttgactaataaccatactaatcatataaatactaagtattatgtatgttatatcacaagattcatattttaaaatatttttatgtgatgttaatttcatattcattaggaatataacatggaataaattaatggtcaaagtatgttattgaagaccgtgtaaaaaataaagatcttataatttggaatgaagggaatacattttactactagatcttatggatatttaatgcattctactaaatcaaatgaccatttttgactgaatacaataacttcaattatagctactactactactactccgtaaatcaaataaagtgattgtacaaatttatatacgagagctctatttccgggtaagatactgggaatcgatccaaataggataataaaaatgagaaatcaacaagtactttgaaattgcggtgcactaatgcctttcatggttcctatatcaatgttacttttcagtttcattgctattgccttacatgagtatgtatgcttaatttgttcagcagcttactgatttccagtcaaatttatcttggttttctaccatgaattaactgcaacggttttatggaaattaatttgcggcaaatatacgtacccagatgagagtcttagcatccttggcatcccatagatgcgagcttgctgtctgtgcactgttgtcaaccattgtgtagtcaacgtctttccgagacagtagagcggcaaccatcttcggattacgcttcatgaccgtgtaatgtagagcagtctttccgctgctatcccgcatgtttacgagtctctggagttgcggtgtcctcatgatgaactcaaagaactctgtattaccagcttgcacagcttgatgcaggcatgtccagccattcgcactgcaacagggagcatctggacaatgcttcagaagctcacgagctgcaccaatgtgacctcggtatgcggcagcattgaggaggggtgagccatttgtggttgttatatatcctaaagactggtcatgttccaagaatactcgtagcacatcagccttatcccagagtacagtgaggtgcaccggagaagtcccttttgtgttttcttctctggccagccaaggacgtgcctccacaatcttcttagcaatagctgaaaaacaagtgatcatggcacaagtggaatatgtaaatttgagtagtagaagtggtcaatgttctacatagtcctaaatgtcaaaatcacgattgatgctgaagatacctgcatttccattcctcacagcagcagccaaagcattgtagctgcaggctcccacatgagaagaattgggaatttccagcactttctcgagaacgtctgcgagatctctcatcgctgcaatgaacatgggagactcgttgtgcttgttcacaccttgcgacagcgcaggctcagcttctatcagctccagagcaagctccttgtggccactgcggatggcatggtgtagcgcgttgcatccatccctgtcttgcctcaagattgcctcgctctgtcccagctcgaggcagcatctgagtaaaactgaggccagagcatcatggccactcgtcaccgcagtgagcagtggtgtctccccatacaagttgactttagcgacaagacacggggatagcaccattaaatctttgcagaagctctcacggccatgaatggaggatatgtgaaggcaggtgttgccctgtggagttgttccgagcagtatgcttggatcctgcgaaaccatgttcttcaatgatttggaatcacctgatgtggctgcttccaggagccctctgttcatctctactcctggtgtttcagactttcagtgctgatgtactggctgaaacaataaatatagctataggaccagtagctggtgactaattttttggggcattgtggctacatacttgatgagatatctttttggtgctgattgtgaagatattgaatgatgtctttgtgcaatgccttacaagaagtaaaactccaaccagattccactcttcacatgtagagagcactgcattttccacacatgtaaaaagcccgaaactgcaaagaaaattgtacagtatatcacatcatagcatgtatcatttctacatgtttattatctatcgtataataaaatccactgacatgtgatctaagctttcttgacaagacaaaaggaaaatatatagtagtacaagatttaactaaaaaatatcaacatttagcacttgatttgatgaaaatctaggattagagtaaaattaatctggaagctattactacttaaactacaattgtaatgtaggatctaataggatatcacgatttcagggagcggggttcagagccagttgatagggttgtccaatgtgggttgactgaactcaactcattaaaacccatcactgaaggtacacatgagacacggtgacatgaccgaattgatgaactagcagaactgttttcaatggtttgtcaaaagtcaaaaccaggtttgaacaacacccatacctgttggcacgatgctgttttcccccatggggctggttgctgcagcttggacaccatggtgttgactatgctgctcttatatggacacaaatagaaatggattgggctggaaacagaggaggatgacaagaaagcaattttctacgttttcctaaatttacctcccacccccgtgagctggctaatcctggcttcaaccagaccagtgtaactgcgtaagtgatggtgtgttgtctattgtgctctctgctagtgctattcttcagtgtttgcctgtggtagcttgtatcaactaccttcttattgaatcttgtacttctttcctaccaaaagtgtaggaataagtaataatgctggcttcgtctagcctttgagccacgcatacccagcagtgatggttaacaattaactcaacggctagttgaataataatagaaaaaagaaccgatcagctccaactagttttgagccccttaatataaactaatgcacgtattgtgcctattcagttccccattttcaaacaagtaactcactgtaaatcgttctttcgtcctcacatcatcaggttaaatggttaactaccccttcagccaacttggcattccaacaaacaccttgtgtacacaacctttgagccctaacaaacaccatacatgtgcacagttgtacacgatctctgcgctctaatctgaataaaaactacagttgcatcataaaagaaacattccacatccaaaaaaaaaataataaagcaacaactctcagataaaacacgaagcgacaatcaagccagggctaatatctggggatttttatttgagcaagaacaaggggctaatacttgggattttcgttcgagcaagaggagaggatgcactttgtccgtgcgtcggcaatcctaacgactggccagccaactcctccgccatggatacgacaagccaactccgctgcgggctgcggctgtgtgcgccgctgtggccagcctcgctgcactcggatagagaagcatgggtcggcgtaatgcttttcggcacccgcccccgcgccgagagctggtttctcccccacttccccggcgccgccgcgtcccgtcgccggcatctctgcgcctcgccgccactacggctggggctagctcgcctcgcctgctcgcgcgtcgccctgggcccgccgttccagcgggacaatcctagaaggaaaaagttccttttaccgtcgagtttcattcgttttttttttttttttgtttttgactgaagaaggtagaggagagagagaggctctatcttataaccattttattaatagtagttataaccattttattaatagtagttaaggtgttacagcaaaagtacatcagagcagaaaaacaagggaagaagaaaaaaaatagagaaaaagaggaagaaaaaaagaatcattcgtaattctaatccgcaaaactagatatataaataactatcaaaatttctttttatcctatatcatactagtaattgcctgtactaacgctatggtgatattttatagtacaatagtgataaatagaaaaatcccaccggatgtttttgttgttctattttcttttgaagagcaaaacgacatattaatttgcaatcaagaaattaacatataaacccaaaaatagtctaatataaacgcattctaattaatcttgttcacatggcccagatattgttagtaggagcaacaccgttattctttttgaaaatcggcaaatccatatttcgggttggcggcagcgccgatctgggcgagggcactgtggcctgaggggcgaacttggcggcggacgggactggggcgcagccgcggtgatgtggggaggaaggcgtgcaaaggaaagagggcggagcggcgtcaacgcgatgcgtagtggcggtgccggtcagcagctgctgcggatgatgaggaagttagcgccacgccggggatccagtggcggcagcggtggagtggcgtcagcgcgatgcataatggcttaatgcggatgtcagtgtgtgcggcgatgcgtggggatgggaacggggtggatgcgtgagggagaggcgcgatcgggtggaagaagcgcggatgccgtcaaatgcaaactcatcagatcattgtcgatcgtcggatgtgtcatacgatgaatgagtgaaccacttatttaactatagggtagatgatgtgttgacttttgatgtttttttccatgtcacacatacatggcacgagaaaaaataaaataaaaataaaaaaaatcaatgaaatcaacgtgtcagttaggcaaaattttttaccctgtgacatcgaatgtttggacacatgcatgaagtattaaatataaagaaaaaataactaattacacggattatgtgtaaattgcgagacgaatcttttaaccctaattgctccatgatttgataatgcggtgctccacaaattacatcgtcccactcacgtcataccaaggaaattcctaaattcctatctggagagaaaatcggatggccggacgcccgcaccactcctcttgaccactccaacctcatctctttctctctcatgtcggtggagatgctgaagtaagaggcggcgtcctcgccggacgacgatggcctcgcgtccgccgcgccgcccttggccgcggccgttgcggcgccctcctcctcgccaccaccggccactcggttgggcctctcgcgcggacctgcgcgaggcgactggacaacggtgagatggagcatggcgggcaggtcgccggagtcgagggaggcagtcgtggtgcggaggtggtggagggagagggatcagcagcgtgaggagcaagagcaccactgccgcggaggctacggggaggaaccgacaccggcggaattagtagtcgtggtggtggccgaggccgtggccgagggagcgcaacattccggcaccgttgaagatttggtcaccgggatggaggaagaacccaaatctagaccaggtaaacttatgtgatttttcgatgttccaatttattttctctcaatgtttctctgtgttaaatcgaaatgtttcactatgtattttaatattgtttcacatttttttcatcgattcttgaggatccattgatatttctcaatgtttatatgttaaatcgaaatgtttcacagcgtattttaatggtgtttcacatttttatcattgattcttgaggatccattgatgtttcaacagtataaacttgatgtttcatgtgtaagacataaatgtttcaatctttgattccaatgtgtttcatcttttctaattggatgttgcacacaatggtgttttcggtgttacaatcagcatctttaaatgttgcatataattggaatatttttaaccacatgatgaaacattttttcattggacaagggaacatctaaaacatttttgttgaaacattttttagttaatggtgaaacatgtgaaacaatttttctatatacggtaaaacaccgtccgaagttttgactgggattggatgtccgatccctagtcgtctccaaataaataatgctagaattaacaaaaacaaagtcattttagaagcatacatttaagttcttttgttcgcttcgttgttagctcatatataatgcaaaatatagtacatttagtaaacacataggtatgttaattcggctaataggttagagaaatgatttttcacccaccaaattaacaatatcttcaaatgatcaaatccaagctatctattatgcctccctcatttcatactaacccttcacccactttcctattctaatcccgttcctctttatcagttaacggtagagtccctaaacctttttaggatctgtaagagaatttctagagtggggtgcacgttgatttatctcaacgaaattgatgttcaatcacacggtaacataactaaattctctttgttaaatcccatccccacctgtaaataatcataagaggattccatcaaacgtgacaagtataactgatgacaagatcaaaatctctaaaattcccaaatttttttaggacatatacaacaaaatccacaaaagaatggcatagaagatcaaattgtatgaaataagaatggcataaaactcgcagaagtactgtaccttatataaaatcggagagcagtagctaaagatccatatatgctgctgaaggcagttatagggatcttaagagggtcgccaacccagccttcttatcgttttatctattgcacgccaaacgctaaacaatttcgataatgacatcaacactgatttggccccctgttttgattaggtcttctaattgcattgtcatggtgcacaccattgtgattaaactacatagtatatactaggggcggagccaggaaaccaccaaaagtagggctcacaacctgtttagataccttatatcttcgaaagtttcactaaaatttaaatgaatcttataggaatttaggaaacaagcctaaagccctagctgccctaggcttgtcatatactaactattctttcttgtataaaagttagacacatatactcacgcacacaagccacattcacgctcatgtacaccccagatgggtgcaccttagattggactagtctcacgcaattatatatatgaatttggttgaagtttgattaaactgcttcaaattcagtcaacttttgttcaagatctgaatttttcatggtgaggttttgcccagacatgcaaaatcatgctatctcaggctctcccatgatcattttacccagaatgatatattctgttcccaatattcaactgagctgtacatcgcttggtatgttgttattttttttaataaccggaagtgatggacaaaaaatagtggctatggagatgaaggtaagatgagctcaagactaatttattaatttactattaattaacaaaacttttttttacccctaccaatgaattagaaatttacaacttcatatccccatccttgtaataattttacaatcaagtatgtgacacattagtttgcattaatttttccattgttcacaaattatcattgaacatccctaaaaggctaaaactgtgatgaaaactcgcatataatttgcagttaacaaatcaataacaataaacaagaacttgaaaaaaaagatacaagtcattacataagctccacatgaataatgttcagagtacattatttagattatatacatgaagttaaagatttaacaatgtatgctattattgatcaaacaacacgtgacacatatatttgaacaataacgatataatatgctatcatttacaagatatatcgataatatcagaccatatcaaggaactctgatttgaaagcttgcatgcctg

SEQ ID NO: 77782 - DNA, 1658 bp, Oryza sativa
cggctcaggctctggctccacctccctcgccttcgcctcgggctgctcctgcggctgcgacggcggcgacgagctgggctgcgacgattcagaggcctctggtctctggatcttgatgttaagcatgaggccgagcacctgcatcatccggggatcggagaggtacatgttgaggctgctggggttcctctgcacatcccgcagcatctgcatgaagtcgggctgctcgaggtatgcgcgcgtggtcgggtcggaggcgatcttggtccagagctcgggcccctggaacatctggcctatgccgtcaacgccgctgggcggcgggcggcgcggcggggcggcggccgccttcttggcatcggcgaggccggccttaaggccctcgttggtggggtcgagggcgaggcccttctcgtaggcggcgacggcgctcgcggcgtcgccgaggccgaggtgggcggctccgaggcgggagtaccccttagcccagtcgggcttcagctcgacggtcttctcggcgtcggcgagcgcctcggagtagcggtggaccgaggcgagcgcggcggagcggttggagtagaggacgtggttccccggggcgagcgcgatggcgtcagtgaagtgccgcgccgcctcctcgtagcggccggccgagaaggccgcattacccttcgccttcgcctcgtcggccatggcacgcggcggcgatcagatcggcggcgcgggctccggaagcttctggaagggctctggcggcggggccggaggagagggaggaggggaggaaaagtctggggttagatgggggattaaggtctcggagaagatgaagttttataaaatcggcgaccactatgattgttgcggcgtggcgtgggccgtcggatctctctcaagggttctcgaagcttccgcttagtactattaacgcttattacgctttctcctcatggaagcgaactctttagcgtgatgtaactctccgctttgtccgccgtacagtctccaatgtgggctgggctggtttctcatcagttggtccggcccgtgttaacttcgcggcttgacttgttttagttgggctgggccacgcacgccgaggcggcgggcggcggttgccgtggctgcagaagacgacgaagcggcggcggcgccacctgtccacctcacgccccacgcgtccgcgccgcaggctaccctccttgcatggcggcatggcgcggcgcctacttcggtgcttcccttcaaccacctcggtgtcccgtagagtcgtaggcgtggtattgtcgcgcgcggagaagaggggagggatatggcggcgcggtggtgcttcgcgttgctcttggcgctgtcggcggccgcggcgggggccggagccaagcggacgtgggagccggtgattcggatgccgggggaggtggtggaggaggaggtggccaccgtgccgcgcggcagcgagggcaccgaggaggaggagaaggacggcgtcgggacgaggtgggcggtgctcgtcgcgggctcctccggctacggtaactacaggcaccaggtaagcgcacgggtccagtactccagtgtcgtcggcttcgccgtcgcttagttcgtgcgcgtctggagctcgatttggggggcttggatgatgatgcagcgtggaactg

SEQ ID NO: 77783 - DNA, 993 bp, Oryza sativa
ctttcgaggtacttagagacagtgtcatactctgggattgagcccaatatggttggctcaatcgtgttctttaccgcagccaaacaattcttgttggctgaagaccatttcgcatgttcaatgtcatacgacatgatgagggaagcattgtccctctctctcttttgccattcagcatctgactctttttcacctctgaaaatttcagcaggttctataggacatggggtagtcaacacccagtccacctctcccaagataaaagcaaggtcgagttctcttttccattcttcgtagttatctcctttcagggtcggaatatctttaatgtaacccatcaaggagtagccacctaagataatcatgtattgtgagaacaaaattaacattaaaattattatgtattaagtctacatcaccgttgggcagaaaatagacataacacataaagccataactataacattgcaattatcaacgttggtcagaaaaattacaacatcatagcacataattaatgttcctaaaattaaaatctcccgttggttcgaaatttaattttagaaacactaattttcattaatttcatctatttgcagcggaagatctatatacaattcatataaattgtaacaaaactctgttgtttacgctctgtaaaattctcccgttggttcaaatttaaacagagataaaacatgtaaaacaattcaaaattctattgtaatttgcatgaaaaatacaaaatacatgttcagaagcatttctcacatttatctattctctaaacaattttcacgttggttcaaattgcttagaaataaacacaatcattgaacatattgaaaatgcttccttcggccgagggacttttattaaacttcctttcttttgattcggccccgagggacctaaaatgaactttttcggcctttgccagtcggcccacggccgccttgcgcgcgggcgggcgccccctcccctttccccagg

SEQ ID NO: 77784 - DNA, 4112 bp, Oryza sativa
tataccagcttccactgttttgcacatcccaatccaatttcccgacctctgtatccaattccaatatgtagttaagcattgtttactatcctgcatatgtcatatacaatgtttttgatcagtaacctttttcactttattaattagagatagtcaattagcaaaaagatatgtttatttcaaacttccactgtatttattttacaggagcagtggtggaaaggatgtgggggatcaagcgagctcatcatcccataaatcacaggatgctgctgtgggttatcttgtccacatgctgaagtctgcgcggccgctgcgagactctagcaattcacctcttacatcaagggttgaatctgttgaaggaggtaatgtcagttctttcatgtcccgtaggacatctgatgcgctcgaggagcttgaatcttttaaagaaataaaggagaacctgcttgcccgtagtagatcaaggatgcaagagtcattggataaatccttgcgccattcttaacatagctggtgaagtatcccaaccatttaaggaggttgtgtggtaagagatgttcttaccgcgggcatctccatgtgtataactgtcaaccggcgcttgttatgaaatgaggatatacaagtcgttcattcttaaactcaagcaggatcatgatccacctttgttcatagtgttttgtatgcaagcaaaaccaaccggatacatgcatcctgctggaagtatatgatgatcaccgtgtgcgtacgtgtgggattatgtaatcatactaaacctgtttatttattctattttagctcttaccttactgctcttaatataccaaactgtttgtttattgttacaaattttttaagtcttgagctcttttttttttctgcacttgtaaataccgtcctattttctttgttcttctgatgcgtgaagtgtgcttgaatggatatgtgacatgaactttctcgaatttttttgtaaggttgaattttctgctctcagcttgttctatgttcgtatcccgtgccatcctattgttctggaatttgtcatcccggcgagctttttagcacttcctacttgggcagtggatccgatttattcttcccgtttccctctcgtgacgccgacctttcttaagggagacgtctctgtgaacaaacagcatgcatctttgagtgagacacaactcgctccattctgctggatacgctacttgttgtatccaatcagttggtggttacggaaaagtaagatgttactcacaatatgtcgcatcagtttcagtttttgtaagaattattttgaacatgtaccattttccttcagctaaagcatcattcctgaaaagattgcgcgatgagaagcatctcacattttcactttcagtgagagcactgcactggagcacatctagggatgaaaacggtatgaaaatttcccgaccgtaccgataccgtttccgcaaaactaatataataataatatttttttaccgatgttaccgttttcaaaatttagtttttttaatttctgtcagcgtgacattgaagttggctctaaatagatgaatttgtaaatataaaaattttccgaccgtttccgtttgttttcgaagaaaataataaaataatataccgtttccgactatttccgaccgtttggcacatcccttgaatcagcgagtccaaatcactcaaaggggcaaactgcaacaactcccacggttagagttaataccgatacagacttgggacaaaacgccaacaagcaaatcggagcaccgaagtcattgatgcaagccacggatggcgcgcaacctgatggacgcactccagaacgagtcatttccttgtttatcagtcgattagcagtctaaatcgagggaacatcaggtgagacggtgcataagttggaaatgcgtgccagtattgtatacgccttcatttgcatggatcactaatgacatcgctccgggttggcctccaaagttggtagtacactagactttatactccatgcattagatggtgcagccgaaagccttaacgcacaaactgatgagaaaataatatttacggttaattattttttatgataaaatactgtaccataaacaacaagcggccgtactgagtttgtcaatatcaaaagatacatcaatctaattgatgcaagtgtgactgcgtgtatgcgagcacatttgtttataccgtacctctttaaaagtgagatatcagatacagtagtacaacgttttccttcgggccacacagacacgggagccaaatattgcagtattaatatctggaaagtcaccggccggaagaaagagctcggcacgtcgactgcaccggtgaaaaacacaggatcggtggccgcccactgcaccggcgagcgcaggacgatccaacacatgtgttcccgagcgaagccgtgctcggacaccggagtagctagctttattctcgccctcatggaaggcacaaagccacgccctcgcccacaactaaactaaaaaaaaaatgctcgcattacaaacgtcgcgccaatgcgccatgcctctggaccatgcaagacgtcgctgattggaatagaaactctctgtgcaaaatgtgcgcattcttaatcctcgcccgatcgatccaaggagtgtcgtttacaccacaaatctcgatcaacaccaaacgtttcaacgctcacgatcacatccatgtatacgttcatttactccgtattataggtacattttgttactgcgttctgaaatgtgccaactttttcccatggtacaacaaaaagatcgcgatttcgctataaatacctctccatgactccatgcaagctccaatattcccagttcaatctccatttgtaataagctagcttagctcagcttgtcgttgatcttgcactactctttgcaaccatggctatcgaccttggttgtcacgtcggctgtgcatcgccagagacgaaacaggaggagacggcggatcccacggcggcccccgtcgtcgtcgacgacgtcgaggcggcggctggtgggcgccggccgggcgacggcggcggcgtgaactacgtggcccgcgcccagtggctccgcgccgcggtgctcggcgccaacgacggcctcgtctccgtggcgtccctcatggtcggcgtcggcgccgccaacggcaccaggagggcgatgctcgtgtcgggcctcgccggcctcgtggccggcgcgtgcagcatggccatcggcgagttcgtgtccgtgtacgcgcagtgcgacatccaggcggcccagatcgagcgcgcgcgcggcggcaaggacgccgacggcggcgaggaggaggaggagctgccgagcccaacgatggcggcggtcgcctcggcgctgtcgttcgcggcgggcgccgcgctgccgctgctggccggcgggttcgttcggccgtgggcggccagggtcgcggccgtgtgcgcggcgagcagcctcggcctcgccggcttcggcgtggcgagcgcgtacctcggcggcgcgggcgtcgcgcgctccggcgtccggatgctcgtgggagggtggctcgccatggcggtcacgtacggggtgcttaagctgttcgggatgcatggtgtttaacgggcaagtctttatattttcaccacgtaaataattaaaccaaagggattattaccaagatactccctctgtattcaattacttgtcattggataatactctctctgttttttaatgacgtcggtttagttcaatgtatttaacgatggatgtagtattcattttcaaattgactcttattcgaagaaaatgtataaatacctaagagtatcctatatcgataaagtgttgcaccctaaatataattgtcaagctttcatacattatgatctgatcattcaaaatttttattgatggtcaagctaaaattacaataatagcagttatttgaaatcggatggagtaattgattaaacacatggtgttaactactctttagactttagggaggagtacgttgctaatctaggtgaggctgccggctgagccattctattttcgtttcaagataaataaatttaatatgggatacgatatatccta

SEQ ID NO: 77785 - DNA, 977 bp, Oryza sativa
ggactgagtgtcccataaatacttatattggggcataaatttttgaacactcaaaatatttgtgaaccaaaagaagtatatggagaggtgtgtaccattaatccattctttcatatgactgtcaacgccgtaaaatatatctgtaatattactctcagtacagttaattagcatatggccctgaaatttttcggccgaacccggcaattttatatttatatatacccttgccttgagcttaggcatcatgtagcctcgccgctcaagcatcgctaactcagttatagctgtctaacaaagcaaattagctttcgctgagctttgtgttgcttttggtctcctagataggtttgtgaagcatgaagctcacggtagcaattgtctgtgccatggcgaccgcgcttctcgccgccgccccgtcgtcggcggaggccggcgacggcgagctgaaggtgggctactacgacaacaaatgcagcggcgtcgaggacatcgtcaggtcgcacgtcatcaaggctatcatacaggaccgcggcataggcggctccctcatccgtctcatcttccatgattgttttgtcagggtatattttgtttcttcctccgtttaataatgtaagtcattctatcatttctcacattcatattaatgttaatgaatctagatatatacatttcctatctagattcattaacatcaatatgaatatgggaaatgatagaatgacttacattgtgtaacggagtgagtacatatcggtacttcatctatttcatattataaattgggccgggttttaaatggatttatgagtgaattcatttatattacctctatttctcattataaggcattctattttttttcctagacaaacttttaatttatagaaaaatatagtaactttttcagcacaaagaaaatattttattatcaaaatggataaaaggttaatcttaatgaaattaaattgggt

SEQ ID NO: 77786 - DNA, 625 bp, Oryza sativa
ttcctgcagcccgggttgccgaggaacgggacgcagcgacaacctcagatcggttcgtgggatttgtcgatgttgaccccgacgagtcacccgtgttgcatattttggaagaccaagagtcctctccgtcgatttcaccgcgagacgtcaacgtgatcaatacagctgagaccagcacgtccgcggcagctaggacgcctgctcaatagctacaagccctcaactcgatattgagagagccctttcgatcctgccctgaaccctgatgttgattagtaggcagtacgactataagagaccatggccaacctcaatagcgcatttgtagaggcagcaactgagcccccgctgcgagatccaccacgaggaaatagagaactagctaatgggaacgcagaagtataaatccctactggtgaacgttccccctatgctcaatcgccacgagcaacctgagatcccactccaccacctcgcgaaaatcacgatcttcgtgagcatctggacgaccgacggagagaacgtcgggatcagaacaacactgatcgccatcgacatcgttctccctcacgacgaagagagaacaccaattgacaccaacatcagcgtcattctccttcgcgac

SEQ ID NO: 77787 - DNA, 16660 bp, Oryza sativa
tctggcagttgtcaatacccaaactgccggaaagtcaagggactgtttcgtcatgggatgcagtgcaaaacacgtgcttcaggagggtgtgttctttgcaagaaaatgtggtacatgctccagctccatgcccgagcttgcagggactcaggatgcaacgtgccgagatgcaggtgtgttggtgcttctcacttttgttccgtcaccttgccttgtgcttgatctggaataacaccctgaccacttacggaaactatacactatgcagggatctcaaggagcatcttcgaaggttgcaacagcaatctgattctaggaggagggctgctgtaaatgaaatgatgagacagagagcagcagaagttgctgcaaacgagtagtggcatctgtacagctatatactgtggaaagaagatagggagcgcgcagtgtcgctgccctcgctcattcccactcccaagtagaagcttgggatatggttgaattagaggatctagctaagaagttgtctcagatggattcgtcccatgaaactgtcctggagatgcaagacgtcgcgcattcttccgccagttgttaacctatggcttggaagcctgcctctgcctcctcttcttcaaaggaaagaaatgaaatggatgaaaggggtgtaccacaataggtggtaactactgtgttctgtgctaactagttgcaccctgctgacggtgcccggtgaaatcgtcgtcgtcgataggacccccagcccttgggtgtggtgattcttttatttgacctcctgtactagtggaactaatcttgttttgctgcttgcctcctcttcatgtataataggtttctggaactcttattgttgatgaaaaattggtctagctgttccccctccagcaccttgttgttgttgttgcctccatcaggagtgagaggggtatagggaagaaaaaaggaagaagaagagggttgggcattggatatgaattgtttatttctgccccccattttgtaggaaccaatctttgttttaaagtataaaagcatagcatatcctgcattctgttgtatcattaacattacatctcctgcatttcttcttgtttcccctctgttgcatttcagctggctatttctgtgcaatattttctctctggaaatttatgttttatagtactatccgtcctagaaaataatgattttttttgacacggatattaagaaactccatctacttttgaaggcaatatttctaaatctgaaaattttacttttgatgggcatatttcaatccaaccagatatcttcttaatgactttctcggatttaatatgtaactatccattctttcacacaagattggcattattccacacaagattggctacatgctcatggagaaatgtaaatattaaggcaaatgaatcgtttatttacgatgaataactagtaacatgtttaaatgaatgataagtagaattacttatccttggtcattgtgctaagatgaaatataactatcaaaagtagatggagtgaacatgaaggttgtgattgtacgagggaaaaattaaatggtcgacaattatgattggttagaaaaataacgttcgtggacaaataaagaccaatgttgttatactccattacggaacggattgagcaagtttttttttggaatttcacctatataagtgtgtcctgcttctgttgtgccactgccagtaacatgtgcacccctacattaattgctgtgtttcctcccctactattatactctggtcactgtaaactgtgcgcattgagatttaaccaaaatttcgaaattcgcttgaatatcctatcagttcgaattttgataccaaaggcctcatgtttgaattacgatgagctcaaagcctcgaatccataacttcaagcccgaaccctgaaatcctggccgtccatttgttaatcgggcggttggcaaacaccctgcttgctgttctatccgcgccttgcccgccgtcgcgtgtggctctcgcctcgacgaccatggcgatgttcgcgcggcgcctcctcgtcttccacctccgcccgcccgcgcatcccctcgcagccgccattgccgctccccaccgccgccgcaagcacgacgccgtcgcgtgcagagccgctgcggggaaggggacgagcaaggccagggcgagggacaaggacggcagtaagcggcagcagaggcgggcgctggaggagcacctcaagcggcgcacgcgctccggcgccgccttcgacgccggcctctaccggcggcactcccacgcggagcacgtccccgtcatgctcggcgaggtcctcgccgcgttccgccgccctctcccgctccgctccttcgtcgactgcaccctcggcgcggccggccactcgctcgccgtcagtagtagttccccctcctgttctcccttacaattccagttacctttacattgctcgccgacgatagctgctcgacgaaatgctgcttcttcttcttggctctttagtgttatccgttgtgtgatcgttgatgcgcaccagctgtttgatagaatgcctattcggcttgtgcaatagatgatggaggcacacccggagatggaactgtacattgggatggatgtcgatccctctgcgctggagattggccggagccgtatcgaggccttccttgccaatagggaaactaatggagatgacgaagatgcctcgcagggaacactgcgtgcatacactcacgccaagaatttcaagtacatcaagcatgttcttggcagcgtggatgagaacattgctgttggaacgtctggagttgatggaatcctcattgaccttggcatgtcatccatgcaggtcaggtgttccgtaaaacgcagtgaaattgatggtaagcctcctttatttcccatttagtcatctgaatgccctgttgtactatccacaggtgaacagatcagacaggggatttagcgttcttcaggatgggccacttgacatgcgcatggatcctaaggtcagtgttgctttgctctagtttactgcccattccttccttccacttgcatacgaaaatgcattgccacaaaattttcttctagttgaagggctatgaacattgattgacaaaactacagtcttacatcttcatcttgttaaagtctagttttgctggagcttggaaaacatgatcccaaaacatttttatgcataatgcattcatattgcaatgcaaacttgtataaaatctttccagaaatttctaaaacattgaatcacactccagtccattttatttggatctgtcttgactgtagttacacttgtgttgacaattggtatttcactttttgcaaacaatgttaacccagtaaattaatacattatattacttgaagtgcaacacatccttaccaatggcctgttcttttccatatgaataaactaccgttagatttgccatgtccaaaaatttcaaaagaacgtagatttagtgccactttatcatttgcagtaatccataatcaactagcaaagtgacaaagccccaaaatagcacataatcttaatcttggttgccttgaaatctttgtactacacctaacctatatatgagattagacaggcaactttgaaagcagaagatatcttgaattcttggcctgatcttgaagttgggcgtatcctgcgtgattatggtgaggaaagtaattggcagtcccttcagaagcggattgttaaagcccgggctatggggggtttgcactcgacaggggagcttgtcaaacttatccaaagaacgtgtaccagttcagggggtatgtatgatgatggtatctctaaatgtggttatatgatttgtgtatgtatgacctgatgttttatgacaaacttataaactgcaggaaggcaaggttggattaagactgcaacaagggtgtttcaggccctaagaatcgcagttaatgatgaactccgaactctagaagatgcacttcatgcatgctttgattgcctagcaacagatggtcgccttgcagtaatctcattccacagtttggaggatagaatagtgaagcagacctttctggaacttattcatgaagatgaaatagatgatgatgaagacgacttggtgagtgctgacattgatagtgaagatgaaccctggtttaagcagagagtgcaaggaaagaatggaaccattctaacgaaaagaccaatatctccttcacaagaggaggaagaactgaatcagaggtgcagaagtgccaagctcagagttattcagaaggcgtgaacctggattaatcatatgatgactaaattctgagctctgaggagcagtgaggacatccatgcgtgaactcatataacatgtgaatgatcgcgcttgcagttgcaacaataataactggaaaaactagctcgagaggatgaaatggccatcctgtttctgcagttaacttagagagtagagcttaggtaagtccaaaaattaatctcactatttgcaccaccattttgtaccccattcatgtacactaaactctctaacaatagtttttactgcatctcttcttgttttttttttttggttatgcaggaagcctctgattaaattgcatattttaccagctaattaaacatatgatggttgtttgacttgggatttcttgctcatatcaattgtacttgtttacactcaagcagggtagggaaccaccacaaaataagtcaagttcagataaaaccaaaacatgcatattcagaatccaacgttggtgctcatcttgttcttggcagagatatggctacaaccttttcgtggctcacattgtcacccaatagttgatagtacaattaaagatcacctaaatttaagtcatttacttctcatatttcatattataagttgctttgacttttttctaatcaaattttaagtttaactaaattcataaaaagaatatagcaacatttcctacataaaataaacatattatcaaaatgtattaaaagttaattgtaatgaaaataagtttgtattgtaagtaatgctattttttaaaaaatttggtcgaactcaaaaagtttaacttagaatatattataatccgctttaacttttatctaagttaaaactctataagtttaactaaatttataaaaaaaatatcaattcttataacactaaattagttcattaaatctaatattgaatatattctaataatacatttatttggtgttgagaatattgaaggatttttctttaaatttaattaaatttaaagaagtttgattaaaaaaaaaaaaggttaaaatgtcacgcggacgtacgcaggcaagccagcgacgagtccgtagccaccagcgagagcggtgaatccggcggagccacgtcgccggcgccgccgatcgccaagcccacaagccgccacgtcaccctctcctcctccgcgccacattttctttaaattatttttctccaactcttaaatcgtaccatgagtcactgcagcgtgggccccacctgctcttctgacaaccacatccacaagcaccagcagccgcgagattttcttttcttccatatataagcagtgaagcagcgcacacgagcagccaagaatctctctctcgcgcgcggatcgcctcgaattcgcgagctcgcggaaatggcggccatgtcgtcgcgctgtgcggcttcctcgtcctcatccgcgttcctcagagctccgcttcccggcggcaggcaccaccagggctcttgcggcttcgtcgccgccggcggcggtgctaagacgacggtgagggttgcggcggcgctcgacacggaggccacggcgaaggctggcaagtcgtcctcccgggcgcggcgggcgaggaaggacggcggcgagcccggtggctcctcctccaccgcgctgcttgctcctacccatcccgacggcggcggcggcggcggcgtggcgctcgacgacgtgatcgtgaacccggtggggctggggcggcggtcccggcagatcttcgacgaggtgtggcgcaagttctcgcggctcgggcagatgtcgacggtggcgtcgccggagcaggaggagcaggagggcgtcctcttccgcggcggcggcccgatgtgcgacttcgccgtccccggcgcgcaggacaccaccgtcctcgtcgtcggcgccaccagccgcatcggccgcatcgtcgtccgcaagctcatgctccgtggctacaacgtcaaggtcacttacttttacctcttctttcttgtcaagctttctcatgtcaaatcaacaaattttgatcaagggtgtgtttagatctttgggggtaaagcttttaaagtatactgacacatatttgaagtattaaacgtagactaataacaaaacattacagagtccatctgtagactgcaagataatcttattaaggctaattaatccgtcattagcaaatgtttacggtaacatcacattgtcaaattatggcgtaattaggctcaaaagattcgtcttgcaatttatctatgttattttttttttgaaacaggctctggtcagaaggaatgatcaagaagtgatcgacatgcttccaagatctgtggacattgtggttggtgatgttggcgatgcttcttcagttcaagctgccgtgtcaggctgcaacaaggtaatctactgcgcaactgcacggtcaacgattaccggtgatctcaacagagttgataaccaaggcgtgaggaatgtcaccaaggccttccaggtagttcttgtgaaaaatctttgaagaaacatgcaaatcaatcttatttagatttctgatatgtttactgaactgtgatttactttgcaattcaggattactacaatcagttggctcagtcaagggctggtaaaagcagcaagagcaaactgtcgattgccaagttcaaatctgccaaatctcttcaaggatgggaagtgaatcagggatcatactttcaggatatttatccttctagattcgatgaaggcaccgatgcatcgtttgaaatatctgaaaatggacaggctgttttctcaggtatcacctgatatgaaagctattacatcatgatctctgaattgtacactatagtgagattgccttttttaaaaaagtattcagatatattgcttcagttgatgatttttcatttgtttttaattctcttatcaaaattttctgtgattagggtttgttttcacaagaggtggatatgttgaagtgtcgaaacggctttcgctcccactaggttccaccctagacaggtgtgataagattcttcagtttattttttcttaataagtttgcctgatgttgcaaaatcatgacatgatctgttctttgttatgctgccatgttctacctgaagatacgacggcttacttctatccgtgggtggaaatggaagatcatatgttatcatccttgagactggtccactagctgacacctcacagagcaagaaatattttgctcggatgaacactaaagtagggttttgcagggtaagtggcaagtgatgatcccacttcactaaattacctgtttctgcattgctaatcggagtgatcagttaactaaatgctgaaaatattcttgttctgttcaggtgagagtgccgttctcagatttcaggccagtgaacccacaggaccctcctcttgacccttttcttgtgcacacattaaccataaggtttgaacccaaaaaacaggtcagtgcaaaatgatttgttgaatcaattggagataggcaatgcttctggaagttgttagtttaccaataaaatccttgtgcagagacctggtgactcgtctcaaggagctagtgacccaagaaatttccagcttataatggaatttataaaagctctacctgtaagtaattcacctgattctatcaattgatctgccatttaaatttccaatgttgcagatatttaccggaaatttcatttgttttttgcagactggtcaagaaacagacattgttttggtttcatgcacaggctctggaatcgaacctaacagaagagaacaagtcctcaaagcaaagaaggtatcacttctcataaccacacatcaaatgcaaactgttcttgatgcactcttgatacaaacattaaccagtttattatctctctaggctggagaggatgcactgaggagatccggcctcggatatacaattgtatgcccaggtcctctgcaggtacaacatctgaatgaattggattgtctttttttttcttttcctaaatgtatattttcagcaccagttgtttctcatgtagtgcattgcatattgatattgctgctgaatttcagtacaagctgtagctacataaaccttagtgtcaaaccgatgaaactaaatattcatcaagcaagcagccaagatttaagcatgcaagttgatcactaatcatagaattgagtgtgaaatttgagtataaattatgcttatttccaagccccaaatatactttcttcagtccatactacagtatagtataacatagtatcccttcttcattccaggaagaacctggcggtcagcgtgctctgatctttgatcaagggaacagaatctctcaggtgacatagcattcactgcgtgcaattatgcctgatataattgcatgttcaatgttagtatacatgctaaccattaggcttttcaactgaaatataaatgcagggtatcagctgtgccgacgtagcagatatctgtgtcaaggcattgcacgattcaacagcaagaaacaaaagctttgatgtaaggaaaaaaaaaaccttgtattgtgaactggccatttgtgcaacaggtagtgaaatgactaaccaggacaccaacctgatttgtgtaggtgtgctatgaacatgtctcaaagcaaggggatgagttgtatgaacttgtaagccccaaaactgaaacttcagtagattcatctttgtacagcaattcgcaaaatttcttctctgatctgtctgtgttttgcacttttgctaatgatctgtcgaattgttttcaggtggctcatttgcctgacaaggcgaacaattacctggcaccagctctctctgttcttgagaagaacacctgattgatcaaatgatcagtgacccatcaaattttatgtcattctgggtcagattattgtccatgtgtatatgattcatcttgtaaaggttttccttttctcatagaaaccgtgtggagtccacttgtgccatgatgaccgtctccagcacaaaagtgaaggagttgttgacaaaaaaaatccatggtcctactactttcccatctctgtaaaacttgtagaattttcataacaattgggcatgaattagggtgtgtttagttcacactaaaattgaaagtttggttgaaattagaacaatgtgacggaaaagttggaagtttgtgtatgtaggaaagttttaatgtgatgaaaaagttggaagtttgaagaaaaaatttgtaactaaactcggccttaggcccatcctatatagcaattttgagaactttgaagaagtaatgagcatgaggaaagtgcatttgtctaagaagtgaatatctcccaatttgtgtacatttgtatcgtttcttcaattttgtcacgctcaagaagctatgagtatgaattttagaatttaattctatgattaattaagggatgttcttcgtcacttttgttgcctagttctgtgataataatgctatcaaaacaagtaaaactcaacctaaaatttttttgaagtcaaactttattaggcataccaacttaagtttctttttcttgtttccatagcaaagccaaagggagtctaaatttacacctccatcgttgaaacattggcagtggctttgctaggcatgccaactcacgtatcaccctctggtaccacctttgtcatgccaactcatatttctttctctaactcgtgtttaggctcattttgatctgtatgagaaaaacctcgaaaatttagaggattttaatcctattgaaaaagtttctaagggtgtgttctatagtacaatttttcaacttctacttcctcaaatattgcgcgtacgcttcccgaagtgctaaatagtgcatgttttgtaaaaaaaatctatacaaaagttgattgaatgtatttttagctaatatttaattaaccatacgttaccatttatgtgacagaagtgttttcaatccttcttaccgaacctcagataagaagccctttgaaaaaaaagatagaaaaagattgaaccatatcaagtctatctctctcatcttttttttttgttttttcctatggtatattcaaacgacttatattttgcatttacatttgtatgaaaatactatgcttttatattcctttttttttcttaatccttcaattcaaaggatcccttaaatttaacatattatttaaaaaacagaatggagatatgttatactataaggacccacatgaaaagccatccaagtatttcattatacaccactcttcattagtactccatccatccattctaaaatataaatatttgaacttctttagaaaagattaaagttgagagaaaacgattttatttttagccacatctttgatcaaattctgaattttgaactagttagattctttctccaaccttctgattggtcgaaaaaatactgagattttggaactgctctcagccggccaggcaagtgttaccaaaagataaaacacggaaaggaaagaaaaaacccagagatgcgccctgccaggtcagctttccgccgcagtctgcccctctgccaccgggccccaccccccacccctgccacaggttactgcctctctctgaccccattgaccaactccgttgaccagtcaaacctctctctccctttcacattttcacccgcctctcgccgctgccgtcctcgctatgaaatgaaatgaaaccaccaccaccaacgacttcctcctccacccgcttcgtcttcgtcttcttcctcctccacctccacttgatcccagcatccgcatccgcagctgcagcagcagcggcgaggtggaggtagctagatccgtgggaggtggtggttgtggtggtgagggggagatgaggggggaggcgaacggggaggaggagcagcagccgccgcggcggaatcatctgcgggacgacgcggaggaggaggaggaggtggagcggagggcggcgaggccggtttccggtcagcagcagcagcagcagcggcggcgaccgacggatgtggggggaggggcggcgatgaggagcgtggggtacgtcgggaagcaccgcctctccgccgccatcgcccgcctcgaccaggagctccagtcgctgcaggtcagcgccacccccctccctcctcttcctctcatctcccatgaacttgattctccgtgtgcttattgcttatcaagcactagtatgtgtgcctttactgtctctgtgctgtggcctgtggatgtgtagcgagtcagcagttcaagctgtggcgcgatctagatcttgagaaaatccagaaaccgaagttttttttttccgttctatcaatgccttcttggcttcttctgttgcgtatgcatgtactgatgtatgtgtacaatcagtacatgcaaagggaaacaaaagagttcttcctttatccacagcttttgttcttacattgaaaaattatgaaagcgttgaaccaaatcacccagactactagacttatagtgctttaaaattaggagtttgtcctaatttgttttttttacattttgtccatgaaacatgtccaccattgcccatattaagccacataatctgcctacttttgtttaagcgggttgcgagtttgagagctttcagggggtattgacaagaacacaagtaacaggattctggtggtctcaatgcatatatagatgtctcctactggacagcttgagctgtgctgaaaatatgattctgcacaactttctgaagtgcagcaagtgttacgcataatgttccaccccctcagtgatttagatcctaaagcagcaccagtggacaagttgaggtacttgcatcccttgtcttcacttgctcttctggcctgtgaccctcagaaacacacatatgttgcttgcctctatatggtagctttctagagcttgttagtgaaacatttgatgggaactgttgactgaggcttataatttgaatggttgaatttgatgaatctactccattacaagtatttgttattttccactatgttctctgattttcagcttctctctcctaggaggaccttgtttttctcctaggggggtaggggatccacagtagtcttctattctcttgggtttaattctctgtattttttctaagttagtggaaaacaagctatgcgcagagagaactacatacattggcaagaagaaaattcagtttcccttaatattctgcatcatagacaggttggatagattattgtgcaatgcaagattcttcaagaatctctccaggctgcattcgtattaaaggttggtgtgcttagcgtaatcctaatagtataaccacctctataaaatcctattcggtccttctggtgctaggccctggaattggtaattaaagtcctggatttagtaatcggaatgaatatgtgctattactcaccagattacgtgtaattatttgtgagcacaatcagttcaactattcttctcatttctgttcgcaaaaacatcttgtttcatcatatcagttgaaactatacagtgagaaattcacttacattttctactggtattttgtttttacttagccacgtttattagaaatattaggctaaaaatcctaactaactcatcgagaggacttttcttatgatttcatttggtttattgtcgccatgctttagttttttttttttatttattgtgatgtatagtatatgtgcatttgacacaggatgaactgaacgagcttgaaaccatggaaccggcatctgctgcatgccaagggtaagtaaattctgagtgtagcatttgttttcccttgtacctaacgtttctctgttttgtgattcttttgtcctcttgatcatgccagagtgatcacaagtacagagggaaaatccgacccgcttcttcctgtgtaagtcgcgatgtttagctactcattctagtacctcaccctgcaagatctgaagatcgtactgcataaggacttgtgtaaccatgatctttctcatctttacagcaccattggtccagagaacgcttcttgggagagatggtttcagcgcgtgcgtagctctcgcagtaacaaatggtgggcatccaaaggctcagatttttcctagccccctcctgcaaagatgagactaccagctttgtgcagattaaaatcacctgaactgtatcatccacggatggcttggcagccaacaagaacacaacgtcgcttgccgccttgcgggctgtctagttcttctcaggacacgcaatagtttttggagagaattgctattgttgttaatgtatgtaatccctaacacgaacatggacgaatgtaccgacattatcttccagagctcttgattagctctgcttgattgattctaatgctttcctgcaatgccatgcaaaacattcagattgcgatgcacaatatgtccatggaaaggatctgggaagaaaaaaaaataacaccaggttctgacctttgacgctcagaattttacatgtgctgtgctgttaatcttcagtcactggccagctgtttatgcaggttatcaacttatcatgcaggtttagtctcgactctgaaatagagttgccgtggttgtgaacaaaatggacggcaaatcagctactccgtcctgaaatataaacatttttaaaatagtgttaagtcaaatatttttaataacaaaaatatagaaaagattaatcatcattaaacacagtatcataatatacaactctttttatttaaagctttttacttttaaacatattattagtcaaagtttcatttcgaaaactatgctaaattcaaaaataattatattttgggacggagatagaactcgctactcagcaccgccacccagcccagccatctcctctgctctctctgccatggcttccaccgtcgccttctccgtgtcgccaattgtccgccgcctgcactgcaggaggccggggaggggaggactcggaggagcacttctatgcccgtcccgagaaccaaggccgtggcccgaacgccgcggcggcgtccgtgcagaccaaggccggaaaagatcaccgacgagcgcggagtggccgcccggctgccgttcccgacgccgcgggcaccggagatcgatcaggcctggcatgctcccccatagaagcattggattcgcaaagggggagaaatctcttgctgtcttcgtaatggacaggtgagttaaccctattccggtcgatcgatatgagaagtttactggcaaccataggtgattgatatgtaacacaacctcctaaacaatccgcattaatcacattgtgttcatctatgcaacagtttagtacacaatccatggtttaacaacaattcaaagtggccaccgatgagttgattgcacatggtaaaaattgctgatagactttgggcttttatccctctaaaaaaagaattgagatgaaaaaaaaaaaagaagagctactacacctttcacgatgatggctgataacacacacgagcattttgtcttattttatttggatgcgaactctgaaataccagcggctgacttagattccattagtactgatacccaattaccccttttgttacgcaatgcactggatagaaatagaataatggctgatatcatttgagatgtcagcggctgggttctattctccttttgacttgtatctgattggtactgatttctgttttgtcagcggctcaagattggagacattacttatttaccttctgtaccattagtgtcaattcccttttgttatgcaatgtaatggacatctatcttacacgaaattgaccatcatattataaagataaatcacaatgaaagtgaatacacaatgcaatagatttgatgcttctgaaagcatttctgttagtcttaacctcttatttttccatggtatgaactaatcagctgcctagagtgacccacagcactgctctgcctgcaacattgcatatagtaattcgagagcacatagtaaaccaaccataatgatttcccactttgacttttggtttattcatacgtatctcttgcatctctaggactttataaagcatcatttgttgttttatgcattgttactctacacagcaaggacctcagagaaacatacaagcaaggtgaaggttcccaagatgatgtcctcaattgctgtagcagcagctagcgctgggctacgaggactagcacagcccatcatcggcaatctcagcagttttgcatctcgctacgttggagtggacatggcacgtgagatggtagacctggagaccatcatccttccccagctcaacctgatcattgcatctgccgagagccaacctcagcatgtgaataacatagtgcagaaatgtctgcaaagactcaaggtagagctgtctcaagctgaagacctgcttgatgaacatgagtacgatcttctcaaacacaggatgaaacagaagaaattatctgtgttttctgtacatggtcagtgccagggtcctatttcaaatccttttatttgggttctcagtaatatatctagcttatcccctcacaacactaagatgttgaatcatttgaaagaggtcaagagcattttagaaaaagcaaaaaatttccttggtgttctttcagttgcaacacaagtgagtgctgacactgcaggaagcagggttattcaagacacaacaacctttcgtgaggaaaaggtttttggacgtgacaaagatcgagattctataatcaacctcttatttgatcctgccatggttggaggaggaaattccaatataaaaggctacagtagcatcgcaattgttggagctggaggcgcaggtaaaactactcttttgcaatatatctgctctgatgatagagtacagaacaatttccatgttatttgggtatgtatgtcacacaagcttgatattcgcaagcatacgacagaggttattgagtctctggccactgaggaaactcctaagatacaaaatctcgatactcttcaaagaaaactcaagaatttgctcctggaaaaaagggaaaaggaattattacttgtactggatgatgtttggtttgaacaaaggcaccatagtgagtgggaacaatttctggcaccactcatctcggctgaatttaacaagggcatcaggattcttgtttctagtcgttccaaagaacttccttcagttctaaactgcaggaaaacagtttctttagaggacatagaggagaatgatttcctaacatttttcaggtactattcccttggtcatgtcctgatagggaacgaagtagtagaagaggaactacaaggaatcggagatgatattgccaagaagctccgacggtccc

SEQ ID NO: 77788 - DNA, 1766 bp, Oryza sativa
cggcccattggctcggccgcgccgtgcttatcccttggcccgtacccgagccgcccaaggaagtctaaatcccatccctccttccttttcttatccaaaggattaataaatccttttccctttttcataaatcaattccttattcccaaaattccataaatcatttcctttggtcccgcgcgtctgtgactgtcaataatattcttgagaatattatttctataaattccataaaccattcctcttattccagaaattccaaataaacttcaaattcatatctctcgatccgtaactccgattgactccgttacacttccagtaattctctaaaattgagatctatctaatggcactactaattagtctaaataggatctttcttttggtcttttgtttaggttttcgattgtttgcgtatagttgcggttatcagatttttgtcgatcgcgggttttctcgaagattcgtgaagctccgtgaagaccttgagcgaggcaagtcaccctttgaccaattgatcctataattggaaaatcattattattttgtttgcaacttgcattagtagaatcacacacttaacttgcttggcctcggtttgcgtgccaaaccgacggacctacccagtagtcgcactaattcctgtaggttgttctaccctgattccttgtcgttccacctttgtggtacttcggtatccatgttctctgagcgcgtatactaactattccacatacaccgttgtttgtcgataatttgggaaatgggtttgagaagtcttgaaaacccgacatgtggcgtcggtgtgtttgaaaacaaaatagattgtgaaaactcacgatgcgggggttgtgcctatgtggtactgtcctgtattcgcatataaggaccgattcctgtgggaaattcatccgagcatataataagtgcgaccacacgggtgcaatgggacgcccctggctgagtaattagctaatcgggggagccatgatgccaagagacttgtggattcaacggggtggtgtcggggagaaccctcgggcttcctggcacagtatggtctgggacctaatctggtgttggtctgggacccctctcgttggcatatggtgaacctgtgtcggctttcgaaatgccttgtcatgaaagccttaaggtctcccgacgtggctgatctcacgggctgggtgatccgggttagtaatgtcgtgtgggtaaagtgtaccccctctgcagaggttaactaactgttcgaacagccgtgcccgcggtcatgggcggatgtgaggtgtttcctgtagcgtagatttgtttgcctgtgttttgtgaaaagttgttgtggtgtgggaatcgttaccagaatcagcctatgtggtagatggatgacctgagtggtcaagaaacgaatctgtgtgattcgggatgtctaccggcatcatagactaggcttctcgagtagaagcggattgttgtgctactaggcagctggactctgggagtccgagaaaatgaaaaaggctctgggagccgattaatcaagtggaatggctctgggagccgagaagtaatgatctgacccgggaggtcggtacattactaaatgagctgttaaaaaacatctcttaaggtcgaaacgagacgcaagtctcttttcggcccaaacttagaaagaaataaatcacttagtgatttcaaaatgatttcaaaacaaaagatttgcaaaaataaccttgcctctcttccaagcttgcattaaacaccta

SEQ ID NO: 77789 - DNA, 11704 bp, Oryza sativa
gagataaaagagacggggcgcgcgcgtgtcgagctagccagcttgccagctgctcttgcgcggagcagcggataaactcatcggaggctacctaattaaccaagcttgcttcctctctgcctacctttgcctacaagtaggtgatcatacgatcgagccgggatgcgtatgctggctggctcctctcttatccgtcttgtcgatcttttattcttttgtacttgtgcccggccggcggccggcggcgccgttgctgtatgtaaattctgccggtcgtctttggcacaggttgtgagcgtgaagggtggtggtggccgccatagctatagctcgtgggattaagggcagccgcgcacaatcgacctgcaaagtgttgccgggagaacagacgcaaagaagggagaagagggcgagcttgacaactgcagctgatagggttgttggttgatctcattgtgaatttgtgatcattggaacaaacaagatttggtgctcgggagtggtgtggattgcgcttcggttcttcctgcagagtaataatatcagtgatctccctccctagctctctcatcatgcataattttttttcctatacaaatttaaatatgttcttgatatagtctctagctactgaatgttttcaccaggaaaattttcctatatacacagaagacataacacatcgacaacttctttattaattgttttcggtctggtgttttttttttcacctaaaaaatctatggcagtttgtgtgggtgtttgtcatcataggggaggcatccagttacattatatcagggtccagtttggctgagatgatcatttcaaagctatatcatccaaacaagctgcacatgatttccatgatttttgtatagaacattgaatatatcaaaataaagagttataatttcagatacatgcatataaacttttccaaatatgaatttctctaagaaatgtcaatcaataataggtcagaggtaagccattactagtctatactttctgttgcttatgatcgtttgttttgtgaatattttaagaagtcatgatgattatttcatgtcataccctaattaattttaccaaaaaatatgttctaaccgtgcatggaggaaacaaggggaagtatgtcagaccttagggtgcatgccctctcagttcatttcatgaattcgatctagacagttatgattttttttttgaaataactgaataacacggattatagtgtcatatcttagggcacaaacagttaaggtctaagttatacttccatttccgaggaagctagggttatgacattaggatatgcttctcttttgtttttttagaaacatagtataaacgcagacgtttaaaacacgtgcacactcatctctttaatttgattgatgacaaataaaaatcttctaagtttacttttacttattttccacatcagttctctccctctcatgagatagaaaataaatgcattgttgtatttgaagttagacgtactatactccagagattctctacagtcaaatgcacagtgcctttgttactgacatgtgagcctagggatcatcggaaccacgtattagtaacaaattaagtcatatgacttcgactgtagaggatcctgatccatacactccctcttgtcgatagtatttaacgttgcgcaccggccggcagctaatacagatatagttgattttttgtcaaggctgtgtatttatcaaaagggatgtgtacatagatagcttctttgacacaaaaggaaacctaaaacattgaattaaccaggtaatcgtgtatatgatgaaagtatggcactttttatctagtgtcatgattgctagcttttcctgaaaatatcatcgatccaattcaaaatgaaacaaaagctaccgatccagttgtagaagaaatattacaaacgatcatgccatctaactaccagacttggttatgaagttagcaatgttacagcagacgaaaaggagataaaaggaatttttcgtgctgtttaattgcatatataatatgttttttttcttttgtgttttctcattggtttgatgatgcttatttttgtgtgatgtttttggatcattctttatgcatctagatgctttgttgtgtatttatatgttagtactattctttatcctgttgctaattactacacgtactggacttaattaatatgtcaacgccagcatttcaaaaacttatactaaaagttatgcatgtccttgcagtcttgctactagtccattagtgaataagatggacactttctcccatgtgccacctggtttccgctttcaccctactgacgaggagctcgtcgattactacctgaggaagaaggtggcatcgaagaaaatcgacctcgacgttataaaagacgtcgacctgtacaaaatcgagccctgggatctccaaggtaattagcatgcatgcaagttgatcgaagaatcaaaaaaatcaaagttaggtttgcgattgaattgagcatccaacatgtacaaatattgcagagaagtgcaagattggcatggaagaacagaatgactggtacttcttcagccacaaagacaaaaagtacccgacgggcacccgcaccaaccgggccacgggcgccggcttctggaaggcgacggggagggacaagcccatctacgcccgcagctgcctcgtcgggatgaggaagacactcgtcttctacaagggccgtgcccccaatggccagaagtcggactggatcatgcacgagtaccgcctcgagaccaacgaaaacggcaccacacctgtatgcatatatttgatgtttggaatttgctccggtccaataaaaaggtaccgtaccttatggtaccaaattgttttttatcatttgatctaacaatgcccaccctgctcagctagatcaaacgatcaaaaatgatttggtgtcatgaggtaacttgagatattttttattggatcggaataaatctcttgatgtttagaatgagattcggtcaaaatccgcctcatgcacctaagtctgactaagtggttgactgatcattggtgcgtgtaggaggaaggatgggtggtctgccgggtgttcaagaagcgggtggcgacggtgcggagaatggccgacggatcaccgtgctggttcgatgaccacggcgccgtcggtgcgttcatgccggacctcagctcgccgaggcagctactgccgcaccaccaccaccaccacccgggctcgtcggcggcgctgtaccacggccaccaccaccagcagctgcagcagatgtacggtcactgcaagccggagctggagtaccaccacctcctgccgcaggaggccttcctgcagcatcttcctcagctggagagccccaagccgccgccgccgcctcctgcggcggcggcctacattggcggccacctcggatcgtcgtcgtccaccgcccttactactcacgacgacgaagcctccggctccgccgcgcagcagcagccgccgtcgttggaggctgtttacatggccggcgccggcgtcggcatcggcgtcgacgcgtcggtgacggactggaggctactggacaagttcgtcgcgtctcagctgctcagcaaggagtccatgtccagctacggatcccatccggctcaggtgtttcaggctgcagacggtggcaagcatgaagaggctttggactacgcttcgacgtcggccggctccggcggcggcgaggctgatctgtggaaatagcttcactttccacataaatataaatccactggacaacatatatacacacacaatttataccatccaaatctgatctagccaagtgtacaaatatatatagctggctatatatatatatcaagagaaacgcacgcatacgtaaataataagtatgtaaccaaagtggttcatattgtttgacatcagatcgcgggatctggtgttaataagttagctgtaaggtgaagccaaggggcttcagtaactaacttgacacaatttgtaaaaaaaaacagtcgagctgtagatggacgtctatttgtgcagtccatcattcgatacggcagctatggtcgctgccgatgcgtcagaaatgtttgtgaacttaacagatgtatcccaattcattgaaaagaatgataagtttatttactgacagaagcactccattggttattagctagtgcaagcagtaaccagtagatatgcaaggaatgaattcggcaacactttgatatacatatatatacggcatcagtcgttcagtacacataacttgtctacagtcctagtttacctgatctctctgcaatgctacaacattcgcaaaacgagaacaatttctctgaatcctgaaccgatctgctttgtcttttgttcagtctccaatgtatatacagcattcagtgctcaatttctgcagtatgctggataattcttcttttattttgcgtcacacataccagttgcttcatcgcagaaaccatcacggtccagaagtttgggtggtggagcactcaaaagaggggaggaagggctcccatatgcatttcggcgactgttgccgcatccaaggcttttccgtgtgctgacccctgttaaagggtttgttccatttgcatatttgcacaaagcctacataccagtttgcctaatattagttatcaggattatcttttgttttctgtataaaagagaatcagagaactcatgcaaaacattgaagatagaccccaacatggcatcatatggtgattcttttatgtatcatccaaaattagttttgaccactgctgaaacagtatggcaccggttctcaacttcaaattcatatgtcacagatgcgggacattaggattatgcaatgtttgttcaagctaaagattgtgttgttagcagttgagcacatggaacttccttcccgaagacatgagacataacagccaggagataatagtcaagttcatgtcaagattctcttgtctgaatattcggttttctcttccatgacacttacttctgcatccatacacagttcgttggccagtgtttaaaaattagtaataccaaaatcagacagcaagcatccataataaaaggaacatttttagaatctgacatgctcaactgcttatcaaacacgtcaaagaagaaaaacccgtggaagaaaaataaaaggaacatttttagaatctgacatgctcaactgcttatcaaacagacccgtggaacatgcaaaaataaaccttagtttgataattactacacgtgatagtagtgtcattcaagtttcatgtacctgtttctgtgtcaggtcaataacagcatcactgaagtctgcaccttcaatgattgctccaccaagatcgctacgcgtaaggactgaccgtacaagcacagcatttgtaaggttagcttcattgagcacctgtcaataacatacaaactttcaatacatgcttaaaggttactttgccttgaaattattattcctgaagaactaaacgatgttgtaaattaagaacaggagactccagtagttgccttaaaaactggtacattgaacctggcttcatattgaaagtaacaatgcattcataagcatttagcaccaaaactaatatatgaatcatttactacactgatcaagaattctgatgcattatctcttttaacacactgatgtcaaattccgcatttgcacaactaagtgcatcacccatatgcccttgagcatcacaagtccataactatatacatgtatttgcagaagatactttgcacaagaaaaacatgacataaagaagttgtaggtttaccatgcgatccatcaaggtatcactcaaatctgcacctgcaaaagaccaaacaatagtacagtgaaattgtgtcataaataactgcatgggaaggttgaagtattctgtaaccattcagatgcagtcaaaagttacaaggattttgaaaaatcagatgcaggactctacttctgcaattgctttcactaacaataacaaagacctaagtaccatgttggttccaattggaacaaaagaaaatgaagtttattgtttgcctcctgatcagagtttaaactgggaaggccttagtggagttcaaacaagggctctctatgatatctctagtgcagtgtctccctgttaaggcatatcactagagtacaggactactaaccacaaaggcacaaaacaggggtaattatttgcatcaagcatgagtgtataataacttcttggagggagtttgacacatccacatactgaaaagatgttgtttcacttaccagtaaaatttgctctataagcaacagccttttcaagataggcaccattgaatgtggaaccactgaaatttgactccctcatatcagcagcagtgaagtttgcccgcctatattgataaatgttgtattaaaaaggaaaaaaaatgatctctttcttgagccatagggaaaattcataacagaaattgagggcacccaacctattaattaagcatatcaatatatctttcatatgcagagaattgtaatatatgctaaaggtggacaaccatgccaagctgaagcagtgatggtaaagattcaaaattggctgctcatctacagattgttttttatgtggctgattactattttgcgatattactattttaatcttccaccctccacataaatgccaatatgttaagcaataaatgccaatatgatagtactatagtaaaactgcttaactaagcaaactttaaactgcaagagcttttatgtcttatctatagcctgcaatggaatcaatgcttgaaaaaaaatgcataacccactggactccagagattgtgtctatctatccagaatactaagatgatgatataacagcataagcatgagctagagaaaagtttgtatcaacacttgcagagaaccaaaattactttataacccaaacaggcatagaccaaatggaatttctgtttatagctgaaattggaaacacaggattcatttggttcaattattacataaaacctatggtaagcagcaaacatttagcaccgcagcacgaaagaatactaatttgggatttgtgaaattaggcatccaacctgaagttctcattaacatggacggccttcctgcaatgatacaagcacggggcgaagaatatcagcgacacgaggcaaaacgaaaggatccgaaaggggaaaggagcccgcgtaacgtacttgaggtcggccgacccaaactgcgcagcggagccaatgccgaactccccacgctgctccgcctcgaacttgttaagatccgcgtaggccggcgccgcggacacaatcgccgccgcgagcgccgcggacaccgcggcacgccacctcggcggcggcgacgccgccgccgccgccgccgccgaggtgctcaacgaattgccgtcccgagaaccccctcggttcgcctggcaggagacgtgcgggaggcggcgaagagggggcgagcgacatctccacggcgtcgggaacgcgcagggcctcgctgcggccgcggcgaggggggaggtggtggggagagccatggcgggggcgtgtgcgcgcgcgctctcgcggcgtgggaggaagcagaagaagagagtgggtgtgggtgaggtgagacgtgttgtggctcgcgcgcgaacacgtagccggccgcgcagccgtcgcgccaccgccggcacgacgcgggggatgcggggaaaagatccagagagcgcgccttgtgggccgagagcctgtagtgggcttccgttatcctccttatgggcctttgccatattgggctccatggctagcaaagcccatgcaggtatctggcccgatgtaacataacaagatggctaaacttggcccatgaatgccagtgtagtagtagactgtagacgttgacaaaaactggtgatgagtacatgctatactggccttggccgtggctagttagctgtcatttctgtcttcacgctggccagtcacttcgttagtatagctacagtagctagtagccgtaattgagtgagctagtagacgcgcacatgcatgtattatacgctcgtatcgtatatatgtacagtacagactacagagagtacacttgctgcaacctgtagcaggctatacggctatacatatacgtataccgggcgcgcatcatgtacatatgtacgcggtactgccttgtcgtaaggttactttgatttgccgcgagatgccggcaatgacgacggtctgggttggaatctgtaacgacctgacccaatctgctcaaccggcatccctatcatttctgggctctgatgatcagatgatccttcagaacagctagctctggcctgtctgccggaccacagcgaagctatagcttagcttgagcaaattttcttttctgaaactgttactacttactgctattgcttgtgtattaggagtacagcattttctttcctcttctcttacgcttgtttaattagcgcaccctgcctgatgcctatagtatatagctactgttgtataggagtgtattagggggtgtttgagagagagggactaaaaacaccctcttttcatgcagatgcagctagccctaagctagctacaagcaggagccatggcatctaagttgacttggggattcaagactgtctactagctgctgctgcatgatgggcgtcttcgttgctggagtatcctactactacactgctgctgcacgcgtgtcatgcataagttttcatatttactccattattagctagtacccctgcattgcctctgcatctcagcatgcagaattgcagatgcagggtaagctgcttgcaggtttcagcctagtacgacgctttcctcagccccggaccattctatatatccgtattttatttgattaattatgcaagcgtaggctgcaatgcagtataagtatatagtagtataatacgattagtatatatgcttctgtattaatgcatcatttagcaagtatttcaaccgatagcatgtaccagactcgcaaccattcaggccattcccaacccaatgactaggatggtgtccatagcattaaataagctgacacttaaaataaaaaatgatgtgtcaagtgaataaatgaggaaagagaaggaaaccatgtcttgcatgagacatagtttctacacaacatccaagacattatgtgagataagtagcattaaatttaagtatggaatagtattgtttgcattgaaagagtagtgtctagcactagtttcttggtaatgtgaagtttatggaaaccatatctagtgtcttgggttgagaatgccctcatgcagtgctcatttaacgcgtgcatggaagcatgcatgatgcatctaccggtcgatcagtgcatgcctagtacgtgtgcatacggcgcatggtcagttaacacaacacatactccctccatacttgtaaaggaagtcatttagtataataacacggtctccaaaacataactttaacttcttatttctataaaaatatttattgaaaaatgatatatgtatacttttaggaaagtattttttaagacaaatctatacatataatttttacattttcaaactcaacaacgtgagaattattcatgatttatattttcaaggcttgacttaaatattgttctaaacgaatttctttattagtaaggagtagtatactatactcgtactacgttatctgagcaagtcgatcgttgcattggtccccggctctgccatgcatgcatggctagctttgcctctccttttttttttcttcttctctcgaagagctaaatacttcaattcaattgaggaagaggcgtgtcacactcacaccggtatacgacgaattatgtctcaggaccggccggatggccggctgaccaaaagactgagctagctgaggcagctgagtagctgaccgagaagggtacgtacgtctggaatctctagctagctccggccatggcatcagctcactctcgattgcagtttaattactactctctccatccataaatataagggattataccaatttcaatactccctccgtctcaaaatataataaatttagagttagacacgattattaagaaaataggtagaaatgaatggtggaggtttatgattgcatgagtagtagagagacggaaaatgtgaatgctggagggttgtgattggtttgaaaaagaatgttggtggagaagttattatattttagacaaatcttgagtgctaaagttgttatattttgggacggaaggagtaagaattaattaaggaagtggtaaaaggacatgtgatggaacagaaggtgatgggtgaaagaataaagtagtataaaagttactaggtgagagaataaattaggataaaagtagatggtagaggaataaaatattataaaaattagtaggtggagaatatagtactatgttaggattctaaaacttatattttaagacaagttggatagagaaagtcccttatattcacggatagagggagtacttccgtactgatcgagggccggagaggaagctcgagagagagaaacaacaccaaacatgtatattacgtatgtgttagctagctagctagcctgcaaaatctgttctgccattttctgtggtgttgcaagagattagtaactaacttctgaagcactactatatatatgattattctgaacgagcagctagcctaatagatctcagacgggatataagtggtcccttgggaccaggtcatagactatacacgaatatcgattatcacgtgtggttgcttaagaggacgtaccttacgcaatacggccacatcgcatgcagtcctctaatgtgagaccacacgcgataatcgatctttgcgtacagttgcttaataggaatgatgcgatgatggtgatcttcgcggacctctaagagcagaagttatccaaccgcacgcgaaatcgtgtttcggtcatttggaaaaatcttttctaactcctattcctaactgtgcagctgatcacgcgcggcttcgctagcttcttgtggtcgtggtaaatcaccaaaatggcgcgtagactaatttaataggagtgggaattaatggttgatcttcggacactatattaataagccattttgcgttgatacgaaaatgtgacttaccaattttctgacaatttaaataataaattaatgtgctagttcggattaaattcaacaaattggtagtgccatgtttcatttggctaaattttaaaagtttcttcactataatattaaattctggcttcatactgttctcaatctaaacataagctagctaattctaccttaccaattcattggtaatactaaagtttatttagattttagtactaccaataaatcagtaggatagataatcaaacaagccctatctagtttgctgtagcttattagcgatcgtcgatctcacccttctgaaaaggtttctttgtattccctggccatgaaacgacagggttaggcacaagcagcgaagggaataaagcttgacggtgagagcatatctcttggtgtgcgtgaatgccctgcaggctttatgtaaacaatgaaagaaagaaaagcaatctaaactatgattatgtttacttcacttc

SEQ ID NO: 77790 - DNA, 13556 bp, Oryza sativa
  unsure (1)..(13556): unsure at all n locations
tgtgctgtccctctgctttttcagcagttacacactaccaaagcacataggcaagttgaagcatctcagatacttgaatctggaaaggacgtccatttccaagttgccaaaatcttcgtgcaaactataccacttgctagtactcaaaatgaacaaaaaggtgcccaaaacattgccaaagaaagcaaacaatctcatcagtttgaggcgcatcaacggccctttgaaagacgtatgtaatgtcgggatgcttacttctcttgaagatatgaaagaattccaagtgaagaaagagaagggatatgaaataggtcagctaggcagcctgaccaaacttcgaggacatctccatatcatgaatcttgagaatgtgcaaaataggaatgcggcaaaggatgcaaagctccaagaaaaagccaatcttgatgcattgcggttggtgtggaaccatgacacatacaagaacaacaatgttgacttggaggtactcgagggacttgagccttcttcaagactgaatgaacttgcatagaaggttacagatccacttcatacccaaagtggttaagcggttgctctcaaagtttgaggtctcttgagctcttgaactgtacctttctagagaacctcccatccaatcttcaatgcttcgcccgctgccgtagtctagctcttctgaatctcacagggctcaagaggctgtcacctctcccagaaaatctcacaagtttaaaattcggtggatgcccgtcactctgcttcatttcaaaggaggaagaagaacatggagtaaacccggccagggagaaagctttgcagcctctgacgagctctaccgagctggaaacacttactgaaatcctaagactggatgggtcagaactggagcagtttcaggcatgcttccaggagctccagtatccagtaagcacaatttctgccagacgccgtgatgttgcgcaactggtcctgccattaacgctccggaggctcgagctatcaagctgcaacatcacagatcaggccttgtctgaatgcctgcgaagcctcacctctctgaaagacctggcactgttgcatatcaccaccttatctgcactcccgtcaaagcaggttatggagaatttgtccatgctttcatcggtgggcataacttcatgccggtctctctgctccgtggctggcttgggagccattgcttcacttgagaagttcgcaataagcttctgtccctcactagagctctcggaccgccgcatccttccctcccagctgaaggaggtcacggttcgtggctgcacgatccatgatggttttctgcatgatgatctaccatttctggtcaaccttgagatatccaaatgcagaaccccctcggttctacaagtcggtgcatggccttctctcaaatgcctgaagctgtgtgattgcctggatgtttgcttcctagtagggttacctgctctggagtcactccaagaagtgcagttggtgctcccaaaccttggagctgattcttttaccggatgcaaagggaactggagatcactccgagttaggacatcatctctgctccatgatttgtctgaactagagggctttgcgcccccgatgctgctgacaattgagggttgccaagagccagacttctcgttggagggcattcaaaatctctcatcaatcatcggcctgagtttcatgaactgcaaagtccaatccatttcagcaatgaaagacctcgcgtctttggagactcttgccttctttgactgcccattgctgatttcattgcctgaactgcctccatcagttcaatatctggacataattggctgccaaatcctggagaagagttgccgatcccgtcgtggggaagaccggcgaaagatttctcagatccctcacgtggtaatgtatgagtaatggtgatgcttggaacgctgcgagcattctgcaaggttgcaattggtgttcacttgtttatcctagatatcctgcaaggttacttggagaaatgaacttttcaccaattacactcgcagatagatttagtgattttttgaaagattaactgtaagatttcgtccttcagtagatagatacccctctatgaatattgtcaaaatcagtgagtgaattggggatttaactgttgatccattgagttggcccttagggctaatatgagatgaatacaacgtgaaaagacagaaataccccttaacatatacacactaagggcctggagctggagctcagccaaacagtttcagctccaccgaaatagggagtggagttgggtgaagctctctcacaaaatgtaccacaactccactctagacctaactgctgaagctaaatttaggagttagagctgtaccgaacaggcccttaaatcttggtagctcaactcctaatatggtgaaaaattgcctctcaactctgaaaactgcttaaaacttcatttaaaatctgatgaaaggggagacataacgattaacgtgggacgaaatccctatatgacaagtgaatactttcgtcaggttttcagttcttcctgtccttctcttcgattcctcgtggtctggtctgccatggctaccaccgtcgcattctccccggccgtcgccaatgctctaggagagggaggaggagcgattctctgcctgccttgagaaccagagccacggtcgttagggccggcgaggtcggggaggaccatcaaggagtgcgaggcggacgtggtcgccggaaatgttaggaaatgataggcaacaaacgataaaaaacaatagatcaatcacaaaagacacgagatttaacgtggaaaaccctcccaaaacaggagagaaaaaaccacgggcgccaaccaggaaaatatcttcactatatctggggtnanncacaacgccgcacggcggcttacaagaggtatatatatggtagaaccctaaaagggatgacgatctgtttcgcgggggcctccgctccactacggcagaagttaccctttattaagtgcaaatgaatttgtatcagacctctgaatttgtaagttatcacatgaacccaacaagttacagagagcaatgtttcatctgctaggtgaagcctggatgtcctccggctgcaaaatctgatgatattttcctagtgtattactcatgttcagtacaattttctctagcataactgtccttgaaacctgtgtatatgtaaaagtataatttcccccaaagctgccgaatgagcttgtcccataatgacatcaaggctatgaaactttcccattccagccaggattgacaatgtgtgtagcagtccttgaaacttgaattaatgaaatgcacatatgatgcctgatcatttgtcacatatgtgcagctgccaagttctatgtgtgtcttatctcgtttcttgaatggtcgtattcgcaacgacattaaccatggtattgtcttgtaggtctccggcgagtactcgatgatcaaagccggcggcgcgctgaagatggtggaccacgagagggtgatgatggagtcgctgctgtgcctgcctccggcgagccggcgccgacatcatcctcacctacttcgccggccgccaggccgccaacctcctctccggcatgcgccccgtctcatccaactgatgcccaactgtactgtacgtgtgctcctctcttttcccctctgcatcgcgtattcgcggtacgtcgtcatcaatgtgttgcgatgcctggacattggggatgaataggatacgagatttgataggatcctatactcgtggggttcacatggtcattgacaggtggggcccacgctcctgctcccgccagtacgtggccctggcttccagtggccgcgctctactggatagagactggagtacctctgactcccaagcaggattcaccaaatcgttttgggtagagttaccgtcatcccgcggtttagcggttatcgtgaaaaccatgtgattattatggggtatactatgattttaaaaattgagaaggttaccgcacgtgtgataaccataataacagcactgttttataaatcctatgtcagcatgacgtatcggtgacgtcatcatctatgaattaccactaccctggttaattactccgttaattaattttgtcaaggtaacagcggcgtggcggcgcgaccaagctattcccagtggccgcatctgcgccatccagcccactaccaatgctactgtcctccaatcaaaccggctcattgttgctaagaaactagtaagtcagctgcaaacatattttaaaaagataaataaggagagagaagtgcagcgggctacttgtagccagctgtagcacgaactccaagacacagtgtgtgtatgataggtgggattagatattaatagtgtagtatgtaactattgtataaatgagctactagattagctattgataaactgaagctagtagttggcaatactattgaacttgctcgtagcagtgtcacgttatctgcagacagccggatgcacacgtcgtgttgttcgatgtgcaatcatcgagaagattgcactactgggggcacagggtagcgtagttggcactttgtgaaatgaacatggttcaccggtcccaacagccgatccattcgattcgagcaccctccaacactagctttgccgtacgccatcaggaaggaaggaggatgacacaaactgcaatgcctagcagagggttcccagatctcgagctggtgcgaacaacacaccttccaatcttccatatctcgtagtcctatatatgcactccccccttttcgtttggatgataagtgaaaaagacaatgctacctccgtcccaaaataagtgcagccatatgaatccatgtctaatatttgaccatccgtcttatttgaaaaaaatttatgagaaaattaaaataagttagtcacacatagagtactattcatgttttatcatctaataacaataaaaatattaatcgtaaaaaaaattcaaataaaacgaacgatcaaacgtgagacatgaacagtgtaaaactgcacttattttgggacggaggtagtacaacatactcgtttactttgaataaaaattttatatacttattcttaacgatgaaatagtaaaggctaaaaaaataaactttgacaaaaaaaaatcaaaataaactttaaaattaaagttgaaaatttaaattttctttaataagcataaacgaaaagatgaggcctcgcacacaaacaagaggatctttagtatatcctccatcttgttgcacgtacaatatgtgtttctaactctttgatagacgggttttttctccgaaacaggatagatttatgctaagaagatattacagtagatctttgttgttaaaagaaagagagagaaaaacatatgaacacttcaaacaaacgggttctacattttgaaatgtcgcaagagctgcaagaagacaaaccataacgctcgtagactctggtacatacaaaagtataagagcgagtatggaataataccgttttcactcttcaatcacctgatagatctataaaacggatggcactgatcaagttagcgtcttttgaaacaggtgctaccgattggattatcgacaacataacatgcatgcattggtattttatctgaaatattgatcatggtacaaaaagaatagtttaccactccacaaaatgggaaccgactatttcccatgctgggtcacttggacagttccatatgccaatgtcatcgagtgacagcataatcaaagtgacaacctttgggccaacgaatcatcaacttttttcctcaaaaatatcatcaaccctgtccttcccctagcataaatcggtctggctgattgtattgtgtattatatattaacgtgcaatcttttttgccgaaaaaaatcatcaaccttggtctaatgctttttagagaaaaaccacctgggctaatgttggctttggcaggagtcatagctacgcgatccaaaggttgggccagagactgaacgtaattatgtaacgtgatcgaacccaaccacacaaatacaggcggtcgctagcagcagcacatgacccccaggtcagaaacgcggagcaacgtgaccgcacgtgggccccggaccgaccgaccgaccgacggacgatccacggccaccggcgtcagccggccacgtgcggccgggatcatcctggccgtccatggcacctacttggcccacatgaacagccacgatgccgctgtggcgcttcgaccacggcgtctaccggaccaccgaccacagtggcacagtgttacgcacccctctctctcactgacccttgggcccaaccatgtaagagctagttcaataatataaccaactgctagcttaaaaaaggttaaaacataagtaatctataaccaacatactaacaatctactcatataataattagttatatatatatatatagcatataggagtataatatatcgtatcattaatacatacctcttccgctaaaaaagtttcaattctaagaatgaatttggacaatccatctttagaattttttttattggataaggagggagtaattcaatcatctctcacatactgtagtagcttgttttctctcttctccatataagggcatatttagttcccaaaaagttttttcctaaaacatcatatcgaatctttggacacatacatgtagcattaaatatagattttttaaaaaactaattgcacagttagagagaaaatcgcgagacgaatattttgagtctaattagtccatgattagccataagtgctacagtaacccgcatgtactaatgaccgattaattaagctcaagagattcgtctcgcactttctaggtgagttatgaaattaatttttttattcgtgtccgaaaacttcttctgatatccggtcaaatgtccgataagacaaccaaaaattttctcagagcctcagaggtctttagctcttaatccaggtgattatccttggaaagatggcacgagcccacgagagccatggacacatgcatatgatccatcgctgatggcgacagcgagaacaggaggcacacacgaagtacaagacgatgcccacttcactccctcctcggtttccagtcacgggcgccgatctcatcaaccacctgcatctcatctcattgattctgattctctcatctctctcactctctctcatcgcgtagctgaagacaaacgccatttcgatcctgatttgacaatcaccttgccctttgagatccttgtgaaggcagcaaaaaatttgagatcgcctctctcatgcaaacattctcatgtcattttgcatgaaccttaacgagaaactaatccatgctaaacatgagctgtcgtagatgtcatgtcatgtaattaagctcaaaattacaccgaaattaattaattaataaatccgatgatttgattcagatttgagaacgaggaaggaatcaaagaaagaaggaagaaagaatacatagcggagctcttttaatccaatttttcatccaatactcgcgaggaagaagaaatgaaaagaaaaaaaagaagaaagaaagcaaaaaaaaaaataaaaatcaagaagcaaaattactacagggagatcgaggtattatactggcgggcgccgctcgatccgccggcggcgactagttgtacggcttcaccggcggcggcggcgacgcgtacgacacgccgtacaccggcgggaacgggagcttcccgccgggcggcgttgacgtcgacggcgggtgtccaccaccgtggccgccgccggtgctgctaccgtgagacggcggcgagcagttgtgcggcgtcggcggcgggtggaagcttggccccgatggcgatggcggggtggatggatgcgagtgcgatggtggcgtggtggtcggggtccccgctcccggcacgtgctgcgtcggcggcgacgcgccgggctggcccgacggcggctggtagccggaggaaggcgacggcggcgagccggagaacggaggggtctaggggatggggccgtacgagccaggcggcggcgcgaaccgcacgtctggtctgtcggccgaggtcggcggaagaagcgtgtatgtaaccgccggccaagggtaggacggatgagtaggcgtgctctgcggcggcgagtgggacggcggancggtggagctcgacggcggtgacgggtgtgatggggtggtgtggccctgcggcggcgagtggtaggacggggtcgtggagctcgacggcggcgaggggtaggacggagtggtggatcccggcggcgaggggtgcgacggtgtactgggcttgccaccattgggcgacgggtaggacggtgtggtcgagctcgagccccccggcggcgagtgggacgacggtgtggtggcgctggatggcggcgacgggtaggacggggtgttcgaccccggtggcgccgggtaggacgacgacggcgaggggtatgacggggtaggagagctcgatggcggctgcgggtacggacctctgcgccgtggcggcgagctcaccggcgccggtggcccttggccaccacgtccagggctaccaccgggcgtcggggtgtaggacgcggcctggcattgcgccttgctgcagtcgaacgggtgcgccgcagcggcggcgcactgcgacggcggccgctgccccggcgcgccggggatgcagttccacacgccgtcggcggtggccacgccgcagcccgggcgcgaggtgatgaagttgtccgtgtaggtgaagttcttgaggctggcgaggccgcagacgccggccggcacggccccctcgaagaggttcctggcgacgtcgagctgctcgacggcggccatcccggcaacgctcgccgggatcgggccctgcaggtggttgtcgctgacgtcgaacaccgtcaccttcctgagcagccccacctgcgtggggacgcagccggtgagctcgtcggcgatgagcacgatctcgttgagcgtgtccgccatcttgccgatggacggcgggatgcatcccccgaggttgttgtgcgcgagcacgacgacgctcgccggcgagttgccgaggttggccgggatggggttgcggaggcggttggagttgaggaagatggcgtcgagcgggcggtcgaacagcgcgggcgggatggagccctcgaagtcgttgaacctgaggtcgaggtagcggagcgaggggagcgcgagcaccacctccgggaacgcgccgacgaagcggttgttgctgaggtcgagctcgtggagcaagcggaggcggcggaacgtgtcgggcacgacgccgcagaagcggttggagttgaggtggatgagggcgaggtcggggagccccagcgggagcgacgccggcaggtacccggcgatgtcggcgtggttgaggtcaatgccggcgacgacgagacctccacctccgccgccgccgtagccgggcgacggcgcgcagtagacgccgttgtaggcgcagacgttggcgccgacccagctggcggtgaagttggaggggtcggagaagatggccgtctgcttccacgcctggagcgcggcgtacgcggcgcggaggcgcgggttggggaacgcccacgacggcggcgcgtcgtaccgcgacgcgaacgacgccgcgtactcctccgacacgttgccctcgtgctgtgccaccgccgccccgagcagcagcagcagcagcgcccacgccgcggcggcgtggccgcgagagatcatcgtggaacgacgcggcggcgacaggagcttcgctagtgggaggcgagtgtgcagtgtgtggcagtgtgtgggggagcgtgggggtgtgatgtgtgaggagagggagtgggcattcagagcgggtcacatgggtggagaggggtcacatggggggtggcggtgcggcggtggaggacgaggcacggacgaagaggagcgcgaagggagcgttttaacgtgggggagtttgatgattttttcccattttttgaatttttaaatttaaaaaacaaatattttcaagacttattttctactcccttcgtaaaaaaaaatcaatcctaaattaattattttgggactgatggagtagatcagaacatttttccgctccagctcaacagcagctcaacaacactgttacaccggtctaaatggcgtgaccagtgctatttgatcacgttgattcatggatacaccaattataatgttgttaggataatactatcacactaattatagattgtgtgacaattttattttagcacgctagacagtattggtgccatggtgtggctgaaagtttacagattttgaaaataagtttttgaattgtttattttttgaataagaaataaaaattcgagtttggtggtttggcggtgtgattggggacgtggacggatggatgggttgcaatgtggaggtacgtgttggttgctgcgttggagtagtgctgggctgctggctggtttggcgagctggatggagttgtttacgcatccccatgtatggccgtggcgtgatatggtactacgcgtcggtgtttgtgttcgaattagtaattcaaaaggttcgcgcctgtggcggcgcagagcagacagccaccatggatttcagtattctcccgccatctactttttaatagttatattttatcttaaaaaacagaccaacgatgagtcattctacttattatctatttaaatacactactagcatttctcgtaaacaagcgattcattaatatttacatttttcgatacccatgtagccaatcttgtgtggaagaatggagagtcacgcattaaatttaagaaagccattaagatgataatttgttggattaaaatatgtctatcaaaaataaattttttagatttggaaatatgactatcaaaaatagatggagggagtatttcactagccgtatccagagtttgcaaaaccgctcggtttcagtcttaaaaatcaaacgatttttaaatttttttgacaacaatttaaccacatttcgccaggagataaaggttttcaaaaaacttctaaggatgtgtttagttcacgccaaaatttaaagtttggttgaaattggaacgatgtggcggaaaagttagaagtttgtgtgtgtaggaaagttttgatgtgatggaaaagttagaagtttggaactaaactcggcctaaaccttttttttttactcgggaacggtttgatgaaatcctggctgtattgctgttttagaaaactctttttggtgaaaatgtaaatttaagcatataatccgtctatgcttctgtgtggaaccaagcgagcgatgaatatgaaatctcacagatattgagctgattttaacaaggttcatatagaatcaatgctttcctgatggacgtagcccttgtttagttctaaattttttcttcaaactttcaatttttctatcacatcaaaactttcctacacacataaattttcaacttttctgtcacatcgttttaatttcaaacaaacttttaatttttaacgtgaactaaacatacctgtagtgcaattcatgcataacaaaaggacgacctcagattccagcgacaagaactgtcctgagcccaaaattgatggtgttcacctacggagtacgttgcaagaaatggaaacttgaaagtgatgtggtggagacaaggcttaacacatgcccagctcaatttactctccagttcaattagccagtcttgactaaactaattactactattactactaactgggaatcagatcatggaccatgcctgcattaactggaccacttggttacttacaaggattaattaccaccagctagagtcgtcgcccatgaagtcgttgcagttaattatgcaaggtaagagggtaattaagaggcgcatgattaggtaaggatcagatccagagaacctaacgtgccggccaggttagagtaatagttgcactagtaatacatctccattccgtactgtttcctctcaaacgatttcaaaggcatccagcttcaaaactttttgaaagcaatgagaatgcaagaggaaacagcttgttgatgcagacaaaggtgtcagtaatttaacctaaacttcttggaagctggtgcattattgtatttgtccttttgggttccaactccagtctccagtgctcttaaacttttgatttcttttttcaacatctgataataatcccttcatcatccagagatcaatccagtgtttccacaggaagctctgacaccctctcccttgttcaattgctaattagagggtcccacagctccttgattgcattggctccagttgtactactacactgaagctctgcaatagtacagtaaaattaaatggaaaaacttagtggtattttcaattttacaggagagagaattagagaagacagtggcatattcatgagtaattagtcaggcagtagactaccaaaatcttctgcagtaatagcaatggagtctcttgcactcaatgatactacaatttgcaaagctgatcaatgaaataaagctagctagcttagactgtaaacgtgtacgaggtagtactacaaaagctatatataatgctactaccagtataattatactggactgccaagtagttgctgtttttttttctctttccaagagtgtttatataattagtaccccacttcagtacttcagtaggagatctatatacatgttcatgtactgtgctgtacttttcatccgagttggcgacaccttacagaatacagagagatatgcaaggacgtaatagcagccttcaatatgcagttatgccaatttgcaacatggagtagtagtaatgatcatggcaaagtataaagccgtatgtatgctagtatggctgtaacatggagagatgaatgtagttcacatgatcttgtctccaaattcaactgaaaaaaaaataaacgtacgaatcgtttggtttggtttggtcctttttattcggagttattaagatccatgtgatgaccatgtatgcatactctagttagcagttacttcctccgttgcatctatatgaatgtgaacaatgctagaatgacttacattacgaaatagagggaatactagtttagtattaaattaaactttgattcaccgtacaaatgaagctgggagatatcaatgaaatagacggtatcaaacagtagagtagaggtggtgaacagtacgacgactggtactcctgtagagtaccatatgtcatttttttcatgtatcatttttttcatgtatatatctgcatttccggcgcatttaataggcatgaaaaatgcaattagcagggcgagatgagattaatttggtttacacgtcacctcatgcacttcgttgttgatggaggcatggccatgtgcattaatcgtcgttggatcaaagatatgagaagcgttttgatcaatctgcattgatgctttacgtttgtatggtactccctccatctctttttatccttttt

SEQ ID NO: 77791 - DNA, 717 bp, Oryza sativa
tttcacaaatagcaaaggatttttatttttgataatattgctaaggcttgggatctacggctcgtcctagggtcaagggggctctgataccaacttgtcacgaccggaattaacccaacgggcgttcctttcgtgcgtgtattattccttgtcccaggaggcaaggtacaccaagagttcatacaattcagagtttaacaagcggaagcgtaaatagataatttattacatgggcgacgaaggcccagcacacacaaagacaaacgagaaacagcggaagactagggcgacgacaacaggcgcttgacggcaggcacgagctagacaccaaagccttcatcatccaggggctcctcttctgggttgggaaaaattgagcaagactcagtacaaccaccgtactcaacaagacacacccacaagtgcataatatatgcaagggagtacaagggagttataatataaagggttagggttgcagtaaacagcatttaaagatgcttagttgctcaaagctattttgtaaacacgattctagaactatgcaatattatttatcaaggccgtgaacccacacgaacctgccttaaccccaggcctacgatgattcagaccaaaccggcaacccgaccctgggtcccagctcgtcccaagccaacccaggccaaccattccacattttagttgttaagcatgttttaagaattcaaacactaa

SEQ ID NO: 77792 - DNA, 3196 bp, Oryza sativa
aattgaccattaataattatgaacttaaataatgaatttgtttaatttctaaaaaaagtctattaaaaattctatgaaaaacacaccgtttaacaatttagcgagcatgcttatagaaaacgagatagccactagccaacttaagaagctgcctcgaactcagctaaattgttttacattatttttataactatttacattatcatttaaggtaattagagacatccacttagggattcttggaaatggaggaaatttggagagattctgtataattaaactgaactgaaaaacgtgcattcggaaggaactcttgaagttaaaacaaaacagtttcccatgaattgaacgggaccatggaatgatcgatctgagcacgagcagcagatacgcgagctcagctagcagctagctgtagcgccaaacgctgcccttccctgcaacttgcgatgatctctggcccttttctgctttctaccacggcgacgcgtaaagagaggagaagacagaagacgcgttttgatccacctatagctatcaatcatcacgcattgcttgcagctgagctgtgatcgagtttgcctttttctctcctttctctgttcgctgcatatgctgttgctgatcgagtactgtacatgcatgcagcgtctgatgcgattgcgagaaagttcaggacatttttcggcttgtctcccattctgccattttcatcctcctcactatcgatccactccaaagtccaaaccgtcactgggagagtccatttctcacaagccaaattgggacaaagtccaaatcgtactactccctctgtcaaaaatatatataatatttatattaatatttaccattattctttatactctctccgtttatattataaaccgtgttaactttttcctaattcaaattcatttaaatttatagaaaatatagcaacatcaatgacactaaattagtttcattatatttattattaaatatatttttatagtacatatattttgtgttgaaaattttattacgttttctataattttagtcagacttagaactttgacgttaattacgatacaaaatggagatagtatcaaaataagtacagttttatctccttacctttattccgcaaaataatttcctgttaatataggatatttcagtctttctttgaatattaagccgttagtagagtaaaaatttaaacagggaaaagaactgcacagctggttggtatgcttatatcaccatattcgagtgcaggtattctccaggtacaatgcaggtcgatttcgattcgattcgatttcagcgtacactggtggaaaaatgttttttactaccaatttagaacgtgactaaatatcgctatctttagttccgggatcaatctttagtctcggttggtaacaccaactgggaataaagagggggaatctttagtcccggtcggtgggaagcgacagttcctcgagatcttttttttattttattgttgaattgctaatggctagtgttaatccctgtattttctcccgaatcaattttctcccgaatcaaatgggatgcacctccccaaatcaacatcccaaatattaagttacttatacgcacagatcaaatacatcacaaatcctatacacaaatcaaatacatcacaaatcctaaaaaactacacacaaattaaatacatcacagattatacaaattatacataccagatccatgcgatgcaatgaatcacaaaatctaaaaaattatacatccagtgaaacacaaattaaaaaaaaaaagaaaagcaaacaagccggcaccctaccgcagtcgtggccgccgcccgcctgcccgcgcgcggccgcgccgccgccacccgccgcccgcctgcctgccgccgctgcctccccccgcgcggccgcgcagccgcctcccaccgccggccggctgatgggagggaggagaggggaggaggagaagaggaaggggaggggaggaggaagaggattggatgtgagaagaggaagagaggggatgtttcaatcttatctaaatatctgtctgggacttaaccgatcagatgtgggagagaaatatttactcccggttgataactccaaccgggactaaagatcaatctttagtcccggttgataccgggagtaaaaatcaatcgatctttactcccggttggtatcaccaatcgggactaaagtggtaatctttagtcccggttggtagtataaaccgggactaaagattctcgaccccctgacatacatctgataggggatgaaccgggactaaagatcctggatctttagtccagatcaaaaaatttttaaccaggactaaaaatcgtttttagtctcggtttttaatggaaccgggactattgtgggatttggttgaccgaccaaagatggtttctccaccagtggtagtaggcaagtaaaaccaggtggttggttattcacagaagatggacacatgcatgggcagaacgaaagagagatgagccggggagacgacaggcgagaggtggtgaacatgcgtctcccatatgcgaatgttctccaactacacgtacagttggcacttggcagactcacacacgctagctagcagcatcataacaacctcattgtaaatttagctattatgtctatttcaaaatataattaattttaactataatatagataaattatgataaatattgtttagatttatagctaaaagtattatattttagaacgaatgtgtcaggctagcaactgctactgctattggtacgtcagctcgcttgccttggctagctagctgcgctgggctgggttggcttcctctagctaaggctgtgtttagttcatactgaagtttgaaggtttggttgaaattgaaacgatatgattgaaaagtcgtgtgtgtataaaaagtttaatatgatggaaagttgaaagtttgaaaaaaaactttgaaactaaacaaggcttaggttcaattcgttccttgccaagcatgctatactttgctttgatgcccgaaataatggcaccgccctccttcctgatccaatgatagatactccattcttcctaaaatataaaaagatttaggtacatgtgatacattatagtatcatgaatttatgatatatcacatccacttaaaactctttatattttaggacggagag

SEQ ID NO: 77793 - DNA, 536 bp, Oryza sativa
gaccgcacgggagaatatatggaaaattagccaaaaattgaccgagcttagttacaaacatcaaattaaatcaaattacatagaatgtatagtgtttgtaatgttacaagtatccccgcgacaaataaaccttttagtccacagcatgttccctctcccactcccttaggttcttgaatttggggtgcgtagcaagttcgctatgaggatcatggaactgtcacgaccggaattaacccaacgggcgttcctttcgtgcgtgtattattccttgtcccaggaggcaaggtacaccaagagttgatacaattcagagtttaacaagcggaagcgtaaatagataatttattacatgggcgacgaaggcccagcacacacaaagacaaacgagaaacagcggaagactacggcgacgaccacaggcgcttgacggcaggcacgagctgcggcccggtagtctagatgtcctggcacacggccggtgtcctgctgctaggggctcagtcctgcctgcctgtccagggggttccggccgt

SEQ ID NO: 77794 - DNA, 1490 bp, Oryza sativa
gggtgaggatttcttgcttgaatagtcttgtgttcttagtagtcacactaattcagagcatttacatgaaatttggttgccatgacttcacttggcacttggcaggtgaaaagcaaacttgttttagcgtagaattagcagaccatatagccaactataacagttcaagagccatccacatttttttatgttgaagctagaaactgatttcgtgtgtttagatggcaggggtcaaaccagatggtattacttttgttggggtcatcttggcttgtacccatggaggtttggtgaatgaaggcaagctattctttgactcgatggaagcagagtttagtctgaaaccgagaattgagcactatggctgcatggttgaccttctcgggcgtgctggtctcctgattgaatcatacagtctgattgcgagcatgccagtggagcctgacgctgtcatctggggggccttgcttggtgcttgcagcttccatggcaatgtagaactagcagaattagcaatggacaagctcatccaccttgagccacaaaacacggcaaacctagtgatcctttcaaacatatatgcgtcatctggcaaatgggatggtgttgcccaagtatggaagttactaaaggagaaagaccacaagaaatcagctgggtacagcttcattgagttagatggtacgatgcataagttccttgttgaggataagtcacatccaagatttgaggaagtatacaatacccttaatagtgtcacaatgaccatgaagctggttggcttggaaaacctggaagaattgaaaggctaggttctctgtcagtctttggtgtagcctgtaagacaccaagcaatgggaataaaacgtgaccaagtagtacaagatttcttgtgaactatttgtctgatctttcatgttgaattggcatgcaaagggatgcaccaaggagacaatcagacaaaagacataatggcctggatgttgagtctctagcacatatttcaatataacaaaatggttctctgttgtgcttgttattcattggtataagactactaggcatattgcagctaaagcatgtcaatggcagatataccacaaggtaaatctcttcttattaatagtgaaatttagaactgacaatactgctttagtgattttccttatgttttattgcatggcatgaatcgtccaattccaatggttgtgtatttggtgccctatattatgcttcagacatgtgatggttatttcaaaaaccttaacttgtgattttaaattttctttgcatgcttgttgacttgctgtggttgagatcatgtttttttttatgcctgctattatatgtttgaaccatggaactgcaataaccctgacactatatacccaagaaaaactaggaacagtggccttaaccttttttttttttgggaaggttctctggagtattttagtcatattagttactccctccatttcacaatgtaa

SEQ ID NO: 77795 - DNA, 1953 bp, Oryza sativa
tttttagaaaatgacttgatgctagaaaagtagtctgatatgctgttcttactaactggaaggcattatataggcattacagttacagaaaacatgataaagcttttttgtatagaagctccccagtttcatggaaatggttatttagaattctcaggctatagaacttggtgcttatgattgttcagaatctcagatgtatgatgaggaacagatgttaatatccttgtggccacagtgctctcatggctcccctttgccatcattttcaccagtgacctggaaatcgctcgtctcggctgtgcgcaggggcaaataacagacatcagaagcctcctttagccctttgtgctctaactttatatttttgttgcacatgcttggaattagtgtggattacttggttctcttgttattataacatgaagtcatcaattggtgtgtgtgggacaatatgcagattttttttatgtgctcctcctgcgtgcatcaatctagatgctgaaagtgattacctgctaagttgtgatcataaaggcacaaagatgctgaaaagtaggatcagataggacacactccaagacatcggtctgcactcagatgggtccacagttgcgaaaaacacttccatttgggccaattacaaaattaggggcttagctaatagctattgaagaaaaagacactcaacatgacttggaagcactgatactggacaatgatgcagaagttctcatttccttgtttcttttactggaacaattcacagttgggtcattgctgagcatttgaacagatagagaattggttggttcaagaaatgtgtgcattgtacagcagattttcagtccactggggagaatgttgagcagacaaggcattagagctgtagtagtaccattttgttttcttcttgagagtggtccctttatttgcaccaacctttagttatttccttccaggtttttgtatcctggacattgctctcccttcgcttccttctacagtgtttggaagagtccctagccttcttgatttcttctgtgaaattaaaaataaacatgtggttcatgatcattgatactagcttattgcattgaagagttctcagttgggtggttgttctttctgaacgatcgtacaaaaagaaagataaggacattatgttggattggttcttgatgtcattaccttgtcatatattatgaaaattatttatgtacatttatactgggccactgggttagtaacatctattaaatgtttggcaagagttgtaagaaacaaagtacagttaaaaccagctctggatttacagtgcacatagaatatctctgatccttatctccatcagctaacagggggaaaatggatcgtcttgtttctttcaggttaaataaacacataaataaagaacaagaagctgaatcaatttgccaactccaacggcctgtattacttaatggttgacctgaacaaagtctttggccttctcttgcttgccacccaatctgttcatatgccgacacaatatcgatttacttggaaacttcgtcgtatgaaaatgacacaaagatttctttgacgaaagcagtatcatactatcatggtcggtggcttaaccacatgagaaactaccagacaattgctaattggataagagtgtgagtgtgtgtgtgtgtgtgtgtgtgtgtgtgtgtgtgtgtgtgtgtgtgttaaaatgttaatggccatgaaaacgattgccacctaatgatgtgaaaaaatattcagtgtctggttggaacctgcagattcccacattttataccaccagaacacaatcttcagcagatcatcagtggtaatcagtgactaatttttcttgtggatgggcacatggcatgaggccaatcatcactgggatgttgcatgtatctttcctaaattttgttgagaaacaactaggatatt

SEQ ID NO: 77796 - DNA, 30602 bp, Oryza sativa
  unsure (1)..(30602): unsure at all n locations
gagtagtttgtgtcaatggttgttgaacgacatgcatctgcatgtgacattgtgtgcacattgccgtacgtactgcagatcgatggagggatgggatacaggtgtgcactgacagtactgaactgcaaagcttcggtgtgaggcaaggacatgttcgatcagcttcctttccaaccaagcgagtgaacacagaacagaatggcatataatgtttggttggtaactaaatttgtcacatctaaccttagtcaagtcacagttttagtaggtagtatttgactcttgccataagtctattttgtctaactcttagccacctagcccacatgtcatacactctattttcttgccaaacgttgcctaagcttagtttgtcattttgtttgccacaaaagtatggctagactaagcttagctaccttagtaaaaaaatgtgtcacaatattagtcccaaccaaacagaccccactcatcaagaatcttaattgaccacaccacaatttggctaactgaaatcgtgtatttgtaaaacaaaaatagcatggtgacccgcgcagattgcatggctagcatcattatattatctcatataatagcatatatgttttctcattatattattcaaatatattaaaatgacatcataattttaaatttcgtaataactttgcaaaactacaaatgtgtaatattcatattgtattttatatacgtgttatttattaattatttttaatatcaaattttagttatttgtaaattatatatattcctatatggactctagactcgtcttttaatatttttttaattctgaattttctgtaaattgtatttctatatggctcttcttccaatattatttatttttatttatgattttttattatttctaattgtatttctatgtggactctaaactcatctctcaatattctttaatttttaatttcgaatttcagttacttttaaatggtattcctatattgactttaaacttttcttcccatgtttttcttaatttcgaattttagttatttgtaaattatatttttatacggactcaaaactctacttttaattttattatgtttattccaaattttagttagttttaaattcctatatggactctatactttacttctaatatttcttattttttaattccgaatttctatttttttcttaattgtatttctatatggactcttatactctacttctaatattacttatttttaattccaaatttctattatttactaattgtatttctatatgaactctatactctacttctaatattccttatttttaattccgaatttcagttatttcctaattgtatttctatatggactctagtctccttttctaatatttcttattttttaattccgaattttaactatttctaaattgtatttctatatggattctagtctcctcttctaatatttcttattttttaattctgaatttcagctatttctaaattgtatttctactagcaaaaatgcccgtgcgttgcaacgggtaaaaaaattctaataataatatacttttttcatgcataatgatgtcaatgacaatgtttctattttaatgagcagcttgtttttttataaacagtgtttttttttcttttgcgattttctcaaaccatttttcagaaatggcgcatttctttctaacagttttttcctaccatgttttttttctttttttacttatgaagaaaaccatatttttctccctttttttgcttttcttttctcgtgtgtttttttttcttgttttctcgcacgtttttttgcttgttttttttcgaaggttcttttttgcttttttccaacacaggagaatatatgacaaaataaagccatgtagtagatggcaaaaaatcgatgtatcctatccgactcaagcgtccatcaatttagcttttttctgacagttttttcagagcgattttttaatagacggtatttttttcttgcccggttttttaaaaccattttttttagaaatggtgtgttttttcgatagttttttcctcgcatgtttttttttaaatattttaccgacaatggaaataatttttctcgcgcgtctttttattttttttattgatgatggagaacctttttagtgtgttttttgcgctttttttctgacttttgccccacacgttattttaaccttttttattttctcatgcattttctctttttaaatagttagattagagatagagaagagatatatactggttagaaatcagatttggtttcgccctttccatttttttctctcttgcattttttattttatacgaaccagctttttattttttacgaaccattttttcaccattttcttagggaatcgaacggacttttttagatgtttttttgcctctataggaatcagactttttttttccgtttttaaaggattcggatctagcgtttttttgtcaccacttttttttttgccttttatatgaatcagattttgttttccgtcggatctacagtttttttcaccactcagggaaaaaacttttgttgttgttgtttttctttattttctttattgtgcggtttttcttttttccttttatgcacctttctttctgtctttgttctctttctcttttattattttttaacaaaaacgacctcaagtagcttgttgcaagattatagggactcaaatgtaaatataaaaaatatagggactcaaatataaaagtacaaatccaaaaattaaaatcatataaaaatggaatgctctcgacatgtagattctatttttgcaaacagatctctggcacatcaatttttttcaccaatctgagtcagactttttttttggcttttctttttctttttatgcacctttgcctttgttctctttctcttttattattttttttaacaaaaacgacctcaagtagcttgttgcaagattatagggactcaaatgtaaatataaaattacagggactcaaatataaaagtataaatccaaaaattaaaatcatataaaaatagaatgctctcaacatgtagattccgtttttgcaaacagatcttcaatccggcacattaatttttttttcaccaatctgagtcagtttttgtttgtaacagtgaatctatatccggatacaggagtcggattttttttttggttttttttatcggacaaacctggtttttttccgtccgttttttttggtttttttcgccccttttttcttctggatcggacttcttttttccattccggttttttatcggacaaacatggttttttctgttcggtttttttcacccggtttttttaacggacgatggaagcacctcttattttttaagtagtagtagatagatagatatggactcttaatgtgagaatttgtaggccatgagagcgaacgtggagattcttttttctatccttttaataatataatagatgtggagtactcccgggaaaaaatatattaaaatacacctttttgcccgatgatttaataggaatatacacgtttagaagtgaatagcagaagtataccactgtcgcagaatgtaagtgtgagacggcgcgatctcacgcgactaatagattaattagtgcaattagcaattaatcaattattattattttaattaacatcgttagtaattaaattaatcactaatcagtatgattagttacattagcgtcaactcgagccatctcgcttggccaaccagcgagactgaacgttctcacgctctcgccttacgagaccttcgcgcgttggtctcgtgatttcgcactaccgaaccgcaacaacggtgtattcgtgtaaatccattcaaatcttatatatttctgagacaaaaaattcaaaagtataatttcaaaattttctggattgtgtttttcttttttttcttttttacatgaaacatagaggaattgtcccaaatctgcctggactggaagaacagtagaagactctaccagggaagagatgcagttgggctgtggagagtccacgtaggctcactaaagcctgaggctatccacccttgggaaatgcctctgctgccttctccctccacagaatggcctcgatgtgggccccactggatcccggtgggcccgggccaaacgaaccagtaaactaatagcttcgcttccgagttcgagcctctcatgaccatggccgccgccgccgccgccgccgagctcgacgagacaagctagacgtacagaaaccgcgcgaagaagaataagaatgcggccgtggcttgtgccgccgccgccgccggcgtggcacggcgtggtgatcaggatgctgcaggcgccggcggtggtggcgctggccgccgtgctcgcggcgtcgacgtcgccagcgacggcggcggcggctgctgctgatccggctccgcaggaggaggcggcggcggagggcggcgcggcgagcacgctgtgcaacgtgccgccgacgctgtcgggggaggacaagcaggcggagaagataaagcacccaaagtcggcgagcgccatgcggtgcacctccaagtgcgtcagcacctgcgtcctcggcggcgccggctcgcccggcgtcgacggccccttcaacatcaggaggtagcttcattggtcgccttatcttgtcgatcttaactaatcaatcattcagagttaacgagatgaacacttcaatgcttctgctgatctcttcaactaattccttctgctccgttcatggatggatcgaaatatatgcagaccactggtggtgttcaaggaggattttcgcagccgtcagtactggtacacgcaattttcctgtttcaattcgcatgcaaatcctcatcaattcacacgcaaaaaaagaaaagaaaagaaaagcatcagttcatcttcatcttgtgcatgtgtagccttctggaatgctcggacatctgcaacctaatcaaggacggagaagatggccaatgactcgagatgtattatgctgcttcaccaagcagattagcagctaagacacgcgtgaatccgtcaaggaagcaatcaagcattacagaatggatgatttagaagcaaacaagtgattagcttggaacaaacgtgcatgccggcccagattaactgaagaaccatggcgtcggacctgtcaactgaatcgtgatacggatgaacacaagtccggtccatactgtatactgtacagttgcattaggtctctaacaacaccgagttagcttgatgtagccagctccctacgtagtgcgaaatcccgagttaaatttaagattggattaagtacacatctccttgtcaagttgttcaaacccgtctctttgcatacgcatttgcacttacatgtttgtatatgcagaatagcttgcaaacttataattagacctttttttttgaactgatgatcacactgtttgcctaaattgtttgatctgcgcaatttggcatcttaaattgttgacgaactatgtttaatgcacagcagaccgtccatccagcagtccacataaatggccaaaaccaagcccagtagcccatatcgctatatgggccggcccatgaagcaggcagtctaacgatacagcccgctagcccgctaggtcacacgattgacaagcgattccccttcgtagttgtccgcactcgcgcgtcgctcgccggccatcgccgccgccgccgccgccgtcgccggtcgcaggcccgcctcggcctcccctgtctctgtctccatcctcgtctgccctccgcctggcgcccatcgccttccgccgtccatccgcggtgcttccgtactctgttcccatggcggcggcggcggtggaggagggaggcggcggtggtgccgtggcgcggatcttcgtgggtggtatttcggagggcgtggcggccgccgacctggaggccatgttcgcctccgtcggccgcgtcgccggcgtcgagttcgtgcgcaccaacggccgcagcttcgcctacgtcgacttccactgcccctccgacaaggctctcgccaagctcttctccaccgtacgcatcgcccccccccaatcttctcgtctctccactccagtagcagccatcaacaattcgatttctagcttatgtctgttcgtggtaggaatcctagtgtgtactagtggagatcaaattacgattaattttggatttattagatgattttacctattatgatttgtgccatgcttgctgaattgttgttggcctaagactgtttgagactgatgcttgtgtgcagtacaatgggtgtaagtggaaagggggaaaacttaggctggagaaggctaaggagcactaccttactcgcctgaagcgtgaatgggagcaggaagcggcagcggcgcaggaaatgccagctagtgctgatgtggagagcaagaaggagaagctcgagctgaataaggctgttttggatagtacgaagattaacatctacttcccaaaactgaggaaggtgagcaattggtcaggctgtgagaaacttttcttatgctcagcacttatgctgttcatgcatcattatgtgctctatagccacttagtcctgattcctgaatgggtgtgactgaacaagtaaattgtattccatccattaatatgcagaataacatgatctttgtgaactttaggttttctctatattttacattagtgtaaactgcatccttttatcagacatgctaatcatatcttttgtctttcagaatttgggctaaactaagcaggtgtaatttttaagatcaattgttgaattaagaactgaatcagaaactgggtatacattaactccttacataaacttacttggatacacatcccattgaaactatgcttgtaaaaaatgaagaggtgatatgtattgacaatgtttattcaatatgtcgattaattcctaaacatgcattgacctaatcaagatttcacttgacaggtgaaagccttgccttttaaaggcactggaaagcacaaatacagtttccggcatatcgaagtcccttcttacccaattcatttttgtgactgtgaggagcactgtggacctccagaggcagctaatgatgaatatgcttctgttcttgatgctgctgcatatgaaaaggagcgcagtattatgaattctgtgatgagcaagctctttgagaaggagaatgaccatttagattcaatggaaattcagaatcatggtgtcgattttgatgccgcggaaccctctaacgccaggaatgagttgcaaatggataaaagagaagaaacttctgaggaagatttggatgaccaaatggaagaaacagaagatccttctgaggaagaattggatgatctcgtgcttaacatcgtgacttgcaagccaaaaagctctgtagcacaattgaatagcgaaaagcaagcagcggataaggtatgcacattgcaagtatttcgaacattattctgtgatgaactactctgttgtgcagttatgttcattaacattttctgcattttcaggactcgcgcttcagaaaacgtcaacaatttgaagaatcttctctgcagaagaggcataaatcctctgatttctctgaaactagaaataggaaacagtctttccctgctatatcaggagccatccaaaatgaacaaaaatcttcagatttgtcaggaaaaggtacacatgagttctcatcagaactcgatggagataaaagttctgctagtgtccaagatgttgaagcactagcagattcttctaccagaaatgggagtgaacaaaattcgcttgctagtgaacctaaaagagtttccttgtggactcagaaatctgcctggagggatcttgttggtggcatggggagtgcatctttcagtctatcacaaatattgccaaacaccaatccagcaccaccaaaagtttcaaatgctaccgaggcctctgcttcacatgctgagtccaggacgaaagtgaaaccaagcgggaaatctttgaaaccctcggaagctgcaactcagctcttgcctgagcagaagatgcctacaagttccatggcaatgctgtctagtgagcgtaaggagaataataagctggaaaaggagagggtggttccaaagatcactattggtgaagtgtgtccgttcatgagaaattcagagtcagaaaagcaatggtcaaaggcaaagaaggttctgactggtttcatcaagaagggcaatgagagcactggatcgaatgtcgggaaagggaagccatcaacaaggagataacaacgtagcatgtcattccagcttcatcttgttgaactacaagctcggtagcatgtcattccagcttcatcttgttgaactacaagctcggtggtttcgtgtctcataggaacatgtgttattttgttgattggtctcatagtctgcctgttaagaatgatctgtctttgtttgtgaagcacaatgctatgtacgagttttgttcaaattgttattattctttgtacgagcaatttaaagtcaaacatgtttcaaaaagtgacatctaacgtgcaatttaaaaacgaacggtcaaacatgtttaaaaaagtccaatatattttaaaaagtcaacggcgttaaatattgggaaaattataaaaaccatccaaatatcactctgagtttgagatgcctctccataagaagatttattgcaaatacccacctcctaaaccttggtttgatttaggcacattctctccacacacgcgtgattcctaaataatctcgtggcgaaatcaaccgagtcccactcagcgggagcaagagattatgttgttttctatataagacgatcatttcgttgcgttatcatggccatttcattgtgtttttcatgatatactagctatatattccaaactaatatcatgtgtactgaacaacatatccgttttttagaatgtaatgggcatatagaaacatttaagcatgaagcagtaatcatatagccagattataactacatgacttcatctgttgcaattggtcagatgacccaaaacagcaggtttcattacagtttaatcagaaattaaggccacacaatctaatgcaaaagagacttgttgacaaatcatcacgatgagtggaacttggctaatttcgccacgagatgctccaggaatcacgcatgtgtagagagaaggtgcctaaatcaaagcaaggtgaattaggacgtgtggatttgcaacaaatcttcttatagggggcatctcaaacttagagtgatatttggggtggtttttgcaattttcccttaaatattttgtgacagaggaaggaccaatgtgtaattaacagaacagagggggcctttttgcaaaagtgaacgtggcacccctaactaactctccggcaatcccggtgttttaagtagacaaatgtattcgaactcctgcgggctgtggcgctcgtgctcgccgtgctcgccgaaatggttctccggtggctcaccaccgcactaccgctcgccgccgctgccgctcgccacgcggccgcggctccctcctccgcggccacgctcgccgccgccgccgctcgccacgcggccgcggcttcctcttcctccgccgctcgccacgccgccgcggctccctcctccgcggccacgctcgccaccgccgcggctccctcttcctcctccgcggccacgcttgccgccgccgcggctccctcctccgctgccgtggcggttctaccggaggcggcgcggcgagtctccgcggcttccctcctcgaggagttaaacgccttcccggagatgtccctagtggtccggtggctcggcgccgctcgccgcccgggagcggaggtcgtctccaaaattgcggggcgccgccaccacctcaccaccaccgccgccgccgcggctccctcctccgctgccgtggcggttctaccggaggcggcgcggcgagtctccgcggcttccctcctcgaggagttaaacgccttcccggagatgtccctagtggtccggtggctcggcgccgctcgccgcccgggagcggaggtcgtctccaaaattgcggggcgccgccaccacctcaccaccaccgccgccgccgactcgaaccttccaagtcaagcgcccggacgactcgtcaatcgggggggtgctcaagtgatcggcgcgggcgacttcttcggctgggagagcaatgattgcggctgcctcgccgacctcgcgccgttccctcaccgcggcgcgccgttccctcgccgccgctgcggtgctgcatcgccttctcttccctggtggttcgcggcagagcaggtgcgcttcggcgtgggcgaccccttcgagagcgatgatggcggcatactccccgatctcgcggcatttcttcgtcgccgccgccgctgcgcccacagcagaagaatcttcgaattcgagagcacccaccacggctttggcaagagcaacaatggcatgagcggcggttttcgttttatgttggatgacaccgacaagaggtttcgccatgtccgagctcggagaaatcggtggcaacagctggtgataaggaagatgttctcaagttcagggaagcgcagctcgtcgacttcaaggcaacagacgccttcgccgacctctttaccagcggccatccccagccaaccagcagcggcgatttcttcctcttcatctgagactaattcatccagtgagcaggaaaaaggggcttcctcgtcagcatgctacattgatgaatcattcggtaatcaggagataattgacgctgagacttatgtcaaggcaaatcctatgcttgttaaggcgaatgtactgggctcagcgaagacattctggagaatgtcggatatagcagtgagactcattcggcgacttgcgaggattctgaaaattctgcacgaacagaagcgttatctcctggccccgctctcagtgcaaaatctagtaattgtctcgggtgaacttaagctcaggaatgtcacccttgcagatgatgatttcagttttgatcggattaaatgtgattatcagtatatgtccgttgtgctggaagagttgatcatgttatctgtcggacaaaatggattgtccaatatccctcctgattttggcaaatacttgggtttgcttaaaggactagtcaaacctgatgacgaatttctgataaccaaccatgcttcgttattgcccatggcaaacaggtacacccgaatgtttttacatactttagttacttcaattagatccagtaagttatccaaaatcagtactcaagtaacacctagatgaagttttgcttagtaaactgtgtttgctactgctgtccttatttagttcgtagttagtactagctaaatacacgtatcttgctagctaatatgatttatgctactgttgtccttattatttagttcgtactacctaaatacacgtgtcttgttaatatgatttacgcatgctacattggttcgaaccaatttggtagtatatatattagtggcgaaaattgataagaaagcaacgacattgctgaaatttggtagggtaaaattgatttcgcgaacgctttttctgtgattttgctctattcatgatttgattgttcttattaacaagtttggtactagtagatatagagtttgtattagtgcgggaaaaaattggtagcaaagcaaacatatatgtgatagtactaaagttgccgaaatttcagtagggtgtaattgctttcaattaaacaagtccatcatgcacatgtttttgtgattttgctctattcatgattaagtgattgtttacattatttgggttcatttttttcatcagtatgcatctctactacatgtgtaggacggatgcatttatgatgatgtacaatcatattatgggctatcttggccgcaaagatcctaaaaagaagatatacattctatcacacctgaagtatgacacagactggcttcgcacagcgtcaggaaacagtgagatagggaaatggctttggcgccggagatacggccagactgttaaggagtttctgcacttaaatcggaatatcaggtcccatccatatgaacattccgaggaaaagatcgaagaagctctatacggtgaatggccggaactgctagttgaaatgcaagaaaaactgcacaaagagggtgaattacaaaacactgagatggagtcgaaatttgggcagcagtgattttctgcattgagtctgcatcatggagaaacatatgttctattggcgctgaaaatgaagacatataacatctgtgacatgtaaacaaatctttcatacatgcagacattgatcttgcaacatagtgcacattaatatcataaaagtgcctcagtgttttttttttctctcttgagcggaaatgatgttgatgtgcaaatgaacaatcagtttaatcttgggatcaatgatcgaggcacttgttgggtgtccatgcatgaggctcatgagcacaagattatgcaaaacgaacaggaagaaatatgtatggttcgtgtgcaaatgactgttgattgtcagcccaatattcatggagatggcgtacttccgttggcacaaattacttaattaattattcatgcatgggcgggcgcagcctattacacttgttaattaggcccacacggccggagttgagttaataacctgcgcgtatggctggattgttgtacttgtatcttggactcttggtttgggcgtgagcgagccgaacgatcaatttgttggtgaactgactgatttccggccggctgtctgctcatttattagcaggaggtagtttttttttaacggaaaatagcactagagtgccttttcattgaatagaggaggagaaaatacaacccctagggacaacaggaaaaaatcgaggaactgtagctatacactatacatagtgcgggattaactcgcgcagccgcttagcccctgctaaagcccaaaggctagcctcttctttaattcttgacaggaggaaactcgttgccacctctttgtggtcaaagattcgccgatttctttccttctagatttcccatacaactagtaggatgagtgatcggagttctttcttcggaacatttggcgtgtttgcgatgctctcccaccactgttgtactgactgtgcctcctctcattgagccggctcaatttgctgatatcccacccatccagcaacaaggcctcacattcttttagtgtatctacaagtggcaacgaggtgcaaggaggtagtttgatcactttggcggcggcggcggcgacaggcactgatcgatccatgcttctgctataaaatttggcctgaactcgaagagaagcgctggctctcacaaacacaaccaatacattgtcaaattaagcctgagctcgaagagaacggctctcacatacacaatcaacacactctcttgcctattctcaaaaaatacactctcttcccttccctctcactctcgatcctcaccacaaccacatgcacgcacggcactagctagctgccgtcgtcatcaccatctcacacgtgcacaccatttttctttcatcccgatctccattaagtacactattgctctctctctctcatctattcctttgggcttcccttaagctcgtccttgtccaccgtccacgcggctggtttctggtgttgtcaacttggcaacaaatatgatggcggaatgcaagacagagacaagtgtcttttaaaccatacaagattaatagctgcgacaacaagcccaaaccatcattaaaaaatatagttttattccattattttcattttttttcatcctcatacaaccatgttttcattttattgaggataaaagttgttgctgagcagttattacctacagtagcaatattttatctcttttctttctcttttccatgtcagcaaatattcataattagcaacattaagagatcatgtcgtgttaatgaccattgtacatgtctttaggggaggggaataagttcatctgaggtcctttaacttgtcaacgaatccgattttcgtccctcaaccggaaaaccagacacaacgggtccctcaactatcaaaaccggtgcagatgaagtccctcggtggttttgaaggcggttttggctgatgtggcgcctacgtggctaatttgactcggtcttcatctgacgtggcgcttagtggcaattcgagctgaaaaaataataaaactcgtggaacctacatgtcagttccacacacaaaataataaaaaaatggtgggacccacatggccccacatgtcatcctcactcctcctccctctctgtatcctctctctcccctctcctcggcgccgacgcttccatccacgcattactcaacgtggtggccgccgacgccgacccacctcgcgtcgtcctcgtcttcggcggcaggcccatccgcgttggcgccgagctcctcgacgccgtcccgtcgctccgctgcatcatcaccatcagcgcggggatcaaccacatcgacctccacactttaggaggcaacaggggtggaccccaggccttgggccgcccggtccatggctcgaggcctaggatgcaatctctattataaagtctattttttcaccatgtaatggtccaaactataatgggctggcccaaatcgtgggccaatcctgggtccaaccctgagaggcactagtgactagtgaggtcgtgtatgtttattgtgaataggttaagtttatagtatatatttttcactatttttctgggtcatttattttacttcgtttagttagcagcaatatctttttcccctttgttagtacctactatcgaccattaagagaaagatggaaaaaccacttaagaaaaagagagagggaaaataattgagaaacgcgagcaaggcaagaagatgacttgggagaggcgaggattttgtgccgtgaggaaaactatcacatcctgatttttgtttcaggatttataaattatttaataaattaataatagaatttatattaaatgttctttaatttacaagtgaagttaaatgtgggaaataaaatttcctaaatataaagcatggatggatttaatttttattaaattctccatgattaagtaaactctctgaaattttctcggatttttcagagctcaattcctaaatgatacaaagaacagttcagtaattatttgatcattaatgatctaattataattgttaagtgcttttcttgtttaaaatccttaaattataaattgttgtttaaaaggaattattagaaatgatttcaaaagcctagaagagaagatcttttttttaatttgctaaatctcaatataaaatggggccagataaaatttcattaaatactttgcttaattctataattcctagatttttctgggatttatttgagctaaggaagtatttttaataaatagaattgcatttcatgaataatttaaattgaaaaaggtttttaaaagtctcttttggctttgggccgaaagccggcccaaaatctctctctctctctccctcggcccagtccggcccagtccgacgagccgccgctctcttctctctctctgtcactgacaggtggggcccgcctgtcagacccgtcgtcttccttcggccgccgccgccgagccgcgccgccgagccgcgccgccgtctctttccaaattccgtcgctcctttccatctccggccgaattgatagaggggaaatgatcctctcgatctcctcttccttttctcttttggaatcatcacctaattcggtttggaaactcgtggattcgatctcgaatcggatcgacttctctcctccgaaccctacctttccttctcgtcgccggtcgccgtgggccttcgccgccgccttccaacccctataaaaggatccccggtgtctcctctacccgccgccaccctcgccttcgtctctcgccgtcggaagcgctctagcgccgtgtagcctagcgccgccgtcgccgccgtcgctccagccgcgcgccgccgccgttccagacgtcgccgtcgctcgggaagaccgccgtcgtggtcgccgtagcgtcgccgtcctcgtccgccccttcgccgccgccgaagaccaccggagcaccgccgtcaccgtcgacccgaagaccgccgccgcttttcctcgtcgccggcgccgtccgttgcccttccgccgttgttttggtcaccggtgagttcgccgagtcgccctctacccgttggtgccttccgtttgcgtcctcgcgccgtcgttcgccggcgagcttgcgctcccgagccgccgccggtgctgacgtcatcgtcgccctctcccgtgagccagtcgtggaccgatcgatctcggccgtccgttttggatggatcgatctcggccgtccgttcccgtgaaccgccgccgtgcacccggtccaccgcaaaccctagccgctgacgcaataatccttcttttccttttcaaaaataattcattattgcgtcataattcaattaaaatccatataagtgttttaatccgatttaatctttaaaaattcataactaattcatcttaactcagtttaatgtggttcaagttgcaaaagttgtataaaataaagatctacatattaaaattgtccataaattgaattaaatttatttaattctttttaaatgggctttaattagatttaatcttgtaaaattcataataaattcatttgaagtcagaatgaggccgttcaagtctcataattcatctaaaattatgatctacatgtttgtttactttttatgtattgtttatttggtttttattagtctttttcttcgttttgcgtgttagcttgtcgtttccgtcgttgcgaaggttcgcgagtgcgtcggaagtgttcaagaagattatttgaagaccgattattgcaaggcaagtcacacagatcctaaacacaatcctttgagcatgttgatcctatatttaaattctctatttatttcaactgtgcatttgttttcgaatgtcactgggtggtgtgaatctattcctttgttatggcctgtttgcattgattactttattccttgataccttgggttattataacttgactagttgagctatatatattggttcagctagatattagatatgattgcttagccatgcttagaaacattagcacactattgggataacttatgactcattattatttaatgatggcttaatgatagttcacgatggttaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttaccttttgtatagcatggttcattgcggagcaccagactgagaagtggcggagataagcccacgggggtcgctggggagtccatgcctctggtttttgagggggtgattatgatccaggaatggtgcgctgcggtgggttgtgttatgcaaggggtaatgtcacagctcctttccgaggtaccgtggtggtactgaggcacatggtgacatgatgtggagctgtgtcttgtgggtacagtggtacacctctggccagagtaaaactattcgaatagccgtgcccgcggttatgggcgggttgagcaatgtttttcgtgattagtctcacacctctcacaataattatggatgttatacctgataataatttgcttagctcctggtttggagttagatctgttcagccgggtatggttgttcagaatggttgggcctgtgcagcatgggtgtgctgttcagtgttgattaaaatttctgattaattactccactgttttacttctcttaaatgttttgctaaatgctgcttttgcaaatgagccaatattatgccattctttggtatccttgtgcacttgcgtatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcatgacgaggactaagtgcctcataagtaagtatttatcgttttagttaatttgatgaatctgtatattaaattgtcagtttgtgtacctcggctgattcctggacgaggattttatgcacaaataagttcggaaattactagtgaatttctgggcgtgacaaaaactagaaaggaatgtgcggcgacacgccgcgcacacaaatatgacttacatcaaaacttcttttaaacacaaatcagctatgggctatttagttttttaaaaaataggagtcataggttatttggttaaaaaaatcagagaaaggacaaaacaagatgcagacaatgccagtcgggcactaagatgcaagtgatggtctgatgagtgatgaatgccagatggaagcaggcaagcagcaacgagtgcagggtttcccaaaccgacggggccagggttatcgcgcccccgtaaccgtatgtaaccgtgtaaaatttatcaaaaatttaaattatttttaaaatttatttgaatttaaggaggtaaccgcggtttttctattatggtactcccgcggttaccgatggtaagtcaaacctagcaacaactggacaaacgactctacacgtctgaacaccctgttaatctttactaaggtggtgattgggaaggagggactaaattttaatccctcttacaaaagcataagtttctatgggaggaactaaaatttttgtgagagtccctcctttctaaacaccacctaaataatatgccaacgtgtatgtaccagtcgcctaagcaaaggaggtcgttctctcatctcgtgtgcttttgttcgtcaatgcaaccgagattcaatttattgccaattcagtctgcaatataatcctaaaagaatgtgtaattgtgtagtgggagggtgtcacaaaactgatagctcttctggtgggattagagtagaagtagccctcttccttgggtttgtcaggaataatctgcgtcctagatgacgcgtccatgcggctgctatgtggtgcattcacagcggaggagaaacggtcccatctcattgtgccgttttttttactgatcaacgagttcaactataagctcggcttgctgttactctaagctttcaatataagctgggccttgtgccttttatctcaaattagaaaggtaccccgcgtatgatagattttgaaaagcactatttctcaataatttttctacatcataatttttccaaactatttattagcttttaaaatatatgatatttaatacattcctataaataattatctatgatctcttcagtacagagctatatttagtttgtttagaaaacatttctaatttaaaagtaatatgttttgtcttatttaattgaatgtttagtggccttttgttaacaaattaaaaactattattattaataaatatgttttatttgtagaatcaagttatgcatccttttagttggtttttattgacgcaagttattacatacttagtatacactggtaccttagtgtggcttcttatatatgtaataatatgtggaaaaactcataatgctatggtatggtatagtatagatttaaagccattaatatctaagcatttaaaaattgttatgaaaatgaaacatgcaaaggttggttcaattttagtaaaaagtaagaactatttttttctgaacttattagactttctccaaataattcaatttagtccttttggcattttacttctatcattatagatctaatttaattattgtgcagttatatagaacgataaaatctatatcattttttttcataatttcagaattgtttgaatgtcatgctaaagtaaaaaaaatataaccccaaagtggcatatgaaaagttaaattacagtgaatatgggtttctaaatgtaaaacaatctaaagacataaacggatcgcgtgatttagatgttatagttatttatttttttagtataagtttggcagcattgctcatagttatattcattttacttttctgagatctaatttaaattgtgaagttaagtacgatgataaaattattactattattattgttgttgttgttgttgtagttgttgttgttgttgttgttgttgttgttgttgttgtttttgttgttgttgttcttgttgttgttgttgttgttgttgttgttgttataataataataataataataataataataataataataataataataataataataataataataataataataataataataataataataataattattattattattattattattattattattattattattattattattattattattattattttcatattttttataattgcccgagtgacacgcaaaagtctgaaaataaaacccaaaatgacatttcttttcaaagttgaattatagttaaatttgttcttcaactgtaaatttagtcataagaataagcggatcaaaaattagttatatgatttagattttacaaaacatattttttgcttttctaactaataaaacatgtaaataggagaaggaacagggagaaaagaggtcatattttttcttaaaaaaagtaacatacgtaagtacatacatgcctaggtgggcccaattttaggaggtaattttttttcgttaagattgtcagagggtgaactcctcaagcgggggacagtgaggccccccttgttgattcggtcgggggcagcgggtgaaaatcgaggactctatgaaacaggtgatgtagaggaggtcgggcccctcgtaaacgatgaaaccaaaggggtttatataggttcgggccgctgagaaacgtaataccctactcttgtgcttgactgatcgactgaggaatacatacgcttgaatcactgagaaccaagcgtgagttagccaaagaaccgatctccccctcccactaggcttggacctctttttatatctcaagagactgccatatgtgcctagaggtctacctaaggttgagggaggatactctccacattaaatgcatgtcttgttgcttggcctcgaagccacacgcacaggtgccgcggcatggggtccgtcaaatccaaacggctaacatgggggactctcatgtcattcaccatttaatgggtgaagatatttgggtcctcacttgcgccgggatatggaaaccctgctctaatcgggtcagacgaatcgactccggctgggatgagaggataaaaagcctctcatcatcacgatgtgacaggccgactgacatgcaaccagtgcgcaggcacactaccctggtcccattggtcattcgaccagtcagtctcaccacacgctgcatttaatgcggcgtgtcgcgcccgctcatgccgccttgaatgtggttaggtaggcgttgaggggcgcccacctaaccctacacacgtggcgttatgcggtggggggtcgggacagcatggagggggcggnnnncgncctacctcgggcccgacccccctcgggggagtgccacatgggtaccggggcaacctcctccctttgggcttgataccccagggcctgtatcaccgacaaagataattataggctgtaacgatttcaagtttttcttatccataataatgacatacttatatcataaatatgggttttatactgtaaatttattaatgataaattatctgaaaacataagctgatcaaatacatgtataatttagatactacatataaataatctaacaacataagcatataagaatacatgcatgatttaaattctttcgatggtgttcataggggtagggtatacgtgtgtgcatcctagggggtgagtgtgcatgtgttgtgagtgcccgcatttgttttgtgtttctaaaaaaaatactatagttgcttaaacgtttttatataaattttgctttccaactaatagaaggaaaataagagagataatagagtgaaaagagtagaacagaataggatggtacggagtacctacgtacacgaacgtccattcaaatagggtggggcccaatttagaggtagattggtttttcttttccatctaatctaatagttcaaaagaatgggtccaccaatttaaatgaaaatcgatggttagatgtttttctgccacgtggcagcttagaagtgctcgtagaaagtttaatggacttttagtatataatagatagataatagatagatagactataagctcggcagtagtcttcttgaagaccagtatctgtgcacatagaaacaagaaagaaggatccaattagcaggtgatttttttagataattattagcagatgaataggaaaggagataaaaaggattattcagagtttcagacacaataagtttcagcttagaacataacagttgctaagaatgcaaagactatatacacaaagcatccagttttgatctgtaattattccaacgatgtcgagtggagcctctcggtgtagcattagttgaggatttgagaacatccttccattgaaagaaaaggttgagatcacgcagcatgacatgggctgccatttaggcgggcaaatggtggaggtactaacttttgatagcaagggatagtgtaggctggcagttgtttctcaggtgttgtgtggcaaaagtactaagcaagatgttaccaggaatgaatttatcagcagtacctgtgatgaccgcccacaacttttgccatcataagtggggatgaaaatatcactctccaaggacaatataatctaacgctaccatctgggaggaatggttctggaaaaaacctgagatatctgaaggcaataatgtctcttttctcacctgaccatcaacaatgagaaaggaaattttataaatatgagatatgaaaggaatgcgcaatcagtagcattggagaagataaactgaccacattgggataagctgaggtaagggcagccattcttctttggccaccgtatatttcaccatcggcaatgtatatttgataactcctatcaatgtctagtgccttcaataccattgcagcctcctccattgttaatgggcagagctcatctttcctctttgcattcgagtcaatcaccttctctttccaccatgggtaagtatatctttcaattttcaaacacaatgtagttgttaatacagattgcaaaaattacttgagaaaattttagacaaaactaaatacctcattattgtgaactactccgtctcctcgttgttgcaaccatgtgcgcaaccagaggaaggcaaagcatgcccatttcatatcgctcgcaagtgaagaaccacaaaaaggcccattattacgaagaatttgaaccacacgtctacccacctcttctatttcaggggtaaatcacaatgcagcaaaattgacacaacacctcaaattctgaatctccataggcaggcaattgcaaggtgtgcatcggttttgttcaaatgaagaatcctgtacttccatatcagtggtagagtcagttttccacaaataaacacttacaatcttcaactgattttacacgtgattttgagttcatgacgaaaaaccaatggaaatgagagatgaaaccaaacctgactatggcaataagatatatcagaccaactgacaggcggcatggagcggacatatccaagctcaactcttctttacagccttagaggcagctctttcagtttcagtacccggaccactatcaataatgcaatgaagtaatcgacatcacattatactaactgaaacaaaagaaccacaagaggttgagtaatgagtcaggaccattcttaattgaattctggtgagtgccaactgcaaaaagaaggctcaccttggatcagcccaagatgaggttatgtccaattctaacacgataagggtgttgttgagggatatatcacatatctgacagacaaacaattaaaatttttgttcggccgcgtgatttgccctctcgtcgcagggtggcgagctccgggaagtcaacctcctccgcgcgaagctcgcggcggcgcgacgtgtcacgccccgaactagccccgagcggaactagcccgtgacgctccaatttaacccattaatcgataccagtcccaggaaacagtgctggtatcacagggagacagaatatcacagcaacagaggtctctttattatagagtaggagtacagtcatgttgggctgcggacccgagctcacaactgcattacgaaagggaagcggaagccaagacttggaccaaacatcataggcgcgacttgggaactaggccgaaaccctaaaactcatcgtagccgacttgctcctggaagaactcctcgtcagcgggatccgcttcatcttccttagcaactgggggggttatttatatagagcaagggtgagtacgggagtactcagcaagccatgggaaataagtgtttaatgcaggcttcaaggaaaggctgttgtttttgcaattgattttatttaaactcttttctgaaacaattaagtgagtgcttctcaaacgacacgaatgagaccgtgcgtctcgtccggtcggagtatgtgcaaggtatcagtcttttgaattgatcatggttggcacccggccaacggcttttaaacggccacccgggcctggctgatcccatcagccgcagattttccaaacatcgaacccaaaccacatcagcaaatttcacaagcagtaggcaaacaaaactacgctaggaatcacctcacatccacccatgaccgtgggcatggctgttcgaacagtttaataacctctacagagggggtacactttacccacacgacattactaacccggatcatccagcccgtgcagaacggccacgactagagaccttaaggctttcatgacaaggcatttcgaaagccgacacaggttcaccatatgccaacaagaggggtcccagaccatactgtgccaggaaacccgggggttctccccgacaccaccccgttgaatccacatgtctcttggcatcatggctcccccgattagctagttactcagccaggggtgtcccattccacccatgtggtcgcacttgtcttatgttcggatgaacttccaaggaaacggtccttaagtgcaagagcaggaaaccgtacacccggtacgttccccggtccgcgattttggaaattcatttagttcgcaagcaccgacccaggtgtcgggttttccaagtcttttgtaaaacccaagttttacccaagatgtttctcagtttttaagtttgaaggcgaccgtcgatactcgtgcagagtgcacgattaccgaggcgcaactaggtggttacaagggaacatggtataacaattaacaaaggaaggataagatgcaataagctaggtaggcccatcggtctgccttgcagacggggcaaacagattaagtgcaatcctatcaatgcataatatttttcaagcaacataattaagttcaaatataggctcaagatgttcaagggtggcttgccttgctcgagatcttgagcttgatcctcgaaattctcgcactgtgggtcttcgggctccgaaactacacgcgaaacgggacaactcaacaaacggagaaaataaagccctattattgacctctaggcatgccattagatagatctcgagatttgaggagttttggaagttgaacggagtcaaacggacttacggatggaaaaatattgaatttctaagattattggatttttggtctaaaggaaaaggatttatttaaatcctttttgaaaatgaaaagaaaagaaggaaggagggagggaaattagactttcctcgggcggctaggacgcggcccgagagaaaggggcggctcggccgaacctaacagaccggtcggcccgagaaggcggcccaaagcacgcgcgcgggcggggaggggagaggaagccgatgggccggatccatcccgcgtggtcccgagtgggacccgcttgtcggcgactcggctcaccgtgagcgaggtgcacgcggggcgtgctagggtttggggagggaggtgcggtgcatgcgcgcggttcgcggaggacgcggatacggcgggcccacgcgcagcctcacggctcaccgcggaccatgcgcacggggggggggggggaaacggagggagcggctggccgggtcagccgatccggtcgtgccgaggtggctccgacgtggcgcctacgtggctgccacgcgggccggctagaggaagacgaaggcgccggccgcgaatggacggcaggcggcggcggtttctccgggacgccgtgcgacgatgaggggcgacggggcgtacaccgggatgacgagggagaacgagagggagcgagccaacggcttggattcgccggagggagtccgtcggcggcggattgcggcagcggcaaccggcggagagaaaaggaggaaacggcgacgaggtcacgaggggccgattcccggcggtgagagcatctacgcggctacgggaacccaccccttgcgccggattaggaggaaacgcatcgagggaggccggcgacgagagacgcttccgagctcgggcggcgacggcggcgagcacatggcgagcgacggcagcagtcggggcggctccagctagctactggggtactacacacgctactaaccaagtctaaggggaggagatggatcgaggaaggagaacgggggaatgcactaccgagatgaggcggggcgctgtgacgagatgccgacggcacgggagtgatctcttcggcctcgggccggggtagaggaagaagatgagcgcccggagtccccttccgcgtcctagcgcgcaccggctcctccggcacacgcgacggcggcggtcggcgagagagacagagggacggcaatggcgcgggtgaaaaactgggaagattgggaggggaaaaaggaagggagggcgcctgggtttatagggcggcaatgtcggttttggaaaccgaccttgggcggtcaaggtgcgagctggcgttcggcgctcgcggccaaaacggcgacagaggcggatgacgccggcggggaagaggaaagggaaaaaggaggaggaaaagggggcttaccccttgccactttggggaaaaggaggaggaagagagggcgacgcggcagagggggagagctctgcctccgtcccttggaggttagcgcgcggagagaggcggggccgagtcgatgacgacggcgatgacggcgggggcggtttggaatggagcggcgacacggacggcaggcgcaggcaggcgcggcagaggctgacggcggcggcgaccaggcggtcggccaccacggcgcgcgcgcgcgggggcggcgcggcgatttgggcggcgtcggcgggaacggcagcgagagcggagagggagggctcggcgcggctcacgggcagagagagagagagagagagagagatgggccgagaggaattcggcccatcgaacccgagggaggcaaaatagacttttgcggagggatttgatttgggaaggatttggattcaagattgaacttgacgatagatcggggatttgagatccggaatggcacggacactagacaacaagcaagaaacagatttcgcaattagggtttttaagagatagttttcccgctaggcgccacgacggaacgggcgccacacgacgcgaggccacgatgcacgcagtgaactctggctcgaaggttctcctcatcctcaagatcgttgtcctctctctacgtgttcttctatgtcttcagtgttgatttcgtgtatgtacatgtatcttggatggttatgatgggggatctcaggttgttcttggatggggatctcaaggatgtttttttggtttgagcagaagccgtcgtcgctcgacgcatttcccgtcagccgtgagctcggtgcctccgtgtacgtctaccgccttgcgagcgcgccgcctttttttattactagattctcattgcgcgccgccttttttgttactatactgttgatcagttttgaaatatgcatgatgatttcacaaacataacagtactatttcaagcaatctccaatttgaaaccatatagtatcacaatgtacttagcttacaacacattgatgaaacgtaccgactccgagtgacaaatctacatataagcacgctgtacaaagtggtacatctgagtttgaatatcttcaattctgtggagatcttgcctgggacaatccttgatcatcagttgcttgggtatttataatgcccatggagtagtcaaaaagagatggcactcgtgttgtagcctcaaaacaatctgcaaaaatattagttgtggaatatgctgaatggtctacttgatgtctaaccagattcatgttatatggtaggtgtgaaaaaaaaagaagatgatcctatggttcatatttgtgaaaaacacaatgaacaaggttgtttacaggaaaaagttgctttcatcaagatgttagcatgttctaaacctctaaatctctaattaaccattttaatgtacgtatataacatagccagcatccttaatgggtgttagtaatacgtagagataaaaaaatatgtattattattaatcgacagcgcattgcggcagcatttccaccataacatgtagaaaatgcatggcaataatcaacaacaccagataccaaacacaagatactaactggaactcttaaccatacaactgaaatttgtctaattgttttagagaaattagtggattcatcagataaacaaattataagaagcaaactctcatgtaagaagttttagatatgcagagatagaagttccaaaccccgacaggggtcgacgaaatcggatagacttttggcctgatgttcttgaagatcattagttttctatatacatttctgtggaaggaactggctgtgtatatctttcgtggatatagaggccggattaatgaaaatccattatctaaaaaattttctttggaaggaaagaaaaacaaaatgcaacagtatagaaagggaaaaaaaagggtaaatgaaggcacacaattgatagtgcatactcaggtatcttgttcttctgtagatggctagagctttgataggacaaagttttgtcatgtcaaagaactgcaataggtcaaaaatataatttgatcaaagaatctagtacagccatctatgattaaaaacagaaaagaaaattggtaaatgatagaaatgccatttccacgagattaatgatgcaatcattgaatgaacagtaaatcttgaaactttccttcagaaccagagtagccaaagttcagaaatcggaaccaaggtcagacatacaattaccagaggtaaggcatagcacatagtttccaaacgatgctccttgaggctgcacacacaattataacattagcaaatggcatgcacaattcaaaaccagtcaatttataataatttaacttatcttgcaaaataaattcaaatcaaccatcattatgttaacatattataattatacacatgcagaaaacctgtccttgtacattgtttgcatgacttctttgactatcttagtctgatgacatatgtatggatatcattctattctacaagtagtcattccaaggcatgaatgcatctttacacaaatgtgatgctaaaagcaagcagactatctcccttttcgtaccataaatccaaaacagtacacaaaagctaaaatgaagattgtgatataaagtatcctgtcatttacagatagaagatcaagatgacatggtgatcactatgagacatttataggccttgattggaacttgtaacttttttttgttgtttactatggtaattaaccaactcctgtatttcacattgcctctacccaggaataagaccatagattttgtgattggactgtccaagatatactgatcaaatattttcaggttgtaaagggatagaggaagaacagagacaaggagggtggttaggatctgttcatatggctaagtttttccttttttctatctctactaaattaaaaaggttcttaccttagtaattacaactaatgtctatgttcagaggttaaccttagcacttggacaaaacatcccccactacacaaccaaacctatagataaaattttctgcttggagttcagaccatcgatcaaccaacaaacatatcaacaagttctaatacgaagtaatatcacctgaccaaccctcaccttccagaatccatagccgattgttgtcctttcatcactaataagagaaggaaaaaattcatcgatcgttaggtattacttggacaaggggtcatctatgg

SEQ ID NO: 77797 - DNA, 594 bp, Oryza sativa
tcgccgtcgctcgggaaggtcgtcatcgtggtcgccgtcgcgtctccgtcctcgtccgccccttcgccgtcgccgaagatcgccggagcaccgtcgccgccgtcaacccgaagagcgtcgccgcttcttcctcgtcgtcgtcgccgtccgttgatcttccgccgctcttttggtcaccggtgagttcgccgcgtcgcgctctacccgttggtgccttccgttcgcgccgccgtgccgtcgttcgccggcgagcatgcaagcccgagccgccgagccgccgccgccggtggtgacgtcaccgctgacgccatcatcgccctctcccgtgaaccggtcgtggaccgttcgatctcggccatccgttttggatcaagtcgatctcggccgtccgttcgcgtgaaccgtcgccgtgcgcccggtccaccgaaaccctagcccgctgacgcaataaatccctttttccttttcaaaaataatttattattgcgtcataattcaattaaaatcaatttaagtgttttaatccgatttaatcttcaaaaattcataactaattcatcttagctcggatttagttggttcaagtctctaaat

SEQ ID NO: 77798 - DNA, 681 bp, Oryza sativa
tacatgaaggttgaaaggtggcattctgacaaaaatgttataccttaaatctactttgataacccctgttctccatttctgtagcaatgtctcggaatctatccacctcctaatttcggaatcacaaaatgttataggagtacggtcgcacaagtggtataaacatcatgcagattgagttctgacctgtagacacactaggtcaggatcccagtgtctaatttcacgaataataagcctcctccgcgaatcccacctcattgcatcccaagggacatccaaataaaggtcaggatggtaatgtgcattgttatccgccaagatgttgtatgacatgattgtgcacgcatctgacaaaagctttattactcttagtattacactaacaaagccagaatggcatcatcccagagtaatacagctccatcaacccaaacagatgcaagtcaaacaaaaaggacgaacaaaaatcacaactttaggggtgaaattggcactggttggggcgaagcttcatacttgcactagctgggtcaactgatttctcactatttactctagcaaaactagcaaagagaaaaaaaaaagaagcaaaagtgcaatcttcactcagacattggcacaaacagatggtgagcaaaggcaacaaaatttcaccaacgatacatccagcataatacc

SEQ ID NO: 77799 - DNA, 946 bp, Oryza sativa
tttacatacagtgaaattgacaccgtgctatgccaattcattaaaaagaactgatggattggattgaaaatggaagattaaacatcacgtatttataaagattactgccatcgaatcagcagtcggatcaattactgctgctttaaaagtggaatccttctttcatcctctcctagcctctctaatctatactacttagaaaaaccatagtggtggtcttgatttctaacgtagcagacgtatcaggtagacacgtacaatcacaaccatcggttcgccagattgaaaaagaccggtcacagaatttgagagtcgctttgcatggagatgttagcgatgtagaaaaacagatccattgcacaagttgagagtcgttttgcctgtttcttgattttcgctagcgagcaagataccgttgagagctccttgggtatggcttccagttaacaggtttggcttggtcgcgagaaatcacaatacgagcatgtcccaaattcttatgttcctttaggttagttcttgcatggaaagcattaagcatagctgcaaattgagtcaaattggaaagcaagacgctaacacgtttctctcggtgaatgtcagttcatttcgatctcatgtcaagcaccatatgcctaactgaaaatacagcaaccctcctgtctacatgagctagcgcccgtagtacgtatgcttttcttagaattcaaacaaatactgatgagccattgctgtgagatgtcaaactgcgtgtacactcctcgcatgcttgcgatgctagatttgactaagatgtactaaaggactgttcttttctgctgctaggatgtcaggatgagttattccttcgtttattatgaacatatttttcaaacttcgaaataatgtgtgtgtcttttaaaaaattgtatctaagttttcttaaaatatcaaataaatcaatctt

SEQ ID NO: 77800 - DNA, 4841 bp, Oryza sativa
ggtgggggcggtggaaggaggctagagcattgatgaggcggttgtggagcggcgcctaaggaggcgccgggtaggattcgaggaggcgcgcggcgtaacactggacgccggcggtgaggactctgaagagcagcggctgcagcaggcgcaccccgcggcggagcgcgcgcgcgtgcagctgcttcgcctcctccatggaacatgggaaacacaaggcaccgtgctagtcgtttcagacacgacgacgccggcggctcgagaggatgctgagctcactgacggtagtggaccggagaagagcgcggccgcgccgtcggcggcgggcggcgaacggcggcgggtggcgggtggctggtggcggcgagagatcgtcgctggagaaggtccaaagagtaggagccgaaaaaagaggcccatctagcagattagtactagaattcttttttttttctctctcgaagtttcaaaaaagcatgaaaatttttacgtggtccccttacataacatggaagtttatatctaagtttcaagtttttttatatttattttctagaaaaaaatatatttgtatggtatatttgagagaatttacttacacaaaagataataacacaaaaatatcttatgtggcatatgaaaggtgatttatattaaaaacaccaaaaattattttgtatagcataacacaaataagttatatattaaaaaaaattgaaatgcaaaaaatttgaaacttatatacaccatattgtataaggaagccatatgaaaattttcatagtttttttaaaacttctagataaatcgattgttaatcttatatatccatagggtattttcaaacaaaggttcggtccaatagcatattatataacaatagataaaattattggtatattgtaaaaagagataatatcagtgataaattatagaatagattctctcaattaaatatgcgacggaagcgtccctttcaccaccttcttctaaagtggcaaggcaaaatccaatgaaatatctgaaccaaagcgaccacgtgagacggctcgcagcacacacaaccatgatgtcccaccacgaagcaagtgtgccaagttggcaggaaacctgctagtctattgagccacttggcacctccaaattgctagaacattagaatcatctaaaaaaaaagaataaaaatctttaggagcataaacttccggaaacttccatgttgcatattttccaaatactcttttccccttttgcactatttcctttgcaacagtttaacaataacgacaaatttccatcaagtccccaactgaagtcaacaaaagaatatcaaaatggaaaaaaaatagcccttctatttccttttgaattgcttgagtaatatgtctagaaaactactgataacttggaatgatcatatctagtaaatcacatgcatatagcgagtacttttacctacttctctatgcttgagagaatgtaagaaacaaaatgagtctaatactaaatatatttaaaaaagaaattatattctctaccttctgtacaccactaataaatcaatatgaaaaatttagaatatgtttcatatgaaaatattaggaattctgattcttagggataataggaaaatctcgatatgtcataggttaaatagaaaactaaatggcattcactaattattttatattatgcaaaattgttgtattctaaaggagaatatgaattgtggaagaatgccaataagtccaataggaatacgaaaggtgccccaatcgatccaaccccgaggttagactcatgagagctagctaagggaattttgaggtttttcagttaaagaaatatattacatgttaagttagaaattaataacccatcaagtggtccttctaggtgttgatagaaattcaatgggatatgaactaactccataaaaaaaagttcttaacttttgtgtgttctaaacatgacataaacaatatagaagtacattgacttattaaaaaagtacttaccaaccgccttatttgatatttatagtttgaaagaaaaaatgaatataactttttaacaaaaaaatgacacataaatatttatgagctatttgctgaaataaattaaaacatatattattttagattttttataaggatggcagtaatttagataataaaactcataatataacaactctaaataatacagcaaatagtgaatatctagaatataataaatgcagtggctaaatccagtgggtgcaccaacaggggcatcgattatctagtatagaataaatgctctcaattaaatatgcgacgcaagcatctctttcgccacttttttctaaagtggcaaggcaaaatccaattaaatattgacgaaccggaggaaccaaaacgaccacgcgtgagaactgagaaggctcgcagcacacacaaccatgatgctccaccacgaagcaagtgtgcaacaagcgcgagaggaagaagaagagcttgatcaccatggcgatccgatgatcacctcccctctctgtgagcacccagaacccagaagcaagatcatatattgttatttcattttcctttttttaacgaataagatcaacgagattatatatatatatatatggccttcatcgtatatatgttgctgactgatgatgctcgtgcacagtgcgaccatcgacgtcgggcagctcgccggagaatggagaggaggagaactcaccggtggagctggtggcgctgacggtgccagtgagcgacgagccggagacgccggtgctgacgttcaggatgtgggtgctggggacggcgtcgtgcgcggtgctctccttccttaaccagttcttctggtaccgcaaggagccgctcaccatcaccgccatctccgcgcagatcgccgtcgtgccgctcggccgcctcatggcggcgacgctgccggagcacgccttcttccgtggccggccgtgggagttcacgcttaatccggggccgttcaatgtcaaggagcacgtgctcatcaccatcttcgccaactccggcgccggcaccgtctatgccatccacgtcatcaccggcgtccgtgtcttctacgggaaaaccctctccttcttcatctccctccttgtcgtcctcacaacacaggtgcatgcaaactagcttctgcctaaacatttaataaattaagttgtcaacgccctgatgctagattagcttaattacctggcaatcaaaaatagaaaaaaatatttcttccttctcatgcgtgtacgatacagtaccatcagatgctggggttcggctgggcgggaatattccggcgttatcttgttgagccggcgtctatgtggtggccatccaacctagtgcaggtctctctgttcaggtacactgcttgaaaaccagagtagatagtatgacaaaaaatcttctcaccagagttgaattcttgcaaaattttgatccactcaaacctccacaccggcaatgcaagagtctgaaccaccacatatgttccacttggaagttggaaccgctgcagtgctgcaccgaactacaacaaaaatggaagaagaaaagtgacatagttaggagctgagggacctcttatatattttctctattattttttcaagaagcttccctagctaagaatgacaggacaaacacaaaccaaattctgtttgagtatagtaagaaatccaagatttaaacatatgtaaaactaaaactaaaatggagttgtgcatatacacattcttagctctgaaacgacaaagaagtttgcatttgcattccgtaagaaaataacttacatatttcttatactagcgcacttcatgagaaggaagcacggagaaaaggtggcttgacgcggaaccagttcttcctggtggcattcgtctgcagctttgcatactacatcttcccaggctacctattccagatgctcacctccctctcctggatctgctgggtcttccccagctctgtccttgcccaacagcttggttcaggtctccgaggcctcggcgttggtgcaatcggtctcgactggtcatctatctcctcctaccttgggagccctcttgctagcccatggtttgccactgtaaatgttggtgttggcttcttcatcgtcatgtacataatcacaccaattgcatactggtttaatttctacaaggcacaaaatttccccatattttctgatggcctcttcacctcgactgggcaaaaatacaatgtatcaagcattgttgactcccatttccattttgacaccaaggcctatgagaagaatgggccactatacctcagtacttcccttcttgtcacatacggtgttggttttgcaacccttgctgcaacaattgttcatgctctcctcttccatggaaggtatttttttttcttagattcgccactccactgtctacaatattaaaataatgtggttaagaaccatgatacttgtctccagtgaaatttggctattaagtaaatcagcttttcaagaaaaaaggatggacatacacacgaaacttatgaggagatataaacaggtccctgagtggtggttcatatgcatccttattgctaacatcggaacgaccatatttgcttgtgaatactacaatgaggaactccaattgccctggtggggtgttttgtttgcatgctccattgcctttttcttcaccctcccaatagggattatcaaagcaacaacaaatcaggtatgtggatttaacacattggacatattatgtcatacagatctaacaagttcaccttttttcattatatacagactccaggcctgaatgtcatcac

SEQ ID NO: 77801 - DNA, 3017 bp, Oryza sativa
atttagacagaggtatgctcaaattctaggttggttttttatgagacgatgagtcgacatgtttttgggaatacgcgaggtgcgcatttttattaagaaagaataaatgtatgtacaagacgggccgaacaaattaaaaatgaagaggacagggtacaggaggggggaagaaaaacagaaagcctatcttctagggaatttggtgacccatctatcaaagaaggaactaccatggccggtatggctgccctagccatccaccaaaggtccgcttcacccgtcatagccctagcgatctccggccaggttctgctttcctggttgaagagccgattgtttctttacttctagattgtccaagctaccagtgtggctatcgtgtcaaaccctcggctatgatccttggtcatcctcttgcggctgtcacacaaccaaacatggaaggactgctcgttgattggaagacattcggaatgtatgtaagcgggtcgacatgtgaatctacttatatatatatcaaataagtgataattaacaggttttcatatcatggtccggcttattatcatacctagaaatataagtgatcgatccataaacttatttatagattaaattagtaggtaatccacgagttaatctacggccactaaattttacttataagtgggtttatgggttggtaacttgatacacttacatccctagctagaattatatggccagtgggaggaatacgatcgctccggacgtactgagagccggatctactcctgttgcaaatctgatgtgaacaactgcaatttagtccggtgaaattgactaagctcctccacaattacttgttttagataggtcatcggtcaatatattgaaactttgagtatgaacataagatgttttttctttcctcgcaatataacatggacatgctttttaagtggatttgtatacctcttttgcgctaataatttggagagcatataactctttcggacaattctagactctagagtgcaatgtatgattgtatctgctcttgtcaagctaacttgggcgtgcagcctgctctttgaaatttaatcggcacgcttggcaggagtaggttctctactgtccttttcagaagagatatggtgcagcgtcagaatcaataacatatgttgcccatccaaacagtaagtgtgtacacaaatcagcgtcagccttttccaagttctccaagtttggtggttccttccaactactacctgtaagtcagacagtccctctaataaggtcctttttgtttcattttaaaattattatactctagattattaagtccaattgctagctataagctgaataataataaactaaattagaataaattgtaagttgtttgtttctctgaattatttgatacatgaattattgggtttgaaatattaatgtctatcatcttcttggctattttggatgcttgttcacttttttatcactgtatataggaaatatataattggtagtggctaaaaaatattgtcatatatatactacagtggcaatataaatttttcttggtagaattttgtgacatcaccattcacggttactcgtattagctattgtcgttgtccatacactgcatacaaattataggagtactcccagttcttttattacacatgaagaatcattgtctaaaacaacccaaatctacaatggcatagagcaccttgaaaacctgtatagcctattttgttttctaattaggatgtaacttttcttgcgaaaactttatagacatgaagttgctataaaatattaaataaatactttttcacttttaaaacttaattaattactacctccatattttaatgtatgacgccgttaactttttgtttaacatttaaccattcatcttattaaaaaaaattatgtaattatcatttattttattgtgacttgattcattatcaaatgttctttaagcatgacataaatatttttatatttgcataaaaattttgaataaactgaatggtcaaaggttggttgaaaagttaacggcatcattcattaaaatacggagggagtataagctaatggtttttctcctattatttgtatcacgatatctctgaataccaggaagtcaagtcaactagccatcgtgacgacaacgacatgccacccataaggagttagtactgtacactatacatatacgaatcgtcgtcctatacaaaatccagttgcgactgtaccagttagttcgggaagaaaaggtaaattataggcggcgttagctcacacgcacggtccaacaatgcgacgcaccagcagtccgtccagcaccccaactccccgcgagtcgtggtccggtccactgcgacggaaataagggaaagaaaacacgtaggtgtggtactatttagtatatacgtcaagacagatcgatccagccacagtgtggtacgtggtggacaggtgctacctgcccgatcgatcgctgggtcttcagtcttctgccgccgttgctcgatcggttagttgagtgagacgtgcacgtacggattggagtgcgtagctagccgtgaagtcgttcggggtgcagtgcaccaaggaggcgcagtacggtgttgcgtgacgactccggccggactgccgcccgcctgcggcctgccggagggctggtgtgatgcggccatggcccgtgggggcgcgttccgtttctccagcgagaccccgtattcgggcccaatggaatatgcatatgggccccttctccgaaggcccgtttagtgtttacaggacgattagaggccaccggtatcgctcttgaggaaaaagtgcaccgaaggtccctcaacttatcatcgagttacaaaatcgtcccccaactgcaaaaccagatatttggcgtcccataactaataaaaaccggtcacaatagctccttcggtggttttgaccctagttttgtcttacgtggcagctgagtcagcgtgggacccacgtggggccca

SEQ ID NO: 77802 - DNA, 523 bp, Oryza sativa
  unsure (1)..(523): unsure at all n locations
cacgcttgatgactgactgnctcctggnacccctctctcggttttggtagcactgtcgctctgaggacactgttggattttgcgtgtgcttgatttcgatttaggatgacacctatcaacaatcctgcttgtcctataccatttttcacttataatttagtactagttgtggaatgatttagtcgatttaggatgacacctatcaacaattctgcttgtcctatgctgtttcagttatattttagtactagctagttgtgcaatgatttaggatgcagtagtgtctcgaggactgaggcccatatttactactaccacttttttcccttgcatagatgtacctggtgctcctgaaatggctggctattactctcgtgatgaagaaaggccagggtatcgtcctgcaagagacactgaggctcttaacgcttcctatgaacgttttctgcgcactggggtatcaaaacctgttcttaacacatactatattcaattccttaaacacattgtcggctgacacttt

SEQ ID NO: 77803 - DNA, 3013 bp, Oryza sativa
ccatggcgactccattaaccttgtcaaagataacaaggaaaagagccacaggtcaccctcctcaaaagaaaaacagcctcagcatctgcctcagaagcaacagtttacagttgagacaagatcagtgtctacattgcaagaaaagacattccaagaaagatcatcctgacttcctgacagtgatcatggcaaagaaaggtgagaacattattacatttgtaaagaatctcattatgattggttattctagatccacatggtggattgattctggagcaactattcatgtgtgtaattgtttaaagggattccgttcaatgaggactatgcaaagaagtgaaagatccattagagttgccaatggagttgaagcaaaagttgaggctggagatcttcgcctagaactcgcgaatggcttcacacttttacttccagacgtttttatgttccttctttgcaaagaaacttgataataagtgtatccaaattggattttgatagatatgattgccattttggaaatggcaaatgtgaatgttgtgtcctcgttgacaaaagaaaagaaagcgaacttctgatgtctcatcgaaattatggcagtgttgtttatgccatatttcgagggggagaattgagagactggttaagaatgtagttcttcctccattggagttctcagttttagaacaatgcatacaatgcatagaatgcatcggtgcccaaaacaccgtatgagctatggatcctccgtgtgtgggggagtcctgcaaaggataaagtatttaacccaaaacagtaagctgccattttattggctattctaaaagatcaaagggtcatcgtttctactgtccaaacagttatacaaagtttgtagaaacgggacacgtcgtcttcttggaagacgaaatgattagggggagctcggtaattcgagaaattgatcttgaggagaggcgggtgtctgtacccgctccgtcgactcaggaacctttcttctctctacctgctaatgttgtgccagcaatgcatgccgttgcggtaccaacacctgttgttatctctcctgtggcaacaatgaatgaaagtgaggaacctgttctacaggattcaacagaaattattgccacatcagaggaggagatgaaacagcctcaaacagataatgtgccagaataggaggcccctagaaggcctgaaagagtcgcatatggaggatgatcccatctcatatgaagaggccatgagaagccatgaaagatgaaatgaaatcaatgaaattaaatgatgtctgggatttagaagaaattcctaaaggagccaaaacagtaggctataaatgggtctacaaaatcaaatatgactccagagggaatatagaaaagtttaaagtgcgacttgtggcaacagttttcacgcaaagaaaagagattacaatgagacattttctccagtctcttgtaaagattccttcatgattataatggcactagtggcacattatgatttggaattacatcagatggatgtaaaaacggaatttctaaatggtgatttgaagaaaaaaaagtatacatggcacaaccgaaaggtttcgtcatgaaatgaaacgaaaatatgggatgccgtataaagagatccatttatgggttaaagcaaagcttcgagacaatgctacttgaagtttgatggaacaataaagcaatttgggttttcaagagaatgtagaggacaactgtattgattcaaagttaagaatgggagactcattttcctaattctgtatgtagatgacgttctactggctagtagtgatgtcaatctactgcaggaaataaagaaattcttgtcctcaaactttgacatgaaagacctcggtgaggcttcatatgttttgggcatagagattcaccgaaatagaacaaagtatgcattgggattttctcaaaaggcatatatatagaaaaggtgttgaagaaattcaatatgtacagatgcagtgctacacctgctcctatagtcaaaggcgaaaagtatggggcatcgcaatgtcccagaaatcagtatgagctcaataaaatgaaaacaaagccatatgcgtcagctgtaggaagcctacagtacgcgcaagtgtgcacacgacctgacttggcatttgttaccgggttatttggcagatttcaatgtaatccaggcccagtgcactggaaattggtaaagaaagtcttgcgtgtttgcaaggaacaaaaggcctcatgatgtcttacagaaaagcagaatcgctccagatagtggggtattcggattctgactttgcaaaagataatacaaagttaacatcgggatacatgtttaccctggcagcaggagctatttcatggaaaagctcaaaacagactaccactgcagggtctaccatgtatgccgagtttatagcatgccatgaggctacggggcaggtgaactggctaatgaagttcatacccggttttaaaggtggttgatagtattgagaaaccactaaagttatactgcgataaagaatccacagtaatgtactctcacaacaattagtcaagtggtgctgccaaacacattgacataaagtactatgttgtgaaagacaaagtccgggatcaaacaatcagtctcgagcacataagaacagaaaggatgctcgcggatccgctcatgaaaggcctacctcccaacatgttcaaggaacatgtagcatgcatgggttttaagggaagccttatgaatcctggactatagggcccaaaagttaaagtatctgtttctgaatagagatgtgtatagtggctgtcgaatccatcggtaattaaccgtgacgatgaaacatgctctatatgtaaatctgtgatggaatagaaaaagctaaaggaaatagtgagatcaagggggagaatgttagatggatctccctccccttgagcccaacggctcaagggggccttgacccgcgcctgatcggggggcgcccagcccaatg

SEQ ID NO: 77804 - DNA, 2680 bp, Oryza sativa
gttgctgcgggatatttggataataccttcatattaacatttgtattggctgaaaaagaagaacaaaagtacaaagaaaatagaaaacgtgttataacttgacgactgactgaactaaaacaacagatctcacaaagcccttatccagttaaactgagaaaagctaactgggctggataataaggtttgtattcatgcaacgatcaggaaaaaccataggattagatcgaacggcttaaaagtgctgatgacgtggagcaatctttataagagtaaatgctctagtgggtaccaactgtataggaagaaaggataagcataaatgcctctaaattggtaccggttaaaaaaccgacatctatagtgggtatccaaccgacaccaatagggaactacttcctctgttttatattataagactttttagcattacccattttcatatatatgttaataaatctagatatatatgttcattaacatttatatgaatatggacaatgctagaaagtattataacctgaaacggaggtagtatgtactagtggacgacgagctcccatctcccggccgaggccaacgacggcggcgcggggacgacacgcgcctcccggccgtcatcccgtgaggcatagaagtagcagctctgctggccgtgttgccaccaagctcgccgaggaccgttgatgcctccacggctccaacgttgattccccagacgacaacgtcgtccccccaccacaagatttcgccatgtccaccgctcggccttgagcatcaccgtcctcagcatcctcgcgctgtcaaagatagtaaggcgaaaggaaggaatggcacactgacacgtagggccataatattttctcttttcccccaaatataacagtgccactttaaccaaaaaaaaaacgctttgaacgagtcgaggttttgcggcaaggcttaaggggctcaaaatagacttattccattcagagctgtttggggcacagggccggcggcccagagaggcggtggtgcccacgaagcctacacaagaccgatgccctatttaggtcaatcgtggactatggacaaccccacaccccaaaatccccaatcgccgcgccgcactgcgactgcgattctcccaatccccggtggatatcgatcggattcagatgaacactcgattccggcggccggaggtaaatccggagtcgattttttcgcaaatcgcaggtactctacgcaatttttgttcctaatccccaaatccccaattgccgcactgctactgcgccgcgtctcgccggccgatttggatggctgcgggtgggacgcaagcaatgaggcagttcgtctatctggtggtgaagggctgctacgatcgccgcctgcggtgttgtcgcgacagctacatggcggacaccttccacatgcgccgcatcaacgtgtcccgcttcttcttctaccccgaaccgccgccgccgccgccgctggcgatggtcgtcgacgctcggctgcctcgcccctgcatcaccttctgcgccccctgggtcatgcacttcatgctgctgggccgcaacagcgacaaggtgctcgccgtcgaccacaagggccgcaccaccatgtacgaccccgccgccaacaccatccgcgccgcgcccaccctcgcccaccccaagagactccccgccatctccctccccattggtgacgacctctacatcctcgacccgacctcctccgaccaccgctgcttcgaggccctcgtctacaagcccggcggccccgcccacgactgggtcaccacccgtggccccatcgaccggtacaacgactggcactgccaatctctcccgccgccgccctaccatccctactcctgcagcttcgtcggcgcaaacggagccatcggcggctatgcggtggtcggcggtggcggcgactcagcagagatctgggtgtcaaccaacgacggcagcggcagcggcaccttctctttcgacacggcgcggcgcgcctggaccaagcacggagactggacgctcccattccgtggcctcgccgagtacgtccccgagtacaacctctggttcgccctctcctccggctccaacaacaaccatctctgcgcattcgatctcgccggcgcagctgagccgccggcgacgcgcgatttctgccaagaactcaagccacccaaggactggaagctggtgtcatcccatctggtgcacctgggatccggcaggttctgcatcgcaagattcttcgaaaagccggtcaagattccagtgtgctgcgtctgcgacatggatacgcagacgtacggcgtcttcaccggcgtggaggtgaagaagccgggaagaggcctacggctacggatggtcaagcacagatcagaatgttatcgcttcgatgaccacattaaggaatgggtgctgtaatatttatctagtcttttttagaaagatttgtgcaaatagatgaactcagtagcattggatatgctggtgcttcaacaccttgaacactagcacaactttttatctctatcaagttttagaggagaactcatctgtaccttttcctgacaaacaagaagattttttattttattttggatgtctcctgatataggaggcaaagactgtttcagtgttcttttttctgggttcagaaaaatcagaggatt

SEQ ID NO: 77805 - DNA, 633 bp, Oryza sativa
cctgcagccccggaatccctctttagaacagacatatgcccgagattttgtagtatgagttgctgatttttccaaccatccttttcggacgctgaaccccacagttccagcataggtgacatagcagtcataggccttgtcttcattcaggaaaaccattccaacttttggttctccttcaggtacagcaactacttccatttctggatctggttctccttcaatgatttcatcttctttactctcaccctggaccaaagaaaacaactgtatgtgttaaagcaatgaggaatcgagtataaagaagtggttcattcggaatttttttggggttcattaggaattaataatgtaaagcctaaaggataagccatcgttccctttagctacccaatcaaaaatgtgacggaggacacaaacaattagcttcaatgcagcattgcagagaaaaaacttttcaaataaacatacatcatttcacaagtgggtcttaccttatcttcttttttgagataatgcttttcaagacgtttagagcgcctttccgaaggttgctgcagtggttgccaattcatgaatataagaaaatacaaccagatggcataaatgaaatatctatgtggaaccaatata

SEQ ID NO: 77806 - DNA, 1804 bp, Oryza sativa
tacaaccatgagtctctgaccgcctgctactgctgtctgtatcttaccaaatactcctaccaactccaatctctctcaagcattaacctacagaatttgcagttcttcacggtatcgcatttccagctaatatttttaacgatgcaagttgtatccaacctattaaatgaaaaccgttatctaaaactaatgaaaatccatgttaataaatcttatattcgcatgttttactccaagaggacatccaaaagtattacacatttgcatgtattattcaaccatcgcttaattctaagctaatagtacatatagtttattcaagctcacaatgatatttagctaatcattttgggatgcttaggtccaacaaccgtttataattcttcaactacacgtgcagttgcaagaatactattatcctatggttcagtccaactaaaaatgcagccggcgaagtttcattagtccaaccatttgtcttttggtgtcagttagcatgggcaaagtttcagagtaggaagttgaacaatctacagccgaacctaagtccaacacagacaaagacaatctcgccgcttccgatgtcgcatacgagcgtctcaatgtctgaatttttagatgttagtaaaagtctcgagtacaatgcgtctcagcaaccgctgattagctggttagcatgcatgtatcctggttcagagttcagatatacatgcagagaacagaactgttcaccaaccctttctccaaatccttcaaacaacttgatctttcaagtcacaggatgagtcacctgcaggtattcagtttgaactttgaactgtacgttttcttcagcaatcggataagggtaatctgaggcttttgatgcgaagaaagaatttgctttaacaaagcaattgttcagacaaatccatactcgatctcgaggccacatgtcatttgtagtcaaatgtacatcaagattccacattagcaccagtgcaatttgacaggaacatactaattttgattacttgatatacaaattaataacatatagatcagtgcgtctgggcatgattactcccaagttggtgttcagaaaaaactgctgcaactgccgctatcaaagtacttctacttaccaaacatgtcgcaacagtgcatttcaaaaaattgcagtttgaccagtctagcacgtgtgatatcgctctctggatgcatatgcatcttgaccatttcatctttgtgtactgacgagacctgaacaactgaacatgcagcagaggaagctgctccgttcttgtggcaagttcaccttttctttacctaataattaagtttagcataagccttgtgtaacatgagttgaatcctgaatggtgttgggatttcttctgaccatgttgacaacaacgattaacgctgcaagatgacaagcttgagaagttcctttcgtggacttggcctaacgtagttgaaagagttcagatatctgaagaaacaacatgaaagtttaacttttggaagaaaaaagcacaactttactcacctaaccatgcaaagtatgaattccaatatgagacgagtcatgcttctgattaaagagtatggagcagaatacggattacgtaattctgttgagttcgtgttagttagcgcttcatgaacctcttgttttttctttaacacatcaaactcctttttatggactactttctgctagaatatatgcacataaatgagtttttcgcctcaaagaaaaggattaattccttgaatcctcgtatgccatttgagcattcgttcacatcatgcttctgaa

SEQ ID NO: 77807 - DNA, 8153 bp, Oryza sativa
  unsure (1)..(8153): unsure at all n locations
actgatggttgttcttggattgtgttctgcaggaatttatcttcgaatagtctcagtggcaaactcccagattcgatggcgaagctgaactcgctttcgacactgtgagtattatcctccttaattgtgtgcagtaatgttctttgtttatctctgaatttgcaatgtgtccgcaacttgtaggcatgttcagaacaatcagctcactggcacacttgatgttctaggagatcttcccctgaaagacttgtaatcactacatcaattcacacatgctctgtccaggaaaaaaaatcacacatatttaccttgatgcatttctcacctgatcctctcatgatttactaatatttgcagggatatagagaacaatcttttctcaggaccaatcccagagaaactgatcaacatcccaaaatttctgtaaatctctcagccttcctcaagaacagtagaatttaatctagtggcatcccagtctgacacaacagttggttcttgattgtgtgcaggagaaacggcaaccatcttaccatccccacgatgcccggctcttctccaactccggataccatccccggctctcctccgactccggcggcagcggtggcggcgcctcgatcaggtgcttcacaccctcctatatatgtaattccggccactccacatggcgctgcacagggtgaccctccgagacacggcaagaaggtctcgccggcgaaagccgccggattcagcatcctcgccgccggctcactgaccattgccgtggtcctgatcgtcttcgccgtgtcgaaacggcggcgggagacgtctcttcatggaggatttctgagaggagttgagatgagcactccggattggagtgggaagccttcaggacaaagtgcagttgtcaaggtagacaaagaacaaagcacaggtatatacaccgactgaaaactggagtatttcctatcttgggcccacatgtcagtgacatattaagaggtcaatcttagaacaattattaatgctcaaaaaattcagtacataaaacgctagcttgtgcagtcatctcatctacattttaatcattttgtttgttgtgttgatcactgaagttgctgaagagaaggataccaagggtagcatttcttcatatcagaagaatgttcaggagagtttacaaaaccatcctttgcaattcaagttcacaatcttcacagttgcatccttgcaacagtataccaacagtttcagtgagcagaatctgatgaggcaaaccctgttcggaaaaatctacctagcagagcagcaagacatcaaggtatctaatcaactgtaccctgaaatctccattccattcctacatggattgaacaagtttatttcttgatcagttgtaatcaagatcttgtcatttcatctctgatctctctacaccttatactagtttgcagtactgaagcttgacgaagcgatggcgagaatgccggtggacgagttcttgaggatggttcagagaatctctgaactccagcatcccaacatcgaggagcttgcaggatgctgcgtcgagcacggacagaggctgctcgtctacaagcatttcagcgatgaaactctcgacgacatgatccatctgaagaaactggcatcatcagacgatcctgctgccaagatcactcttccatgggatgcccgggtagctgtcgcactcgaagctgcgaaagctctagagtacgccattgccatgatcatcttcaatttgctgaataattcgagtgtttgtcttgctggcttctgaatctgaagtgagtaatcggtaatcgcttctgccattgctgttcttgcgttaggtacctccacgaaggtggtcagagacaggttgtgcaccagcatttcaggcctgaacatgtgctcgtcgacggcgagatgcgtgtgcgcgtgtccggctgcggccttgctgcggctgtgaaatccggcttggatcttcaggtaatcgtttcgtagacaccgcttgatcgatcagcttgttcttggatgtgcatctgatcgatcggtgtcgatttgagcagtcggaatgctggctcgacgcgctgagctacgagccaccggaggcggcggcggcgccatggacggacaagggcgacgtgtacagcttcggggtggtgatgctgcagcttctgacggggcggaggccttacgacggcgcgcggccgcggggcgagaggcggctggtggcgtgggcgagctcgcggctgcacgacctgacggcgctggagaagatggccgacccgcgcctcgggacgccggcgacggtcaggtccatgtcgcggttcgccgacgtcatcagccggtgcacgcagcaggaagcggagttccggccggccatgtcgcaggtggtgcaggatctgcggcgcgcgctgcagcctgcacgcgatgcttgcggacagcagagctgcagcaactgattagtgacgaaaatttactaatcccgcagttccgaaaaaatatatataacaccatataagacatactctaatgccctatatttatgccactatcttgtgttaaatctattatattttggaacgaaggttgtagtaatatttgtcatcctcctgatttgcgtgggttcgatttaaagttttagacagcgaaataccatcagaaaatagatggaaaagtggaataccaacggaatacaaagggaggaaggggcagttcaaattgatgtcattttcaaccatatctttttttttgcaaagttgccaaatttgataaatacataagaaatcctgctaaaattttggcaatattaccatcttgctaaattttggtaaggtttannnnnnnnnnnnnnnnnnnnnnnnnnnnaagtctctcatgttcaacatacacatttttctcaagtgctaaatgatatgttttcataaaaatatgtatagagaaaagttgatttaaaaatcatattaatcacctttcccttccggtgatcattaaaaaaaatcatgttaatctattttttaaatttgaactaattaatactcgcgtaaccacgtgctattggattaactcattttacgtgtcttttaaaaaaattctttcacataccctcaaacatatcctaaagtaagtatcgctaggcaatattctcgcaatatcttcaacctcccatatgctaaaatcaccgcttgtcagatatacgctgatgatttgcaaccataatccacttatttctttcatttcaaatctccaaacaaccaaaatgaagagaggctccaggtccatgtagatttgtccacataagttgaaaaataatggtcaaagttttaacatctccatcacataaagttgcgaataaaaaggtgagttgggaggcgtcgtttttatatttttaaggatgcaacataagtaacaaggcatttatttgatgattgaaacagctcaacgatacattattttatttttgttgtttcacaggttttacatgcaagagacaaaatatattgcaaaacagtatagttatgatttcatctagatgaaattcatttcgtttctcacttcatttatctcttatcatatcataaaaatattggcacggcacccaatttaatgagaatgaaacttatattgaaactaactatcagaattatgaataccacatacctaatagtagttgactaaatctcggcaagacccaccacataccatgttttatacggaaacaacctgcggatatgggaggagttccggataaggaaagacaactagagttctacatggaaacgacaaggactacgcggattgtatccatattggtttccctagttctatttggacaaggggatacctatgggtataaatacaaggtcccctaggaggagaggggacaatcaacacacccaccatgaaaaagacccaccatagaagacacggaacaataaatcaagacagaagatcagcatagaagccagcatacgccaagacaagacgcaggatatcgacttcagagataagtacagttagtcccctacggtgtctccggatactgtcaagagagacgaaagcgctgtctctgatctcgtcgggcacgaactcgaggaagaagactaccctgttgtcgactacgagtcagacctttagaccgccatgtcgacaacagttagataggctaccccaaatattgtactggtgtgattatggtgaataagagcaataccggcttcggccaacaggatgtagggttattacctgacaattcaggggcccgaatctgtataaaaatccctgtctccatctattttatctcagtctcgcgtatatcctagtaccgacgatccccataccatgcaaataccggaatcgcgacatcaaacgtcgacactaacattacttagtaattcaattcatttcatttcttaaactagacaaatcttactgcatataattgtgtggttgattgcctatccaatcggtcggtcctggacaaacggaggaacggatagacacgggggcggttgttcccatgcacgaatctcaaagcactccatggttcggctaggacaagtcacaagccagatctcgtccacctccattcttcccttcccattttccgcttttccggtttcctcccacccaccccgcaccgtactcaatttctcgtcaatctcaggaaaaaaaatggtgcctcgccgcgacgagatctgagagcgcgcacgcgcgtcctcctcgccctcgccctcgcctccgccgcgcgcgcgcgcgatggcgtcatgcgcctcaccgtcgtcgcggttgcacggcaatgcggccggcggcggcgccggcggcagcgccaccgcgatgatgctcccggggccccccggccgcggcaacggcgggtgcatcgacctcagccccgcggggctcctcgcgcatggcgcggggagcagcgtcgtcatctccgacccgcgcaccatgcagctcctctgcgtcctccccatgccatcctcctccctcgcctccttcgtcaccgccgtccgctgggtgccacccagctcgcgcttccacgccgcggggatcgacgacgacgacgacgaacgccgcccgctccgcctcgccgccggcgaccgccacggccgcatcgccgtctgggacgcgcgcgcgcgcctcgtccttcactggcttaacctcgacgagacccgcggtgtcgcgccgggatccggcggcggcgtccaggacctctgctggatccaccatgcctccggttggctcctcgcctccatccatgggccctcgctgctctgcatctgggagacctccaacaaccctagtgtcctctggatgttcgacgcctcgcccgagtacctctcctgcctccgccgtgaccccttcgacgctaggcatctctgcgcgatcggcctccggggcttcctcctctccgccatcccgcggccggactctgatatctcgctccaggagcaccgggtgacctgcggcgccagtgacattacagagctgcagaggctggagaaggagatagcggcgcccccgccctccccggccctcgccgcgtttccagcattcacgccgaagctatgcttctccccgctgtggaggaacatcctatatgtcacgttcccgcgggagctcattgtctttgacctcaattacagtactgcgctctctgtcactccattgcccaggggatttggcaaattctctgatgtcatgtctgatcctgatttcgacctgctctactgcacgcacattgatggcaagctgagtatctggaagcgcaaggagtgagtttacagtcatacttttcatgtggatactgtagaattagaatatagaaaacatgtctattgaattgtgtccaaatgcccgaactcgtatgaactaaatttgcaataagactgtggtggtcaagtgcaatcaataggctacatagaaaatgcaggaacaaaacagaattcaaaatggtgcaagtacatagtaataaattctagataaacttggaaattccttacatccttgggagtgtgctgataaacacataattactatgaagccattggagtttcaattatgttgctgtgtaaaacgaatgaataatcagtatacacacctgttagtgaccgttgatctgtttattaatggacacaattttaatgaaatcgtacattatactatatatgttttacaatctgttcaggttattgacatatgggcttcacaattgtgaaccaatatatgcatgatcacattacgtttgtacataaatgatacacttctttccagtatattaagttcctctcgtaattcttttttcttttccggttctaggggtgaacatgtgcatttgttgtgtgcggtggaagatctcatgccttcaattggtacaattgttccacctccagctgttcttgctactacaatctggcagtcagaggctgttttccgtaacatagagaagcaatcacgggacttgggacaaatacaatctacacattctgtcatctctgatacaaatacaaaccaaaatatgtatcaagggaccatgacatatctaacctcgatctctgaagatggcaagatctggtcatggcatttaagttttgacaagtctgcatgtgctagaaaagataaactaggtgcgaaccagtggtcagttcagtgaaatagctatttctggctctcaactgtgtaatttactgatgattccatttctgtcactaatgttgggaagggaccaggtacatcgaatcatagtgatgctggaatttccaattcgcgctccaatggacttgattttaccgtaaaggttgtagtgtaaacttcttccttggtttctgttgttagggtatcaccatgattaagcaggaatagtggttctttggaatctgaattccctatacttctatacaaattccctatacttctatacacagctcgattatcctaaattaatgggattgagatgtactccctccgtttctattttaagtttgatcaagtttctagaaaaatttagcaatatctaaaatatcaaattagtttcattaaatctaacattgaatatattttgataatatgtttgttttgttttgaaaatattactgtattatattgttctataaacttggtcaaacttaaataagtttgactaggaaaaaagtcaaacggcttataatattaaatagagggagtacatgtttagtcatcaatcaatatcccctattcctggcgcttatgtacttcccttatgtggtttgctcatttgtgctatgctctgcagattaatttgatgggccagcttcatcttttgtcctccactgtgactacgctagctgtgccatccccttctttacttgccacagtagcccgtatgcccatgaccataacattgtaccgtgttctgaaattataggttttaaatttgttcaacattcccataacagaaaactttctttttttctatctgaaggtggtggaaacaatcctgctccagcagtaccacttgttgctgtaggaactcagaatgggactattgaaattgttgatgttttagctaatgcaatatctgttagctttgctgtccatagcagcactgtcagaggattaagatggcttggaaattcacggcttgtttcattctcatatagtcaggtactcaggtgcttccatgttacttctgataaatcttgtcttttataaaccaagtacctacatattttgataatgtgaccaattaacattgtggcaatcaaaggtgcttcattactggaatctctgatactattctgtttcttatagtgccctacgttaatattatcattgatttgactacaggccaatgacaaaactggaggatacaataataagcttattattacatgccttagaagtggacttaatcgctcattccgtgtacttcaaaagcctgaacgtgcaccaataagggcattgagggcttcctcatctggaaggtggttctatctctcttacctagaccaatctctgtttgtgcccatacctttttcaagttttaaccttttacatttcaatatgcatggatttggcacatttatcacagctatatttttcatctcaagcatagttttactttcttaggtacctcttgatactgttccgtgatgctcctgttgaagtatgggctatga

SEQ ID NO: 77808 - DNA, 8450 bp, Oryza sativa
aaaattcatgtgtttttttaagtagtactactaccaaacaacatttttacaaattactctggatccacttcccgtaggattcagtaagccttgacaactattcatgtattttctaaatcatgtctcaaagcaacctaataagccagcattcttctcctcaaaactttgggtgtgtttagttcacgtcaaaattagaagtttgattaaaatggaacgatgtgacggaaaagttgaaagtttgtgtgtagaaaagttttgatgagataaaaaagttgaaagtttgaataaaaattttggaactaaaactcggcctttgtggattagatgatcacatctcaaatgctagtcacatcaaacaatggaatgtccagaaggttaaaatactggtacatatctaaagaaacatttgcttcactatggaccaacatgcgttcagacttcagagacaccgaacctgaagaataatgctgtcgcgctcgtaaatccagcacttggctgccgtcggccgaagccgctcaacctactccggtccacgtatccgaaactccgaatccaccgataaaaaattcaatattttcttttatatatactacgattttgagaagctgtgatctcatatatgaaatgaaaccttcaggttcagtgctcatatgaaaccttccagggttcatcacacctactacgaggaaccggatgactgacacgcaagaacacaaggtctgaaccggttggtttttctctcataggataacagcaacatgacactatgacagcagcatcaagtagtagtagaggctgcgttgaacggattgagtcacttgcacacgaatatctcggaggattattcagcgattccaatggcaacggcgacatctttgcccctgggctgaatcaagccaaaaacattggccgaaatcgcatcttttttatttaagtagtgctagtccaggttcaccttttcgattgagtgctggatcggcggtacgacatttttctaccaaatttcgacaaatttcaatcaaattttggtcaaattttactgtttcatatctgaataaaccatttaagttttcatccggaatctgcctttgacgtcgtaacctcgaaattcttcgggttttaggggctgtttggtttccagggacttattccaagtccctgtcacatcggatgtttggacactaatttagagtattaaacatactctaattacaaaacccattccataagcttggactaattcgcgagacgaatcttttgagtctaattacgccatgattttgacaatgtgatgctacagtaaacttttgataattatggattaattaggcttaaaaaatccgtctcgcggattagctctcatttatgaaattagtttttttattagtccatatttaatactctaaattagcgtccaaacatctgatgtgacatgggctaaaaagtattagccccatctaaacacccccttagtactagtagactagagtagaggctaacgagaatccaagaggtggccgtttctttcccgccttttcttcttctaacaccggctactactcactccgtcccaaaaataacctaaccctggatttgaacctgacatatctgtgtccaagtttaaacctaacatgtgtctaggtttaaatctaggattgggttttttttggatggagagagtacggagggtccagatttaaatctaggattgggtttttttttttggagggagagagtacggagggagtacgtcgcaggcagatgcagtggcagaatagttttctactactatctttttgaaaaagctaatgggacaaatgtaagcactgctcgaggtttccttcacagccgattattgatttcaaagaaaacgaagtgaagaagaatcacagcaacagagacaccaaaggaatggcaaaatcttttctggactttgcatgtattattgtcgtccttgccatgttgaattctaagagagaaaaaatacaatggacaagagggggatggagatcgaggagattgagacgcccctaccaatcccacacatcccaatctcatcatctcatctcgttgcatccatccactgctcaaagattgaaatctttggagagagagagagaaattattaaaacgaaacaaaaacaaaattctcatctcattgcatccaaaatgaacaatggtaaaaaattgtcatgaaatgaaatgaatgaagcaactaataatcgaacgaaacttatttgttcctcatcttattctctgatgaaatttcaaaaggagagcgaaacagtggacactgacgcttgcgaaataaaaaggtggcgccagaaactccggcgagactacggcgacgagacgcccgacgacaacgaccatgacacgatacaaccacacactgggtggagattaccgtcggcgacggcgacgaacacgacggcgacgacgactgctcagtgcgacaggtacaatggaggaggagaaggaggtgcaagaactcctcgcgtgaacaccaagaagccggcgatggctgcctcggtcacacggtgagcccccgcatgaactcccactcgtcgtcatcctcctccgccgcgccggcggccgacccctccgagtcgctgctcatgccgctgctctccccgctggccatcgccgcggcctccgggtcgaacgacaggtacggcattgcgccgaacgccctggcgagcgcggcggcggtggcgccgtcggtcctctgcttgagcacctcgaacatcacctcgggctcgtgctgcatcgagcggagcacgtcggcgcacgacggccccgccgccgcgcgcgtgacggcgaagcagtgcggcccgtcgctctgcgacacgcgcaccacgctcggcccgccgaacaggttgtggaggccgccgagggcctcctggtaggcgccgccgaggaacatgccgaggtagtagccgcgggtgccgtggacggggagctcgtgcagcggcaggctgtgcctcccgccgatgaagtggtcgaccttgccgtcgctgtcgcaggtgaggtcggagaggacgccgtcgaccgcagggcgctcaccgaggcgctggattgggatgatcgggaacatctgcccgatcgcccacatgtccggcagggaggtgaacacggacaggttgatgtggtacgtgcgcggcggctcggcggcgcccatgccgcgggcgacgatctcgcagaggctgtccaccgcggcgaggtgctccaggccaagaacgccgtccttgaactgatcggcgcagcgccgcttcagctggtcggcgtacagagcgcaggtgtcgaagtcgccgcgcaccgcggcggccatgaggttgcggtagtcggcgtggcagtcgtcggtgagctcgtcgagcaggtagcccgtggccgggtcaatgcggccgggcgccgaagccgagaaggcctcgaacaccaggacagagtggtgcgacaccagcgcgcggccgctctcgctgcagatgatgggatgcgcgacgcccttgcggtcacagacgcggccgacggcggccaccacggccgccgcgtactcctccaagctgtatgccacggacatgtcggtctgcgccgagtgactcccgtcgtagtcaatgccgaggcctccaccaacgtcgatgacgcgcatggccgcgcccaggcgggcgagctcgcagtagatctgcgcggcctccccgacgccatcgccgagcagagcagtggtcgggatctgggagccaatgtggaagtgcaggagctggaggcagtcgagcataccaagggtcttgagcttggcgacgacggagagaatctgcgcggcgttgaggccgaacttgcccttctccccggacgtggagccgaagtggccggcgtgcttggtgcgcagcttggcgcgcatgccgaccaccgggcgcacgccgaggcggcggctagcgtcgaccacaatgtcgagctcctcctcctgctcgagcacgatgaccgtgttgagccccatggtgcgcgcgatgagcgcgagcgagacgtactcgtcgtccttgtagccgttgcagatgagcagggcgtccgggttgccgcgcgcggcgaggcagctcatggcgagcagcagctcgggcttggagccggcctccaggccgaagcggaacggctcgccgaactccacaatgtcctccacgacgtggcggtcctggttgcacttgacggggtacacgccctggtacctcccgccatagccggtggagcgcacggcgtagtcgaacgccgcgttcagggcctccacgcggtggcggagcacgtcggggaaccgcaccagcagggggagcggcaggccgagcccgccgccggagcgcgggccggcggccttggccaccaccttggcgaggtcgatctcctgcccgggcagggttgcggcgccgtgcgggcgcacggcgacgtcgccgtcgtcgttgacgaagaagtacggcgcgccccagccgtccacgttgtacagcgcggacgagaggtcggccgaccacgcggccgcgtccggcttctccgccaccgccgcagccgcggcggcggggcccagcagcggcgcggggaagcgcgccgcgtcgcacgcgaaggcgtgcgcgacaggtgcagcggcgtccacggcgagcgcaggcatctcgtcacaaaccggagaacgctaaaatccacagaaaaaggttagccttccttctttttttttcttttgctgtaaatctgttgtctgtttcggtggcgttagcagcgaagaatcaaatcaaaggaaaaaagaatgaggttgtttggatggatagatggatcgatcgagattagcaacaagaagaaggataagaaatctaaagcaagaagaagaaatcgaaagaaagaaagaaagaaagaaagaaagggaagggaaattgaatcaaggatgccaaaagaggaagttttggaaggggaggtagaagaactctaggacgggattttggatcctgttgtgaggaagggggctttgaaagccgccgaggccggagccccggctacccccgcaaaagaagcaggctgggggagcgctcgcggcggaggaggagtcgtcgccggtggtggagctggggcaccccacgccggcggtcaggagagcgccctcgtcgtcgcagccgctatccacaacccaaccaccctcgtcgtcgccggcgtctaggagggtgttatgaccctaccggcgtcggagtcgtcggaatcgtgaggcgtagcggcgagcgagcgagcgagcgagagatgagatgggaaatgcgagggtttgcgggtgggcgtcgagccgcttttatagcccccccgcccgccctcgcggcggcccgccttggcccatgggccccaccccccgccgcgctcatctctcctcccttcctttctgttgctggcggcgtccgcgaaaacgtaaataactttttttttccttctttccgttttttcctgggagacgggtggtaggtgcggtttgaccctgacaaagcggggcctacgtcgcagcgacacatggcaaaaaaaatggcatatggctctccgggtgtatggatggatggtggtggttggggtcgcggacagcgcccggtaatcgctgcacatctgcttggctctctctctcgcctcacttcacatgcctactcatctcggcaacattggtcatcgtctctccaattctccatcaccccacggtggttgaatgcttcaatcctcctctctctctctctgcttcctccctcacggggggtcacgttctttgatccctctcttgttctgttgcgcggggcggttggctggctggctgctgctgcagctagcggcgatggatgatgatggtggtggtagcagccagccacggtacgatctgggccgttcgttcacgatccggcggcggggagcgtccgagatcggacttgtgggaggttttggatgcagtttatacgcgggtgggagataataatagggatgtgggattcgctgcgctgcagcaggtggtcgaccgatctgctgccgctgccgctgccgctgctgctgcatgcgtgtggggggcgtcgcggtcgactgctcgatcggccgaacacgactggagatttgaacctccggttaattctggattttgccggttgctggattaagggcatgcttagttggcaaaaaaaaaatttacccctacatatcacatcagatatacgaacacatatttaaagtattaaacgtagtctaataacaaaataaattacagattccaccagaaaacaactagacgaatttattaagcctaattaatccatcattagcaaatgtttatttagcaccaaattgtcacatcatggcgtaattaggccaaaaattcgtctcgcaatttcctgacgaattgtgaaattggtttttgtctatatttaatacttcatgcatctgtctaaacatttgacgtggcagcatggaaaattttataagccctaatttttctttattgttagtttgtttttttctcgtaagagttcagcttggcaggggataacgagctttgaattgcggggaaacgcttgcggtttttttcacactagctaggcacgcctgacgaaaattcagcatggttggtggtccgaattttttataggattttgcgcacggggatgggattagaaaaagttttgtgtactaaaggaaaacacttagtaccttgttttgggttgttggaaaaacactttaaaccaagtatgtatgatccttacaaacaagatccaaagcagacgacaaatcaacaatcacaatttggttattctctcttttactctcgtaaatctcaaagacgtgagacctgtgtttggcaacgaggagatggttagacgtactagttcttttccattccttcgctcatagcgaaatgaaggatcttttgttgtggctgcaatacaacgagaggacgtgtaaaccttttgggtgtgtatatccacaagtgaatatggataccgaatttctatctattatcttttagaaaataaagtagataagatacatagctttgtgactagcaaagtttatttagtgtaacatagagctcagatgtttcgtactaacataagaaaagacaaaatggatgagaaaacactcggctaatggtttcaatgggttaggagccgtgagataaaagattatagataatgaaatattttattaattagtggtgacatggtaaaggatatatatatatatatatatatatcataatgtgtgtatatcttcttataaatatagatatcggatttatatctagtatcatcttaaaaaagaaaatagataagatagagggtcttatgactatggacagaattaattgagtgagtgtgaacatacaaccaaccaagatgtttgataccaacataagaaaacgaattgacgaggaaatactccattaatgattttggtggattaggaggtgtcagatttttcgcgaacgcacaaaaggattgcacgttaatatattagaagaaaagagtttttcttacacaacacaatcagccagcccggcttatgctaggggaatggagaaaaagcaaaataaaaaactaaagcttaggatactacaacaaccaaacacaaatccaaacagcgggaagggaccaaaccacgctacactccaagaagtccataaaagcggcaatgccagctaaagaccacatatcaccctccgagtggatgaactctagaatcagagtctgagatcgaagagagcgcaaagtcgaaaacatgaagtttcgttctttccatagatgccaagagaccaagaggtgtcagatgaaatatttgcagttaataaaatattttattgatcagttatgatatgatagagtatacagaatactagtaactcataacgtgagacttgagtctatcaatctacaagtaaatatatcttccttccatcatcgtccatttctgtacaccgtcggttatgggttggtatgggtttattcggtgcgtatagtacagcaccactgataaccactctactgctatagcactatacgtagtacgtaactgctcgcatttgcaaatttgcatgggtcggaagcctaggaggaaagcgcagcatcatccgaacctatccgagctcatatccgtctgacttgggacgagggtagccgctcatgggttcaggagggctataggccgtagcagcgcgcgcggcgacggcgagattcgatcgatgggcgagaaaaaaaaagcgtcgtttctttctggaaaagcatatcggatgggcctgcctccgccggcgttgtcgcctcaccaccacccattcattcatttctgagtcggatggatggatccaaggagaatccgcgggtggaccgcgtcgaggcgccgcgtggctgcacgcgggcccccacctctccagccacagatctctcgcgcagatgcgtcgtccctgacctcacgctcccccc

SEQ ID NO: 77809 - DNA, 13617 bp, Oryza sativa
ccccccccccccccccactcgtcaaaccccgccgctttcggcttcggctcgggtttttttgccgttcgcctcgccccgtcgtccgccagcaaatgttcccccgttgataaaaacggctcgagtccggaaatatccagattttatttcggggatcccgatgggcggcccggatcgccgcatcctgttgactggacggcgatgcgtgcgtgctccaccctggccgttgccgcgcgagccgttttcgccggctcatgcggaattccggattagtattatatactccctccgtattttaatatatgacatcgttgactttttgaccaacgtttgactattcattttatttaaaatttttgtgcaaatatgaaaatatttatctcatgtttaaagaacatttgatgacgaatcaagttataataaaataaataataattacataaattttttaaataagagaaatgattaaacgttggaaaaaaaaatcaacgaagtcatatattaaaatatgaaggtagctatatcggctttcactggtactcgtactccaatagcgactagtgacctgcagctagcacaccggatgcagcttggagttctgttcttttttgcatagagtgcacgtacgtacgtgcaggacagattttatgtgagaggtcaattttgatgtcttgtttcttgtcaagagatattagcgtgcctccgcgccaaaaaggagaaaaatgtgaacaacgccacggacagagttacatttttcactccgttctcatcactttctaagtgacaaatatctaccagggattttgttatgtttactacgactagagtttaattccacttgcaagtgccgcgattttcacatgaaaaaactgaagatttattatagatattatctattactactggagaaagcctttttcctctcggttagtaacccctatactcctggttttgcaaccgggagtagaaatccgggattaaagatgagtatctttagttattcgggattaaagatgagtatctttaattttaggtgaaataactgggactaaacatccatctttagtcccggttgatgatgccaatcgggactaaagatggcagcgccagtcccggttggctactatatttttttcattattttttcccaaatcgatttggaactgcacaaatctcttcccaaattgagttgatccccatatccccaaatcaaaatcaaagtatcatcacaaacatagattcacatcacaaattctaaaaaaaatacatctcaaattataaaagaaatacatcacatatcaaatcaatcacaacttctaaaaattctcagatccaatgtatcacaaattcttaaaaaaaaacaaaatcgagttgccgttgcgccaccggtcgcccaccgcccgccaccctcccatccgtgcggcctaccacgccagccgtcgcctgcccgcccttcacgcagcctaccgcgccagctgccgccgctcgaactcggccgcctggagaggaggaggcggggaggggtaggagagggggagggggaggaagaagctaaggggagaggggaggggagatgactgagatggagaggagaggttgttaatttaatgagaggggagaggaaggggagggggataagatcgatgacgacgactgtcgaccgagaccgaggcacgcagctcggggtttttagtcccgattgtttataacaaccgggactaaagataattggggccctgactcgtcttgacaactttttgaaccagaactaaaaataatctttagtcccggttcctattcgaaccaggactattgtggattttgggtgatcgatcaaagatggtttctccagtagtgtatatatgtaacttgtgtaggaaaactaatgtccaagccttgcaaattctaaaccatttggatcaacaatctaacctagatttcatcaccaccttcctaaataaaacagctcacgtctcgtctaattggcccgtattagggtatagttagccgccgccaccaccatattgctccgctcgatcctgcctcgtgcgccacttagagcaagtttaatagtatagccaactactagctccaaattatctagagccaatataatagctgattcatacaatagttgattactattctattaatatctagtcccacctgtcatacacatgttacgtcttagagtccgtgctgcagctggctacagatatgtaggccgctgctcttctctctcttcctttatctctttaaaatatgtttatagctggcttatagcatgctattgtacctgctcttattgtcgttcctccgcgttattccttccgtcgtcttagagcaggtataatagtagacggtaagactttaaatattatatctgtgatgacatggaaggaagagaaggttagaaaaggcaaaggcgagcgcttcatttagcactagctccagcacagcctccaacgcaaagtggtggggcccacgagtgggagggtatggccagccaattggatggagctaagccgattgatgtgcacagttagttgaataaaatattagaagtaactatgatgagcttaagtagtatttcttctttttatttacttttgctaaggtggattattttgtagctggcagccggctgctctattaacctgctcttatttgtctagatatattaccatcattcgtcacctcgtaatctgcattcttccttgccatcgtcaaggattctacccactgctcagtgctcactaacaaccccgcgaaactggcacaactatcaccttagtgctccccatcatcgcagccctctaaaccaagaaactcccccatccttccactctacccagctttgtcctcccaccctgaccctaattttgaatcatattttggtcaagcccgctactctattgtatcgtggaagggtcgttagagttgctgtgagtcaccgaagctaggagcctaggaggaaactggtgtgcaagtatttaagccaatcggatgatccataatcttattttgttcgtcgattttttttcgtcaaagaacgttagaaaatccgttaattataatgtgatgagatttcatacgatcgagacaatattttcagttaccggtacaatttaatactcctcccgtgaaacatgtacgactcgttaagtcagtgcacccatccctgcatgatacatcccgcctactagatgctgtgtacgtgacggacgcccggccggcctaggggcctaaagaaaaccgagaaaaacgttggaacaggacgacgtactacgtaaaagcaacgaaagtagcctgctcctccccctctcgctgtctctcgctgattgatacgcacggacaggtggacggagcagactggcccggcatggagacacacacctcgcccctactagcgcgagagatcgccgcgccgcgcgttgcggctggatgatgagttcgccatgtgccgccgcggcggcagcgggcgtcgatcgtccagggcggggagggtgcaacccgggggaagcgagatgccgcccgggcgccggccggggcggggccccgaatccgcacgccgcgagaccgacgtttgctgagatttcgtgggggctgcgcaaacgcaagcgcgtgcgagatcactctcaaaccggtcgttggcttgttgcgtgactttccactaccggtctcactctttcgcatatacaaatcaacagatgttagagtataattatttataccatagggcttgcacatgatcgaaggggttgttgtcatgtttggaacaaaggagatatataccttttgtgttgattctagaaatttttttgaaaatatctatttttttgaaaaagatttgtgtttacatacactactataaagaatttacgaaaatatacctaatccgcagatcagttctgcggtagcgcaactaaagtatggcatggcagcgtggagtagacggccaaggcgtttgcgcggaacggggctacgggacggagccagtcccgcatgccggtaacacggaaccgacacactcccgcaatgccggtgtgcagaacggcggcgccagcatttttttactgcgtggcagtatattcaatactgtttgacactgttttacacagttccatgtcaattccgcacaacagaggcgcggcaccgggcatgcacagtgtatgaacagtgctgtacagggtcaaaacagtgtataaactgtgctgcacagtgctgaagtcgctggccactgcggttccgcgttttggagctgcgggatcgcgacggttccgcgtgaccatcccgcgggatcgtcggtcccgcattttaaatctgcggaaccgtcgttggatgagtatatttttgtaaaacctccccatacatgtatataaacataaattattgaaaaaataattatatttataatttttttccgttgattctatcacctttgtgaaaccaattgcaggagatctacccttagcttcgtttcttcaatgagttggattctcaaggggtgatacaagacaacgccggggaccctggatgagggacgttctagcatcatgggaggaaacgtaaacctttgcctcgtatctagaaacatttattgtcaagttattgacatccgagcaagtactaaaaatcttgatgaaatcttgatgcgaagttgattgaagagcgagacaaagtttccaccactctgttgcatcacatctagaaggcaaagaaaacatacactaaagccatttttctttacatacgtggtggattaccctccccttccatctcaacctagtacaatatatgctggggaattgctctacaggcaatcagtgtcatacttatcaagtattattataacatatgctcatattcgttgtagtaggatatgttctattcgatattagatagttatattttaggataaagataatatattggtacatactatcaacagaagggaaaaagatctaaagtcgtgaacgtttttcaaaattttagtgttttcaaaacaacattttcctccataataaaaaacaatatctttacctgtagggttttgtgaaattggtgtaacatgttcctttgaaaaggtagatacacatagtgcatactactccgtctaaaaaaaccgaattcctagctatgaatctggacacaggaatggtctttttttttgggacggaggggtagtcattagtaaacgaaggtgacccactttttttggttttacacagttcataggttacacgattttttcttcttctaaaatctcatttcatcttctaaaaccatggatctcacatgcaatttctccatcatacagtggtgccgataaacatcgagttagatccttggtttgaaaaagggccatttgattgatcaagtaggaggtgagagggccatttgattcggatctaaccattgaggaagtggagatatagatctaataaaaattaaaaatttatgtgaaaaataaaaatgagaaacccactaaacacctgtaaccaaacatacgaagaaaaaagaacaagctgagatttacaatacgtcgtggtcacctcagggcgacactctaacatatctggtgactcgggataaacctagagtcacccggcggattcgaatgggatttaagagtttcctttttatggggaaggggtgatcgaaagttgagactatgacataacaatgccttcaggactaagacgtacatgttaatttcgtcaaaaggtacaaatcttagtaaactactctcgtaggatgaattgatggctgaccgtatctagtggatgatgggattgcttgtatgccaccgtcactttgcaaaaaccgtgttgataaaatgtggcctgctaggctgtgacaaaaataagtttatgatgcatttttgtatgtggtttttatactgacaccagtaaacgattcttgtatgcagggataattatgacccgcctacggtatgtaggaggtttggttcgaaaaaatcgattatgtagtactgtgatggggtagtctgaatttatataaaaaaagtgttacaaatcatagttatagcacgaaccaaaagcttgcttaaactaatcggcagtcgatgtcaaaatgtcgtaaaatttagcacccaatcaaaatgtccctcctgttcgaaggaccgtgggagtgggacagacagcaaagcaaagaaaaataactttctgaaaaataacgtgagcctacggctacagaagtactacagtactgtattttcagtacagtgtagcgtcaggccagttaacctttagctctgattctctgaacagttagcaacggcgtcttgtcgcgatttatctacgcaatctgcagagcactgtacatacgtgcctagattcgtgtcgctcgtcaccggctggcccgtcaacgattgcatctccggcgacaaactctgacgctaatgttttgggggataaataattgaatcttctaatgcagatttggttggtatcagatcgacaagcgaaaaggagataaaagcaccgtcagcatgcaccttcgattttactatgcaaagttaagctcggtggttctgcttgcgattcgcatgtgttactgtagctgtcatttccaggaagctaggttagcacgtgtgtttaccttacctggtcaaaggttttactacgtaatgacgtaaacttttcttgaagaaacttctaaacatgtgcaagttgtcacagagcacgtacgttctctgttggttacagtcctagggaaagatatcgacaaagacactgaaataataactagtatcaaatcttatcgtcagataaagaaaatgatatccccggctgctatcctaagtggagctattagttcaagggcctggattagtttcatctctcttttttttttttggggaaaagtttcatctctctttaacgtcgtcacaagtggtctcttttttcgcattattgaatcagcaaagagttaaagagaatgctgtgacctacttgataattgagacctaattccatcctctcccctttcctgtggatataccgaattaatctgccatgttccaagttgcatacctgaaaataagaaaaggagatggcatcatcggcaaaaggcctaactgaccgaagaaaacatgcgttgtcgccgatgtagcttgcagatacctaaacatggcgttgttcatccaacctatcctatgtttgtgtttcttatcgcctaaagacgcacgcatctgatagaatggtgatgcgtgttctgctccctgctccctttgtgtcctatgaatcaggtcataagctactgtttctgtgattcttgttggttgtgataattaattgcacactgttttctccatgagcttaatcatgggtcattgtattaattgtttgtagctcgtttgagtaaaggccggatattttattccattatctaaaaaaaaattatgagtctttgtatacttatcattactattactagtactatatactccctccatacttgtaaagaaagtcattttggacaatgacacggtctccaaaacataactttgacttgctgtttctataacaatatttattgaaaaattatatatgtatacttttataaaagtatttttcaagacaaatctatttatataatttttacattttcaaactcaacaacttaagagttattcatgatttatattctcaatgtttgacttaaatattattttaaacgactttcttcatgattacggagggagtatacttgtcaatgtgaactagtaccaacagaaggatcgtgtgacgactgcgttgggggcaacccatgtgtgaagagaagcaacgatgggtggaaagctttgtttggtcgcggctcgtgagcacatgtatttttgtgcttcaggatcagcgcatccatccggtcgatcggccgccgtctggcctgtcacacgcacaggacagtgtgtcgcgggtggagagacgtctcggcccggacgcatacgggagcaacccacgtacgccacgccgccgccgtcgccgcgcggctcgcatcgcaggatgcagcgcgtggcgcggcgcggcggcaaatgcacgtcacaaggcggcgcggtgttggcggacgtggtaggtcgtcagccgctcgcagcaccggtggtgggccgcggcgcgcgtggatcgcgtgcgtgtcgtggactggactggtcggggagtccgcgcgcagcgggtgcggggactcgggacggaagaaagtccaaaaacgagaggagaagcggggagcgcgccgggccggtggtttccttccagaggagaggtgaggtgaggtgaagcgtgggattgggccgtgtggcaccgcgagagcatggcggaaaggccgagaacgcgcactgcgcgattggctggaccgggcttccggtacacacgaaatcagttcagtacatgtgtttttttaaacttgtaagagcatcaatatacgtgcttggacaggagaacaaatttatgcacatcaatatattagcaggagataaaaaatttacaattatgacctgctgtagcggtgatgagagttttacacaggaagagaggagggcagttagctaggcaaaactagaccctgaacaagcaaaaagacagaaaaataggagataaggattatataacaataaaaactgctagaggactcgacttcacttccctccagagcctaccctcctgtgggatacgagtgaccaatgtatgcacctggaagaggaccttattaaagacacgagttgtcagtatcctgatctatattctaatatcttacgacactacgatcctatcaaaacgaaatgataccgattttacctagtgtcctaattttcatagtatcttgatcctactatttaagtaccacacgaccctacgaaatcttaggtagtatcccgattctacgatccttacaatcatacaaaatattatttaaaacaaaatggtttgaaaataatgtaaataaatatgctcaagtttttttaaatcagttaaatatatcaaaaactaatgtggtttctctcgataaatgtctctatttgcatgacatatattattactatatttttttatatagaatggatataaatataaatattaattaaacttaaaaaaatctcatagtatcccgatactactatacgatcctatcatacgggacgatactcatttgagcaaaacgatactcgatactacctaatattctaatattctgatacttgtaaccttgaagacacgagcattcctttccaaacatagacgctaggtaacgagaaagatgagggaatcaaatcctttcatgagataatcgagcggttgtcgacgagagcccccagcatacttcaagtgtggactgtcaacgggacgaagaagtggccactggccagtcctatcttggctagcaactcgtgctaaacttgtcacgcactcaccggattaggcccattatcacttttagcttgtgtggtcccaagtgtagagtgtagagctagactttcgagtccaaatactcaaacaaggccgaagcaaagctgaaattaggcctgtgagaagtactaaaacgggccaaatccatcccaattcgagttaaaatctgtcctatgtagattccataatgagctaattcaatcccgacttgagttggaatcagactccataaagagctaattcaatcccgacttgagttggaatcaagccctgatatctcagcctgtccaagctctcatcgacaagtacttcgagacccataacatccggtctgatatgtttttttgagcccatacagcacacacaatgcttcactgagtatgctgcttattcatctgtcacatggctatagcttaccttcttttgcgtcgaaagattctttgcttttgcattgtgctaacttttattttcaacgagggggagtgttcagtttcattttgctattactatggttagtctgaattaatttcgtgccctgaaagatctgaatctgttgaaacttcctctgcgttttgatctcaacacagcagctttcgaccgttttataccgtgtagacggaatcgagacgcagggaaaaggaaattatggtctgtgcgatgagtgtccacgcaaataagtaaagtttgcaatgcaaaccaccactttaaagttggccactatgcgagatactttaccttcttttggagccatccatccatcccttcccttgtcttctttgcttttctagtgtaatctgattatctccaatgtcatgcatatgggcagctagcttagcttagcttagcaagctgcgagttgggggatactgtattttaaagagaagctgcactcaagcaagagaaaagtagttgaggaaagctaaagtgctggctcaaattgggatcgatcgaccaattctttcccacaagttcgtcgacatcttgcagagatgttgtgtaccgacctggctctttcagtcggcagggcagagaggagtgaaccttggctctgaaactgaaggcgacgcacttgattcagacatgtaactgaactgaagagtctcaagttcgtacagcaaatcgtttcacttcaaatagttgtggctttgggtggttgttctatttttgggacaaaatgcttgggacctttatttattcactactacactttaaacacatgaattttctttccaccctttgttctgattaattacaagttactagtatatcctaggttggtttctctaatgggctaattcagtatactgaaaagaatccaatgaaagctcagacttctcaagcatagtacgtaagaaaagaacagatgccaaagacaaacgtagttcttactactagttgctactagcaactaaaatcaattgttactttagatggcttaactgttatattctttatgttggaatctgtccacgtagtttcaatttttaagttccagacttacggatactcatatttgtaactgattatttcttcaacggtagacgatgtattcgacaatagtgaagcgttcatacgtgcatggtgatttcgttaatatccatatatacagatttcgttaatctagaggaaatccaacattgcatgaaaagaaaagttttgtcccattttgaattgtccatgtcaacagtgtaaaaatcagcatcgtcgttcgagcaacaagggaagaaacacgcacatacttctatgcaaccaaaggaaaaaaatgtacggtcgtgatctagggaacctcccttaaccaacggccgatgacacgattcaccatcgcaaagccgaaagtaatacagcgaaatctccttataaagcagccgtgtttcgtttcggacaccacatgcatgcacgcgctttttgtttatggctaccatttccaacgttgtcacgaacacttattgtgcttctcccactccactgctccgccggcgagccaccgccatggcgcttcgtgtacagctcgtcctcgccgtcgccgtggttgtgccggcgttgggggtggcggcgggtggtgctaccttgggggtgaactatggccaggtcgccgataacttgccgccgccgcaggcggcggccatgctcctccgctcgctgaacgccaccaaggtgaagctctacgacgccgacgcgcgcgttctcagcgcgttcgctggctccggcgccgacttcaccgtcggcctcccggaccgcctcgtcccgcgcctcgccgccgacccgtccgccgccgcggcgtgggtgcgcgccaacatcctgccccacatcccggcgacgtccatcaccgccgtcaccgtcggcaacgaggtgctcaccggcaacgacagcgccatgctccggtcgctcctcccggcgatgcagtcgctccacgccgcgctcgccgcttgcaacctcacctcgcgggtggtcgtcaccacggcgcactccctcgccgtgctctcctcctcgttcccgccgtcctccgccgcgttccggcgcgagctcctcccgtacatggcgcccctcctcgcgttcctcgccaagaccggctcgccgttcctcatcaacgcctacccgtacttcgcctacaagggcgacccggagcacgtggacctcaactacgtgctgttcgaggccaatgccggcgtcggcgacccggcgacggggctgcgctacgacaacatgctgcacgcgcaggtggacgcggtgcgcgccgcgatctgcagggcaaactacggcaaggcggtggagatccgggtgtcggagaccgggtggccgtcgcggggcgacgacgacgaggccggggcgacgccggagaacgcggcgaggtacaacggcaacctgatgcggctggtggcgcaggggaaggggacgccggcggcgcccggcgaggcgctgcaggtgtacgtgttcgcgctgttcaacgaggacatgaagcccggcccagcgtcggagcggcattacggcctgttcaagcccgacggcacgccggcgtacgacgtcggcgtgaaggctccgacgattggcggcagctggaaggggagagccaatggcactagcggcggcggcgccggcgggctggtcgtggcggaagggcccggaggggcagacggtgcagggcagggcactggattctacaccgtgtcagcagcagcacacaaggtaattgattgattgattaattaattaattataattacattttgcaaccgcataattacttcattgtttggttacttttttttttgttattagtgtggttcttgattgaatgaattgtgattgagtttggtacaaggaaagtatagtttaagtatgcagtgttgtgtcggttcagacgttcagttgatgctgcgctagctagttgctttgcagtgcttctgttgctaatcaattaaatcatcaatatagtctaattagtatgtgtaacaagtttggtatgcacgtacaaaaccaagttttaaaattgcaaagaggggaaaatgctgctgtgctagctcccagatcatactcctactttgctattccatacccaaaaaaaaaaaagatttgctcatcaagtgagtaatcatgcttggcactagctagtaatcaatcaaaaggttagctacctgctgtgacagtattggagattatactagccctcctttacaagtaatgctttgtgtcacacactttatcttcatgttccttttttcataggtgaagaggtggcggtgctgggaaagcttgttcgcaaccgttgttctagtcatgtcgtccggcctgtgttggtcatgacctgaagagttgaagatgttcatgaagaattgaagatgcagtagaggaggagatcgatctgcagcatttgcagacaaaggagaaatgagcttgaacaaaaacgccattgattcaattgattcttgtgttttcgctgtcctccgattggtgttggttgatgtgtagtttgtgtactgtaaggaagagagatgtaagggacattacatgatacactggattattaattagttcagattcagatttctgaaaggattagaacatttacgcccagtagatggccagacttttaaatcatggatttggatttttttccccaagcaatttttgttagaaattttgaaccaagtgaaatgtgagtgccagtttattggtgggcttgacagcccatctgagagtg

SEQ ID NO: 77810 - DNA, 3647 bp, Oryza sativa
acttgtttggtttagttgttgtaatatccagttagtgtatgtgcagtagttatgctttatctgaaaaatgttgatgctaatttggtgatatcaggttaatgagcagacattccttttctgcagcccaaagtgaacataaatgtcttgcctgaagcacttaaaagtgacactattttgttctcctttctcttgatgtgctatggtaattctaacttgctgtgcgtaacccatgcagggtactccagaggtggggtgattatattcttcgcagtgaacataatatgtggaggtatgttgatcccttacagctacaggatttaaacaaattcatcactcctgctctaccaacacatcgtttgtccttccacagagctctgatactatatgtagctgctggagcactacctgaggctttagaaacgcttcgcaaaaaccaacgaccagacatcgcggcgctgttcttgcttgcgtgccatgagatctattcccagatcaccacagaatcagagtcatcagatgacacgccagggtctggatcgccgacatcggaacagagccccaagctccggttcccttccaagaatgtggacgacgaggacctgatcgcggtcagcgaggtcttcgggcattaccagcagaaattgattcatgtttgcatggatgctgaaccaaatgtggattgagccctcttggcgccatgccatgccatttgccaattgccatgtgggagggaggccctctcctggatggacaatatccgaagctgaaagagaccgagtgcccccactggtctctactactctttgtagatgtcaacgtctagcttttgcttctccatttttgtctggtgtgaagcttttttttttctttctacaggatgtatgctgcctgcatttttgtctggtgtgtaatctttttctacgggatgtatgtcgcctgcaaatcttgatgctggacagagccgcgttgcgccgtatcctacaaaagacgccgatgattagcattgctgatgtggcatctgtacggagaacctgataatactacttgaaagggataggcattgcggtgttgtattgtactagtaggtgaggacgcttggcactggcaatacttttctgtaagaatatatatatctgtacattttttattgctctttctcgctcaggctgcaaaaacagaaatttggaagttgtagcacatatgtatcgacttaaaacatatttaggtttggttttgaggaatcaaaccatccagaatgagaaaaatccctactttctcatctagaattggtgatccatcggtggacaattcctcaattctttttttgacaggacaattcctcaaatttggtagaatgtctccattgctcatttcttttctactggtacttgtgagttgtgagtgactggggatcatgggatgatggataaacctattcaatttctcaaaccaacaccccccccccccaaaaaaaaaaagaagattaaccgatcaattgaccaacccaatcctcaaatatcctccatgttactattaggccatgtttagatgggactaaaacttttaagtccctatcacatcggatgtttgaatattaattataaatattaaacgtagactattaataaacccatccataatcttagactaattcgcgagacgaatctattgagcctaactaatccatgattagcctatgtgatgctacagtaaacattctctaattatggattaattaggcttaaaaaaattgtctcgtgaattagctttcatttatgtaattagttttataagtagtctatatttaatactctaaattagtgtctaaagacagggactaaagttaagtccctggatccaaacaccaccttagacgcttgacgcattgagtcgtcgccatcaatcaatcatgccctattaaaatcttgtagccactgctatggagtttgatgaaagcaacctttttctgtcctagatgcctaaaatcatccatgaacctctgtaattaactactccctctgtctcataatatagcaacctacaagacgagacatttcatattacaacgaatctagatagatgcatgactagattcattgtactataaaatatcacatctgatcctagattgttatattatgagacggagggagtactgtagtattactttcacgcaggttcatttcaggtccaactttcttggccacatgacatcttaagataacatatttggcatagttaatcatcctcagacaaccaatcaaggaagcatgataagcaaccactaccataacaagtagcagcaactttctatccaaattacattactggcccgaaacaaaattccattttggctctgccaagtgccagccaaccaaccaaccccacgtttccatccaaattaatcaccaaacttatccaaatcacttaattaactatattagaccgtttgacacgactccgaaccggagctctacctttttccgaagtttgagcctaacgaaacggtttcaaaatacaagcaagatcaatagtgcagcccactattagctctaaatcatctatagtcaatataatagccaattcatataatagttgcttactatactattaatatttggtcccacctgtcatacatacattatatcttggagcccgtgctgcagctgactacagatatgtagcccgctgctcttctctcttcctttatctctttaaaatatgtttatagctggcttatagcctgctctaaggaaatagtactaactataatactatcacaaaataaactgtagaaatgaagttgggtttagacagctctacaaaccctattttagatctaactcataaaattaaatttaatagtttaagccctaccaaacaaattgcagttacacaaaaagaattttagaagcgatcgctacctaaatagcctgcgacctcatgaggccgacaaactgagcacaggtgacaacaatctatgactagtggaaaaaactagcaacacaccataacgttcccaacaaagagattcgaccctaattctcctaatctcttaggaaatatggaagaagcgggaccaaagaatcttccaaaacaaggagctatccctataaatcttattatgaaaattaaggagaagccaaatcttgggtattggcgggagccaaacaactaactaagatgttaccatagacgtctgccttatttgtaaatatttctttgttttctattttacatgtaaataacactcctatattcaatgaacaggcacgctgtgtctttcgtttttcttttttaaaaaaacacatgctaaacgacccataacgacggcattttttgcgagagtgggaggtggtcccacctcgagcgggcaagcaaagcagcaacgagaaaaggaatctggacgccaccccaccacaccaccactaccccccacttgcaatctcccctctctctccctttttaaaataaatccggataacgcatcggtgaaccctgcggattaacagagtaaactgcaacaaaccacgcgacccccaaacctctctctctctcctcgcctccgccgtcgccgtcgccgtcctcgactgctcctccggtgtgatccgatcacgcgcggcctctccgcctcccgctcgcccttc

SEQ ID NO: 77811 - DNA, 1868 bp, Oryza sativa
tacagctcgtgagcaccacaggaaccctgatccctaaccttttctctccccctcaattttttttgagcctaccttggttgtgcatgcgctgtgctgtttgtcccccttcttcacgacgattttcaagttatacgttatcattcagatgcaaggaataaccgaaacgcgtgttgtcgtagctaccatgttatcattcagatgcaaggaataaccgaaacgcatgttgtcatagctaccatgctatcattcagatgcaaggaataacagaaacgcatgttgtcgtagctaccatgctatcattcagatgcaaggaataaccgaaacgcatgttgtcgtagctacaatgctatcattcagatgcaaggaataaccgaaacgcatgttgtcgtatctaccatgttattaatcagatgcaaggaacaaccgaaatgcatgttgtcgttgctaccatgttgtcattcagatccaaggaataaccgaaacgcatgttgtcgtagctaccatgtttcctttatatgtatatttattagtaccttttatgcctttcataattgaatggattgacatggctggcaaatgtctgtgttgctttaatatgccctcatttgggcttttatgtactagggttagttcgttatttcagtatatgcgcgatcccgtgttggactttagttaaagatcatgtgctggagtcactgcaggacaaggttgtcggaaggagagagaaaggagagcaaaagagtttggggatgaagggaaaaggggaaagaaatttaaggaaaaacacgtggcccaatttattatttgaagctgaaaatctcataaagcagaattatgatgtctaacggcataattgaaaatttgaaactctttatgtgcgtttctttccttttcttcaagtcaaatgctgaataggcaaccgctcttgcttcaatatccaatgcttaaaaaagaacttctgaaaaaaaatcattgtagtgttcccttacctttccttttttaatatgcaagatatgctctcttttttttgtcggatgtcctttatcatttcttgtactttctcatttattttgactctgttaacacttttgtgtgaacatattggaaactctgtagttgtacttctctctgcatacttgaagcaataagtcctcatacaaaaattgttttacaggtccagaatcttattgaacgatgtcttcagctttatatgaaccagaaagaagtggttgagaccctatcattccaggcgaaaattgaacctagttttactgagcttggtaatacccttatacagattttctttttcttgttgtgcactgaatgtagcataactataacttggttgacttcccattgcatattgacatagcaatatagcattcatggtgcaccaagcctttgaatttttatgagccaatggttaatatcggacaggaatatgtgtgctttctaatacaatttggagggcattaatttcattccgtcgtaattcataaacaattggttctccgattgctgtttttaatggtaaaacacaaacacgtttgcctctatttctcactgttgtttttctccagtctggcagaaacttgaggaagagaatcgtgagttctttaaagcatattatgtgagacttatgcttaagaatcaaataatggtcttcaacaagctccttgaggatcagtatcggcttatgtgtaaagagcagccttctggagtaccttctatgcctcctactactaatggctccaacatgggcacatgtaagtatatgttgttttttttttcatcagctgtctatacaatgatgttaccttgcttactgttcaacaaatccctctaaactatttcattctaaattgatg

SEQ ID NO: 77812 - DNA, 1631 bp, Oryza sativa
gttgctactattctccattgatagcacatgtaaaaatttagggagtaactatatatatatttatagcgccgtatttttcaccaaaaaaatagtcggcatgtatttacattgcaagtccctaaattacatatataattttagtgtatttacaatgtaaattccaaaattacatatgtaagtactaaaattacatatgcaattctcaaaattacatgtgtaagttgatgtaattcccaaaactataaatttgtgatgacacggatatttagtttttaagactaattagtaatcctaattagcaaataacattaaaacaacagaagagatcagaagagaacagaatcggagggatatgcgtacactgcgatgatttctgcatccgcatctgacggttgaaacaaccgactgaaatccatcgtaatttgtagcgacatatttttagcaataccgaaaatttatggatcactagtaaacgttccttgtctcccaggtttaagtatgctgctagctttgccattgagaccatataactttaccgagttttattttagataacgtgctatccagtgtccttacttaaagtcaagtgtttttacctagatcaattgtaccttagcacggtgcccctgtgcaccaggtgggaagatatcaatgggaactgagtttggtacagatggtttgttttagtatataagtgggtttttgtaggttagccacttgcactctcgatgaccttcattgcactaacacagttcagaatagctcactacaaaatagtgattgaacacttcaaattctatcgaaccaataacgttgttcaagaattgaaagcaacgagagaaatccattgccttctacgcgagtgagattcaaaaacacaaatcttgcgctccatcactagtattttcacaattcacattttgctatatctttattgttttctatgcccttcgctctacctgatcacttatatataacaaaatattgctttacttagcatatgttcttctggagggattgaaaacccccttcgcatgcaaaacgaagcaacatactaacactgtcggagcttggggctcctcaccgggagaccgcgcaggcccccctttgccggttcggccgggggcgctaagtgaggttcttcaccctcgatctgtggaatattcgcgagagagcaaatgcacgagacacgggcgatgtagacaggttcgggccgctgaaaagcgtaataccctactcctgtgttctggtggatctgtgtgtgaaggagttacagagagctggagagcaagagagttcaggctctagaacccccttcctctttctctcctctacaagctcaagtattttcagagtcgtctcccctcctctctcttgcttcggtgggcaaggtcctccttttatatctcaaggggatcccacatgcaccacttctacctactcttcttttgggtggggacccaccctatcctgaccaaaacttggctcgcgtcttcgcctggaagctaaatcacagcttgtccttgagtgaggcccagcgccgtcactcgcctgacacaggggatacccctgtcatttcttcattaatgggtggagatttgcaatggatgctgtccgaatgaccctccgat

SEQ ID NO: 77813 - DNA, 647 bp, Oryza sativa
  unsure (1)..(647): unsure at all n locations
gaggtcgagcacctaggaatgccatggatgcccttggcgaacacggtgtagtgcccgttgaggtagagagctgcatggggtaggtgatgaagaactggctcccgttggatgttgggcccgctgttcgccatcgacatcaccccgcgggcgttgtgcttgagcgactccctgaactcgtcggcgaacttcttcccccagatcgaggtgccccccttccccgtgcccgtcgggtnnnnnnnnnnnnnnnnnnnnnnnnnnnnnnnnnnnnnnnnnnnnnnnccgtcgtagtagccgctcgcgcacagcgccaggaagttctccgccgtccgcggcgcctggtcgcagaacacctcgcacttgatgtccccgagattcgtgtgcagcgtcaccgactgcggcggagatcaatcggtcctccggtcagccacagggaagagattttccggtgagggagagtgagattcgagcggcgagggcttaccatggcggcggcggcgaggcgacgggttgcttcgtttcggcggcgaggagaagcgtagagaagtctcgagtctttggggaagacggtttggtgggttgggctgggccgccatttttatggatcgagaattcgcactgacaaatactacctccgttttttaatagat

SEQ ID NO: 77814 - DNA, 8937 bp, Oryza sativa
cccttatactagagacaaaattggagaaatattgagtttaagaactatttttttagaaaatatattacatgttttacaatacccaattgtagtgttagtacaagtgttgaattctaagttttctaacacaaaaaagaaatgagatcagatctataatcattatactatgtgtgatttgtgaaacccagtccaaagtgtaaatgatggtaactatatatggtgttaagtgaaaatacaagtctaactctagtccaatgtgaaattttggtaaataaaggttgaccaaagtgaaatttactctttaaaaaaattaagtaattatttttttcttagttatttaatttattgttaatatatacatatagttttacatattttataaaatttttaaataacacttaaacatattttttaaaaaaatcaacagcgtcaaatatttagagacggaggtagctaacaaatttgatttgtatctttcaagtttttagcctctttacctctgaaaaagtttttagcctctcattatctctaaaaaaagtagtacttattagtagcttatcagttatagttaaattataaaacttcaattgtaaattgattttaaggtcttctcatattctatttttcagcatttgtttttaaaccattaataacaggatataaaagtttacctataataaattattgataagttatcttttcatataaacataaatataattttatctataaactacttctaactcctttatttatttcttcacggtttgtcagctcctgagttttgcgtttgaatatttgtttctggagataggagacaacggccacacaagaaaaaaactgatcaaatagggcttttgcaatacatttcatctgaattctgtaaccaacatgttctttttttcctatgcatgattgttccattgtttgtgaaactgttctagtgacaaaaatgaaccccaataaataaataattttgatgacaacatatgagtcgcgtccaaaaccctggcacaagcaggaactgatttacaaactcacaaaacaaaaacccaacactagcttatgtcacaatggacctacagagagaatgaacttatgcttgatttaacctatcaacagatgggcaattttctatctgaaacccctacaatggaagcagctgagacctacagatcaataaaagcaactcagcaacaactttcaaaagaactgttgttcttcaacagatcaatacaaacatggtcctgatttgtctttgttccagcaaaggcgtacgattgctcctactggttgttaggagtagttcccatggtaaagaaggattataccatctttttcctctatgccccctggattctctgtggagtacctggcaaagcagttattccattccatgacaagctcgagaggataatcctggtgtttcaatgattcggtttatggctatctgtaatcgtcctgagcctttgcactaagacagggatatcatgttcgctcaatgtcgtgaagcaacacctgaaccatccaggctcgatgcaatggcaagatgaacctggagtgacattgacctttgcctccttcaataacctatcctaaagcttgcgctcccctttttcgctgtaagacctgatgacttgctcatgtctgcccagcagtagaaccctccactgctctagtagcactcaataccccacttgatccaaagcatcaacaaacaatggtacatcttgcgcaatctctctctattaacttttaggtaatctgaaatgaacttttggtccgagagcatggcaacaagcaagcgttgtgttggagttgacacagacgagaacctagcaatcttagcagctgctgtcacgatgctttcattataggaatatattaccccaacccgaaacccggcaagagataggtctttcgagagtccatatattatgtgcaccctgcctttgtcaaagtcttctagatcatcaacaacctctgccacacttacaaattttccagatccatatgttgagccagcaaacacttcatcagatatcaagtggatgttcttctctgcagcaaactctagaagatcatgcagtgtttgcttgggcacaaagcttcctgtagggttatttgggttggatatgagaaccccacgaacctttattcctcgcttctttgcctgattgtaggctatttctagagcagtgatactaatgttgaagttgtcagtgctacggcaaggaacaggtatcaactcaattccagtgcgccattttatgtccctgtcccacctgcagaaatgaagtgacagttagtaccttcacttccaatacgttcatacagatgaacctagagattggagaagagacatacccagggtagtatggtgatggaacaagaaatgcatttcctggatcagcaaggcagaaactcagtatttccattgcaggagttgcaccagatgttataaccacctgagatggttcaaaggacactgatccttgcatgatttgcctcataaatccagcaagagcctgaaagagaaatttaacacttcatatcggaaaatttgcacacagaagaacacaaattaatcatggagaaaatagttcaatgtcaggtaacagatcaaaaccactgtgtggaaaaagggtaaaactgagggatgctagcaaagatatgcagattttggacaatgttgaagcatgaagcacaagacaggggaaaggaaaactataagcaatacaaagtactgatcttgcaatgctcacattgtcatgtgtttacatgttcaataataaattcagtgactgcacaacaatgagttcctgagaatcatatgctgtactagattggtggaacagtccagttctaatgaaacatcacaattgaaaaaaaaaagctttatagattcctctaatcatttgaatggaaaataggtcaaccaaaatttacaagctaatacagaaaataagcaaaaagataaagtaaacccgcatgatgttaaggtccaacagcagacatgacaaatttgccagcttcagtatgataactggtgattatcagcatgccattcaacaatgaactgtgaagcgagaccattctagcaggtatgatataatatgaaattttattcaaattcacgcggatttacagcagcgtaatacagagtaagtcaataatatggaactcttgattattttttttaattctacgaaagagctgatcaagatagtggatcttttcagttgaagtcaaggtttgacagatggcacaattgcagccaccatagcaaaaaatgacatccaagaataaacgcaagcgacacctcttctgcagataacatacatgtggctaccaaaaaaacaagagcagaaggaaacaaaaatgcacagtaccgcgtcaacaataatattccaattcaggcttaatcgctaataaggtcagttgtaattgccataattcttcatccatccaataatgaatcacacactgttaacactgttattgatcgagctatgtcatccaaaaatttgtctatgtgaccacatccatctaaacagaacaaccgcttaaaacaatcaattttaagcaaagctttcttgaaacatgagaaaacaaaagtattctttttgtgtaagaaacaaaaagattgaggtagcatcactggggtaatgggctaagtgcaaaaaaagctttggaagaatcaaaacagggcgagttgttggattcgatgttctcatggatgggatcaggggggattctgcaacatttttgttgccagagacagaacctatctttctgacagaaatggatgtttattttttttcgtcgtatggaatcagggggggggggggggggggaatcgtttggcttaccatcttcaaggcaagtatcccgtcgtacggctggtaggcggcgaggcctctgatggagagctccctctcgtcctcgtcttctccgcccgccatggacgccgcctccgccgcgtgctcctccatccatctcccaaccaaatccagcgacagctgcacgcaccaatcaccagaaaccaaaccgcgtcatcaccatcgtcggcttcgaaattaacgatagagagatagagagagagagagtattgcgaacgtacgtagttctcggcgaggccgagctggatgatgccggaggggttggtgaccgggtggtaggggtcggcggcgcagcggcggaggccggcgtagtagagcgagtcgtcgtcgcggacggaggcgccgcgcgcggagatggccgggagcgcggcgcgcggggcgaggaggccgcgcgagagcgagcggtggatcggcgacaccgccgcggcggaggcggccgtgggggatccgggcggcggcggcggcgaggcgcggttgcgcttgatgtagagctggaagaagtagaagagggcgcaggggatgagggagccgagcacgagccccccgcgtccctgcaccaccccctgcagcggcaccacgatgcgcatcccgccgtccgcccgcggcctcctctcggacgccgcgctcgcgctcctcttcttcttcttcttcgccgcgccgccgttgccgctccgcctcatgggacgccgaccgacgaggagatgacgtcacgtcaccccgccgcccggcgccacgcgcggcgggcgtgcataggcggggggtgtggagggattgggttgggttgggttggcggggaggagagggatttgggagggggttttggggggaggaggaggaggagaggggcacgccggatttggcgtcttgcctcttctttctttcgtacgagtacgacgcgacgccgggggtaaaaaaaattgagattttcgccgtgattccgctggtttcggcggtcgaacgaacgaccggggaatggacgaatggttagtgatggatggtaaccagctgtttgatgttaaaataaaccttgtcaaaatttaataataccaatagtattataaaatttttggtaaaattgacttaataatgttgccaaattctattcacattactaatggtaacaaataaacgtagacacgtaattatcaaccaaataatggtatggccatcaatctgaacatgcctccaattttcacagcttttacaaatgaacctttaaaattgagtcattagtacataattaattaagttattattttgagattagaaatagattaatgtgattttctaaaacaacaattttatataaaaaaacaccgtttaacaatttaaaaagtatgcgcacagagaatgataattttttttgcactcattccgcaaacaaattgcacgttggcttatcgtagctaatattataattttaaagcttttccaagttaattttagggattttcctttgtattgctaatatcatgaaataaaattttaatctaaaaatcattatttatgcctttttcaaccttttgagtttggaagttttttctcgcggcttatttattagtcgtacctgaaaatggcaagaaaattcagcttctctaaattagcttctgcacgagcaaaatttgttttcagcccaaagttcgaagctttgcctatctagtgatctcttcaacgtaacgacgttgttgccacggcatgctataagcgtagcaaaagaatatacacttcactcggagttggtgatcgtcgtggttaggataggattttcgagtggttctcgaggcttgtttgtaatttgcaaattgcaaccctggggttcacgatgtgattgtgtcaagtggagtgacagaaatggattgatttgggcgtgttcttcccaactctcatcttctcttcctcttgctgtttggaagtacttgcaaactcaggctttgttcatttcaccaatcattttttttcttcttcagagaactcatttcgtattttcgttcaggcctgaagataaaaacggacgagagatgcatatggaattcagtgacaacaacaatgtattggacaggtgaaaccgggaagaaaacgcagctggggttgtgaacaaaacactcttgttcgcatctgctgcaagaagcctaggacgaaatctcaacctgctgccaactgttgcagagagggactggttggctgcttctgaattcccaagagccgtattggttttttttgtataacaaaaggagcttccgaagctgctggcctttgcctgttgccttctagtgcaaattttcatcgcctcagttgtgccgcaagagacgagcacttgggcagaaagtatataattatatcccaagattcttttttttaaaaaaaaaggagctttgattgcattggaagcgttaaataatcgtttgctgcatccagcttagaatagtactaagaaagattccatggcagcagtggaagtcagttaaacatgaagcattgctcgcttttctgcagcctcggtgatttctcttttctgtttaataacagtgaaatgcatcctcagttaagcatgtaccaaaccagggataaaggagctgctaaatgctactactagcatcttggacatgttcagttaacctgcaatacactcttgaagatcgagacgacgatcttttcatgttgctggcggcaaacgagtccagttttagctataaacagatacgcatacactgtctttgcagcactgtcggttggctaggctgattataaatcataacaccttattagcgacaaaaaatagtttataaatatattttttatataaacgtcttaaaagttaacgctgaaaaagaaagtaggtttaaaataccctttaaaacaattctaaaagtaagtttcgaaattttggtgtagtgaggataacaaactaatccataccacatattgaaacctagaataaatggttatgcgaatatttgccaactacggatgtatgtatataaataaacttgaataaatgtttatctattaagtgttggtgttattagtttctgcatcattatttcctggggttttatgtgtttttcattaaacgaattgtgtaataagtagttgtagctttttaagcaaatttcgaaattcattatattatcttttaaaaaattctgctccagtgtagcagtgtgtttgtctagaaaggaatgcctttctctgatgaaacgaagttcagacccctgttcgcagagatatctgaattttgaagaggaaagcaagagaaatactctctgttggcaaatagcccagtgcccacacttcgaaacaacccgagcatcgggcaaactctcttgatcttgtgagattcccctgagagaatctgggtcacacaatgggattgcactgttggctgtttcctgtgtccaaccacaaaaattgtcgtagactggtacaagtagaatacatgcagaagcactgtccccgcagcggtgggcgactctggtggcacgcagttgtcggattggccacagtcacagtagaagcacaggcctatcatttccgttgaggcaatcaacggtgagcgttaacgcgatgactaagcccttgtttagttttaaagtttttcttcaaactttcaacttttccatcacatcaaaactttcctatatacataaactttcaatttttccgttacatcgttctaatttgaaccaaacttccaattttgacgtcaactaaacacactaaatcgtgtttctatgattctacctaataaaatgtaaattatttgtactttgttatttggttcgttgaaaaatcgaaagttgtactatactttattacaaagaaatcataatgctaaacataaaagtactcatgtaatagtaacttcaaagttttactatccaagtttcagcaaaatgtgcctattcagataaatgatatcacaattcgtctggttgtagtcatgccactcaaattttaaaaaattggaatcatgtcatccctgtcacgttttccatattcttccccatctgcacgtggaacccacccgtcatattcatcttattcttttcaccctcccttatcttctttctccctatctctccgtcgtggcgaggagcgcggacaggatgggaggagcagcggggtacgtgcagccaacaccactaccgaatagcctctgggccatcccgccagacaccatcgtcgtgtgggatgcgtatcgatgcaagaactactcatgcttggtgcacggtgactaggtgagttcaacctgtgcggcctggagaattgtcggtggatacacgattacaacgaggtcgaacgacacagtgcgcatcaagctggacattggcgacatgtccatcacgttcgcgcaccgcacgcgtgagccctgtggcgaccatggccatgaactccagtcaagggccttagtgcgaacgcaccaagggcatcgctgctctttccgtcctacccgcgctcctcgctcctcgttgcgacatagagatgaggaaggaagaagttgaatcaaatgactatgtcccatgtgtagacaaggaagaagataaaaaaaatgtgacgaccatggtatggatctaattttgtaaattttaagtagcacggatacgaaatgtaatggcatttatctgaatagatatatttgcaatatcacggatcaaattaaccctttatattattccttccggaaaaaaaatactacttgttaccaaggaattagtgaaagcaaccccattttgaaacagtgaacgcgatcggtcggcacgcatgaggactggaccaaaaccagaccgtgcagatcccactgtagcacagtgcatcacacatcccatccgtgctacagaaacctgccgggtccgtccggtccccagcaacaggtgcaaccatgtagtactaccaaatcaccgatgcaggtgcagcacctgtctcctccccgtaggctctcccaacctggatttttcacattttggtcattttaaaaaacttatttcgcaaatagacccctaaaaaaacttatcccaaaaatggtcctttttggggc

SEQ ID NO: 77815 - DNA, 4838 bp, Oryza sativa
ttagcatgccgcacgtctgcccttcttcatacaatgacttcctcgccatggttgcgatgaagcctggaatgaatctggccgggactgacataccaactctaggagttagcacgccggctccggctagggacgagtgcctggaggctctcattattccgacgggacggggcgaggcgtgtgacaggccgcctgttgccacctaacccgcaatctaaccggtctgtgaccggtcacacactgcgaccggtcacggaccggataagcgtgcgatgcgctgcattgaatgcggcgtggtgcgctcgtctaacccgctataaatgcggttaggtgagcgccgctgtgctcacctaacccatacacgtggcgccaacaccacaggaggtcggggcgccccagccctcggggccgaaacgggagcggcccgacccctcgaggagacagagggaggggtggccacgtcatcctcgggcccgacccccccgagggggtcaggccacgtggatgaccgcggctgcccaagcctctagtcacgatacccccggtcccatgtcaccgacaaacacctaattaaatattagcttaaacttaaaaaataaattaatataaattttacaggaacattttttatagaaaaatatttgcaaacacacactatttattagttcggaaaccgtacgcaaaagaaaggagcgagtgaaggttaggaccacagacttattctacgcttttaaaaggcatcttctatctttttatttttgcttgcttctgaagagggggaatttctagaactgttcggctgcactcattcaacgaagctgcaacacagtggttgcaccttgcagccgaacaggccctctaattatatataataagcttgtaaacttctcaaatacagccatacacaactactcaagccgagagagaatccaaaaattgctcaaatttgaaaattttggtcgtcagccatcaggctcgagccagactgcgaccctaagccgacctattagagcatctctaatagtctctccatcctactctctaagataaattttagccattctagccaaaaaaacgtgctccaacagcctctccaaccggatggctaagccatatggctggctaaaacccttcctccactagccaaatttggccactctatttggctggccaatggtgggccctacgtggctaatcaactccatccccacgcggcaacagagagacacgggaggagcacgacgacgagcacgctaccgacggcctccgctcgccaccgcaccaaacccgcacggcactgcccgccgcctccgctcgccgcgtctgccggcctccgcgcgatgaggctcggcgccgccgccgctcgctgttctccgccagtccgcagtagtccagtaggaggaagggaggaagaagtagtagtagaaaatgggttggaagaggaggaagaagagtaggagagactgacatatgggtcccatttgtaatggacttgtaatagagagggtagatgaagaggctgttgaagtaaacaaatagtattactagccaaatcagattgagagttggctatagaaatgtttagagaggctgttagagatgctcttatgccgcaaccgcaccaagccgcaaacgctccggttgagttggactcgtccgagccggatctgataacccacccgcgactcctaccccattcgagcaccacccgccccgccaccgcctccaatctaaaaccctagatctctctctctccccacttctctctcttctccccccgagtcttcctcacccgccgccgccgccgccgccggaggaggaggaggaggaggattccggtgcggccatgtacctctacagcctgacgctgcagcgggcgacgggcgcggtgtgcgccgtcatcggcagcttcagcgggcgcgactcgaagaagtcggcggcgtccgggtcgtcgtcgtcgtcgtcgtccacgcaggagatcgccgtggcccgtggcaccactctcgagctcctccgccccgacccggagaccggccgcctccgcacgctcctctccgtcgacgtcttcggcgccatccgctcgctcgcccagttccgcctcaccggcgccaccaaggactacctcgtcgtcggctccgactccggccgcctcgtcatcctcgagtactcccccgaccgcaaccgcctcgacaaggtccaccaggagaccttcggcaagtccggctgccgccgcatcgtccccggccagctcctcgccgtcgaccccaagggccgcgccctctgcatcgccgccctcgagaagcagaagctcgtctacgtcctcaaccgtgacgccgccgcgcgcctcaccatctcgtctcctctcgaggcgcacaagtccaacacgctcaccttctccctcactgccctcgactgcgggttcgacaaccctgtcttcgccgccattgagcttgagtacgccgagtccgaccgcgaccccaccgggcaggctgccgagcaggcgcagaagcacctcacattctatgagctagacctggggctcaatcatgtctcgcgcaaggcctccgagccgatagataacggtgctaatctactggtgactgtgcctggtggtggtgatgggccaagcgggctcctcgtgtgctgcgacaactttgtgctttaccggaaccaggggcacccggaagtgcgggctgtcattccacgccgcgctgatctcccggctgagcggggtgtcctcatagtcgcagccgccacgcacaggcagaagagcttgttcttcttcttactacagactgagtacggcgatatcttcaaggttgacctcgaacacagtaatgacactgttactgagctcaggatcaagtactttgacaccatacctgtgacatctgctatctgtgtgctgcgctcaggttttctctttgctgcttctgagtttggcaaccatgcactttatcagttccgtgatattgggcgggatgtggatgttgagtcgtcttcagctacactgatggagacagatgaggggttccagcccgtattctttcagccaagagcactcaagaacctgtaccggatcgatgaaattgaaagtctcatgccaatcatggacatgcgtgttgcaaatctatttgatgaggaaacaccacaggtattcacagcctgcggccgtggtcctcggtccaccttgcgcatcctgaggcctgggcttgccattagtgagatggctcgatcgatgttgccggctgagcctattgctgtctggactgtaaagaagaatatcaatgacatgtttgatgcctacattgtcgtgtcctttgccaatgttacacttgtgctctccatcggtgagactattgaggaagtcagcgacagccagtttctggataccactcactccctggcagtttctctccttggcgaggactctctcatgcaggtccacccgaacggcatcaggcacatcagggaagatggccgtgtgaatgagtggaggacacctgggaagaaaactatcactaaggttggatcaaaccggctccaggtggtaatcgccctcagtggtggagagcttatctactttgagatggacatgacaggtcagcttatggaagtcgagaagcaggacatgtctggtgatgttgcatgcctggccattgcgccagttccagaggggagacagaggtcccgattccttgcagttggttcctttgataacaccatccgaatactctccgtggaccctgatgactgcttgcagcctctgagtgtccaaagtgtctcttcagccccagagtccctcatgtttctagaagttcaggcatcagttggcggtgaggacggtgcggaccatccagccaaccttttcctcaatgctggcctgcaaaatggtgtcctgttccgcaccaatgttgacatggtcactggtcagttatctgacacacgatctcggttccttggcctgagacctccaaaactgtttccgtgcatagttagccaccggcaagcaatgctttgcctgtccagccgtccctggcttggctacatacatcaaggtcacttcctattgactccactgtcctgtgatacacttgaatctgctgcatccttctcttctgatcagtgctcagaaggtgttgttgccgttgctggtgatgccctacgaattttcaccattgaacacctgggggagactttcaatgaaacagccatccctctgcgctacaccccaagaaaatttgtgattcttccaaaaaagaaataccttgctgtcattgagagtgataaaggtgcgctcagcgcagaagagcgagaagcggctaagaaggagtgccttgaggctgctggtgttacagaaaatggtaatgcaaataatggggatcagatggagaatggtgatggtcaagaagatggtgctgaggacagaaacacacttccagatgaacagtatggttatccaaaggcggaatcagaaaggtgggtttcttgcatcaggattcttgatccaaagagcagagacacgacttgtctgcttgaattgcaagacaatgaagcagctgttagcatttgcactgtgaactttcatgataaggagcatggtactctcttggctgttggtactgccaagggattgcaattctggccaaagaggaacctttcagctgggttcatccacatatacaagtttgtagatgaagggaggtcacttgaactgcttcacaagacacaggtggaggaagtacctcttgccttgtgccagttccaaggacggttgcttgctggtgttggttcagtcctcaggttatatgatcttgggaagaggaagttgctcaggaagt

SEQ ID NO: 77816 - DNA, 11861 bp, Oryza sativa
tttatgaaagaaacttagcttgtgaatttgatgtgaaggaacacagaacggaggatccagttttgccagagctagcgaccaagtgtactcgtggatgcccaaatatagacctcagaaacatatctcttactgctcgctataagagatgtttttcgagaaacacaataaacacataatagatacaatattttcactattaagagatatcttattcttttgagaaacctgatttttttcctaggcgggtatggtccttagagccaaatggacgcctacgataatgtaacatgcttgcacaatcctgttgcgagatataggatttcagtttagagcaatgctccagtactctctactggtagtattatattactagtagaaaatttgaaccatttattattaaggataaattagtaatttgttaacagagtaacttagccatttacatatttctttttagggtaaatgggtccctagcgtcaggcccatttgcatcgtggcaccggtgggccgttttgatcgtgacactagctgtggctggcatggcagcgcatcgtcaatatttcatcagaaaattggatcgcaactcgttcgcccgacggcgcttttgggtggcgagtggctagtcctccggcaggaggcgcgtgtggatcccgccggcggcgacacatccccggtaatccgtttctctgcatcccgctagcgatacgtgtagatctcgccggcggcgacatatatccggctaaccgtttctctagcctttaaagcagaactataaattaaaactagcacgggccagcacggtggcccatacagattgcgcggctagtatcattatattttctctcatataatagcatatatgttttctcattattttattcaaatatattaaaatgacaacataattttaaattttgcaataactttacaaaactactaatgtgtaatattcatattgtattttatatacgtgttagtaattaattatttttaatatcaaattttagttatttgtaaattaaaatatattcatatatggagtctagattcgtcttttaatatttctttttttaattctgaattttctgtaaattgtatttctatatatactctatgctcttcttccaatattatttatttttatttctgaatttttgttatttctaattgtatttctatgtggactctaaactcatctttcaatattctttaatttttaatttcgaatttcagttacttctaaattatattcctatattgactttaaactcttcttcccatgtttttcttaatttcgaattttagttatttgtacattgtatttttatacagactctaaactctacttttaattttattatgtttattttaaattttagttagttttaaattcctatatagactctatactctacctctaatattccttattttttaattccgaatttctattttttttcttaacgtatttctatatggactctatactctacttctaatattctttatttttaattccgaatttcagttatttcctaattgtatttctatatggactctatactctacttttaatatttcttatttttattccgaatttcaattatttcctaattgtatttctatatggactctagtctcctcttctaatattccttattttttaatttcgaatttcagctatttctaaattgtatttctatatggactctagtctcctcttctaatattccttattttttaatttcgaatttcagctatttctaaattgtatttctatatggactctattttttctttttcttcgattaatgtgagaatttctaggccatgagagcgaatgtggaggctcctttttctattcctttaataatataatagatatgttacgtttggattttatccagtctgttcaaaccgggtttaaaaaaacacgtggttttttttatcatgcacacataaattaaagcagaactactatttttgaataaaatatgttacgtctggatctcatcgggatggtctagaccaggttaacaaccaaaaacacggagttttcagtggtgcacacgtaaattaaagaactattattttaggataaaatatgttacttcgcggtttcatccgaatggtttggactgggtcaacaaaaaaacaaatggtttttcggtcgtacacacataaattacggctggatttcatccgatctgttccgagttaacaacgaaaaagcatgtggttcttcggtcgtacacacataaattaaactagaactattattttatgacaaaatatgttacgtccggatttcatccggtatgcccggactaggtggacaaaaattgcatggtttttcaatcgtgcacacttaaattaaagcaaaactactattttaggacaaaataggttatgtctggattcatcaggatggtccagaccaggccaacaacgaaaacacgtggttttcggttgtgcacagataaattaaagcaaaacaactatgttatgataaaatatgttatgtctgaatcttatcgggaaaacacatggtttttggtggtgcacacataaattaaaggactattattttaggaaaaaatatgttacgtcctaaattcatctgaacagtccacaccaggtcgacaacgaaaacacatgggttttttttgtcatacacacataaattaaatcagaactattattattttagaacataatatgttatgtttggtccgttcggactgggtcggaaaaaacatgttgttttttgggtagtgataaattcccctttttataaatataagttcgtgcacgatccaatatttttgttctttcttttttttttctaagcagttctatacatggtatgtccgtacgtgatcatattttcctgttcccactgcggtttcttttcctgtttttatgcattccaatcgatacagtttttattttttaatcacacccatgacattaaatatttatttgttttctcgatattcacttattttcactgtaaacttttgctgaaataatgcccttactaatttatccttctattctcgttagatgagatgatagtaaaagagataacctatataattatatattaacggttgagattgctttctaccaaatggaggagagagctgatgtacttcagtttatgtttttgtctctcccccccctccttttttattgatagttctgcacacgcttgggatatactcaaacatcttatgtcttaatagagtaaattgcagattaggccatgtattttgaccatagtttcacattgaaccatctatggttcaacttttttatttaacaccagatctttttacccaaagttacaattaggactagtggcccacctgtcaatgacgattgaggatgaaaagggaaaattggagctactgatcgagtctaaattggagctactgatcgagcagactcgccatctccatagtttgcgtttgtggttgagtatggagttggatgctagctagggccatgctgccggcggcgacggcggcggtgaccgtctctgctatcgatgtcggcgacggcgaggagaggccgttgtgcaggaacggcagcagttgtgacggaccgacggcaactcatcgcccatggtggccgtggtgtcagtggccatcagagagtaggatgaagcgggagctaatcgtctaggcaaaggccgtggcatccatggccatcaggggtcgatgcaattcaaatgtattgcacctatctaattcctgaaccctttctctttgtagagtgagatccatgttttttgaagcagctcgtatagtctgtttgaatcttaatcgatccattgattgatgaatcggcctatacatgccccctttcttttttcttttctcctgcgaaggactctaatcgaaggactctaatctcatagtaatgcaggtggagagatgtagagagatgtaggcactaataagtgggcaactttggtaaaaagatctggtgttaagtgaaaatgttgagtggttcaatgtggaacaatggtaaagatatatgtcccaatatgcaatttactcgtcttaatataaagataagcaaatcatgtatttcctaagtagtgttcctccacaatgttaactcaacagaaaaaagaataacggagatatataatacattacgcataaaaatatagacatggtggcgagaaattggtctaattatgttaattaatagtgattttttaaaggtttgtttcagtttactccaaaatcttacccaagataagatttcagtgtcatagtagctttggaaaacgtaatttaacaaatcaaacacaaagaacacaagcaaatatatggaatgatctgatgaaatatatatagtgttgccgaacgggaaaggagagcaaaaactgtgaatataacatgtcttaaagtatgaaccttatcatgctggtggaataaaacatgagcagtactagtgccaagtaccaactagctccactaacagtaagagaaatgcatccacgaagaaaactcacatgatattcctattgcttaagctcatggatataaggaaatactcatgcaagcagtatgccagtaacaacttcataatttcacaatgagctgcagagagatacttctgttgataactgaaagttgcaaaactaaggtatcacactcaaaatgatgttggttgctggatggctgattgccaaatgagttgtttgcaggttctgaattgtggccagtatttcttaaaggtctaagttttttttttaaaaagataatggaatataatccccaacctttcaccaaagagctacaaacaattattacaccaatttaacaaaaactcacacttaaataaacaaaatcacacataaactaataaaaactcccacagcataacaagatcataaaaattgttgaaattttatttgtgaatctccatccaaaggtctaagtattggcagtggtttagcatttgatgtttcaaccggcacagtttgttcaaatgcctatagcaacaaaggacaatttttagaccaagccttgtttcatttgtttggatgggctgaaatcccagccctgtgctgggagaagaagcatcaaggtctcgacggttttttgggctttgccgatgagcagtagttgtctcatgacgccggccgtgcacttccacaagttcagagtttcaggtaaaacttgcattcgttcttctatcaacacaccttggcttcaaacgcatcacatcactgaacttgtttaggaattcatactgaaaccgcgagaaaaacaatttcataatctcgatccaaaccccttggatcgatatttctctctctttcagttccaggtaacgatcgaaaagaatacgtactattccgaggcgcgagacaatggtggtatcgtggagaagtgaagaaaggtggcgttttagtggcagcagccagcaggtcgcgttttagcgtgtactattattttagcgtacaggtacagcacagaaaatagaaggggtgaggcacggaggcttcgaacccagaccggcaaacctaccaccttatggagctagtcggaaaatctctgggcgtttctctacatgtacaacacagcggcgggacgagtttagcgtggagaagggccaatcgatgtaaactctgaaccctcacgtcattgtctcctttatttgacagtacattggtgttaaaaaatgagcctatatatcaaaagataccgtcgtagatgttgtgattttatagggatcaatacagagagaattgcaaacgtaacgagaacatgaaaggtgtcaaggagtaatccctggctcgccttgatctgcacttctcctcactcactcaatgcggccatcccgttgcagaggagctccatctataggggaagatcacgtggtttgtgatgctgaattacggatctctagggggttcggagtctaattctccaacttacgtaaaaaaaaagtataattctccaacccctttagaccttgttcagtttggagtggaatgaagagaattgaaggggattgagggggaataattccacaccataataggtgtggaataaatccccttcaatccggggattaaacgaacaaggccttagttagtttcttcaatcatcgatattcgaaatatgcacaaaataaaaaagaaaaacgtaaaggggttcaacactattaaattttctgacaccttggatctatgtatttttttccttagagaactacaggggggaagcggtggagggcgatgagtggaattacgtagctcccctgccaagatactttagattatgcacatgacaatagtttcatgtttatgttattcttcttcgtcccattattttattgcgtagtgaacatgtttaataactcatatttgcatataaaagtgaagtgtgaaaatattagctcaaaatgcatggagggtgctatcatgatacagagtagagaactacttattaccaataagctcaaaatgcatggagagtgctatcatgatatagagtagagaactagttattaccaataagttaataagttatttgaggatcaagatctgcaactttagcagttgcagtgcagccgatggataaaaaatcaacggctcaggtggcaggaaaatgctgttcagaaaatactgtagcaaatttgtactatatcgattactgtagcatagatggtgaaacaggatgacagcgaatccggcgttggctccatcgatccgatggctataatgtggtccgactgctaaagttgcagtcgttactactacagcaccatatctgaattcgttatttgagtacaattcaattcatatacatggaacaagaacccatgcataaatacataccatcattttagtgagatgtacataattttattgataagtaacaatgtcatattataagcaaattccgtgacgatattttttatacacctcaaactttcatttgagatactaacaaacatttcattcgatatattaacaaacataaatagtattgaataaatggataacacaatatagtattaagggggagcacaataaaattctcatacaatatacttttgataagaatacaaccaatgcaaccacttagtacaaccacaccaggcatacttagtacaacctccaacacgagacgtggtaccaaaataaaaatgttattttttaaatgaattaaggtaaaatgaaacataataaactatggtacttcacaccatcttcttgttttggtttcctccaaaatctcaaatcacatattcactgcaaatatgagtaaaggatgtactggtatatatacacagtgtgtcaagtagggagagagagagaggtacaatcaacacttcagtcaaataaggtgtgataaatatctcaattacaactagtggtaaggaagtcatgaaggaaatcatgcaagcagtaggccaataacaaagacataatttcataatgagcttaagataaatacttttgttgataactgcgagcagcaaatccaaggtggcacactcaaaatgacactgggtactccagtactggatgaccatgtttgcaggttcgaaggttcataattaattagtttaggtatttcgaaaaggtctaagtattgacagtgatttagtatttgaagtttcagttggcacccttagttcttgaaatcctatgaatttcctttgaattaacgggggccttaatctgttgtcccgttgacttacttcgccgtccttgctgttaccgataagcactgccggcagaagataacgtgcctccatgggtgtcgagttttagtcaccgagaccccctctcctgcaattttcatcataactagtgaattaaatcgcacgtttttccatttcggaatgcaaaactttttaaagaaatcatgatcaaattcacaaatatttgaaaaaaagtccagaaaaatgctcaaaataattgcttgctagaggggcgaaattcctgaaatttccatccctgacctttgtgcgactaggatagagatggcaatggatatggacccgacgggtttccactgcacgtacccacacccattaaaactaaatatgcccactaaaaaacccacacccgcccacgggtgagaaattcccccatacccgcacccgcatgggtgatgggtacccacatccgttgcaacaatttcaattgtgcacaataataactcaataaggttataggctgcagtgatatgtacacagcaagattgaaaaactaaggctcaaacaaaccatacaggatacatacagcctgtcacattgcaaaatcaacaacaagccatctctactcatggtcatggccccagccggatccagcgacctacctcactgcacctgcggcggcgctcctgccgacagctgaccggcgcgcggcgtccctgcccctaagcggcgaccgacgcggtggctatcccgcccccaggaggcggcgtccctggctccctggaccctgccccaggcggcgaccgacgcggtggatgtccgcctccacgctggcggctgcccgcacggcggcgcccctactccatcggcgcgaccgagaccggctggcggctggtgctgcggctgtgcgcgcctacgcggtggtgtgccggcgtgtggcatgtgccgtgcggtgcgaccgtggcttggccgcttgggggatggggggcggcggagaaacggagacaggagggagaggagaggaggagaagaggaatagggtttagaggagtgaggaaaagaggatttatacctagggttttgatggttgtgggccttgcgccatctgcatattgggctaggcctacgggtattttcaacccacgggttaatgggttcgggtgacagcagaacgtacccacacccgtgtacccgatgggtgaaggttttgcccgttaacgtacccatgggtatgatgtttggaacgtttatacaccctaatagagtaaaaacccaacgggtttcggtcgcggggcccgttgccatctctagactaggaccatccttataagctgtgtttgagaagttattttttctatatattattttgattgttgctaactatttaaagtttatatgtaaaataacttgttcccctcaattaaatatatccgattagtgcgaagtaagcgtagctcatctggttaggttccttgtggaggaactagtccacctacattcaaatcctaaatttgttcgcatttatggctaattattcttttaatggtagacgacgtacccgtcgacagcgagacgttggtgacttcgtcaatctcaagatttgttggtccaatcttccgaagagactcatatggataggggatatgcgtgtgaacgttcatagagatgagtgtatacgcactatgaacgtctcaagaaatttatttgattggtcatatggtccaaaagactgtttggcctgttcgaccaagccagcccattagacctattgacagatcaatgaggcaaccactccatcaaagtgtgttgttagtgcatgttcagattgctgttaaaaataaacttttctaaaatttgccaagttagcaacattgccaaatttgatcggatagattaaatatggtgttgccagaattctttagacaaccaatatttagtaacaaactaaatgcatccacatgtttattgattttacaaaataaaatggtatagttcaagatagcaccaaatctgaacgggctcatagcctttttcttctctctctatattttacccgttcctcatcttgatggctaggatttttgctttggtattttttttttccttttgtgaatcccattgccattatttgatacatgacgtggcttatcctggttgcttcttgagtttcacttcagatagattttcgttgtgataccaattatctctgctatctattgggttgtgctgcgctgcatgcgctgcatgaatgccaccggcagccgcgaccacttccataatccccaaggcgtcgtccgtaacctcctccggtggccaacgccactgtgtgccggtaggacggtgccagtgatcgatggcagctcgccggcgtctgtgtcgcgatggaggcggcttctttaatttggctcaccgcccgctggagcccgctaccatcgccatgccggccgcctctcccaccctctccggccaaccccgtccagacttaggaagaaaagagaagaaagaagaggacggctgatatgtgagtcccatatactttttttggctgactaattaggatgtcatattaacgaaatcagagatccataccgctattggacctaaatttatggttttgtgtagttttgcggtgagaggaatctatcatgctggatgtaagcatgaaaaactaatactaattaatttgactaacagtatggaagcatgaagaagctcacatgatatacatgctgttaagctgctggatataagcaaatacgtagaatgagatgaaatatcctattaactgtccgggccttccatttcatttcagcagcattgcccccctacttttaactcggggagcatactcttaaaactgtctatgtgtaaagctgctactaccaataatttagagctagtttatgacttgtttcggtattttcgaaagaaattgagcttgtgtaacttgagaagggaaaagagctgaatgatccaaaaggtggtttgttctttgatgttttttttaagataaaaaaaaggtgtgccgattcagctgtcaattttactcaaaagcaaccatgcatctgaaaattcagctgtcgattttatttcaaagcggcgttcgcaaaaaaaaaaaatatttcaaagcgaccatgcatctgaagatcttcaggccctcgagcgttgaatcggaagtcaccagctgccgccgctgctcggacggctcgccggagaagaattgcctcagcttgtgctaatgggccttctgtaacctcctccggtggcggaggcggcttgtcccggctcactgccggcgtacggatcataaggagaaatgccaatagtttgatgtttatatatatgttcttgtttttggtcccattattttagtaatgaacatgcttaattactcatagttctacttcttaggtgagatggaatcagagtggcacggaaacgattgacttccagtattatttcctgatcaaccacagcgaaatgtgtttgtggattgcccaaagttagcaagactaacatagcacaaacatggcattgtgtatttcaaaggagtaagtattaacacatggcattgtgtatttcaaaggagtaagtattaacaataacagtggttcagtagctgtagttccaatcgacttgaattagaatttaacattcctataaaaaaaattagaatttaacatgaacacacggaacaaataaacttgctttaagtgtgaaatattttgccaatctcaaaatgcgtgtaaaggagttatgatgatatagggtagagaaatggctatgggagtagaattcaattcatatactggaataagaacccatacataaataaataataccaccattttagtgacaagtaatagtcttactattattggtcgaatccaatgctatctttatatttatatatatatatatatatatcatacgactagactccaccatcttttgtttcaggaagctaatttctttctttatctattgtattttcttaataaaaaatatcccaatgtaagctatctttatccattgtatttccttaataaaaaaatatcctaacgtagactattaggtatatggtattgccgtattctaacaactcatatataggatgtatgtttattcctaacactagtaaaataaaatagaataatctatgg

SEQ ID NO: 77817 - DNA, 818 bp, Oryza sativa
ttgtgctcatgcttttaggactgattgccttactttgtagtcttctatatccgtgctgtaggaattctagcatagaatgctaacagcaaccagcgactgccaaatatgtttgaaatttactaccccccttccactagactgtagttatatccatatgacagttggagcatgctctccaagctttctgttgttttgaactgaatatattacaggagtgagaaactaatgctgacctggtgtcaaacaggcgctctgtatactttgacttttttattgattgtccatttccacatgtgcttacttttatttgtccatacaggttcaatgtctaacggttaccagcatctaactaccagtgttccattaaattcaaccacaagcagcatcccatctacgatgggtcctgtgggtattcagcggcaagtgactcatatgatccccactccaggatttaataatcaacagaatgtgcctgtgaatcctgatttttcaaatggagctggatatttcaatggtgagccaactgtgacatcacaaatgcaacagcagaagcaatttcctagcaaccaaaacagtcatcaaatccagcatattggggggcacagtaattctggaatgcattcaaacatgctggagaattcttctgcatatggtttatcagatggacatgtgaatggtggaatgggtgtacatgggtcaaacatgcagctaacaaacagaagtgctgcatcagaagcatacattaacatatccacatatggaaattcacctaagcctgtgcaacaacaattcaaccagcaccctccacagaggatacc

SEQ ID NO: 77818 - DNA, 4300 bp, Oryza sativa
cttcaaggcaatgacaaaggtatccttgtcctagtacaatgccaacagccagtctataatcaccaatgcagctcctaatttatcatcaagttcctgcttcttccgactatttcttgaaaactaacattatgctttaaaaaatatggcaccaaagacatggtgagggctaaccagaacctaggagtataaatgcttgaaggttctaccaagcaagagatcagatcggcaccagacgtaccaccttatgctagctcaacctacatttggtatggttcataagacaaaacaattacagcagaagttgtggagatgaacctctttgcttggtcgggtgatcagccagattagcgctgcctgtttcaggcaagcacattacctttattgcgttatcaatatcccaaagttcaacctgtattcactttgttatttagtgacaacatgaaaaaattgaaaacagggcaagaaaatatgtaggcacaaaaaaaacgatgaattagttatgttctattgcatcacgctatgttttgctcaaagtcaagattaaaaactaacctgcgatgattcttgaccagcgattgccattatatttggtcctttacagcaagtgcctaggaaatacaccattaagtcaatcatgaagagagtcactaaggagttctctgacaccaatttcttgtcaagagtgatcaagtttctagttgctctcttttatttgagatgctgaaatcatgcactacctagttcacgttcttcagtaactgtgctttgtgactcaatatcaccagttgcggagatcaagccagattgtgtgcagcatgtagaacatgttgacttaacgagtgacattttgcagaaatggtatgtacttgttctgattgtatatagggccctcctgaaagaacccaagaaattggatttgcatgccacggaaactcaaataagaaacacaaatgaaacacagctcaaacaaagaaggttgacaagtatgtgttttaccatattccttctggaccttacacttatcatcttaattaggacaaggtgctagtcaacaaataccgaggaggctctgactagtttgtttaagtttcttcatcaatttaccactacagatcatgtaaagtccattgacacaagaatatgatagcactaagttggtatatatattcttttattatttaagagctataagatcttcaagaggcatatggggacctgccctacagactataatcaggttaaatatactgacaaaacattaatagcattacacttatgctctggtggatgcacttgcagcagaatgaggacaacaggatggagtatccaattacctgagcagatggactttgtggagcagatgcaataaatggtggagtatatagcaggtagtttcaggatagatacacttggtttggtggcatcaaacctaatgaggcctacatgtgtaggagtaaaagttgtcttgcaaagacttctcttgatgggttgtatatctcttctagtattcaaaatatcttttgtctatatgtatgcccatgtcttcttctccttgcatttacattggtaaagcctactattaaccaagtcctaatttatgttaaaggtagcatgttctattttttctttttaaaaattgtatgtcaatccttagcatgttccatccaaagaaagatccaattctaactcctattacacttcatgtgcaatgagtcataccgtgaaagcccagcttcctcgatttcccagcatttgcatgatccatccctaccttgactgcctcagcatcagaaacagatatatcgatcaaaattcaatccaaatcgtaacaatgtgagaggcactcaactcaaaatatgctactaaagttatttttatgttccatctgtatagtacaatgcgctgatgctgtctagactgaataatcagaaagataatacggtcatatatgatatgaagaggttcaatcctacttgcaatgcaattccgatccgaaaaggctgtgtactcaaatcgaaaatattacactgattcaacccgatgttttaacgcataacagctacggatgcttcttatctagcctgttgcaatagcatcctataatgatgcaaacctacagccagcaactcctgaaaaaatcacctctgttcactcacctaatgattttgtttccaagtctggtgctagcagccactgaatatacaccagccgatccaccatgagccctgcaaaatcgtatgccctcgcatcaagtatccctcaaaacgaaccaaccataatcgttgacgcggaaataaattaccaaaccgaggagacagtgcggtggctcgctgtgtcccaaaccctgagttccccgtcagccgcgctggatgaagagcaaaccccaaaatgcaaaaaagcagaggagatgttaccgagagcgtgatcacaagcgcgagggctcatacacacgcgctgctgcggcggagaatcaggcaaggggggttttggggggtcgaggggagagcgtacccggagaagatgagcgggagggaggggtggaagcagacgtcgttgacggcggcgcggtggcctcggagcaccgcgacggggtccggcgcaggtcggcggcggcgcggcgggttctcggcttcggccagggccatggctcgggctgcgagattagaactttctggaagcttcggcgtgaggtcgaagtagacagtgaccagatgagaatggtttgaggcctactagagagccgagtgggccggagggctgggcctgggaactttattacatggaaaaggaataagttcactttaggttcctctatttgtcgcccagtccaaaattcatcatagaccgcaaaaccggatacaacacatctcctaacttacaaaaccgtgcaaacgaggtccctcgatgctcggtagtattgtgtctgcttttagctgacatggcgcctacctgactcctttcactatgtcttcgtcttgtgtggcattaacatggcacttgcatgccaattcaatctcgggaaaaaaattaaaaccgtgggacctacaaatcagtttgacatacaaaataataaaaaatagtgaggcctatgtgacccaacatatcatcctcactactcctgcttttaacaatttaattaattttatcaatagaccatgccattaaaaacaagagaagcaaaataaaaataatagtggtactctgattatcatctatcccctacctctttctctatctttccagctggtggagcggcccatcggtgtatcgggtgggcgacgcctggagtggacgacaggcagcggctggagcaggctagcggcaagaagggcgccaagggccgggagccactctcctcctcctcctcgtcggtcgcgggaggggagatgtcggtggcggactcgacagttgcggcctcccctcgacggattctttcgggacggcggcggcggcaccagatgactcagcggaagggctcgtcgcctcctccacctcggcgccagaggtacccaccagggcctcctcctcctctggctctttcccctcttctctctcaccgaaccttagctactccgaccttcggcgacaatgtcgacgacaatggtggggttgtatcaatcgccagagggggagtgaagagggacgacttcacggtgttgggttcgccaccacgcgcggtcgttgaggaggcaacgatggagatgaggagcacaacggtctcagaaggaggtgctaggattgagatgaggagcacgatagtcacggagggcaatgctaggatagagatgtgtcgtgcgccgctcctcttctgtcgtccgccggctgcatgccactccaatcccgcggtcccgccgctcgccactccactcccacggcgtggctaaaggagacagaggtagagaggggtgatgttgaataagtgggacccactgacatgtgggtcccacatattttgtttcgattttttattttcaatttgctgcttttagttttttttatcgaattggcaagtaagcgccacgtcagtgacatgtgggataaagaccaagccaaatgagccacataggcgccacgttagccaaaaccagggacaatactatcaagggatcttgtttgtactggtttcgtaagttgggagacccgtcatacctggtttttgcgaccaagggacgaaaatcgggttgagaacaagtagagggacccaaagtgaacttattcccaaggaaaatgaatttatggcaataatgtattttacgatttgctccagaatttgtatgttttctcacaacaagggggatcc

SEQ ID NO: 77819 - DNA, 650 bp, Oryza sativa
acagtttacatcttctatctctacgtgaaatggaatcctgctacaaataccattaatctaattaactaaacttagctaattaattaatctaattaatttaactaagctgtgatcaggcggcgcgccattggcgcgccccaccatctagtatagtttaaacttggtaactacgtaattaaatttgctgtataaaagcacaagtgtaattttaatagaatattttttaaaaacacagtgcgaatgtagacacccacaatacgtgcactcacccctattaacacgcacgcacaccctacccctgtgaggacatccggaagattatgtcggtatatcgctgtcgacgggtaatacaagcacccgtgtcaaatttagaattagaacccggatgagttggttccaccacgaggaacctaactagtcaaatttagaatttgagcccggatgagttggttccaccacaaggaacctaactagttgagtttatgctcacttcataatttcaataggattttagtgactagctagagatttttttttcaggcctccactttttttaagcgtttatttgttcggagcagattgacgggtatatatgtaaggacgatatgcgtatgttaattttagtagcatccgtgtaatgctggaaaaaa
